United States Patent 10,233,495 (METHODS AND COMPOSITIONS FOR SCREENING AND TREATING DEVELOPMENTAL DISORDERS) - sequence listing, part 161

SEQ ID NO: 925 - DNA, 980192 bp, Homo sapiens
caacgactcaagatttattttcattataaagaagggaagggaaagcacaatgagaaataaagagaataagacagcaactgaaaaagtataagatttatcaaatccataagcatactactaaatccataagcatactactaagataaaagcaagtcagagtaaaagatgttcttatcagaaaacagatgactacatgttatagcacctgagatttattttgaaataccttatgtctgtcatctcctacaatctaggtacattatattttacttcggtagtatttcttcttaccaaatacataggcttcaagaaaaaacagaacctatcaatcatatcagttttaacttatttgtaacagtctgcttttttcttggaacattcatataaaactacgatcaaaaactaaatgtaaatgttactgcatccacatgatagacatgcctttggtttaagttgggtatctaattttcatgcccacatattcccactaaaaaagagattaaaattacttacttttcaaataaatgtagaacaaattatgctactttgtagtttttaaaaagtaaggtaaatctattatatgagtgagttagtagtgatgaggttaatatctttttaaattaaaaacgagaaaaaaaactgcatttcattgaatttggggtaaaataatagagtcttctttgacgttcaaatttgatgttcaacttgaagactatgatcaacaagaggtttgcccgactaaaataagaaaagcaacattacagtgaagtagattgactgtgagattgtttttcagttccctcgacaatattgttcaaactccccttgttttgttcagatgtgatttccatatttgttacttctgaagggcacatagtttgaagttctgaaacatttgtgcgtagatagtttttttctatttgactgtacatgttagctactgatttttcaagttctgctaagtttttaacgtgtctgaggatgccttttggttctctctgagggtctgttttacacactgtcgttgttgatagctgtgtcatagaggacttaattttctcggcaggcatcaagttggtcgtgcatttaacacctgttatacagacacactctgtggacagaaatgaagctgaaggaggtggagggcaaggaatagaaggaggtggtggaggaagaggagttggaaatggaggtagaagaggtggtgttgggggaccagacgttgaaacggaaagtggaaaaaatgtaggaggaggaagaggaagagggatagaaggaggagagggaggaggacaaaaaagagaaaaaggagaaatgtcaggaggaggagcaagaggagcaggagcaggaggaggagaaggaggagaaataggaggaggagggggaaggggacaggcagaaggagagatgtttggtggatgggcaaaattttcaaaaatatttctttcggtttcaataggtaacatacaaataggtgtctctctcctagagagtgaagaatgtaaaacacaaggccttgaaggagaaagttccaaggaacactcagcaggagaactgatgacattaggttctgatttgagttccacagttcttgaaacagttggcaaagtggagaatgagaagtgaggcctgggaaagcaaaatgaagagtctgaagagagagatttcaactgttctgttccttctatcatcagtgtttcaccttgccttatttcctctttctctgtcaaatttgcctcttcagttgtaagcaatggattgctgctacctcttttgtttgtacagattccagtgttttcattttcagctttctgcctggtgccttgccactgctgcagatctatgatctctggtctatttggaactttcctcatcagcctcctgggtaagctgactgactgactccacagcctctgaatcttttctcttgggcccctcagagacttactcttggcttgtattttgggtgaaaatgggtctacaaaatctgttctctgtgaaatgtctgaatttgttgatacttgacttatgttttccttataaaggggattatgggcacttaagtcatcctcatcagatagaaatgtgaattttcttgcagacttcagtttgttgctcttaagtgatccgtctacatgagctgacttgtgagcctcaatagtattggaagaaaagggcatcacaacttgttgatgtttcctgtcttctgagactgagttatttcccctgctttgttgaaaatggtagagaaggaaaagacttgaaagaaaagaagataatgaaatgtaaggaaacaagttgtgacacagctttcatgagaaagatgtttttatggctctcattactattaaatacttaaaaacatcaaaggccaaacaacactaacctactaaagcaagacattattttaattccctgctcttagaaaggcagggcagaaaaatcttagagttgtgagaagaatgagaaatgtaaatgaaaaaaaaagtactcatctctagattattttggaagagagtattttttgtttttgttttttttcagctagtgtgatacagcaaagcatccatgtccacacgtaacagttcccttatgcacaaatcacagttcttcccattgcagaacaccatccttgcctgaggatgctcagggctgcctgttacgcatagaagattcttagctgtatctgattcagtacttctgtcctagagccaaaagtaatctcctctctgagccatcatgtggaatatcctgttctccaaattaagagaattaaaatcaccaaggacagatgggagtttgtctcacagcccaaaaatcacaattgagaaattgaatgtatgctagaattgtgacagaggagtttttcttctgtttaaattttgtgcttaattagttttaaaaccttatacataataccaatcaggaaaaattgttttaaaaccttataaatagtaccaatcagaaaagatgttgtcagtaatttcttagactgatctggatcaaattttacttaaaactcaccttaacaaaaagattgatgctaaaaaaaaaaatcactttttgatatcactgaaaggcttacttatgcacggaaactgaatcataggtagttgtgagtcataaataaagttgcatacatcaaagatcacaaattaaatggctctaaggaaagcatttggacccttctcccaggattgttggctgattgataggtggttccgaattctcattagcttttactctcaagccaaaacagaataacatttattttagttactgcttaatatttacccacttagcaggaatgaaataaaaaagaaatattctgaatagaaattaactagccatattgaaaaattagggtgatagtttaggcaacaaaataataaagccacagttgttaatgtgtcttttggcaaagatacgaactataagaaagagaaagaaacaattcacacaggtagacctggagcatcaagcctacttggacaacaaagaaaattcagacaatctggactaatcagagtgcaaacaaacacttttactcttcgaatcttgaaaagtatttttcaaatatggcacgaacaactgggattgatattatatactggttgtttttgtaaacaaacatttgttcgtggtttgatttctcttggtaaagcacccaatggatataacaatatcacatcactttgactaaaagaaatctataaataggtttctatttatagatttgtaaattttaagttcttaaaatttaagaatttttaaaaactaatttaaaaaaattaaaaacaaggagaattttgaaattcctttcagtaggcacaggtaccatcacagcgaacacatgttttaagctcatgccatcaaaaggaaattgggtgtggaagacaaaactttccttttaacagtaagtgagtctgtggcaaaagatgaagatcactgtatttacagtacaacagcattttaatctgttctattgtatctatttttctaacgctcttctattagagtgatattatttacttacttatgcctatgtatccacaggtgagaaacagaaaacatgtgatagaaaaaaagaagtttttactagagttaatttaaaacaattctgaaaatatgagcaggaacttgctttaaacaaacacttagtacgtatatcaaaaaaaaggcatgtttttatattttgttattattcatatgaatgacatttaatagtagatgaaatcaaatgacattatttgaatgtcttttcacagaaaattgtatctaataaagtctgtttactatacatagataaaaattcacttctattaaacctggatgatgccaatcctaaaataaaaattttaaatgagagtttaaaaattgcttctatgatgtcttaactctgtaaaactggttaatgcacactgacttttaaagtagatatattttgtttggaagaaagtaaatatacaactactatgatgacaattaattacaaagtaattatagcattcataggaagttatcatacgaagttattactttgtgaagtagtttttccaaaatgatctttgactttgttctttttaagataattgataataatcatttaaaactaattcattttctagtaacttaatgcttagaattcctgtaaaaagttcttgaatagatagataggttaaacatttactaaagataagataattaaatatgtagaacttacttaaactatttcaatgaatacatatattacaattgcaaaatctactgagtctactacaattgttcaagtaaaaataatcttaggtattgctatttgaaaattactgtcatcaaactatgctgattccagatgatgttatagtatacctgttcttattaatttaaaatgaatacataattcattaatttcatatataaacacacaactttacacataatccttttttttagtttctaaagatctttgcttgagagaggtcattaacatactcaaatagaatcaaatcatattggctcaattcctacattcaccaataattaattacaaaagaaacaatcatttttcaacttacaaaaaaggtgaaagcatatatctaaagcatgaaccctgtattatgtccttattttggaaatagaatgtcatgctttaacctattataaattcagattttgtgttaaaataatagcattaagatcaattttaacattaatacgactatcctaaacaaaaccttgtataacattattaatatggtaagtaacctgaacacatttgtttaaaaccagcttttccattaccaggtcaatttcatgattttttaggcttttcttattgctactagtaactgatacggatgtcacatgtaataacatgttatagtccttctactccatcaaattccagttaataaaaggttttctggatttaattgtcatattcaaaattgtaaaatattcttggttgttttacatatcatgtccaaaagcagttattcttgaatttttaaaatactgacaaactgaacatcaccataaggaatccaattatgagggtagcatcattatacaagcaactgtgaggtcttttaacagttaccagtgtctttcaaaaatgtatgattttttaaatagtgactacaagtttcaaatcgtgcaggagaaatattcggtaatcaccgcagtctgagagtaataaagtgaaaaaagcattttctaagtagttgggaatttaatatagaaattctgtaatttcattgagattttaatttctatatcatataacgtcctaaaagtagtatctcagaaaatactacgattttaaaccagagaatttggttttgattaccaaatagggatcggtttggatacctaatcaggattactattttatgattgtgctttatttctctcgtctcctatgcaaaaatatatttttcagaatctatttatatatttatacatatatacatatacattatatatatgtaaaaatgcatgaccctgaggattgagatattaaatattatactcaagctataaatgtgcaattgtctcctgaagttgaattctgcttttctcttagctttctttaatttctggtttggttttggctattatttttcaacttaacctttcttagattttcgtcttaacaaattttctcttgaaaataatagaataaaataaatagtccatgtaggcatttccacatcagattgaaattaaatactcaccacacagaattcagtaaaacccaactacttctcagagttcctgaacggtctacttacattgagctgtctccaagttcttcatagagatgcgcacctggcggaggcggcggcggcggcgggggcgctgccactggtgcaggagccggcactgctggtttagccgcgggtaatgcggcctgaattcgtgcagtctttgtacactcagcttgacgtcttggataaagtaaggatggcttgtaaaactcattttagaaatcataatgcttatcaataagccaccttttaataatggggtccagttatcaggggaacccactaaaattattttacacaaacatcaatttataaacagatgtaattacaaaagcatccccacagggtatcatttgcatataatccctgctttgttcttgaaaatagctatctcttgaataaggggtagaattcagcagacatatttgcaaattaaattaaatgataatcttagagaaagcaaaattttaattaaaatgggatggataattaattggtagtttaatgaatctctttcataagatgaggcatattaaagataagatagataatttttctttattatttgtcttttaaagttatttgaaatgatttgaaacatttttgacgttatttcacagaggctgtacacacatgtacaagggaaatttggttagcttgtatatcctttaagattcctaggaatgcctaggccgggcacggtggctcatgcctgtgatcccagctactggggaggctgaggcaggagaatcgcttgaacccgggaggcggaggttgcagtgagcccagatcacgccattgcactccatcctggccaacaagagcaaaaagtccgtctcaaaaaaaaaaaaaaaaaaaaaaaaaaaaaaaaaattcctaggaatgcctgtgattctcatgttacagctacactgctgtttttggatttcctggacactgattaatttcttcctcaaaaccaagatgttacaggatggaagctataggcaaactatctttttcacatttgtgcaagttacgtccaattgtctaaaatcagctcaattctatatatatcaaaccaagaaataaactattacaaacgcaaaacaagggaataagatgtggttctgagcaggctgacttgattgatataatctcgggtttctcttttcctattacatgaaaaggatgtgtaaaatgttaattatacttacactttaaacctgtttgggaaagcaagagtaagaaaaatagaaagctacattagaactattgcattaataacattttaacatctgatttattctaaatcatgaataatttatacgttaaattcataatgacagagttaatgacagactaagaaaactaaggatatcaattcaaaaggtgaaaatagtatcgttaccgttagagtcattcaagccattaaaatatccataacagaaaaataaagaaatgaactacatagaataagaaaactggattaaaatgtaaatgtgagaatttcaactctagtggaaaaatggaatattaaagatgacctgacctttataattggcttcttggtttaccctgcttgaagaatattacaggaatggagagaggtagcaagccctgattatactcttggcttcactttgaagctgaagctacaattggaaggtcctactcttgggtaataaatttatgacagtttttacatatttgctttttagtttccattcatagaaaagttcaaaggcatatcattatataaaaggatagctattcattcttaccttatttgcaagcaaatatcaaggtacaaatgttaggtctttaaatattagaattttactttgctatgtgagcagagaaaaactcattttgtttaattatgttaatctataaaaagcagtaactaaattcatatggtattgagctgattatcaaactaaaggagaattaaataatgcgtctataaattatttaaatattaaacatctcaagtatttgttgtatttcagactaccttgtataacatccagagcgcttcagttttgatcattgcatactgtgccaaatacaagaatttttctcactgatttgcttgctagcaggatataataaagctcctttggaaaatagttaagtgtaaaaagataactggtaatacggaatggatttaacattataattaataatgggttgatggcttaataatttaaaacaatttgttcagtatcaattttgttcatcagctttagatttagcatatcaattgattggttaaggacacattaagctccagtatatcaaccttaatgctgtatttgcaacttcacattgcttttgaggtagaaaatatttctgtagtttcaggttggaattacttgaaaagtaatgacctgcttgaaaaatattaaaggaatggagtcatgcagcaagccctagttatactcttggcctcactttgaaaacggagctagaattggaaggtcctacttctgtgtaacgaattcatgatactttttttcatatttgctttttagtttccattcatagcaaagttcattcagagcatacatttggattttcaggttggaattaccttaccttattcaattcacaagaaaattttaagtatttgagaacaaagatgacagtttaagaatacataaggactattggctgggcgcggtggctcacacctgtaatcccagcactttgggaggctgaggtgggcggatcacgaagttaggagtttgagaccagcctgaccaacatggtgaaaccccgtctctactaaaaatacaaaaattagccaggtgtggtggcgcatgcctgtaatcccagctactcaggaggctgacacaggagaacagcttgaaccttggaggcagaggttgcagtgagctgagatcacaccactgcactccagcctgggcgacagagccagactccgtctccaggaaaaaaaaaaaaaaagtaaagaatacataagaactattttagtatttcctctgtaggtagtttaaatgatgaatagcagttctaccattatttcttattgtttattacataaagtaatttacatgatttattattactgtctgctatttattttctttttgtggcacactcagggctacttctcttcttaatcagctccccaattttttcaagtcattgtctatagaaatatacttaaaatgtgtggctctctatcacaaagcttccccagacctagtgtcaaagaatatattactaacctacttcaaatatggatgtttaaattagtgataattacttgactactctagataagttaaatacaattttaaaatatggatattgtcaatggatgcacttgactgcaggaaccagaaaaattaagagcctgcacagccagaacatgctgtcaaatagtacactaaaaactctggcaaagcacccaggaaggaagaaaccacatagaaaattacatcttacatgctatgattttacaatgcttttgctaacactgtgatcatttgcacaaaggcaaatttaacagtttggataaaaacctatcatgacaatgtcgcgaagttattgaccttcctttggagctgggcagagtgggtatccgcatatgacattccattgcttttaccccaggatacctgttaccttctctcccaagttggctcttaaacaaaagaagagcataaacaaagccacaggaactaaggtgatatttctattgaaagagaccgaattagaatcacaggaatattgggccatcagtgaaaaatgtactgggagtttgtactgttttccttttgaagaaaatcatttggtacgagatagacagacagataaagcaatctcagagtagttgcaccatcaatattttacaacgcaaagccatgttaccagagatggttttctgcaatgacttctgaggaactatccaggtttaccatccttgaatacttactgtctgtagctgaccaaaaccaccaagatggcaggaatgcagcagaggatgatgatgaaggccagagccaacaaggccccttctgtgtatcctagactttctcctctctttttaatgctggtcactgcctctggagtccggatctccagaatgcgtcctccttccccataatacggctgaaagtctttattgatatcaagtagtttgccatccaaaaatctttattgttagataaatagtaaaattaatgatgctagcagagaaagagcattttaaaaataaaatctttttgtaagatctttcaatattttctctaattgaaacacaagctgagtcagaagtctcatgaataataagaaaagcatatataaaaagcataagcaataaagaagaggagtaattacacatctgtatagaaatatcaaaaatattttaaaacacagctcttgatctgcttatagacttaaaaaatctaattatcagtatcattaagcttaatattactgtgtcaaaataatttaacaacattttagatggaataaaatataatatcctaaattatataccatagtttatatttatgcattttatctccttgggtcctgtaaccttcaggataaccctgtaaagatcaaacattacaatactgatttattgcaggccaaaaagctatacagttataaaaacaaatctgaggcaccaaactaagatttcagactcaaactctgtatttgtttgccataacaccatcttaaaagtaaacattctcaagtttcaaaccaaaagaatgttttatggtcaaatggtgaagacatttaaaagacccttctgcctaggaaaaaaagactaaataaatgatgcgagtagtatatcagtgttgtaagaatgacaggaagtggtagtcaatgtaattccttcctctaaataatgcaattccaactatgagtcttgaattttggaagagaatcaaggaataattattcctaatcttatgagattgaaaaaatttgttatgtatttaatatcataattagcaggtgattttttaaacaattccttgggaacttttgaacagtcccttataagctctacatattgatgcagcaactgtgttcttaatacaacaacaccataaaggtcaaacgtcttactatagaatattggaaaacaaaaatagttcaagaaaaacacaattactcatagtcccatgatctacagacagtcataatcacttctaacatcttggtatatttaagtctaatatttttttggaggggtgatattaaatattttatatacttgagtatactgcatatataaagtgcttatgttgaaaaatacagaaaacacaaaaaaatgcaaaagaaaaaattaaaatggccctaaatttcattatcaaaatataatcaatgccatgcttgtgtacttttttcagtctattttatgcccttttgagacatttaattttaatattcagagtgaccatgctgattttaaatcccgttaacacactgttcattgcttaaaaatagaagtgcctggtatcacatatgaattccatcacatatgtaactcataaactaattcatatcacacatgtggcaattagaatgcttttttgctttttttaaacagatacgcttttatagattaaaaatgtactttttatagcaattttccaagctcattgttacacgttaaaagaaaataaaaatttagccatttttatgattactagaaatagaatagtgaaacttcttgtttgaattgtttattagataaaggaagagattctaaatgatgcatagatcaagaattgcttcacaggaactatattattagaacaaggaagaatcagatccagaagaggatcattaatttaagggaagaatatacccctacaatgtggagttcagttgacagatcaaaattctattggattcctggatttcatatccaaactctctaaagtaagatttgttagtctttttacactgcaagagccctattacttagatacttattttcacttatcaatgtgatgtcataaacaattttttactagaaggatggatcacttttgaacccacacctgatctagactatctttctttactttgtgtatttaaaacaacttgtctgggtaaaaattcttgagtcataacattatcccttacaaaacagcaaaattgcttccattgccttttgtcattttatcatgcaaatgagatatgcagggcttacctaatttttgttcctttatgagtaagatatttttatttctgtttcagtgatttttaaacatattcagatactattcaaagaaacatggctaccttttcattgatttttgcctgtaatataataaactcttgaattcttttttcgattttttgcttctgttataaatactacaattttaacctcagaaataactgtcattatcaggttgtattttaatcgtcctataaatatattttgatctcttttattatttatatgttttttcctttttcttaatattgcataaattttcaatggatacacttcatgttgtcaatttaattttcacatgccttctcatttcaggaaaggttgaatccaggtgctcaattgattttaggagataaaatttaatttataaattaggcacagtaagatattaacaacaataactaataacaaaatagaacaattatagaactatagtgtaataaaagttatgcaaatgtggtttctctctgtctctgtcaatatcttattgtattgtaccattggtaactgaaactgaagaaagcaaaaccacagaagagggttgactgctatactccagttggactgaggggaaggcactttagattaaagactaccaccgtgtaggaaagggacaattctcacgagagaaagtggaattcttttaccagaaacaggagaaggactcaagccatgtaaaacacacacaccatttcaccaatccataccattctgttttctactaaaaatgttaaactgttttccaatggtttctgtaggagaaaatttccagagttatatattctccctctgggtcatcaggttattatctcctgattttccatatttattttgttttttagtatttattgctgatcccgtttttccactgcttacttatcctaaaaaagagatagatctgcccaaatccagcatcaacacagaaatgtgttttttttttttttctcgtcattttcatctacagtgtactcagttactatatgcaaaccttttgtaattctaagggaagggtatacaggtcccttcccaggatgtagccaacatgaattgattactgctatgttatcctgaaatgagataagttgctaaaccaatgtcatgtcttattattttctcaagcacatgcaaacatgtatttctgcctccattgatggatatggggcctaatgttgtgttattcagcatataattaataaatacataatcaacaatctaccctgcatctcaccttcgtgactgattaccttgatgatgatgattttgatactgcaatgtacatatgaatgtagaaataagtaaagggtgagcaggagattgtactctagacagtagagggacaactgtctatttcctttgtaggtacacaatttaggcgtacagagtgggcagtggttaacatatctacctacattcattacactgtataagatttttctgcttaatcaagcaaatcatggttagatcatcaactattttcttttcacagtttcataactgtttaactagattctaataattagtattccattgatttggattttcagtattttgaatttatatgtatagttttttacttagaacattgaaagaggctttatcagagcctgttaatcagataccgtttaaggtctaagtgtgtttttaaacattgtggtttaaaggcagtgtataaagtctttttctgccttctccatctttctcttacgatttggacatactgtttttaaataggctggatataagacagataaacaagctaaaatgtatttgcttatttttaaattttaattaaactatattttaaagtagtgtgttctgttttgtgtagaatgcagaaagccacaagagaatatggctattaacagcaacaacaaaatgacaaaaaagtgccaggttatactaaaatcataaatttccttgagctgaagtcacaatgtgagcaaaaaaaaccaaattccattgagtgacaattaggataatttcatggtgagatgtgaccatacattgtttcacctttggcagaaaaggttaaaagtggctgccataggctgggcacggtggcttatgcctgtaatctcaacacattgggaggctgaggtgggatgattacttgagctcaggagtttgacagcagcctgggcaataaagtgagaccatgtctctacaaaaaacaaaacaaaacaaaacagctaaaattgtaataaataaggttagaattatagacacccacaaacacaaggggagtctcccctcatttgaaaacttctttgcgtagatttctgtaagatagattgggggacaaggcaggacacaagagaatattccttcatggtgtaagaataggaacaaatcagcaaggctggtgcacaggcagcaacccttgtgcaattccccagacctttatctcagatgaaacaagggccgtaagtattagagggaggaggaggaagtgtgcccatccctggtgctcaggcaaaggtctactgcttctggaaaagaggtataagcaaaaatcccctacccctgggggaggagcaggaagtcctctcaggtgtaagatcttgcaccaatacaaagtagaggtctactatggattgagaaggggcagaaaattctcttgcacccaagaccccctgtaaatgtgaagcagaggatggctgccatgatgccataagaaagagggggaaaaaatcttgagaaagcccataccaaggcttacacatgcaggctgtacaaggagaacagaggaacccctattccatgacccacctcttccttataagagtggaacccagcagcaaggaggagcagtctaacactgtgggacagatcagagtgtgggcagaaacctcttctgtggcacaagcatatagagagcactgagagctgaggactgagtaagaagactgagaaaaccctacagcacgcaggcctctattctaagactgagttgacaccattccaccaataaaagaatttttgaagcttttggcacagtggaagtaataattgcaacagcaaaatccaaataattcctgaatagctttacttaacagagtaaatgtctgtaatgtccatttacaggcataaactctatttacctcacttcttactgttcttccacaccatgtctggcattcaatcaagtaggacacaaaaagcctacaaaatataaaacaaccattttcaagaaatgaagtaacagagccagatagagataacccagatattggaactgtcagacaggaactctgattcaactctgattaatacattgcaaaatagcagaaagcacaaacatgcctgaagcgatggagaaattcagtagagtggtggaaataagaaataatctaatagaaatgctagaaatatctttctaaaaagataaaaagatgaagaatttcttcagtgagttcatcaataggctaacacagatgaatcagtgaattcaaaaatagggcagtaaatattattcacactaaaatacaaagaaaaaactgtgtgtctatgtgggcgggggaggggagcagagtcagaacggaacaaaattatgagaaaaatcaaattgtaattggaatcccagaaaaggaataaagagaaaatgggcataagaaatattagaaaaaatgtctgagaatattccagaaataaaaaaagaaaaaactcaaaatcaaactcacaaaaaaatgcagctccaaagagttgagaactacaaggataaaaaagcaggataagagtaatatataattattgcataaaatctaagcaattcaggtaaccaaaaataaaaaaattaaaataccgataagctggccaaacaaaataagttattaacatatcactaaaagtcattccagtcctgtctatgcatttatgagcttttttatttttgattgccaaaatatattttttcaaatcaaagtaagttcccaggacaaattattattatgatgatttctaatcctttgacctgagcattccaacatcctcagaagcttagattttaaggtgaaaggaaattgaaagaacacttccattgacctggaccggcatcttaatgttctagtacatttatgcagtgttaaaaactaaataaccaataactctcacaactacagaatagataccaatacttgggcactggcattatcagccttggaaaacacacacacacacacacatacacacatatacacatgtatatgtatgtgtatacaattttattataaaatctttcaagaaacaattctagagtttcaaatagaccagtgactctaagcttactataatacttcaaggtgaagactgctaaggcaaaattttcatatttcatggctattctatcttttcttcaatataaacatatattatttatttatttatttatttatttatttatttatttagaggcagagtcttgctctcttgcccaggatggagtgcagtggcatgatcttgctcactgcatgctcggcctcctgggttcacgccattctcctgcctcagcctcccaagtggctgggactacaggtgcccgccaccatgcccggctaattttttgtatttttagtagagacggggtttcaccgtgttagccaggatggtctcgatctcctgacctcgtgatccacccacctcggcctcccaaagtgctgggattacaggcgtgagctaccgcgcccggccaaaaatttattttatgatttatatatattctgttttttccttgcctgctggctatgatagttattttattgaatttagatgtttactgtccataatataatttaggtttggaaaaacttatttagaattaattaaagatgttcatcttgtatttcatggtgtcacttaaaacccaagtggcttttttttccccaaatatttaatctctagaaggtttgctagttaaattcaaattctaatcaccattattttactctttaaagttagcccaaatataatacatatttttatattcaggtaaaaacaccctaaactcaatcaatcgtgaaatttaaaaacaaaactaatgtatgcaaaaaacacagaatgcaggtagattcacataaaaaagaaatgtgttgattttctgacaatcgaaagaatatatatgaattactttggaagtttattcctaaactttttaaattaataaactttttaaattaataaaacttacaaaaaattggcttggtagatctaaatgttgcttcattttggtggtgactataaaatcagagtgcgagctattacttcattcatctatatttcctccacggttagtatcctgttttgcacatggcccaaatatctattaaaaatgaattgatgagccaggcacggtggctcacacctgtaatcccagcactttgggatgccaaggcgggcggatcaccaggtaaggagatcgagaccatcctggctaacatggtaaaaccccgtctctactaaaaatacaaaaaattagctgggcgtggtggcgggcgcctgtagtcctagcttctcaggaggctgaggcaggagaatggcgtgaacccgggaggtggagcttgcagtgagcgagattgcgccactgcactccagcctggggcacagagtgagtctccgtctcaaaaaaaaaaaaaaaaaaaaagaattgatgagtaacatgttaaataattatggcttttaaaaaattttagctgatattaaatcattattttattattgccaaaatagaagtgatgaaattttgtcgatgaacacatttaaaataaaactaaattcagaatttattaatttgaataaaaattgaatagatatttacaaaataaataaatttacatacacataatatagatatatttgtaaatgtgtatatggatatgtttatatgctgtttaaaaagtatagacaaagaaaaactaaattatgatgtttcacatatagagttcggcatgactatatatacaggcacatataaactattatgattgtatatcaatatatatttttaactaaaaatgtttcattgagatagaatttcattacaagacccagttggacactaggtgtcaccagagtaaagaaaattctgttaacaatttttttttttttaagtatttaagtgtgctcgaataacatccaaagaaagtaagtagcaggattttctttaagattctgcactttatttatttttaggatttataactcaaatttttaagttcctgctaggatgaaatttcacatagagcatgaacttaaatgggaatgattatcccacctgctctccacctgtaagttaaagaaaaaagcagatattgatttttgctgatttagtagacctgtaagaaaggtggatttcttcttaaaatgcaagcatatgaaaatcattgcagaaaaactgcctctttaagaatctgtgctttcctcattaatagccagtgcccttgagcaagagtgaggagctggcagcaggtgatttcaaggagctgttccttgttcttaagtacaaaaggtcatctgatgcccataaagaaaatgggccctctgaagtcactgtagcccacacttagacctgaaaactttaaggcatgagaatcctaggtatttcaggttctttgcttacacttcactttcagtaactatttggtgggttttaaactttaagtacttatagcctcaagtcagaatcatctatggttgctattgtaaccaaagagctgttacagataacaaaaagcacttacttaaaaagctcatttctatcgatggctctgttggtttgggggtcaattgcatagacagtcaagtcacatttggtgtaatcttctagggaaaaggcatctccatgccggcgagctccaatggactccactacgaccttggcaccaggaatttgttcctgaacatagcgatccaagatcctataaatcaaacaaagtacaaacatgacagtccaatgggctttctgggagtaaaaaattactcttaacttgaaaagacatttagtaaatgaaaaatgatgacagcctagttttttgttaatgtttactgaatataaacccttgaaaaacattctctatattttttcagcatttagctcccaatgatgctagaagctgaatacggtagaaaaggtcaccaaccatgtcctatttaactttaggctttttgaatttatgatactatttgagcttttacatgagaaatgccaaatatgctgtacaaataaagctgtctatgctttataggaggcatggggtcttagaacccttgacttcacatggttggtgtcataaattacatctcccactaaagtctgtgacacatgacacgtagctatatgctaagaagcaggactaggatgcctgttttcccaaaggtataaaaatccttgcagaatcacagcaacgggagaatgtggagatattttgcaatggcaggattaccacgttaagataaaaatatggcatgcaaatctcagacactatttaggtgaataaaaacaacatataccatctggtataaattagtgatatttaatttaaaaagcagagacaatattaatcaataagtaattttcccatctcatgactggattttaattgaaagtatgaattattaccatttcccaaatgtctcattccttattaaaaactttatattattaacccaagtatataaatattaagagcatataattcagtatttacagatgtttaaatttaaataattttaattactatatatgataaatattctaaaattcgtagactcaatgctcttttctgagtctatattttgaggtttttttagggggagaagggcaatatattctaaagtcctttgatacatcagaaaataacttttgcttctaatgccacaattgacatatttcttgctcgactgaaagtatattcccttaagagtcttgtatgtgcttggtttgccttgttattagaacaatgaggttactaaactttggaggaaatggctctaccagtgcatgccaggagacactaccaatcatagtgaaatgtttgcttgcttgtttttaaatgtttgtaacccagtactgttgaagtctgtcttattgaagtactattcattattttccttttctgtcaccactccacgcccactggtctctcggcttcgcaatttcttttctgatgacatccttgaagtagactaagaaaagatgatgtgtaaaaaaggaggaggagcaaattcacttggaaaatatcagttaatagttgaatgcctgcaattccagctagtcgggagatgaaacagaagaatcgcttgaacccgggaggtggaggttgcagtgactccagcctgggcgacagagcaagattttatctccaaagggaaaaaaaaaaaaaaaaaacaaccccgggaacctgaagataatggatgtactgagagacacagactagtctaacatcatttggactgtgtttttcagattttttttcctgagagatttatgctcatttaacaaaaataagagaggcctcggagtcaaaccatattatactcttgacattttgtaggaggcacaaacaataatgatataatgttgaggagtacagatgtctggctggcttcaattttaatttcctttgcctttcaattgcataaccttagacaagtaatcttaagctctcaaagtctcaggtttgtttgtttgctttttgagatggagtctcattctgtcgcccaggctggagtgcaatggggcaatctcggctcactgcaacctccacctcccgggttcaagggattctcctgtctcacgcctggattacaggcatgcaccaccacacctggctaatttttgtattttttagtagagacagtgtttcaccatgttggtcaggctggtctcaaattcctgacctcaagtgatccgcccgcctcggcctttcaaagtgctgggattacaggcatgagcatcacatctggccatgtttccttaaatagaaaacaaggaaataatgtaccacatggggctgaatgtgcattcggtgaaataaagcttttacacagttcctagcacatagtaactattcaacaaaatgaatcttatttttattaatttgactgaaatatttccattaataagcttcttccttgtctcaaattcattcaaggcctttaattaatttgtggaataggaaagtatacttctcactagtataatcaatcagttcacaaatcaaaacgcaaacaggagtacctagttaaatacaatgcaatagatggctctctgtcccaatactttggtctaacaatttatgccttctccagtgcattttggcattgatttgacatgttccaaggaaatccttcatataagcatagattaattgtgtgtgatcctacagtgaagaaacatatctattgtgcttgggttcttttctattttcagtgcaatactgcagaatcatttcactaaaaaaaatagatgtggaataaaatataactgtaccaattccttcatggtagcagggaatcatgaataaaagaagtctaaaaacaaattatgtcatttaaaacatgcaataatgtcttcactttgagcatttttttgttaaacttttaaagatcttttgggacaaagtatatcttatgataaaaagagatatagcctaatcttaactgcttctgtatctttttcttataaatgtaagtaaaactaaataccttttaattgagaacacatttcataaaaatctatcttttcatttatcatctatatctatatactaagtattttctacatctatattcattacctatatgtatataaatttcctcacatatatacatatacccccacacacacaaagaaaaagagatttgcaatgatgtttatctaacccataatatttgtatcatacacacacatatcaagaaagatgtccataatgatgtttatgtaatgttaataatgcttagagctggatggtatgattttgagtttaccttttataactttcttcttcatatattatattgcttatatttctttataatgggaataaaagaacaatatagttatatttttaaaaaatctccttaactccctatttcctctccccaacttcgtgataaaaaaagtcttcatataaatctatattttctagtttaaaaatgaaaaaaattaaattggattcagggcttttcataaaattatagcaaaactcactcagggaagtgttaagtaggaaaattttcatttattcattccttcaacagatgtttattcaatgcctatcctgggccagaagccattccagacacatggaatacatcagtgaacaaaatacaatctttgatgtcaaagaagaatttacattcaaattgaacaagacaagtaacagatcatggattgataaaattggtaaaagtgttcagaataaatatcattgagactttgatatttgagcaaaaactttagggaacaatgtgtgctgtggctattctaggaatgagtgttctaagaaaagagaattgctaactgcttgtataaatgtgctgatgtagtagtgtgtggccagagcagatcacgtggggactttgaggattgtaagagcattgttttttgttctgagtgagataagaatctgttgctggttttgaatactaaagtaatatgatctaccttacatttaaaggaggcacactggttgctgtgttgagactaggctgagtagaatcaggaaaactagttagtaaagaacttaagtacatgaaggttcattaaatgctcagcctactcaataatttagaagaaaagacacaacccaatccatgactattagccatatgaaataaaatataaatatcagagcagatataagcaaaactttgaccaaaaagaaaacacaaaaaatcaagaaacagaaaatttgcttttttggaaaaaacatgatatgaccataaaaacagacacgtacaccaatgaaacagaagagaaaactccaaaataaatccacactcttacagccaatcatttttgaccaagatgtgaagaacatacactggggaaaggacaatttttaatgtatgatgataagaaactggatatccatattcagaaaaataaaaatagattcccatctttttctatgtacaaaaatccactcaaaatggattaaaagcttaaacataagacataaaactgtaaaactactagtagaaaatattgggaagagacttcaggacattggtgtgagcaaagattttgtaagactccaaagaaatataaattttccaatgaaagcaaaaataggcaaatgggattacattaggcagaaaagcttttacacagcaaatgaaacaattgtcaaagagacaacctatagaataagagaaaatatttgcaaactatccaatcaacaagagattaataaccagaatatataaggaactcaacagataaaaaccaaataatccaatttaaaaatgggccaaggatctgaatagacaattctcaaaagaagatatacaaagagtcaataggcatatgaaaaaatgctcgacatcactaatcatcaaggcaatgaaaatcaaaatcacaatgaaatattatctcatcccaactgtaattgctattgtcaaaaaacaaacaaacaaaaaataacaaatgctgtaaggatatggagaaggaggaacatttatacattcttggggggaatgtaaaatagtacagccattatggaaaacagtatggaggttcctcaaaaaactaaaaatagaactataacatgattcagtaatcccactgctaggtatacatccaaaagaaagaaaatcaatatattgaagagttatctgcatgcctatgtttatcacagcactattcacagtagtcaagatatggaatcaaccaaaatgtttatcaacagatgagtggataaagcaaatacagtatatatatacaatcaaatattatttagccataaaaagaacaaaatcctgtcatttgcagaaacatggaagaaactgaaggttattatgtaaagtggaataagccaggcaaagaagaaatatcacatattctcattcatatgtgggagctaaaaaatggatctcatggaggtagagagtagaatggtgcttaccagaggctgagaggggaagaaagatggggataatgataaaatggttaatggatacaaaaatacagatagagaaaataaataagttatagtattcaacagtacggtagggaatttatagttaaaaataatgtgttgtatatttcaaaacagctagataagaagaattgtaatggtcccaatacaaagaaaaatattggagttgatggatattccaattatgctgatttatcagtacacattatatatatatgaatccaaatatcacatatatcccaaaaatatgtacaactaggttatatcaatagtgtatgtgtatacacacacacacacacacacacacacaaacaaaaaaagaattaaaaaatgaatgccaaaaatttccctgaatctgacttcttggtagcaatatacgtatttaaaatgcaaatagtacaatcaagtatgaagcaaaacagtatctgattatgtcgagcattctcaaaacagagaactggctgtgattggtcttctaaaaagtgaaaaatatgttaataaatttggatgataattacaattattgaataaaaattacattttaaggctatattgttccactttactttgaatgctctctaacatactcctgttaatgtctatttaattatgtcacctttaggaaaagttttaaaaacagaaaacttctaaagaaatacgttaatatagctaatacaaacattttatgtaacatatgttagtatagtaccacatactaattaatgtccaatacaaaacagtttatctaaataaccttcttagaataaatgctgaaaggtttatttaactgattttttttcctatgcagatagcattattttaaaatcacaaactaagggtgtcaataaacaattggttcgcttaacttacttattcttgaaccaagttatttttggtagatgctctaaatttcaatttacagcattaccttatccagttacctgtatatacatcttcaattagtttcaactagaaattgcattatgaaaaactgtagtgtaaggtgtttactgatagttttatagctgggacaggtatttactcatggttgatttagctttttatttatttttttacactaaaattattacagcagccataatctcaattacccatttgtctgtgtgaatgagttgagttaaaattaccatgtgatgagaatttctggttttgcatgctcagtttactcccaagaaaagatgggttgggtttttaattaggtttgcctcctaagaggcagtgtaacagaggaaactccatctgctggtggctggtagacgtagattaaaattaaacctccattattgtgtctttgtggaaattacttaacttttcaaagtttcagggaatttatctgtacagtgggaaaagtagtcaaacctacctcaaaggtcctctgtgataggttaaggagactacacccattaaatgcacaaaaatctaaccaatatgaagcgtgtcataaatgttggctacctgttgtgatggttacaagaactcttcagatttcatgattataaaccctacttaggcttttgttgaggtaaatggcttatatttatctagcatcatagagagttccaccccaagtgcttatcaatatttttacacaagcttagctaaattaatcaataggcattgcagctggctggagggataaaaatacaggcatacagttcctactgttctgaacttctttcctccattaatacagacccacagggactctacccagaccatatcctaagtagtgctctagatgccatggagcattttgttcattacattacatggtaacctctctgtggtatcccacaagataaaaatattttcctctaatctggaattagactttgaaagagttcttttgtcccagaagagatatggttttgttaattttgtaactgagtctgttctttttgtttagcttgtttgcttctttcactttggccctaacaaggtgacagtcaagtttgtgactactctatatggactatacaggcctttgcagcatctctgtaattacttactcttactctgatcctttctttaacttctttctcatctgtttgctttatttttctacactcatttttaatgtattttacctttttttctgtgtgaatcattgtaaactacttctgtttttctttggaataaggtagaaaattaaaacaaaattaaatttagcctttaatatttattagacatatatggaagcatctaaaatataatttatgactttctgatacaaacggaattctcttgcataaacattttgtggagtttatgtctcacattaaaaaacagcagtacagactgcggtaaattgtgaataaattgaagaaagtatagaaaagaataataaataggattaagagaacagaggaattgactcttgatgattaaagtggcctctaaaggaagtgatatatctaccttgtaccatgagttggggtgaattacaaaaataacaagctgttcaatttgacaaaacttctaggttataaaaaaaaaaagaggaggaagagaggaaataattttaaaagaaataaatgtccactatgtattttagagatctccataaagcaactgtgattcaaatgttttgataaaataatatataatgatgtccttatttttacactacaactattttctagttattttctacttggtacaagcaaaagatcttaaaaataaactgaactgaatgatatttgaggggagaaaaacagattataatacaagttaagattaaccgctcaatctttctttgcttttcttcctaatttctagatcttaaaataaaaacataaataaagttgtctggaaatgtttttttccttagtgttttataagtgaatttcacttttgaacatgaataaccccttaccttcaaatctcaggaaaaaatatacctgtatcaattattttttctccatcataagttgataagaacattttaaacactttaaaattttgaagcacaattcaaagattcagttaatatacgggtaccttcattacgatgattcattgtgcattaattaattttatttctttaatgtatctttcgatcatgctattttcttaaacaaaatagtttccccaaaattttgtttgtattattttcatagtgcaaataaaggcaacataaacatatttatctttgatttaaaactaaacacatagtgtttttaattgatcttccaataaaatatatttttaatctgggaagatctcatttatctctttttgaaaacaacaatagctcaaagattttaaacttttttcacctaaaagcaaaatgaaaatgtcctcaatgttcatttatttgtttgtttgttttggctttccattgtctccaaaagtttgaatactaaaaaagtaaaaaagataaaaagtagaaagaatattgattctgacaaaatacaccacctaaatgtagcagccctgcctcattctttagtttttaatctttttttttctatgttgctgagaaggcatggagaaagtgtgcaaatatgatttcttttttttatattacatctctcagatggcaagtgttaactaagaaagttgatttattttgtatatgtatatatattttttccaaacagaagctgttataatagactataagcattcagaaatgtgttaatgaatgaatgaatgacgaccattaaaataagaaacatatctatctgaagcaaacatgtcagcatacaggaccctttacggaatcaatatgcaatggaatcttaagaaaaaaagtaaaacctacttgataagtgatttgcttttggttaactttgcttatagaaaaatatgtacaaattggccggacgcggtggctcatgcctgtaatcccagcactttgggaggctgaggcaggcggatcacaaggtcaggagatctagaccattgtggctaacacggtgaaacctcgtctctactaaaaatataaaaaattagccgggcatggtggcgggcacctgtagtcccagcaattcaggaggctgaggcagaatgacatgaacccgggagacggagcttgcagtgagccgagatcgcgccactgcactccagcctgtgcgacagaggaaggctccgtctcaaaaaaaaaaaaaaaaaaaaaaagaaagaaagaaaaatttgtacaaatttggaaaatccaagtcatacaaaataaaaaaaagcttaccttaatatacgtgaaatatattatcagagacaaaacactaattattgtgactttgagccatgtgacagatgattaatccttaaagtaaacaatttactcatattgggctaagataacattcctccaaataataactaagaatccacgtaaaataaaaccttttaactctcaaaaatagaacagaactgaaaatcatggagcaccttagtttataatcatctttgttccatgtgattatttcaatactaaagttttggaaacaattaaaaatcctgccatatttaactaaaaacagaattttaaatctgtgctttttctacatttcaaagagttaagcattaaagatgctactgcaatgtgcacaaggattattataaaatagtagcttttaattgtataattgcatattggggtatcttcagttctgtaaagaactatgatttctttaatcataattaacctaatgagttaaagacaagtcattcttcttgtaaacagaggttacttctctactaaataatgctccaaatgaatatttcaaaaagtagcaaataaattttctttctgtcaaaacaatgaatttccaaggctttgaataaagcttagtcacacttaacctttttttaaagaatagtaaattataccttgaataataaatggtaggatttattattatatttctggtttgtattttatttttatgattgcttttagtttattttatagctattacattcctattacagaaacattattttcaaaaattgtactattaaaatgggtgtgctgcattatctgataaaaattaaatcattcatggcaattctctgttgataatatcttcaactccaactatatctttatgctaagtatgctgagagaaaattggcatgtaatagacaatacagcaatttaattgtagaatatggcagctagggagaagactacataacaaaagaaactcttaaggtatctagtggctaccatattgaacagatgggtctaactaaggactttccatctcacacagaataaaacttgaaatcgtccaagtgatctatcaggtcctagaactgattttctaccatgatatctatattttaataagccaagcatggctctttctctgggttttcataactgcagttctctatcaggaattgtgcctcttcctctctcatagtcaaacgactttttccatcacttaatatagatgtcttctcagatttcaacttatcagaaaggctttctttaaccatcctatttaaaacagcacctctcttccaaaattttctacttgatacttgtatttatctgtctttattacagttatcactacataacttaatattacatatttattaatattgttattttatatgccatttttatgcaatcgaatagaagctccatggcagcagggacttcacactgttcactgataatctccagtgcttacaatctgtaactatttattttttaactaataaatccccagctctaagatacaaatgcaaaaactcaaagagtttgatagactggcccaagacttcctagctagtctttggtggtctgggaaatgagcctaggttctctgaaacaaaaaggagctcaaactttccccttaaaaccaagtttttattacattgatttaagaaaatgtgctagcagttagcgtttcataggtatgcttcccgagagaccttctaattatcctcctagaaatatatatatatatatatatatatatatatatatatatatatatatatatatttacacacacacatatatacatatatactatacaaataaataaattctatatacgtaatatatatcctggctacatttctaatgtaggttttgtaaccttaattctaggaactatagattgattacacagcacatttcaggtgctacataaatatttcataaagttgaggctcttcctcatcaagtcagtaactacttcagtaaagctctactataattgaattttcatattttattcagaaggtaagagatgggtttgagcaactctgagaaataagttgtcagttccgattcatacaaaaatactctaactcagtgtttctaaactcgagtttataattttcaaaatatctcttttatagatgcttaaggatttaaattttagaaccacagattcctcttatttgagtttcatggtgaactgggagtagaaagaagttataaaatgcaaacatttcatagtttcttctttagacaattatttgccaattatttgtccattgtagttacgtgtccctactgttattctcacagctgtttctcctataccttaatttaaaaaaaagtaatttaaaaaaccacaagccttacaaagaggtgaattctaagatcaacttaaaatacgtcagagcacagatattcaagggtatctgtagtggatgcagatcctcactggaatttgttgaatatattaatctaattaaaaaggtatatgtttccttacttaggggaattggtcaattttataagcttaaaatctaaaaagtagtaaaaaattttcagtatagtcatttcagctgattcagtgaggtgaggagtaatcattacagcagctaagatttattacaagcattccattttccaggtactgcggtcttagctatcaaagtgtactgatctttgtaaaatctgctccattgtaaaatggatatgtcaggtcattatttttcctttcatcaagtgtcctcatttgtactgattacatacttaccaaggaaactttatatttttgcctaaaatattggtctaccaaaaaaaaaaatgatcacatgacattccagttttccacttcatcggatagggatgtctcaagggaaatatagaaatggctttgatgataactaacttgtcacctaagaatgtcacagggaattaatgtgtttactggtctcgtcactagaacaataaattcttctatttaattaactatttggcaccccgatggctacctgagttatgtgtgtattttcatcactcatcccagacatggatagggggagcactggggcttcacagtgctgactcaggtcttacagttcttatcactaccacttccatctactaatgtaggtttcaaaaagagatcagaaatatttctgcttaagaaaactctaaatttacataggttttaaaaaaaatctacaaaatgaaatcagacatggaagggacaatttcttaaacaactagtattgaaaaaatggaatatccatatgtaaaaaaaaaaaggctggacccttatcttacaccatatacaaaaattaactcaaaatggattaaagatctaaatataagacctccaaaccataaaatgcctagaataaaacgtatgagaggtgttttgtaacactggatttgacaacgatttattgaatatgacaccaatagcacaggaaacaaaagcaaaaatagacagatggactacctctgactttaaaactttttgcccaattagtgacacaatcatcagggtgaaaaggcaacctatggaataggagaaaatatttgcaaatcttacatctgataagggattagtatctaatatctaaacaactcctacaactaaacaactaaaataaatcaagtaacccaattaaaaatgtgcaaaggacttgaatagacatgttttaaaagatgatatacaatggccaatagcacctgaaaagatgctcatcatcaataaccatcagagaaatcaaatcaaatgacaatgatatatcatctcacacattagtatggctactacgtataaaaaaggaaaaagaaccagaaaataaaaagtgttgataggaggttgagaagttggaaagcttatgcactggtggtgaaattgtaaaatggtgcaactgctatagaaaacaattttctttaaattagaactaccatatgatttagcaatcccacttctgagaatgcactcaaaagaatgaaagcaggatataaaagatatattttaatatttatgttcatagcagtattattcacaatatccaagagggggaaacaacccaaatgtctattgagaggtgaacagatgaacagaatgtggtatgtattgagaactattcagctctataaaggaatgaaattctatcacatgctaagctgtaacatggatgaatcatgggaatatcatgctaagtgaaataatccaatcacaaaatgagaaatactgcaaatttccacttttatgatgtatttaaagtagtaaaatttatacatgtaggaagacaaaaggttgttacccagagtctaggggtaaggctggaatggaaacttgtttaatgggtaccaaatttcagttgtgcaaaatgaagaagttctgaaaatctattttgaaacaatgtcaatatacttaaaactaccaaactgtacacttaaaaatgtttaagatggtaatgtttatactatgttttttaatcacaacaaaaggaatggggcatgtatgtgctgcttaataaactcgcagatttatatttaattcttttaaaatcaacatgagatagaggtctttattccaattttcatgaagaataaaagtggctctaggtgctaagtagcttgtccagaggttacagagctgtaataggatctaaatctctgtgtctgaaaccataatctgcattccattaccaaatgcttaataaataaaatgtacaaaactcctagccactctccacctaagtctactgactttgagctgctagctccatttatatggaatatttaccattcaccgaatagtcatactttctattgtcctagatacattatataattcagttttcaaaataattctatatgttttattagctcttaacagtgaaactgaggttgaaaagattaaattatttgcccaatttcatgttttaaatccaaagttttatgaagtcagagcttccttcacaatgatacgattctctcaagacctgaaagttacctgatttttcctatttatatcatcctatctacttaagaagcattaaaatcttataaattcctgcaaaactatacttttgctattttctttttcagtttgataaattttgtctcaaaataaagaaaatggcatcatgatttgcttgtaaaacatcctttcaataaaatgtatcaagtgtctactatataactggagttatagaaataaaacacaagtctcatacattcgtagagataatattctagtggaaattgactataataataacattagataatgctttgtagaaaaataaactagaataaagggttaaaatttgaagctgggtatcatttcttacataatagacaacggaatcagagaaagcctgtctcaataggcttttattaaagcagctaaaagttaggcacaattctaattatttttaaagtataatcagctattattttgaaaaggctcagtgtatataaactacttctgcagaaataaacaagacactgtacaattgatattccatgcataaatgttgataaccatcaccctcataaaacaatttacatgacaccaaaaggttaaatttgtgaactatcctgaaataattgttatgaatcatatatgcttttcttatgggaaaatcacatatgctttaatccgtgcctactgtattttatttggcatataattactaaaagtttagttatctgactctttaaagcttcttctggcaagctgaagtgatgatattttgctaaagaggcaaattgacagtgacgataattgacctctgtcaaactgaaatcaacagaagacacagaagaacaacctaatgcaggcagagcttaaaacctagacaacgggttgataggtgcagcaaaccaccatggcacatgtatacctatgtaacaagcatgcatgttctgcacatgtatcccggaacttaaaagttaaaaaaaaaggtgatatgtatatatatatatatatgtatgtgtgtgtgtgtaatgaaatagtattcagccataaaaaggaacaaaataatggcatttgccattattggagaccattactctaagtgaagtaactcaggaatgaaaaaacaaacatcatatgttttcactcataagtggaaactaagctatgaggactcaaatgcataaagatgatacaatggagtttggggactcaggggaaagggtgggatggaggtgagggataaagactgtacgttgggtacagtgtacactgcttgtgtgcaccaaaatctcagaattcaccattaaagaattattcatgtaaccaaaaaaagaaaaaaaaatttaaaataatggcagctaaattagggtaattaagggtaaaatagtaaagatattttaaacatcttttacagtatcaaaatataagaactgcagtttaataaataatcacaactagattggagttaactataacatactcagccatggtgagtctacactgttaaggaggcagagggacatgccacatattttacaataatttaaaacatatatattgcttaatattagtcaacttggttttaaaagactaagctctaggcatttagacacattgctttgagaaatgacatatttcctggactggccagactgctttttgagtaaattggagccacaaaatcaaggtatatattcaatccatgaatgttatgatttctcatatgcagcattttgaggttctgatacatcaaagcattctgaataataaaatctcacatctaatttttatccttatttgaagacactctcaaaatcttcacatatttccaattagactttgagaaaacagtaagctaaattattattaaaacactcttaaactatatgtttaatctgaacattgtaatgattaaaatgacccactcagattaaaattgtggttgttcaaatactgcatgttattatttataaatgagagtcaacaatgggtacatgcagacataaagaaagaaaataatagacactgagggctccaaaaggagggaggatgggaggggcatgagggctgacaaattagctattggctacagtgctcactatttgggtggttggcacactcgaagcctaaacctcaccaatatgcaatatatccatgtaacacacctgcacatgtatcccctgaatctaaaataaaatttaaaaaatacagttaaaaatcatggtcatataaaaataaatatataaggagacaaaatcaattactctgtaagatcttctatctttttttccactagagtaggaggcacattggaaacaatgacttgcatatccagctgattgaccacggagacctgaaagaagaaaaaacagaattcatttaatttttactcactgaaatttccataatcagaaaacccccacattacctcttccctactatgcatagacacagtggtttctgattttcaaattcaggaacaaatatatatacatttttaattatatgatctacacaaggggttggagactaactggggcagactgagcatgagaaactatttgttgtttacctagaaattaagaatcctgagtgatttcaattgtttttggttatgtgtttgttttattggttatttactgagacatgaagggtggcatttttttttaatttgattgttaaggaacacccaagataatgaaaaatacgttttatattttacaagtcttgagaaatcatttattcattataactaagaatctgagatatgactggttagaataattcattctatgaggtcatcacatatagttttcttgtctatttaaccaactttaaatttgtgtaggtagaggtatatatttagaactttacatatgggttaaatgagctaatttaatggctgttgataactatgtatcattcatttaaaatctactgaatttcttctatgttcttatatttgaaaaatagaagaaaaataaaaatatttattctgtgcttacaacatggcatttcatcttttcctcaatattctacaggtttaactcattgaaatctatcaacagaatcaggttgttattaatatcatttcgattttaaaacaaaaaaaataaattgaggatatatttaataacttaatcctaattaaatgcagtctgccttacaccagagcttgtgctctttactattatccaatactgatataaaaattctaaaaagccatatattatcatgcacatacatttatacactattaaaatataaatgcatttgtaccagaatcataaattgaacactctgagttaggcatatttagcaccgtatctcaatacaatctacagtagggagtaatttcacattgccacacatgtttttataggctccagattctttacatatagagaccccattaggggtcacaaactcaaatgccttcaggaaccaggcaggtaacttaaatgagaaaagtagccaaaagtatgaaatgatagaaagaagtgtaagtaacaaatccaagagcacataactctgctgaagaggtcagctactactcacctctaaggaatattgcagtgtgggaaacaaaatccagatttcctagatatttcagtttttcaggaaaaaaagaaatccaaaatattttgtaaaatgtttgcaactagttagaaatctatcaaaccattgtgtgagcatgatcaatcatgtctgaagactgtattaagacaggagtaggtctgattattacttctgagcaagcagtttatgctggcagttctaaccttgtacccctaacccgtcataggtgtctgggaccaaatgactaaatttcccttcaacatgtaaatgagtcttgattatctttttacaaaacactagctacttcactagcgaactagcgaaagggatcattacagtttttgtatcactttgtcttttcttattggtcttgagttaaagaggatatagaagttgaatagaaatattttttgttttattgtttttgagtttttagcagtaaaattacatgataaaaatttctagaagtatgtatatgaaacttgcataactgttccctccctccctcccctccttccttccttctttcttccttccctctcctcctttttttctttcttttaacattgggccagaaacggttaaaaaaaagttttgataaaaatcaaaccacccggaacaagtagtaactatagggtgttatcccaacgagaagtataatcactaggcctcattctctgttccctgaagctcccatcatctcctctaactgctggactcagaagtactggagtcctggcctcaggacagaggagcttttgcagtgggactagtgctgaagcacttcctaattccaccatctgttgggagaaagctcctggaccatgatgtgggttatggatagggtgagtagtagggaacattagcaggatactggaaaagagaagaaaatgagtaggagaaataactctttattactggttctttcagtggagaattgttaggactgtctgccctgtcaaactgtcctcttctcacatgtctgtctcctggtctggtaagcatgtgcttcaacccaccttttctggctgacagactgttacagatccgtactattagtatcccttgaattttccactgtctcttatttccctacattcatcctgcccaggccttcaaaaatagacccttcattaaactgtcttcaaattatctgactcttgcagcggagacttaaaattaaaaaaaaaaatgtttcacatgtgcatgaattttctgccaggtccttactgatatagatccgaaaaaccatacaatcaggtgtcaggctgtatataccagaaatcggtcacactttacaaatatgatatatgatgtgaacaaaaacaaaagtgggaaaggaactaagtagtaactagtggaggatagattcagcagcctcagaggaagaccaaacataagccttcctatcttagggtagaaacaggatttaatcaaggaaatctcctgctcccgggatggggatctacattatatatacccaacaggatttcagaattggcctggacaattccatatgtctaccattactgtcctcttcaaataggaatttctagtggatattctgtatttttccatcatctatactgggtgaatgtgtttgctggatcactaaaacatcagaagttccctctagacctgataaaaagaacagcatgacatctgagatccaggtgttaactttgataagactttgttctatttgtgtggaaaataatgaaataaatatttggtaatcagaagtatagactggttagctgttcatccagctctttctgtcttcccactgggaacacacagtcgatttctcagccttctttgtagtttagtggagccatatgatggagttctgaccaacgtaaacttagtggaagggaaggaatgaatgttcttaaatttgaaggatagtcactgctttctcttcatcagaaagataggttacttattcaaaatactttaagccaggcgtagtgcctcacacctgtaatcacagcattttgggagactgaggcaggctgatcaattgaggccaagagtttgagagcagcctggccaacatggtgaaaccctgtctctactaaaaatacaaaaaatagccaggcatggtggtgcatgcctgtaattccagctactctggaggttgaggcacgagaattgcttgaacctgggaggcagaggttgcagagagtcaatatcacgccactgcactccagtctgggcgagagactctgtctcaaaaaaaaaaaaaaaaaaaaaagtgagattttgtgcaaaattctgactgaaatagtaggagctaacatttaaggtatctagaatatatccattttaaggttacattttattaacaagattttatgatgttaatacattttgaaaatatacttttatattttattttaaggatataaaaataaaaaacatttaattctgataaattaacagaagtcgcactaccgggagtagttgtcccacacttacctctaaatcattactttaaaatttttaaatctcctgaatgtgctaatgtctggtttatgtagaacacacacattttgactatgcaaatgaagaaataagatattacagtttacatttggtctttgacagaaattctacatcctaactctggtttgttttatcatctataacaaggatatttagctgtttaagattagtagattttatttatgctacttttccagtatagcttctgcaaatatgcaaatatttccagaaatttgcatgtcagtttattacaccaaatatttaataattctctgtgaaattatttaattctgtagcttaataactaatgaaagctttataaatatgtttccatcatcattgagattgatatttgtaatggattcaaattactaggtattgttaaaaagaagagaaataacatttgtgaagcacaaaattaaaaaagcaatggttggaaatttacatgttactatttctatgtcctttccatttattctcataagtttcttttctttcttcctctatactctcataaattttaaatagtgctgtccaatagaaatacaatgtgagccacgaatacaaatcacatatgtaattttaaattttctggcacccacattagaaagataaaaataataagattaattcaataacacatttaacccaatatgtttaatatatgtttagtaaaatatcattttaacatgtaaagaacattttacatatttttatcaaagtctttgaaatctggtgtgtattttatacttatagtacatctccgtgtgacctagccatgttgcaaatattcaatagctacatttggctgatagctagcatattggacaacccaactttagagatattcatcatctcctgcttgaactgtctttcctaactaactaactggtctctgctgcaaactcacattttattaaataaaagaggtgttttaatagtccatttagataattatgtattttcttttttaaatactataccaaaatttagtttccacatgaaatctgaaaccatgttcagttatactacaatctatttgtctgtcttgtactttttttttcttttttgcgatggagttttgctcttgttgcccaggctagaatgcaaatggcgtgatctcagctcacagaaacctctgcctcctgggttcaagcaattctcctgcctcattctcccgagtatctgggattacaggtgcccatcaccacacctggctaattttgaatttttaatagagacgaggtttcaccatgttggccaggctggtcttgaactggtgacttcaggtgatttgcctgcctgagcctcccaaagtgctgggattacaggctgagccaacacacccggccattgtactttgaattgattttttacacgtgcataattttttaacatcctgcattggccacttggaaaatacaagtttactgaacactgcagatattgtaaatatcaacacacttcattacacaatatcaataaataaatcacattatttaatacaaccactgactcatcaagaaagtctaaatattcggaagctagtcaagtttacagtgacaggtacatttttttaatattctaatttgtgcttcaaagcttcagtattatcattagttggttgttttcaatgaaatgacaggctcccttcatccattttgtgtaaatgcctaccaaatatttaagtttgaataaccatattttgtctctaagttgctctttcatataaaaatgttagtccataaaaaaagcagcttgttcagcttgcatagtgcttttccttgaggcaaccatcttccacatacagcagatgtactctatgcatacttctcatttcatcaacaaaataatgaaaaggtgtttaggacactttcgttgataggttagctagctgcctagatagatatacagtatttactaagggaatgaatgtgaggtttaggagagaaaggagtcaagaaattttttgcctaaggaactcaaagtgatttggtcatcaaataaaatgaggaagactacaggtggaagaaatgtgatgaagaagagaaatccattaggaaacactaaataaacaccttttaaaaatattcgggtggaattgctacatgtacagataaatatgcaaatctggtgttcaggaatgatctttagtgtaaagatgtaagtatgagcgcttttactatgtagatgatattttaaagttatgggactaagtgagcttaacaagtcagtgagtgcagatagaaaagagatttaatgtctgagccctgagaaacctcaatactacaaggtcaggagaagaaaatgaaccagtgaaggagactgagaaggagtaaacagtgagatagtaggacaagggagtatggtgggtggtctgaaagcatagtgagggtaatagtcaagcattgctgatggttcaagtaagataaggactggcatcatcagtacatttcctaacatggaagtcattggtagcatcgacaagaatagtttggaagagtgtttggagagaaaacactcttatgattagagggtttaagagagggtttaagagagggttcaatagtgagaaataagtcaaatctaacatagaattttgctaaaaagaagaatagaaaaatggatggcagctagaaggtgatatagatcaagggatgttttataatttttggaagatagaaaaaaagcattgttgtgagaataatctgatataaggaggaaatttatattaataatgtagaaaagaaatgggagagctgctgaggcaatctcctagagctggcgagtgggaattgaatctactgcataagtagaggtacaggctttagataaaaacagaattcatctaaaggagccagaaagaaggcaaagaatgttggtctagatcctggagggtaggtaaatttagtggcaggagtcatagaagtgtccttctaaatgctttagtattatttttctgtgaaatagcatgccagttaatcaggccatagtgagaatgaggacaaggtattggagattcaggagcagagaagattttctaggacatcgaggcaaaatagagtgattactgaccaaagcaaaagctcatttggagggtttgttttagtcattaatttaaattgatactgatgcaggagaacagggtctggaggcagggaacctaaggccaatttgtgctgacttcctaaagctaaatcaaagggaaaacaccaaggtctggggtcagggaatctaaggccaattcatgatagttttctaatggtggattaaacaggaaactcctgggtctgggggcagggaacataaaccaattaatgccaacttcctaaagctaaacaaacaaacaaacaaaaataccatctccccacaccccacctgagtaacaaaggatcaaaggctactctccctaaaaccttcccccttcccccatgtctcagatggaaagggaaagtgccttggagtggctgtgggccaagcaggggccatcctttcatttgcttagggcatcaatccactcaggccttgggtcaattcagctcagcctttagcctcaggccaaatccttcatccagataaggggtagcccacagggacctcaaaaggagtattaaaacccagaaaactttgtaaccaggcccttgagtcacttgcttgagtccactcccaacttgtggagagctttcttgctttaataaatccctgctttccgaggttgcagtgttgcagtgagccaggatcgcaccactgcactccagcctgggagtcagagggagagtccgtctcaaaaataataataataaaataataaataaataaataaataaatgcccactttccttgctttgttcctttgtttcgttcctgtgttaatttgtgtgttttgttcaattctttgttcaaaacaccaacgacatggacaattcacactcaaagccgtcatgtaacaatactatagctaggcatggtggtgagtgcttgcagtcctaggtgctagggtggctgaggtgggaggattgcttgagcccaggattttgaggttgcaataagctttgattacaccactgcactttgacctgggtgatagaaccagaccttgtttcttagcaacaacaacaacgatactaattatagaattttgtatgtttttgcagacataatcagcatggatataggtctggagaaaggagacagttggaattaaccaaagtggaggttttgctaagtgaatatgacatagagaaagaaagcaagaaagttaaattttatatgatgtactgcttattataattggtaatgcattataaatccagtaaacaagaaagagaacatgagaggttctcatgagagaacacaatggaagttaaaattattcggctaattggactggacatcctggtaggaacaaaagaatgatgggtttagctgcaatgttaattaaatgttatggacaaagagtgggaggtttgaaatggaggttataaaggtaatggcaaggtaagccaagaacagaaagttaaacaccacatgttcttattcatatgtggaatctaataaaaagtgtttaccgatcttaatttgatcaaaaatttatgtcaaacttaatatctcctatgtcaaaagcttcttggcttagagtggccttcatttactctattgcagctttactgttaaaaatgagaatgctcctggaggactgttttggccacaatcatggtgattgttcttcaccattatctaagaagaaaaataaagcattgatgtctgcatgtatatgaaggttacgcttgtccagggaactaaatgagaagaactgcgaaaaaatgaaaatttatgatgtaaagaacaaaagacaacttattcttgatctgtttttatgtgacaaatatttctaatgaatatactttgtattagattcatcagacaaaactccaaataacccatgctttcaagttggtaaagagtccacaggatatatgcactggtgttaaatattttcaatacaagctaatatcaaacttccctttcaaatgatctatcactaaacttctgcactgcctaagtgaaaattagaacagtgatattattgactatagccaaatataacttagtcaaggctaaacaatgtcatcattgggaattttgatagaacaaagaaataaatactattggaacaaaatttgtccccaaacattttctttgttttctcaattacaaaatgctgaaagtaatttaaacaaataatttcatagtttaatttctatagtataactctgtgaagcatttaaaatttttatgtagcactggacaccctatattaaacatgagctttgaagacaaaatagaaatccagtgcttatacctttgctgttacaatcatattttttcaaatattataatgtttttctcaaaggtcaagaaaaataaacaccttacggtgtttttgtaaatatatatatatatatatatatgaacaatatatttacatattcctaaactatagtgactaacaatctgagtgaaaataataattatgtttttgaaaacccgttttaaattaatcttagaagttctataaactgaaaacactgacctatggctagtatcgtagctacttccctttcctgaagttttatctacttacgagtacatcggctttgccgctcagtcccttcccatagtcgtcagttgcaataacttgaaacttgaagtaggatctcctcatattatggaagagcatagcagttttgataagccctgtatatgtttccactacaaatccttcttttccctctttaattggtggtattatgagtctgtaggccatgacactataattgccagtatctttatcagtagcctagacggaggggaaaaaaaaagagattataattaagcaggaaaagataacccttatgaaatggcttacttttgtttgtaagaatgaggtttcttatgtaataataacacaataaagccctcctaaatgtctgttttttctggatatagttatgtagattaatagactttgtgtccacagtttcgaatggttgctattagaatgataataactgctgaagtatgaataaaagggacataggtataattctgtaccctttaacaaatttctccctacccctcctttccttttacccttaccagcctccagtatcttgtattctacactttatttttatgagatcaccttttttttagattccacatatgaataagaacatgtatgtggcatttaactttctgttcctggcttatttcatgtaacataatgtcctagatagggagaatatgttctagtgctctataccactgtagaataactacagttaacaatagtatatagttccaaatagctagaagaaggatatcgaattttcccaacacaaagaagtgataactgtttgagatgacagatatgctaattaccctgatttgattgctatgcattatacatatagaaacatctatgtacccaataagtaagtactattattatttgtcaattttaaaaatagattttaaaaaataaacagacatagacactaacagagtcaatgaatcaagacttttggtttacaggtttgttgagttcaactgtgtgtgctgatccaaattggttgaaagatgggattggttgtttacctaatgtttgtcttgctgtaataggcatacagtgtgatggtatttttgatgtagtatatagcctaaggaggataaatataaaagaacgtagtaaaatatctcgaatgaaataaaataaagttgagttataacaaatttagagatgcataaaaatattctaattaattaatgccataacataattctctaattagagttagaatactatccgacttcctttttaatcatcctgtatcccgattaaacatatttgttcctggtgataggtacttatgatccacatattaaagtttcctaccatttagaattaaaaaggactaacacattgtttagatttttttcatttgtttttaaatacagctatgagaatcatatattgggctggctttatggtgtctaattaggggtaattttttagaatgtctatttcagaaccatttcatagtgaaatacttggaaaataaatggtagataggagagttttagaggcttgataaaagactatatataccttattcatgatactagatatgtaagttatacattttcatttgttataacaatgattattatttttattatccgattattcttatttttacctatgctattattattaagtatgagtatgcatttatgatctgccattactaagaattgctaagaatcatacaaaatacaaaatacaatcacacaaaataacatcatacaaaaatagtcttatctaataacaatataaaaaactgaggaatatattgttttacttatataaattagtgatattcaataaaattttctgaaatgatagaaatgttcttaaccagctctgtcttatgcagtaggtactagccaaatatgacaaatgaaaagtggttgatgtgacaaagaaactgaaatttcaattcaatctaattttaatttaagttacataatgaaagactacataataagtagtaaagttgagacacaaatgattaaaatagtaaatcatagcaaatgtgtattaaatacagcatcaacttgatttagcttcaaattctatatatattgtgaaccatttaaaacgtttccagataatcatatctacttgttagaaaaggtaatttaaactactcaacacagataatttcacttcaggatcagctgtttcatgaattttctagggagttaatattctcttttctttatttttttctctgtcacccaggctggagtgccatggcataaactcggctcactgaaccttagtctcccaggttcaagctagcctcacatgtcagcctctgagtagctgggactataggcactccactacgcctggctaattctttgtagacacagggtctcgctatgttgcctgggctggtctcgaactccttgactgaagcaatcctcccatcttggcctaccaaagtgctgggattacagacatgagccactgtgccaaacctaaaattatctttagaagaggacaagctcaaactaccggctaatcactttagatagtttatatggcttacagcatggcagagctcagttttggtattagagtaatagtaattagttatcaatgttaggtcacattctcacttaaaggaaaaagaaaatgaacaaagaaagaaaaacagtatcaaaattttttgtacttaaactttgaaccacaggtttataatcactcaacaaaggatagcataagatagaaaaaggcatattcccagctaaaataagtcaaagtctgagtcaaggtatccaagacatttcttccacatagaatgagcaaatttgggcctaatgtcagatcagtcagatttggttacatattattctctatcttcttattaacatggatatttctatgaaacaaactttttattattaatgtaaactttataaaggaataacaaacatgcaaaaagtgtacaaattataaatgtaaagctcattaaaattttgcaaaatacacacatctacatgaccagcatttacatcaagaaacaaaacaagccaggcatggtgactcatgcctgtaataccaacactttgggaggctaaggctggaggatcacctgagcccaggagcttgaaaccagcctgcacaatatagtgaaactcttatctcttgaaaaaaaaaaattacccatattccagaatgcacttcatgcacttggagtcacaatctgagaccttcttaaggaaaaccactttcctaatctaacattgttgattagttatgcctatttttaaaactttacattgactgaatcataaaatatgttctattttctgtctgacttctttcattcaattttgcactgtaagattctaagcccttatatttaaaataaatactgtataacaacactatcacatttggaaaagaaaaggtggttaccataaaatcaccacagtgattgcttggtatattaagctactttacacagttctgactgattaacttccaatttcagtaagcaggtaatttcactttgcaatattcctaatatattaaattatgataactacaaaatagtcatattccatcttaaaatattaaagtgttctgttaaatgtgcctttcctgaaacaaattatcacttaatgcaaaagtttgggtgtggaactagacaatttaactcagaaataactattttcttttatgatttttcatataaatgccttaatatttgcagaaaatagtcaagaatgagataaaagtttttttaaaaatcttgtctactggaattaaaaaaaataaaaccctattgtcatatgtatgttatacagtaaggactctaatttttatttctttgaatgaatatgatagtctttgggatcttagagatcttatttcaggagatattcatcaaagatgattgccaggatcattagcatatttttcaaatctcccctcttcctcaagtatgttcagttgaatactagtaatttaaacagtgactgatgaaaattccaatgggtgccatacttaagagcaattgcatggatttttaatttttagtctccccaatttataacaaatacatattttaaaatccgaaacctctcctctaagatgtgactctgattgatgtggagcatatgcaataccatcatacatagataacaaccaaatgttctttctataaaatcaataacaggatacgatatctttaaatacacactgagtcacaccagagataccaataataaaattcagagcgcagttttaaatctgggtcaatatgtgaaaaataagtgagagtttcagcacagagtatattgtctctatttgttgttaaataattttaaacttacttttttgcttgttttttgcattatgttttggagtgaggtggactccaatgtcaggtgtgactttgaaaaattaataactcaaggccgggcgcggtggctcacacctgtaatctcagcactttaggaggctgaggcgggcgggtcacaaggtcaggagatggagaccatcctggctaacgcagtgaaaccccgtctctactaaaaattaaaaaaaaaaaaaaattagctgggcgtcgtggcaggcacctgtagtcccagctactcgggaggctaaggcaggagaatggtatgaacccgggaggcggagcttgcagtgagccaagatcgcgccacagcactccagcctgggtgacagagcgagacgtcgtctcaaaaaaacaaaacaacaaaactaataactcaaaatttcagatttctttattcataagataaaaataaggatgcccaaaaatagtattttaaaattttatatatattcatacgtgtgtgtgtgtgtgtgtgtgtgtgtgtgtatatacacaaaaatataaatatgaccaagtccagtgtaactattatagttacctaagttgtcataatggtgattcaaaaggtttaacattttttcatattatgtttatccatgaatatgtaaatttatgcaatcaatttagacccttattacttcagacatattatcacacaattgtaactcccttataactctacttttcttaattttcttttccagctctcctttattgcttccagttcttgttttgttttgttttgttttgttttgttttgttttgttttgtttttgagatggagtttcactcttgttgcccaggctggagtgcaatggctcgatcttggctcaccgcaacctccacctccctggttcaagcaattctcctgccttagcctccccagcagctgggattacaggcactttgggaggctgaggcgggcggatcacctgaggtcacaagttcgagaccagcctgaccaatatggagaaaccccgtctctactaaaaatataaaattagccaggcatggcttccccctcatttttgaagcaattttgcaaaacctcttcctcagttgaaatccatgaacttttgtacagtacacactctacccctccttgttgccaaacataatgaggatgttggtatcttgctctcagtctaccccttctacttcaacttcctccctctttacaaatttcagtattcattgagatgacacatccagcaacttatttttaaagtattaggcatgaataacattcatcagtctttgaacgacctcactgcatcgatttaattctacagtcacactttagtcttttgccttagggagatattccgcttaaagaaacactccatatttaatttatatattaaactttcatgtctaaattctgaccacaactttaatcatcatacttagttaagacctcttctttgatatcagtgaattttcagttctgcaaactgccttttgctcccattacttcagggtttatgtccctttctgctttatcatagaagtcagagttgatcacattgttctcatttctctctccttccacaacacctggatctttctcctcttggaccaaactaaccatcagtttactcctggtgactgaagagggcgcagagaaattaaataatcagtcagactagtgttactgtaagtccatggtctctgagtttcactgtgcctttgtctatttaggaaatccttgctatatgtaataagttctctttctcactccagaagtttgcctttttctttagttcacagattctttcagtcttctccagagataaggaagctctaattcccataaaatttgaggatatcaaatgtgagatctctcagcttttcatcacataactaaaaaagtacctatatctgtacttactttgactactttcttcaaatctcagaggagcagctgacacgtatctctcactgaaggtacttatgccttaatctgaatcactcccatcccttctgcatttaatgcttcatcagctctattgatctctgtccttttcacctctcctctacagactataaaacacgttatgtctctctcattaaaatgaaatgaaacttttcttttactgagtccacactcgtgacactagcccccaaacttccatacctatttttcacagttaagttcctcagaaaatttttatagaatcaccatctgtaattccttactttacaatcatgccttaaccgcagccagatctctgcccctgccatgccatttaatttgctaacatcagtgactgaggctggactccatctcagatcaacaatcagtctggtgttctttaaattaccaagtccatttatgttgtttgtataatgctgttgctgcttccgctgtttgctaacatttattgaacacttacaatttgccagatgctatgtaaatacatatattattacattatctcatgacatcctttccattgagtagattccattattattttataggccaagaaatggaggcacagagagattagtaacttgttcataatcacacatatggttgttagcacagtgggataagtctcactttaaagccactacattccacatgtgagactaaataccagggataaaactgcagtttaaaaataaaacaacaaatgttcgataaaatattctaagaaatcttcctagatccatcaagaagatggaaagacaataaatatgccagtcaaaaacaaagtgctatggactgattatttctccccaaatttatatgttgaaacataatactcaatgtgatgtcatttgaaggatgggcctttgcaaagcagttaagttcatgatggcagagcccccatgaaacggattggttcctttttgaaaagaggccccagagacttcctttgttccgttttgccatgagaggacacactagaaacgcagccatccatgaaccaggacggcctcgctaggcacttaatctattagcaccttgatcttgggcttccctgcctccagaactatgaggaaaaataaatttgtcttgtatataagcttccaagtctatggtattctgctatagaagtctgaatgcaaaagtaaaggtaagaatataaaaaccatagtactgatgggagctttcatttagaatttttttgttttttttactgacctgggtaaaattaaaatttaacttgtctggttttcagtagctcagacaataggaggcaaggccccaagcctactcatgaaagtgagtctattaagatttccctccccagaaagttaaattctcaccgtaagagtaaaggagaaatttacttttccccctgctaccactgctactatcaccccaaactgcaacgaaaactgtaaacttaaactttgctattgaggggagtgaagagaaaacttctttgagaatctaggacgaaatacagcccctcattttagtttgcagccattatttgccggccaccagtttgcccaactcaaggagaaatcataatattccattggtaaagtctaataggcctgatctccacctgaatggacagaaaaaccacaacctgagaatttaagagaaatcatctatgactgaaaatggcctggtctcctgcctgacagaagcaggtgctttttcaaaaacccctcctgcaagccatgcctaaaataattctaacaaataaagttccaagaaagatgaaaagttataataattatcaaaacaaacaagaaacaatcataaaaaagtccgttgagataaaaaaatcaaattcataacaacatagactttaaatatttgaattagtagacactgaatataaagcaaatatggttaatacatttcaataataaagagctttaaaatgcggaataaaaaatgagactcgttgaaaagaaatgaaaaagtatcttttagaaataaaaaaaaattagaattaaataccccaagatgggattgttagcaggttaagcgcagctgaccagggaattagtaaatgaaatgatagggcaaaggaaatgacacagaatgtttcacagagctacgaagatgaacaacctcaaaaaaaaaaagtttgagatatggagtttagaatgaaaattttggcaaatatctaatcagagtttcagaaagagagaaagcgagaatagaacagaattttccagaactgataaaagattgttatccacagatattaagaagcccaataaactgcaaacaggataaataacaagtaactcacacctagaacccacatgtcatatagaaactacagaaccacgtactgtaaatataataagtattgttttcttaatattttgggaaaattcatagagatattttagtaatggcataaataattcataaatatattctataatttattaatagtaataaggagatgtctaacaagttgggttaaattaatgcataaaaattaaaactgactcactgtggaaacgctaaatgaatacaatttactaaagaattaatatgatattactttttccaccaatttctctataatcaaacatttatgctcagttcacaacaaagtcattaatatctgggagaggtgactctggaagatttgattcactgacttttatgagtttcccttagtgaacaaaataaaaaaaaaagttagtctagagttcttttaaaagaataaaagtcagaaatgaatattataattatacttgctataattatattttaagtgaaagcttagatacaggaaaccacttacccatttctaagacctcatctggaaattttaatggatacagatgtacaacattaaaagaaaatcaccaaataattgcctctatcatacaggggagtaggggagaccattaattttctaatagcctaaataactgttcccctctgttgcctaaatgaataccatggatgcagaaatattagtgaaataattagtgatgtcctaagaactttcaaacccattaaagttcagtaatgccaagtttaactttagcttctcaattagacccattttaacatttaacggtattgaaggctcacttaccctgaaatagagtgaaagtgttttagactgtctggataaaaatactcaaatctcacatttccacctaccaaggtcactatgtcaagtttgcaaaaagcaaaaataacagagctttggcaggttagaaccactttaacttgagtcttgtttttttttttgtttttttgttttttttttgacacagtcttgctctgtcaccaggatggagtgcagtggcatgatctcagctcactgcaacctccgcctcacgggttcaagcgattcccctgcctcagccacctgagtagctgggactacgggcacccaccaccagatccggctaattttttgtattttaggagagacgaagtttcgccatgttggccacgatggtcttgatctcctgacctcgtgatccacccggctcggcctcccaaagtgctgggattacaggcatgagccaccgcgcccggccaactcttgtatttttagaaaccagaaagaaatctttattttaaagtccttaaagacaatatacccagaacatgataaaatatgaataagaaaaatgtcaggtagattgatctacttttagggctattcaaaacttttgcaaaaaaaaaaaagaagaaacaaggagagaaagagaaaagaaacattttaaatatgcaagctcaagtgtttgattttgcataagaatgtcaaacagtgactacaatgcaatattaataatttctaagttcaacatacctatttactttttgtagagttaagtaaaagtctaatataattctgagagattctaaagagtaaaatacaactcattgtagaaacagcaatgtaataatggaaacacgccagtgcaacaataatagagacatgccatcatagtttgaattacaaagacctttacagggctgggtttcggttagaatttatcaaaatttactcttaatttaaatcatggtgcaaaaaattacaggataacatctatttagaaaattaaagaaagaaactaaagaaaagccaaatgttccttttattattttaaaaaattatatggtaaattctgaaccatagaaggcttgagagtacaaaacaagcaggacttgcatgtatgttataattgaagtttccttttttattttttcctttcttttaaaaatgttttgtaaaataaatattaccctataaatggttttgctttttccgtcattattgctaataataaaatgattatacctccctcagagatgctttaaaataaactctgagctaattgttctaacttttcaaccatgtgaaaaagaaaaaaattgtgctctattatatagacaagttaacaaaagaaaacacacatgtaatttatgctttttacttgagaggaaacactagtttaaatgttggtttggttttgaatcacaaaatgctattaatttttaccgaaaatatccactcttaaacagcttatcttttacaataattctgtagttatacatcctaaatccttcagcattcaaagcaaattaaataacatacttgttatttttgaacttcctgatttttccttagttacattaggttcaatcagtccaaaccaaattcagctgctgcttcttggctcccaccttgctgtccctcttctgactatcatatgtggttctccttctgttttttctttttgcataggaagggcaacaccatctatgaactgaactgttctaaaaaatttcagcatcctccccctcggtttaatctcacctcctggctcctccctacttccagtccatcagcaagcattctgatttctacctatacaatatttctcagttctgtataatactttaggccaagcttacactggccaatttcaggctctcatcagatctcacttttaactctagcgatagcttaaaaattactgatagctcccacttgccagagatgaatgttaaaacaagtcctttaaatattctcaatctgattaaagttcatgattccaactttttgctttacatttattctacttcccagaaccatattattttgtttttctgaagaatgtgttctttcaggtttctatttctttgtatacattgtttcttctaccttaaatgaaatgtcttttgtctgctaggccaaatgatgttcacttcttggctatactatggcacacacacacacacacacacacacacactttgaatatatatatatatatatatatatatattctacatatacatacagtaaactatggcatacacacacacactttgaatatatatatagactatatatattctatatatatagtctatatagtctatatataatagactatatatactcatataatatattctatatatagtctatatatatactatactatggcgtacacacacgttgaatatatatatatatctccatatatataaaatgtgtgtgtatgccatagtatagtatatatataaatatataatatattatatatatacgtgtgtgtgtgtatatatatatatataataaaacactgaataaagcaatcaaacctcagcttaaatgaccccttttctgaaggtgttcttatctctactagggagtgctgcttctacttacatattttcattgttatgttacataaatgtgtgtgtatatattagcatttattatgacacgttttaattttgtgtgtccattatacgtcaaatttgtttcagttcatatttttcactgtggtaccacgtgcagtcagtggtcaaataatatttggcttaaatgtctatagaagactatcatagtggttgagacatcaataattagaattgaaagatttgagtttagttctaccacttattagatacatgagcttgggcaagtgattctctaaggctttgctcctcatttgtaaaatgaggaaaataggacatgctgaataagttggctgtgaatattcactcgggtgtaaaatgcagtgcctggtacaaagtaaacctaaatcaaggttagctgttgttttactattgcatttactactgagatctttgaatactttgtagctatcttcctgatctcttctatttgttctttttttttttaaatcactttttgtacacttaaacgtacctttcactttctgcatcgtgtcactggctataaattctttggaagcaggaccattttctgaatcgtctttggatctcataagtctcatggccagtagaatgtaattagaaaatatttgctaaagaataaatctgccactgaggaaagtatagttattgatgtctctttactgaatgctatataatttattgatagcaaagcaaaagcacttaaatagaaaatatttataatgatacagatataataagatgcttataaggagggtgggagccaagaagcagtagctgaatttggtttggattaatgaagactaatgtaactaaggaataatatagaagtttggaagtttgaaataacaagcatgttatttaatttgatttgaatgctgaaggatttacgatgtatacctacagaattattgtaaaaggtataccattcataaataatttaagtataggcatttttggtaaaaattaatagcattttgtgattcaaaaccaacattcaaactaatttttttctctcaaatagaaagatcaaattatacatgtgttttcttttgttaatatgtctatgtgcctcagcctctcgagtaccagggactacaggcgcgcaccaccacgcctggctaatttttgtatttttagtagagacaaggttttgccatgttggccaggctggtctttaactcctggcctcatgtggttttgccatgttggccaggctggtctttaactcctggcctcatgtgttccgcctgccttggcctcccaaagtgctggtatcacaggcttgagccatcgcggctagccgtaactttatattctatacttaaaatttgcttcatgataagctgataaatcctgtttgtaatttctgcattttgtatttgtactttttcattcattttaaatcttcttcatgtaaaacaaatattttgtactccaatgcagtgttcaatattaacttgtaatttctgaaaattttactgagaaaccactggaatatttagaaattcaaataaaataggtgttatgcatattacatataatgaagacttcacagttcataataaacatctattttaaaattacatggccacagattcaacccatgggcccaaaatttgcaacagagcaggaagacttgtattttaatatgctaacagtacaagtcatttgacctagagataaaacaatttaatattttaagaacacagggttcacgaagcaaacttgaacttactgtaaaatgaacttactgtaacatgatttcaaatatgaatagtgtataagaagtctattcatcttttaatttctaaatttaatggaaagtcaaaggaaagtaatagcagggcaattgaaaattaaatctgaatgtcgaatcctctgtaaattctgacaattttactgcctacctaataaatttacaaacagaaacaaaaagctctattacaaaaatttttaaaaaaacctttcttattgctttcatagtaaaagagtatgtcgaggcaaatataattcaatttataaatgttttaccttggaaaataaatttataattttcaaaatagactggatatatagggctatgatgaaagtaattattaccaaacaaaatgcctttagtattgttataatgacactaattgtaaagaagactgtatttatggactagaatggtactatttgtacatgggacaataagatctgtctcctcgaatttatataattgtaacatgttaatataaacaaccctcaaaaaaacagtgtctgtcctcagtgtccttcatttaaattgatggtattttggagctctccctcgtgctctctctctctctgtatgtgtatgtgtgtgtgtttaaaaacacacatatgtatatatcacatatgtatacacatgcacacatatatagttatttttatattttataacatgatgtattttgtgtcatgagtaccaacttacaagtttgctaaaaagaaatggctccaacaccagtaaaatttcagtgaaatagtcttgctgcatgcagctatactacctaaaatttcaggatttgttagccagactcaaatactgcatgttcttacttatacgtgggagctaaataatgtgtacacctggacatagagagtggaataacagtcactggagactcagaaaggtgggagggtgggagagggtgaaggatgagaaattacctaatgggtacactattagggcgatggttacagtaaaattgggaatttaccactacacaatacatccatataacaaatccacttgtaacccctaaatgtataaaaataaaaaaagtaaaaataatcattgataaaattttcttagcttaggcagcagaaagtaattgagcatgaccaaaaacgtttatgccaatagagcaaagagaaaaactgagtacacataataaaatttatcttttgaagttcacacctggactaaattattagacatacataatttttaatcattgaaaaaaaccaagccaccatgtatttatattcttaagaataatatttctaaaatgtgtatgctagattacttttgtctacataaaattatacatatttttaacccttgcgatgttttgatgtgaattgtggttcacaaaatatactgggaactaagtaaaaaaattacaacaggtaaatgacacagatctgatcaggactgagatgaaatattgtggaagcatccatggtcagagattgcagtgatttttatctgaagagttggccccaaaacaatttactatacaggatgattaacattacaattccattttgagataatttggtaaaatgttaatattatgaattgcccacttgcttttttttttttttttttaacatggagtttgtttctgttgcccaggctagagtgcaatggcacaacctcagctcactgcaacctccgccttctgagttgaagcaattctcctctgttgggagaaaagctgagtgttgggagaaaagctgagtgttggcagagaagctgaggcagggcttgcatgtctgtgagacttgctggctccttgcttctagcactccccttatctcaagcagacatatgtttctcattcacttgatacactgtttcctttcaacccccacatccacatcaccttttttgtttgtttgggcaccaataaatagcatgggctcccagagctcggggcctttgcagcttccacactcgtgatggccccctagtcccactttctctctcaaatgtctttttctcattcctttgactctgctggacttcgtcgcccccactacctggtgttgggtctgatcaccccaacattcctgcctcagcctctcaaatagctaggattacaggcacgcgccaccacgcatggctaatttttgtatttttagtggagatgggggtttcatcatgttggccagtctggtctcgaactcctgacctcaagtgatctgcccacctcagcctcccaaagtgctgggattacaggtgtgagccaccgtgcctgaccccaactgctattttttaaaaatatggttatttttcatgaaccactgatggaattgtaatacacgcatatctctttgcaaagttattagaatgtatttgtttttccctctgtttttcttttaaaatattcccaaatcatttacatctaattattaatgttctgtattatgtgtaaagatgaaaaattgtaaaaatgtaaatggccaatagtcttttataatgtgtttaatatataaaatgctttgtgcttcttgctttttagaaaaataccattaaatgcaaatggaccaaggaatacaaaaactttataattttatccatttacaggcatcattaacacattggtgtttgttcctttatgtttttttgatgtacatatgtatatacatatatgtacatacacacatatacatataggatattatgatcctagtttactgaaagaatacacatatgtatacatataaaaatacataagaatacacacacatatatacacacatatgcatacacatacatatgtgtgtgtattctatgtattcatatatgtatatgtgtgtgtgtattcttccagcaaactaggatcatgccatcctatagctttgtaatccatttttttgtcattagccagccattaagaatttttttgttttaaccattttctattttaaacatcatacaacagaaagagtaggataaaaatatcataatgatcaggtaaaattatttaaagagatatatttttttctttgcatcatcatctcctttttctcttttcttattcgttaaatctttgtttttacaaatccctgtgctaagggctgatactcggtagactgcagggaggaaactgctctgccacttaaaaaacactgaccaagaagcaggtcatctacactagttcctcacaaatgtcctttgtatggcaggaaggaagatatgtatgtttttaagtgaatacatacacatctataaattgttgtaaaataacccccagagaacaccaacattaccaaagcttgaaagatagtttctaaataacattcacatttaaaaggcttttgttttgtttgagatggagtctcactctcttgcccaggctggagcgcaatggtgtgatcttggctcaccaccacctccgcctcccaggttcaagcgattctcctgcctcagcctcccgagtagctgggattacaggtgtgtgtcactgcacccggctaatttttgtatttttagtagagacgggctttcaccatgttggccaggctggtcttgaactcctgacctcaggtgatctgccctcctcggcatcccaaagttctgggattacaggcgtgagccactgtgcctggcctgtttttgtaaaaaaacaaaacaaaacaaaacaaaacaaactggtttgtttttatttgatttggccaaaaaatagcactgctcaatctgtctttaacttacttgcctttggccaacttgctctaaaccaaattgttcttcagccaaatctgcaggggctgacactgacaactactggggcgattaaatgcaggttgagttttgtactgaaaaggagtaagagacagaagactatatttgaggaagatctgggaaatgtaagaaatcatctgaaagttgactcagtgccctgctctgttttacaccctttaacaaagagggtatcataaaaatttcttaattctggtagttagaaagaataaaagtcattccgtgggtgccatttctaaaccatggaagattaaattaatgaccccaaatcacacagttggtgagcagaacatatagtctttaactccaagcccccatgcagagttcgccaaaaaactgactgtactgagaaaagtatgtggtgggctgaagattattatcaggttccttggttcagaaacagataatacctgtactgaacagatagctttcattaaaaattacaatctaatatttctcacatttttccctctgtgtagatactgttaagtccagtaggaattagattaagacaagcagctttatctctacacctctttttcaggacaaagcagaagacaaaactggcaggacacagagttgcttgtatccttattagtgatgctacttcattaaatttcatgttgaaagataattcaatgatttaattgcatttaatgctaatcagacccttataaatgtaggtgagatacacattctcattgtattatttttcatttctcattagttacccctaattttcatgatgattactaacataatataccattaatactctcaggaggtggcagaaaagattatgtgtcatgctgtgattcattaatgccagagaaagagctgcttcgtttttcaatattttataggtaattcattctttaataatgaaaaataaattttctgccattcagaactttctatcaatacatttactttgaaaaatggcaatgttgaccatacctatatacaatggggtacttatggtctctctataaacattcttaacttgctggcctttcccaggctgggcttattttttatatagattgtgccccctccttctaaagaaaacttatttaataaatttcactgccttttcccttttttcctactttaattaagagaacttcaagatttatttccacttagcagatgtacattaattagtataatataatttcactccattttatgatatactgtggtataaggaccaaaaaaccttcaatatgccttttaaaaaaaagaaatattattttaaaaactgttctctggataaatttatactgatactgcttgaagactgtttgaagtgtttccagctgtgctgttagggtttgtttctcaggacttcatgcctgtacatatagagataattatttattttttcttaagcttaccatactcccagaaagaaaaatatcaagctacagataaccattgacaacaagaaaattctatgcaaaaatactttataacatggtgctaagataatactactcatttaaaacatataaatatgcctcacacattttaatctggtcagtattcatataagagaaccaactatctcatttaacatatacaaggatttagaaaagttatattgagtattcctcagtggaataatattttcatgtaaataatacactaaggtgtatctcaaagagaactcatctggtgacttaatggaggaatctattatgttgtattcagcttcttataattattccttattctactattaagaagacaaattagcattctatactaatgctgaaggtgaattctggaaagagaggcccagtattcagttttaagggcaaagaaaaatggctgtgtgttcaataaaactgtgtttttaataacatgtatgcactgtgcatgctgtttgaaacattttgattttgagattactatcatcttacagggaaaaagaacaactcaggtaacaggtaacaatgactattgagagatctattgagagaatgtctatttagagaatgtctaagttcagagagaggaacgaaccgtgctcagtgctttatgtgcattttctcatttatattcagataaaattcattagctagtgttgtcatcactctgcagacctgttgcttacagaaattaagaaacctgtccactcctggttacacagcccactcatggttaaataaaacctcacatttgtccttattatgcttttggaaaacggttagacttaaatatatcaaaactttatttttataatgtcctttatatattatattcattaacctttctttcacagtcttccgatttagcatacccataacatttggttaaactttaatcaacattgacttaaataaaatgttcttgtagtaattcctatcatgacttcatgtttttggggcaggagctgctagtcgtttcctgcccacatgtatgcctcttttttttttttttttttttttttttggcacctttgggctcagccgcatcttacactcatatcttagctctgaaccagaatattgagcccaaaaagagcccattcctcaaaagaggttgtttcagtatcaactggtcttgttctattcaaatgttacttaatctcaaagtgaatatgttcagagctcactgccttctgggtctggaagccacactgtttactttttcctatgatgtttgttctctgctgagtgtcgaaatccctccaactgccttttctaagatgcaggctgttccctttcacttatttttattgcccattttgggctctttatcaacgccctatattataaaacatcagcaaggactgtgtctgtgcttacgtttttgaaggatttatgaatctgtttttgacatgttggcatgattatgcaattttttcaggtccaaatgatactatactagctcatgatcctggattctgaaaccaagaaccaaagtaaacacatatgctagttcatactgactttcattctccctaccaccctgtctttcagatccaacctaaggtatttgattactggcacctctcagctactaccacctgtaatatagtatttcgtcttcctaaaacatgcattcttgctataaatgacaagaacactatgtggcattgttttaccaagcattaaatatcgagaattccttaacattaagtaaagagaagactaatatttagatggaataaactatgctaaccaataagaaaaatactagcttatccccttttgtcagaattattttatcttccatgaagaataacttaaaattaacagaaagttgaataatctttttccttttccttttaatttcaagcttgttaaacatttttagaaatgtaatatacatttctaaaattgtgtctctacagcttcacgtttcttctttgtttctacagtactctcatgaaaattcaattctcttccctgtatttttaaaaactcattaaacaggtcgggcacggtggctcacgcctgtaatcccagcactttgggaggccgaggcgggcggatcacgaggtcaggagatccagaccatcctgactaacacgggtgaaaccccgtctctactaaaaatacgaaaaattagccgggcgtggtggcacatgcctgtagtcccagatactcgggaggccaaggcaggagaatggcgtgaacccgggaggcgtagcttgcagtgagccaagatcgcgccaccgcactccagcctgggcgacagagcaagactccatctccaaaaaataaaaataaaaaacaaaaaacaaaaaaacaaaaactaactcctaaaacataggtaataaaagaatacaggatcttcaaaaaaagaaaacagtcattaaaaactacagaaatactataataatttgacatctactccttaatttggcagtgccatacaccatgggttgtaagaaagaagagaatatatagtttaaaaaatgctattaatacttttctccagcccctaacccaacccactcatgcagtttttcttcatagaagaagagattttgctggtttgtttaaacacagaccaaaaatatgttcacctctgctcaatattgtatagctgacattctctttaaatatatctgtagaccaattggatacaaataaacattccaacactatatatacatatatatatatatatatgtatatatgtacgtatatatatgtacgtatatatatatacgtatatatacatatatatatatattccatatcagttgtttggggtttcttaatattacaaatttgtcttacaaattacataggagtagaaattctaggtaaggagatatgcataagttcagatgtaatagatagataatatcaaactttttccaaaatgtcttactaatttttatcccctcagcaatatctgagaacttcagtcgcttcacaatttgattttgtctgttttttttttttttttttttttagtcattgtgatgaacatgtgttggtttcttatggtttgttttcaattccctagcagttaagtttgatatatatatatatatatatatatatatatatatatatatctcctgtggaaattgataagctgattctaaaccttatttggtaatgagcacacagagagagccaagagaagccaacaaaccttgaagacaaaaaaataagcagaagacttacactatcagatattataaaactatagtaattcagatagcagaatgatgcaaagacaaacaggtcaatgaaatagaataaagtattcagaaataagcctttacatccatgaccatttgacttagaacagagagaacacgtcaagtagagtggagaaaaaaaatggtctctttagaaaatgatgctggtcaattaaatatccacatgggaaataaaaaaaaaaaaatcttgacctcctacatcactccaaacacacaaaaaaatcccatatggactgtaaatctaaacataaaatatgaaataaaatttttggaaataaacttaaaaaagtcatgtttttgtgttactcaaagagcttttaaacaagacaaaaagttgctcaacatgaaaaaataataaattgtattaaaagtttctgctcatgaaaaagcataaaaaatagggtgaaaatgcaagccataccttgggagacgatatatccaatacatatattgaataaagatatgcaatccagagtatataaagaattctaaagacttaatgagaaaacaaaacaaacaacagaatgtccagagaaaaatgttagaaagagaccaaaatagtcgccacataaagaggatacaaatactggcaaaaaatatataaagagacatttgactatcttaactactagggaatggtaaacgaagcacaagaaaccatcacatgttcatcacagtgactaaaaaaaaaaatcagacaaaatcaaattgtgaagcaactgaagttctcagatactgctgaggggatataaattagtaaaacatttttgaaaacagtttgatattatctatctattaagtctgaacttatgaatatccccttacctagaatttctactcctaagtatatttgtaatattaagaaaccccaaacaacttatatggacagtatataggatatattaactgtaatatatttgtacaatgaaattctctagagcaatgaaaatgaatcaattattactacatgcaataataacatagatgaatctcacaaatatagtgtgagaaaatgaatctaaacaaaaaatacaattttcctaagtctataaaaatatcgtaaacaagaaaaacaaatttatggttggaagtcatactagttattcttacggggatgtggagcaggaactggtaatgctctgtttcttgacctgggcactggttacactaccgtgttcactttgtaaatatttatctagctgcacacttagaatctgtgtgattttgcatatgcaggttgcattatgtatgcagcttgtaataaaaattatacatcaaaaatattcttttaggctgggcacagtggctcatgcctgtaatcccagcactttggaaggccgatgcaggcggatcacaaggtcaggagatcgagaccatcctggctaatacggtgaaacaccatctctactaaaaatacaaaaaattagctagacttggtggcacatgcctgtagtcccagctactcgggaggctgaggcaggagaatcgcttgaacctggaggcggaggttgcagtgagctgagatggtgccactgcatgtccagcctgggcgacagagtgagacactgtctcaaaaaaaagaacaaaaaaattcttttgatatcagcattcaacatatcttggggtctattggcttcaggtgttgatagtctttcaaattactatgagcctcactgacttttgtccttttctagattactgggtttctaagagaccataaatgtctagggggagaaatcctggaaatgagtaaaatgaaacattattaaagagagaattatctttataaaaactagtgtagctaccacataaagtttctggatcaacttgatggagatgcctagtttagatgttatttttgttcactagaatgcatttttgtgaatccaggcatttcattgcctgtttttgaaaaaaaaggaaaaataaaaaaattttaaagtctctgcaattctcagattttcagtgaattacaactaaccagtgcaaattgtattctctttatgcataaaatctctctccaggcctgcgggtttcccttaaggtaaattaattgaaactaataggaagaatcatttatttcttatggcttatttggaactaaactttcttcataacgcattttaaggaactcttgtactttaccgttcttattggaaatattgatagacaattcaaaattaagatacatttatagaagtatgaataaacaatttttaaaagctcattttcctcattttttccccttatattcgtgttatagatctcctgtgtcaggtcagtacagcacaaagttaatggaggttcaagacattacaggacatcttcagacaaaagtaatttttatttgcccaatttatcttctgaattgtgccttgcaatgcagccttcactttcagaaaaattctgagattttcaaagggagaaccaaatgtcagtattcttgctctacagatgatggaggatgtggcctttgaaacataatataggagagtacacacaatcatcactactctaaaacttataaaacctcctaaaagtaaatgcaagcttacctccaaaaatagtattccatacctataccttggattgttacacatttaatcatctgagagatacaaagacatttaataaatttctaatactgctagagtgcactcaaactttaaaatatatgagccaccagcaagtttaggaaaggcaaaattatttggccatttaccaaataaactactttattttcatgtatcatgtccaatggctcttcaaattcataaaaagtccttaaactctctactttaaaaataaagtatccaggctggtcgttgtggctcatgcctgtaatcccagcattttgggaggccaaggtaggcagactgcctgaggtcagggtttcgagaccagtctggccaacatggtgaaaccctgtctttactaaaaataaaaaaaaaaaaaaaatacaaaaaagttagctgggtgtggctttcacctgtaatcccagctacttgggatgctgaggcaggggaattgcttgaaccagggaggtgaaggttgcagtgagccgagatcatgccaatgcactccaccctgggtgacagagcaacactccatatcaaaacaaacaaacaaaaaagtttccagttatcagagcagctttacatctatgttttttttttttttttttttttttccaagacagagtctctgtcgcccaggccggagtgccgtggtggcatcttggctcactgcaacctcagacgcctggattcaagcaattctcctgcctcagcctcttgagtagctgggattacaggcgcctgccactgcacccggctaattttttgtagtttttagtagagactgggtttcaccatcttggccaggctggtcttgaactcctgacctcgtgatccacccgccccggcctcccaaagttctgggattacaggcgtgagccactgggaccggcctcatcgattttgaaacatccaagcttccctcattcttcagataattatagtctgggaaaagtagtccgatttctattataagtaatacgaattaaagcaatttttaattaaattacattcaaattaataggcataaattgtttgctaggagaatgatattttttggtgtcccttctacaataacaaacaaactgatttgtgtggagagggggaagaagagtaaaacatatgcagaattatttcattgtatactcaactgacatctaaaatagacttcatcttgtccacttatattaaaagaacataacaagaatgttttacttgttcagactaataaggagaaatgctatgtatcagcaactggtaatgttttttatggttctcaactagtacaggagaaaatgcaggattagactatttgaaacggaatatcaagtttcagttatataggaggaataaggtaaagggatatattgtacaacatggtgactatagtaacagcgatatattctttaaaaataaaatacagaatacagtgtagaaacagaatagatttttttgtaatcatctgtctgcatttgtgccacagaatttcaaaatgaatgtgaagtattttctaaaaatatatgatataatctaaaaataattgaaagaaaagatgatagagagtaaacgtaaaatatataaaggaaatcagagaaagtcagtataccacaatttgtattgcattcatcttctaaaattgccaaagatggatcaaatatttgactttgagtgtcggtggaaaaaaacaaaaggaaaatattaagtacagtatagcctgtgatcatataacaaaaatagcccagttgttcaggaaaaaaaaaatcttcacatttgatgtcaccagtgaggctaaataaatgtaaaactatgatacatggataacattcataaagctgtcatcaagtctgagtttctaatttggcaagaagtgaaacccacagggaagtccagggtgatgttattctgtgttgtaatcagcccaaaagagtttaatgtaaaatgtattttactaatttgaaatgatcattcatgcaacatatgttaaacaggttaaaagacatgagtatatgtaaaaataaataaataaaattttaagaagtcattatatgaaaaaggtacttgcacacacgtttatagcagcacaatttgcaattgcaaaaaatctggaactagcctaaatgcccatcaaccaatgagtggataaagaaaatgtggtatatatacaccattgaatactagtcagccataaaaaggattgaaataatggcatttacagcaacctggatggagttggaggccattattctaagtgaagtaactcaggaatggaaaaccaaatactgtatgttctcatctgcaagtgggagctaagctatgaggacgcaaaggcataagaataatacaatgaattttggggactcgggggacagagtgggaggaaggtgaggggtaaaagactacacaatgggtacagtgtatgctgcttagatgacaggtgcaccaaaatctcagaaatcatcactaaagaacttatccatgtagccaaaaaccacttgttctccccaaaatacttttttgctaaactttttttaaaacccaggggtacaagtgcaggtttgctatatgggtaaacttgtgtcaggggggtttgttgtacccaaaaattattgaaataaaataaactaaattaaaatcaataaataaaattttaaacaaacaccaatttgaaatgttaagcccaatatataatgtctttaagttgatgggaaaacataatgtctgcttagatgaaatttaaattctagtaggaaaatcatgcacacagataaacgataacagtataattggtttaagtgctaaactagacatatagtgattcagttacagggtcatagtcaagaaggcaatgcaccctcagacacctacatatgtttgctttgttcaaagtacaaaccacacaaggtcaaacaccgtgccaaaacatgaaggaaaccagacgagatcgggcgcattcagggtggtatggccatagatggaaggaaaccagtgattagtaagaccttgtgaaaacacctctcccttgaaaccatgagagagtttcctcatacttggcaatggggaaccaaaattagtgttttattggacctttacttcaggctggttcttgtttgcatctgttctatatgtaactaggaagaaaattgtcacaaaataactcactagctttcaagtaacataaaccacaaatactgtaaaacataaatggtgattttgatttcagaactaagtaatctacgctatttgacctctaaaatgtggttctcaagtataacagttgtcacaggacacttgacattgtaacagtaaataacacataaataagcaaaccatcagcttaaagattttaaagggcacctgcttctacagcaatatttatgtgagaagatatctgtggcacagagtgatggagcataaagtctcacagagagataagagcatgcccagaactaaatccaggtgattagaatgtcagtccagtgctcttccactggaaacgtggttgagcttggtctcggaagcagaatgccaggctgtaaattgtagcctcactcccaattagctgcacatgttgggaaggttacttattgctcctgtgatgcactgttctctgtaaattaaagagatgctacttggggaaaatacattaaaaattcagaaatgtgctggagatgttttacctaagacccaggtgagcaggtatagggctagagaccaggagcccccaggagcccccaggagccctaacctctgtctagaaacattatgtattaccctacattgttaaccttgtacatttctataccttttgctactaaggaaatttgcatcctctgaccatgactgtggcttttttctatctacggcatcactctgctgaaacctctcatcaccagtttgtgcttttgaaaatgtaataaacaatcagccattaagtgttaagtcttttttcttgctgctttttcacaatattattttcttttagtccataaatttcttaaatttggcatctttaataattcaaaaatagaatattcaaaatctttttaactttcagtagagatcaaatcaacattataactcaattcttctgacactgtttttccatatgtgcaacttgtaaagaatgagattaatcctcactgcattaacttctggaaaatatcttcataattcagagttttttaaaattaatcttgatcacatttaacatctccctgtatttgcaataaatgctatttttgcagttaagacaacatgcaataaactggaaaaattagttaacaatttgaaaagtgtttttaaaatcaaatcttacttgttaccttaacagggggtgtcacaatttacacagttcatctcaagttgaaaagaaatcggttgcctttttacttgtctcctaatttttcacagaaagttagtatgttctcttattttctagcaggattctacgcctcatttctcctgggaagcaatgtaagaggttacaagaaaagttcttgaactgaggtagacctaactttaaattccaacttcactgggtatttggctgagtaatactaggaaagttatccagacttactgagcttcaattttcccaaaagtgcaataagaaataattgcatctactgcataaatcaatgtttaaatttacttgttttattttaattgatattattttatttattcattttatttatttatttaaagagtgtaggctaaaataagtaaatgacatttcacagttctcagaaaaataataatgacaaataaaccacagttattattatgaattagggaatatttatccattaacatttcttcaaagcccagcagaaacaaaaagttaatgttcaaaggcctagcttcaactttccttcttcacacaaaaaattacaaatattacaagtattcatcactttttctatttcttttttgttgactacatagttgcttttttacagttctttctatattctggatactgctcctttgagatatatattttttaatagatgtcgtgagtatttgcttttaacatattgcttcactcagtcatttatagcacccttgttgcaggagtctgctattctgatgtaaccatattcatcagtcatttttcattagtgtaggacaggggtccccaaccctcaggccatggacaactaccagtcggtgacctgttaagaactgggccacacagcaggaagtgagtggtgggtgactgagtgaagcttcatttgtattaatagctactcttcatggctcacataacctcctgagctctgcctcctgtaagatcagtggcagcatcaggttcttataggaacataaaccctatcgtgacctgcgcatgaaagggttccaggttgcacaaaccttatgagaacctaatgcctgatgatctgtcactgtctctcatcacacccagatgggaccatctagtttcagaaaaacaagatcagggcttccactgattctacattatggcgagttttatcattatttcattatatattacgatgtaataataatagaaataaagtgcataataaatgtgatgcacttcagtcatccccaaaccatccccctctgcactcctgtctgtgaaaaaattgttttccacaaaaccaggccctggtgccaaaaaggttggggaccgctggtgtaggacatttcagttaatgatgttcaactaatggcctgccctagagaaggaggactcagaattgtggggaggctttttcaacatacaaggtaatgcagattctatatggcctcctgacaggctgagaggattagcatgttcccacaatgcacatcactcccatattgttgcaactggtgttttatgaaataaaatgtttaaaaacgcagtacatagtcaagaaaaataaattgactaatataaatctttacttctgaatttgaacataagcttcacattcataagagcttcaaaggaatgaattaaattaaatatagtttaaaaaattttaaagtttaaaacattttataaattaaaaatagtttaaaaaaggtgttcacattctttcaataaaagtgatgccctctctcctctttttctttactgtggtaaaatgtacgtaacacaaaagttagcatttcaaccacttttcagtgtacagttcattgacattaagtgtattcacattgttctgcaaataccactgccattcatgctcaaaacgtcttcttcttcccaaacggtaacagagtagccattaaacaacagcttcccatttacctcctcccacttcacccctaaaccctggcagccaatattctgctttctgtctttatgaatttgcctactctaggtaagtagagtcatacaatatttgcccatgtctaggttatttcacagagcatgatgtcctcattaatccatgatgtaacatgtattagaatttatttccctttaggactaaataatattccattgtatgtgtatatcacattttgtttattcattcatctatagatgaacatatgtgttgtttcttttccctttttttttttttttttttttttttgagacagagtctcgctctgtcgcccaggctggagtgcagtggcgtgatttcggctcactgcaagctccgcctcctgggttcatgccaatctcctgcctcagcctcccgagtagctgggactacaggtgcccaccaccacgcctggctaattttttgtatttttagtagagacgggggtttcaccgtgttagccaggatggtctggatctcctgacctcgtgatccgcccgcctcggcctcccaaagtgctgggattacaggcatgagccaccgcacccggccccatatgggttgtttctaatttttagttgttgtaaatagcacttctatgaacatgggtgtacaaatacatgatcaagtctttggtttcaattattttaagtatatagtaagagttatattttaactgatattaactaattgttttaaagactaaagaaaaacgaattaccattggattttcttttcgcactcctcataattaaaatgactgattacttgtcactaacggaaatcaacttcgtagaaccagttgtgacacagatacccagcatgaaaccatagtaaatatagatcttctcagataactttttgttctgtgcacttttgatacaattcatgtacttaaatgtgacatgagccttcaaattattgagccagaaatcaagtatctacatgtctgtatatatctttgtcctagaaaatcctcaggagacctcccttaacaatcactgctcaaaaatgactcacatatccacgtgcaaaccaatcatttgcaaaggtaacaggacaggcatgattggctctgaccagccatttttcaccactttggaataggcttcacttcccctgaagcacatgatccccaaaaataatacctaaataaaactgaaattctgttaaagtgtgaggtaggagaaatagccaactaatggtgtctactatactcagacaatgtgagtatattaaaaccagagacttcacctaaattaactcagtggtacaaacagaataatttaaaactcaccttcacctaaatttcagataattatattattttccactcactatagtataaacatgaactgaaactaaattaggtattttgtccatctagatttaattataacatatgtttttatttatttactttttttcgggggggggtggtctagtttactagaatgtggcttctgtaagggtagagagagcctatttttgttgcttccatattttcagtacagagtaagaacacagtatatattttctttaaaaaaatgaacttagaacctaagtttttaagtatattaggtataccacttcagagcagatatacaattgtctttattatgttattacttatattggataattcacttcaacaatgtttttattgtgtcactttacctgtagcatattttaaaaataatgccccaaattcactactcatcttttaagctaatatagccttattcactgctatttcaaagtcttatcttactttgtcaatcttattctatgtcacatttcttctttcccttcttacacaaagcacatatttacatttaacttttatcattctgcgttatatcatggaccaaaaaaaattaacttgtatgcatggtagatgatctaccattacctaatattgtatagcaattggtagaaacacctctttcacaatcatgggctacttcccatttttaaaatcatctttccttccttcaaacaccacagctgaactggtcctgattcagtgctgtttgcattaatatttttgttgctctaagtataaaatgagaagaactgcttaactcatgctctgattaaattctggaaaggagatttcaggcttcaaggctaaaggcagcaactggaattgttaaacattaagtatttattactcccttccgctcgtaaatcccttgcctcctatcactcagatacgctctgcactttgtttcttctgagttttggcttacttagtttgtttcctctacttagactgtgtcttcctcacatatgtttcactttggaaaaaaaaatctaaccacccttcagtgctagtcttaaattcttcatcctccaggaaacctttatgttcattcaccaactgaaatgttttcttcctttgaatccacaagacaatttgcgctctgctacttgactttattattatagcatacacttgcataaacacattctttctctctctctctaaactttctctctctctctctctctctctccccccctctctctgtctgtctctctctcccctctttctctcactattgtataaagtacctagtatattatattgcatgaagttggtttcctagaaaggacccctttccctagtctgaattacccactgatagtttgaagggggagggttccttagagttctcagtagtctggagacacaatcaatcccaacactgtatacttcatctgaagaagtccatgcattctgtccagggcatatgtcctcaccctgatgcttctttcaatgcaatgtctttacacaccttattaagactcagtttctcacctgacttttacactactaccaaactttcgccagaatcccttggaaatcacagaccatcatcaacaaaatcccctaaatgttcaactttccctctgagtattacctatactttttgattccttctttctccctctaaccatcctcgacaaaagatgctgctttctgtagatctcccagtagtggctaccataatttacatagcacagagcccaggagtacagggcaagcatccttctgtctcctttgacactctgtcccaattcctctgaagtaaatcccatcagataatgccacccactaaatttccttgttatagtcatcacatgccttttgagtaatctcctttattaatggactagtttaacatttggcttatctttttttcctacatcacactataggattagtaacataagtggtgatgtaaaaatccacaagggcattctaatcacagtagcatctgacagtcaacgatcctcttttatcaatcttgttctttccatggttcagggaccttgcattttccctgtattcctgtcacctcatggcagcaacatctcagtatccccaaacccttcttctcctgatctctaagtgctgaaattcccaaagcttagtcttcgtattttttttgtcaaacccattttcagggtgatttcatcttggccccttatttctctctcaagtctagatcagcatttgcaaatgccttgccaagaattaggtttctgtattgaaaaagcctcccaaaccttgattactgccatcacaataggcagtggaggaggtatggggatctgttcaggacaaaaaccaccaagtcattcttgatttttcctaatgtcccatgtatgattcatcggcaaatcctatatgttctatcctttaacccccttctcaaggtctccatagcctatcaacgtcgttcaagctaccgtcaaatttttcctggactcgtcatgcattaaactctacttgtccaaaacactgtgttacccattcccaacatcccccatgcagcatctacaataatctttttatattggatgatgtcataactgtttaaatcattcaaaggctttctttccaacacacctagaacgaatcccatattctagccccaggtacatttctgatctcatttcctaccagactttttcattcacactagcctccagctccctgtctacctttagggctttacagagaaatcccagaatgctgctcacttaagaatccatgtcttgatcttttcctttattcaggtcactgtttcagttttatccaaaaagaactatcttaactttcttatctaaaattgcaccactctcattcttcccttatcaaacttttttgtttccttagaatttatcactacataacttactcatctattcatttcttcaactagtttgtctgcattactcgggtggaaactttgtttgtttgtttgctttgtcaattgctctatatcaaacttctagaacagtgtttagcacattataggtactcaaacatatttgactaaatgatagaactaaatcaattaagagttaatgagactaaaatataaaataagataaaaatcagctacaaaggattcctacttgtggataacaacataaattaaatgtaatgaatgacagatttgtggactacttttagttaaactggtgattcaggtcaggggtctgtacttagcatagtggaagagctattttgcaagcccaacccaattaggttgaattttttttcttactgagagtgtttgataggtgataaaactacacgtaagaagagctctaatcatggtgctcctggtaataggaaaagaaaggcaattactcatgtgcaaaactagaagcaatcaaaagctagatttgccagagatgtttaggttttatgtgcaatttacagctatttacaagttaaccattgaaatgctgtccaaaattaactccgcaattgagaatccaaaatgtttagcatctaaactttttcctcagtaaaattcaatctttaaaattttttcttagtaataaaacattagtaatacacagttgattagaaatagtcataaacatttgattataaactattataagagtaattagtaataaacatttgatgataaataaagaaaaaaattgaaaacttacaactttggtcttagatactgcatttttgaaattccaagtaagccaacattctctgagacatcaaggtttttgtaacttttagtaaagtactaaaactggtagtgttatttttttactttcattcaatcagcatttaaaattcacaatttcagaaaaaaatggttaatttattccactatttcttctattagaagtggtaattttatatttgtcattagagatttcattttgagaatcttttgagttatcctactggaggaatacaaaccattaagaaaagatatacatttcaacatcttattcaatgtaaaacatcgtaagtattttgttaccattttcatagtaaaatgaaactcaagaagttgcttagtgtttacctgatataatctgtattgagtttagataactaaactaatatagctccaagtttcaggcttttgtttatacagcataagtatgcagttaatgcaaactacaggcttacagcttatctgcaaaacctgagcttttactttagttctgtatattaacataattccgcataccttcactctgagtacagaagtaaacattcttgcatcttcagatacacctccgatgtagaattttttctgaaacactgggggatgattattttcatcctgaatctcaatgtatactttagctgtattgcctggaggacaagaaacgatgcattttttattggtggttattcatgggggaaaaaatgcactgaagtaaatatttgctgcacttttttttggaaacattgaaaataaatcaaaagccatttctagatgccatgcctagcacccccaaattcaggggacactgataatgatgcttctggtataaaaatgttaagttgctgttatttcttttaattacaatgtcctggtagttcactttacttgatttaatttggcactaaaatactgcaccctgttaattttaatgaaacaactctactgttcacgttcacaaacacttcacacacaataccagttataccaaagggacacaaatatataaaccccttatgaaatagtagaaactgccataaactattatatgaatatatatttattcttaagtataaaatcagcaatggcatttctttagcttaaaattgtacaataacttttatgttttaagactaaaagtaacagtgttcgggtgaggtgtttatttccacaaatggaaaacaagttttatcatgccttggaaactgtcaatgttagaggctaacattcattgaaaacaatggagctgaagatatgattatgactcataaatgctgcattttaccatttaaataacagtaaatgtaccataaatgatatgtcatcatcaaatgttagaacctccctcaaatcatcacacctttaatgagaaatgtggtacttgtcactagtccaataatgaccttttaaaaaacaatttaatatgtataaaaataacttataaaccaaataaaatgggaaataagtggctattcattttgtaaaaaaatagtcaaataagtattgctaatgtattacataagtcgacttttctgattcatttcagttatgaacaaacggcaattaacgtacatactatttatcaaggatgcccttattttggtgttttacctgtgtttaatgcctcctgtacaattttaagtaattaacaccagcctacttgcaggatacatcatgggtatacatttgtatttgttgaataaattaatgaatgaatagcttgtattagtaagaacttagaaatagtcttttttttttttttgcttgcccttggaaaggtcagacagaacagtgagttaacctcaagattttgctcctatcctgctgctactcattcagcttttctctgtttgtcatctgtgacctggaagaggtagaatcaagaggaaaatcatgctagcgcaacagattagagaaccaacagcgaaatagggctaatagcagattatgcttctctatcctgcagtgccagggctctgacttgtaccttagtcagccaccacaaatcagaattcacccaaaatgaaatcatttttagttcagtagcagaccacttttatctctagaataaaaaatgcgaacagctctaaatttaaaaataaaaaggaattttagaatatgtcacctttccaataacttctttgcactttcattcagaaacatatacaattcaaatgtgctatttcttttcagaactcttagagtgacagaggtctcggaaaaatactgatgacgtatattttcttctttaaatgggatgagtcatttaaaatgttatacaatttgcaaagaacaagaactttgtcatgacctgttcccttacctcccaaccctaacttcatatctggatggtaaccaaatcctacatgtcagcctcataagcaggtaaatcatcacctaataaatatatcttgtgtcatttttctctcaactccacagctgcccatatacttaagtctgttgttgtctcacctgagtgactaaacgtcatctgctcccctgtcgtgtctttctaatgtgtcctgcattctgatataacaaagacatcacaaaatacaaataggatacattaaatcaaatgttaaaccaaccaccattcatatgtacatttttttctttttcttgttttttgagatggagtctccctctgtcgcccaggctggagtgcagtggcacgatctcggctcactgtaagctccacctcccgagttcatgccattctcctgcctcagcgtccctaatggctgtgactacaggcatgcgccaccatggctggctaattttttgtgtttttttagtagagacgggatttctccatattggtgaggcttgtctcgaactcctgacctcaggtgattcacccacctcggcctcccaaagttctgggattacaggcatgagccaccatgcctggccgacaattcttaaaaataccatgtgtatattcatatccatacttatatgtatactttgtgcatataagtttaagattcaaataccaaattgttcctatgaaagctcctttgattcagtggcctgtatcagatattaagtggtttgtgggaaaaggcctatggataacccaaaatatgattatataacctgaacataatggggagagatgattatacttaattataatattttaattaaatgatatttatttatatgaaaactaatgactatacaatacaaaattccagaatacttcacaaccagcacacaaacaaaatctcaagaacattgtttagacttaaaagaacttatacatttatttattttaaaaagccacgatcatttagttcttttcacaaaagagaaacagttataatgcgatttataacaatactgtatcatgaattttgaaatttatgatgttagctatatagctaattatgtaggatagtttgtaatagtcaactaaaaataaatataaagttgtgaaaaaggtgttttcattaagtttgtgacttagatgttagaataaaaaaaattgttaacttttattttccataatgtaaaatagactagtcttcctttttttttgcttctccctgataactttaggcagttgttatgtatccctcctttgaaatgctatagtgcactaaaaatgtttctttctataaataacctttccagagcttggtttacattgcatttagttataagcatgattttattcttattagatttcaatattcttaaagatggaaattgtatctcctacatctatcagtactataatgcctcagtttgtaggtaatttttccgctcagatattattgtaacaaaatttcttaatttttgttgaacaaaaaagttgatattcaattaatttgttagctttctttgattataatcatgagattatgattaactgaaacaaaaagttaactcttagaaggatatgagggagctcactaaatcaaagtgaagtaagtccaaagaaggcttttggtaccacaaaataatcaggaagttgtagagcctttaaagcagcagatgtttgattttcttgcagatgaaataacagcaaactctcttcttttatgttattttaccccaccccttattcctctttttttttttttaaagaaacaaaccaaaaaacaacccactaggcttaagaatcataccctggggacacattacctgactgtcctagtttgggtcatgtgcttgctccttgtctcgggaaggagaagtcaccagattatccacttgagaagtcactgggacaattataagaaattgtagtgtgtctacttaaagaatgtaaaataaatgttggccagtaagaaaaggaaaagcaaataagtatacacctatagttaaatcactagaacagcgttctttttgacttttttattcatgtgtatacaatgtacatgacatcatcaatttccttggctcacgtgcttccccactaaggattgtaccatgttcttccaccaaatttggatattgattatttcaaggcagaagcttggaagcaactctgatttaaattcttttaagatagcctgctttttatctccttgagtacttacaaaaactttttttccatgttgtatcctttatttaatgtagacatcaaacacataacaaaagaaagatactagaaagagaaaggaaagcacagatagaaaaataatgttaagggaacaacgtgcgtgcctaatatcctagtattcccctccagtctcccttctggctcatctaaacaatgcaagtattggaaagagaaccacaaacagtgaaagaaattacaaagtaggcaaaaaagttatttggaaagtgttttggttaagagacattataatttttctgtgtgctttggggcaccctgccttatttttcttccattattaacttttttctccaattttctatgggacaatcttttctttggctagaacttttggctttagtaagccagaagttttaaaaatgactcctgaggtaagaaaatgtgagataccttcttgcaatgttttaaagaaagagaaaataatacttttatgtagtcaagctcaggggaaaatgtaagtcttagtatagttacctccttgaatagcacttctgttctattttagacatttaaacatggtagaaggagttcagaagagtgattttaaatacccattaacctcaacttgactctatgatttttaagaccaaatttagtttgatttttcccttcccttacttttaataatcaagactgtgatgctagttttttctttttaggaaggccctattatcctcaagatgaatccatttcatttatccacatgactaatctagtgcctacactgcactggattttcaaagaaagccttactgaataagaagccaatgagttaaaagtgttctcaactgggatcaatttggctgctctagagccatttttggtagtcacaacagtgtggataggggaacgtagtgctactggaattaaatgagtagaggtcaggaatgctgagaaatattctgtgatgaacagaacaggctcttaccccaaacgaacaaacaaacaaacaaaatatttgggccaaaatgccattagtgatgaggctgagaaaccccaagttaaataacaagagaaagaggaattagatgagttaagataaaatggaaagtttccaaatgctatagtaataccctctcctcaatccatctgcatgcacatgcctttaatgtggaacttatcaaaatatgctgtaattatttgatcacacattggttatactcttttttgactgtgtcctataaagtcaagggctcaagcctgtttacctccactcttgtcactgccttctggcctctgttcctgacattctctccatctaaaatattcttaattccaagccatttctctagtcattgccagtaaatatacatcacagaaatatttattcctgtacttgggaatgtagaagtttagtctgattaaaaaacatacactagactatattttcctcaaaccttaaaggaaaggactgtgcttttcttattgttacgtatcgttgcctaacacattaaatgatttttaaaattgttatcatgataaatgatttatagattcttcaaacagtcctattgcagagaattttttaaatgcttggaataccagatttatatttgttaatttgttggtatcaggagattgaagtcagttcctcactttaaaaacacacaaacaattttttatgctgtttttcttttaagacaatttttgtttaagctttacgggtatattaattatggaagcattgtgacttccacatagtaggtgatatggtttggctctgtgtccccacccaaatctcatcttgaactataatcctcacgtatcgacggaagaacctggtgggaggtgatcagatcatgggggcagttttccccaatgtgttctcatgtagtgagtttgcacgaaatccaatggttttataaggggtgcttccccctacactccctctttcctgctgccttgtgaagaaggtacttgcttctctttccccttccaccatgattacaagtttcctgaggcctccccagccatgtggaactgtgagtcaattaaatctcttctctttataaattacccagtctcggttatttctttataccagtgtgaaaacagactaatactgtaggtgttcaataaatgttaaattaaattgtaattgctaccacttcactactcccaagggtcctcttaaataaaataaattactctattttattcctgtaaattaaatgaggtaacagatttttaagcatttaaaaatcaaataacagacacccccattccaagacagctgaataggaacagctccagtctgcagctcccagcgtgcttggcgcagaagacgggtgatttctgcatttccaactgaggtacctaattcatctcactgggactggttggacagagggtgcagcccacagagggcaagccaaagcacggtgggacatcacatcacccaggaagcaaaaggggttgggggatttccctttcctagccaagggaagtcatgacagattgtatctggtaaatggggacagtgccacccaaatgctgcgcttttccaatggtcttagcaaatggcacacaaggagactatacccacacctggctcagtgagtcccatgcccacgaagccttgctcactgctagtgcagcagtctgagatcaatctgcgaggcagcagcctggcagggggagaggagttcaccattgctgctgcttgagtaggtaaacaaagtggctggggaagcccaaactgggaggagcccaccgcagctcaacaaggtctgctgcctctgtagactccacctctgggggcagggcatagctgaacaaaaggcagcagaaacttctgcagtcttaaatgtcctggtctgacagctctgaagagagcaatggttctcccagcacggtatttgagctctgagaacagacagactgcctcctcaagtgggtccctaccccagtgtagcctaactgggaggcacctcccagtaggggccgactgacactgcatacaggtgggtggctctctgggatgaagcatccagaagaaggaccaggcagcaatatttgctgtgctgaagcctccgctggtaacacccaggcaaacagtttggagtggagctccagcaaactccaacagacttgcagctaagggacctgactgttagaaggaaaactaacaaacagaaaggaatagcatcatcatcaacaaaaaggacacccacaccaaaaccccatctgtacgtcaccatcatcaaagaccaaaggtagataaaaaccacaaaaatgggaagaaaccagagcagaaaagctgaaaattctaaaaaccagagcacctcttctcctccaaaggatcacagctcctcacaagcaatgaaacaaagctggatggagaatgactttgatgagttgacagaagtaggcttcagaaggttggtaataacaaacttgtccgagctaaagaaggatgtttgaagccatcacaaggaagctaaaaaccttaaaaaaagattagacgaatggctaactagaataaacagtgtagagaagaccttaaatgacctgatggagctgaaaaccatgcacgaaactacatgacacatgaacaagcttcaatagccattttcatcaagtggaaaaaagggtgccagagattgaagatcaagttaatgaaacaaagtgaaaagagaagtttagagaaaaaaagagtaaaaagaaatgaacaaagcctccaagaaatatgggactatgtgaaaagaccaaatctatgtttgattggtgtacctgaaagtgatgaggagaatggaaccaagctgagaaacactcttcaggatatcatccaggagaacttcctcaacctagcaaggcaggccaacatacaaattcaggaaaaacagagaacaccacaaagatactcttattccaaaattgaccacatagttggaagtaaagcacccctcagcaaatgtaaaagaacagaaatcacaagaaactgtctctcagaccacagtgcaatcaaattataactcaggattaaaaaactcactcaaaaccgcataactacatggaaactgaacaacctgctcctgaacgactactgggtaaataacaaaatgaaggcagaaataaagatgttctttgaaaccaatgagaacaaagacacaacataccagaatctctgggacacatttaaagcagtgtgtagagggaaatttatagcactaaatgcccacaagagaaagcaggaaagatctaaaattgacaccctaacatcacaattaaaaactagagaagcaagagtaaacaaattcaaatgctagcagaaggcaagaaatcagagcagaactgaaggagatagaaacacaaagaacccttcaaaaaaatcaatgaatccaggagctggttttttgaaaagatcaacaaaattgatagactgctagcaagaccaataaagtcttgcaccatcacaagactaaaccaggaagaagttgaatctctgaatagaccaataacaggctctgaaattgaggcaataattaatagcctaccaaccaaaaacaaagtccgggaccagacagattcacagccaaattctaatagaggtacaaagaggagctggtaccattccttctgaaaatattccaatcaatagaaaaagagggaatcctccctaactcattttatggggccagcatcatcctgataccaaagcctggcagagacacaacaaaaaaagagaattttagaccaatatccctgatgaacatcgatgtgaaaatcttcaataaaatacccgcaaactgaatccagcagcacatcaaaaagcttatccaccacgatcaagtcagcttcatccctgggatccaaggctggttcaacatacacaaatcaataaacgtaatccatcacataaagagaaacaacaacaaaaaccacatgattatctcaataaatgcagaaaaggcctttgacaaaattcaacagcccttcatgctaaaaactctcaataaactaggtattgatggaacatttctcaaaataagaggtatttctgacaaatccacagccagtatcgtactgaatgggcaaaaactggaagcattccctttgaaaactggcacaagatagggatgccctctcttaacactcctattcaacatagtgttggaagttctggccagggcaatcaggcaagagaaagaaataaagggtattcagttagcaaaagaggaagtcaaattgtccctgtttgcagatgacatgattgtatatttagaaaaccccattgtctcggcccaaaatctccttcaagctgataagcaacttcagcaaagtctcaggatacaaaatcaatgtgcaaaaatcacaagcattcctatacaccaataacagacaaagacccaaatcatgagtgaacttccattcacagttgcttcaaagagaataaaatacctaggaatccaacttacaagggatgcgaaggacctcttcaaggagaactacaaaccactgctcagcaaaataaaagaggacaccaacaaatggaagaacattccatgctcatggataggaagaatcaatattgtgaaaatggccatactgcccaaggtaacttatagattcaatgccatccccatcaatcggccaatgactttcttcacagaactgggaaaaactactttaaagttcatatggaacaaaaaaagagcccacatatcccagacaatcctaagcaaaaagaacaaagctggaggcatcatgctacctgacttcaagctatactacaaggctacagtaaccaaaacagcatggtactggtaccaaaacagagatatagaccaatggaacagagcagagccttcagaaataacaccacacatctacaaccatcttatctttgacaaactgacagaaacaagaaatggggaaaggattccctatttaatgaatggtgctgggaaaagtggctagccatatgtagaaagctgaaactggatcccttccttatatcttatacaaaaattaattcaagatggattaaagacttaaatgttagatctaaaaccataaaaacctagaagaaaacctaggcaataccactgaggacttaggcatgactaaaacaccaaaagcaatggcaccgaaaaccaaaatagacaaatgagatctagttaaaataaagagcttctagccgggcgcggtggctcacacctgtaatcccagcactttgggaggctgaggcaggcgaatcacgaggtcaggagattgagaccaacctggctaacatggtgaaatcccgtctccactaaaagatacaaaaaaaaaaaaaaaattagctgggcattgtggtgggcgtctgtattcccagctactcgggaggctgaggcaggagaatggcgtgaacccgggaggcagagcttgcagtgagccaagatggcgccactgcactccagcctggatgacagagcgagactctgtctcaaaaaaaaaccaaaaaacaaaaaacaaaaaaaaacaaagagcttctgcacagcaaaataagctaccatcagagtgaacaggcaacctacagaatgggagaaaatttttgcaatctacctatctgacaaagggctaacatccagaatctacaaagaacttaaacaaacttaccagaaaaaatcaaacaacaccgtcaaaaagtgggcaaaggatatgaacagacacttttcaaaagaagacatttatgcagccaacagacacatgaaaaaaggcccatcatcactggtcatcagagaaatgcaaatcaaaaccacaataagataccatctcacaccagttagaatggcaatcattaaaaagtcaggaaacaacagatgctggagaggatgtggagaaataggaatgcttttacactgttggtgggagtttaaactagtttaaccattgtggaagacagtgtggtgattcctcaaggatctagagctagaaataccatttgacccagcaatcccatcactggatatatacccaaaggatgataaagcatgctactataaagacacatgcacacgtatgtttattgtggcactattcacaatagcaaagacttcaaacccacccaaatgtccatcaatgatagactggattaagaaaatgtggcacatatacaccatggaatactatgcagccataaaaaatgatgagttcatgtcctttggagggacatggatgaagttggaaaccatcattcttagcaaactattgcagggacagaaatccaaacaccacatgttctcactcataggtgggaattgaacaatgagaacacttggacacaggggagggaacatcacacaccagggcctgttgtggagttgggggctggcggagggatagcattaggagaaatacctaatgtaaatgtcgagttaatgggtgcagcaaaccaacatggcacatgtatacctatgtaacaaacatgcacattgtgcacatgtaccctagaacttaaagtatataaaaaaaaataaaaacaactgcatgttgtttcaattaaaagcaatctattacaaacaacagatttctctaaaaagtttaactttaggaaaatattgactctgaaaccattttggaatttgatgggctatttgaaaacatcttgaagattctggtttttatatcattattaattgtctttatgttcccctgttccagtttgtattctggataatatctggttctataggcaaattaatgtttaaaacaaaatgatcatctgagataaatgcttaagctgttcttactaaggggtttatagatacatatttttgaatatacaggtggaaatacatatttttactacaaatagaataatttatcttaatttgtgtatttttaagttattcactaaaaatataaagtagaatttgagagaaaagagagaaatatgttatagtgtgcccactagacagaattaacaggaacaaaatatacttacaaaacatttagaaaataaattattaactgtattagcatgagaagctcactggttcttctcagcttttgctctgcagagattatatttagctatatttttatatactattcattttcagtggctaggcagaaagatagattgatcttttgtggttcatttcaatagttttcaaatttagcttggacatttaattaattagcctttgcataatattaattgcttgtatctagaagaaatattttgtgtatgtgtttggctgataggttaataactgaattgagtaaataactgctgtcactactggctccaaaatgtgacattcatatttccttttttttgagacagtctcgctctgtcatccaggctggagtgcagtggcacgatcttggctcactgtaacctccacctcccgagttcaagcaattctcctgcctcagcctcccgagtagctaggattataggtgcccgccaccatgcctggctaatttttgtatttttagtagagacggggtttcactgtgttgtccaggctggtctcaaactcctgaccttgtgatctgtcgcttcagcctcccaaagtgctgggattacaggtgtgagccactgtgcccggcccgtatttgtataatatataatacttgattttggctaagtcttttcatgaagaaaatgacaacactgacactttgtcattcctcagtatctgtgggggattggtcccaggacccccttctgataccagaatccacatatactgaagtccctgatagaaaatggccatagtatttgcatataacatatacacatcttcccatatcaatcatctccagataacttataatacctaatacaatgtaaatgctacataaatagttgcatactatattgtttaaggaataatggcaaaaaattctgtgcatgttcattgtagacacaaccatccatttcttttctgaatattttccatctctggttgtctggattcacgaatgcagaacccatggatacagaatgccaactgtatagtcatgaggaaataatcaggaaaaaacagtaatattctaagtattacttaaattttggttttgaatccattttaacatttttttcctcctggaaagattttatgactaaatttatctgcaaattgtaatcaccaaaataggagttaaggatgcaaaattgtttgttttcattggtactgccaacattttgttattcctgagttcaaacggatacatttaaaagcctctgcaaccaaatgactgtgacttttagctcagtttctgtgagaaaaaaagacactattttaaatcatttttatttattaaacactagctctctacaaaaagcagctattatgatattacaggactataatgatcaacaaaactgtagtagttgtaatctgggcaataaaactttaagcataaactttggaagcagagcctgggtctaacctgataataccacatgtatgctgtgtgaccttatacaggttacttactctctctgaggtaaagtttcttattcataacatgatagtaattttacataaataaccagattaaatgagcaaatatatgtaaggcattaaatacatggtagctttactatttcatatatgcctcagagattcctggctctcaaggcaggagggagaaaatattagtaacattattactaataccagaaggaaaaaaaaataccaatagcatgaaattgaaacaaaatttcctagcactaaattttaaaagaaaatggtttttatatgagatatataggaatatagtacacatcaaataatgtagtggaaaatacatatttttagtgcaagtaaaataattttatgaaatcataatgaaataactattggaaaacatatgaaaagtactgtgtcctattaaatatgcatacttttgtttacacaagaccacaaatttatagaaaatttatttcaaaagctgagagttcaagaaaatcagacagtatataatatttgacctaagactattccactgataatacaagccgaataggaattattgtacactgaattgcaggatcatagctgaggaagacaaaattattatgtctgaatagaccattaaatgacctctgaattctttgacatataattaaaaataaaagcatatttatgccccaaaactaatgctttgtttaaataaaaaaagatgaataaatttactaaaataaataaacaagctaacagaaaaacaatcaaagatgcaaaaagattgtgttgtggaaatgcaatttgctaagcacttgaaaagatacatgggctgtagttattgtcacatgggcagttttgaactttcatatatgcacctaaacacagacacacacacaacagatattaacactatgttcttttttttcttgagactataaaggagctgtttctaaaagataagagaagaatccatcaaaaagaaatgaacacactgatacggtttggatgtttgactcccctgcatctcatgttgaaatgtaatccctagtattggaggtggggcctggtgggaggtgcttggatcatgggggtggacccctcgtgaatggcttagcaccatctccttggtgatgagagatttctcactctgagttctcaagagatctagatattgaaaagtgtgtggcacctccccctccctcttgctcctgctctggccatataacgcactggctctcccttcactttccaccatgattggaagcttcctgaggccctcatcaagagcagatgccagcaccacacttcctgtacagcctgtagaaccatgaaccaagataaaatatattttctttataaattacccagcctcaggcattcctttgtagcaatgcaagaatggcctaatacacaaaccaaatatggttttccatatttaatgggaggaatggaaggtgcgttactctttcttgaagagtttctctacattagacattttacttccaatatttctttaaaaaccttgcaacaaatccatgaaataggtattttcattctgctttgtagataaagaaactgagactcaaggagattaaagaactagtcaactattatacagaagagccagacttcattcccaggcatggttaaattcatgcccaggtttctctccctagttaaaacaagatttgtaataacagcaaaggtaaattccattagacacttttgctcagcttctagaatacaggcaatcaaatagtagtactgaataaagaattattgaataaaacgatacgtctatttcaaaagacagacaagtacagttgccccttctatatttggatatcaactgaagagttattacaaatgaattaaaggatttataaatgtctatggtattgttgaaggaagagaaaaaaatgcctttcaaacaatgtgctaaattatttaatgctgctcaaataggcgcctctgtcctttaatgcaaatacacaaacacacacacacacacacacacacacacacacacacacacacacacacacacggataccaccatagcttcctattgcttctgtaatagattacggcaaaattagtggtttaaaacaacaccagtgtattactgtatagtttgtaggtccaaatgggtctcactgggctaaaattaagacgtagcaggtctgcatttctttctagagcctctagggctgtatctgtttccttgtcttttctagcttctagaagctgcctgcttgcattccttaagcttagtgtcctttcatcagtcgaatctagcaatggccagtggattcttctgttgcatcagtctgacactgactgtcctgccttctttcacttataaggattcttgtaattgcattgagtccacccagatagtccagaataatcaccctatattaaatccttaatccaattacatctgggaagtcccttatcttatgtaaattaatatcttcccaaatttcagagattagggcatagatgtctcaagagaagggggcatcattctgcctacaagaggcatattattgtgttcttttcaatgtaaaattcgaaggatctactacatttaaaaacagaaatgtgttaggatgttcccaaatgacaaatttaggaaaaacaaaattctgttttaatacaaatatgggagctctcaagctctttttatgtgcaaacaacatcactgacagaaagctttaatggtaatactaatcactgagaagtttctggaccaagtgttttctgtgcattatttcaatttactcctgtaataacattgtacatattattgattgtccacattttatcaatgaagataatgaggcttggagggattaaataacatgtctaaaattactcaactaggagaaggcataaataagattcagactgaacccgtaacaacatatagatgtaactatttcactttatggccttaaatttgagtcattttttaaaaacctgaagtaatccttggatttgtgatttatggggagtggggagcaaggcggtttatttctatagtgaaaaaaataatttatttgtatttaggtattaggtatttaggtatatacttctatgcctaggaccacaagaaaaatgaacatttcactgggaaatttctaaaactttctaagtttttataaatacccaggaagccaagaatatagattgctagaatggggacagggaaagcaaacctacttctaaactgcatcaggaaaataatttaaggaatatgtagataatctggttggaattaaagcctcccagtggaagtatttctatatgccttcatttgaaaatatctctttcgctcacctcataacagcttgaggcaaagtaaaaacagtatggatacaagatgagaaatcccatttctataaagttgaggactttttcatcttgcacaaggcggttgaatacaagggcctgctttctcatgtataaactgtagacaaacaataagattactgtgatgattaaatgtcatcataaacaggtatatgtttataatcaccatacacctataaaacattagaattgtctataaaaagtgaaaagtgttatggcatatattctattttcaaaacatttgcatcttttaataaaaatagtggataaattatgtaaaagtgcatataagtgtatgtatagatactatataagtatatattaggatattacaatataattgaaaaagatatataatttaaaaaaatcaaaatcacgggatgatagattattttaattttcttcttttcgtattttatttttattgtatataatgataagtactgcttttctaatttaaaatagttaatgttaatgttatgatggaagactagaagtagagcggaaacagaagtcataaagcatacgtacacgaaactcttgaactttatctgttcctttctatgccttttctaaaatatctctttcatctaaagaacctgtggagatactatgtgcaaatcttcattttcttttcctccatcaacaagccctggcttacgctagtaaagcatacattttttttcctcctgaaataaaataagaattttcctgcttgtttgcgaaatatttccctaggtatattggatttactcgtgaagattcaaccaagaagcaatgaataaagagagaagtggccttgaaaaacacagtctaattattatttatctatatatctttgctgtgttcattagtcatatggtatacaacatattaaataattcattttttgcacaaattttagaagtaatataagtggaagcaatttaactacaactacttagtgtaatgaacattttaaattgagcttttggaaagtgcttaattaatacttgtaaaataggggttcacagttcttgcaatatgtcattaagtccaagcattatctttaatcttctcccaaacttctgagaggagaaaatagtttttgaagcaacacaaattgataaaccttcaaaagttgaggtaatcagctacttacatttttgagcactagtcacagtataaatggaaattaaaattccattatgacataaagtaaaaatttagcactgtaagtttcaagtaatatgccacccctctacaccaaccttaccaagcacttcattcaaccacatttcagccctaatatgactttttttttatttgcctaaacagtatcacttcctcctttattttggcctcagaagtccattttccctccttggtttactattacctccacattccatgagtccttaatagaaatgccaactattgtactcttcacttcacccctggccaaggatacacagctcaagccaggccaatcagattctctcaccttcagatgtgtgatccttgaactgactgccagttgcttgaaggtcattgacctcagctttcttaatggcactgcccaaaaaggaattgctacttgagtttctaagattgctgaagcctctccatgtttttgtttttccttagaccctattcaatttctctcttgctgtacaagccaccaagtattcttctgatatgattcctttagtataagccagtcagaagtggtttctgctgtttccaacttactaaccatgccaaaaatagtttggaatgaccaatttagttcatagcagagaatggacaccatacctccctatttatggaaaagatactggattttttcctcccaaaagacattatgaaatgtagatttttcattttgtgttgcaaaatttaatcaagtattaaattttagtatattttcttttttataatcatggattttacatcattttaatttttttttgaagaaagttgtctttgtttatgtatatacattatccggttgtcaatcaaggtaggtgtattcaaatctaaagccctcagaagatgcctggctgcttttctaacatgtcacaacctacaatccctggtaatacagagaattcagaggaaaatatgagatatctctctgtacacttatctaaaggagtagatgaagcatatttagtatgtgcttattataattttgtgtggttcgaacatatcacagctagcagtagtaataaaaaatacctttttatagagtatttcttatgttacaataagttaagtacttttctgatatgatagtccttaaaattctcaaatacccttatgaggtgtagacatatttaccctaagagaaagttgaagattataaaggttagagaagtttgtaaagatcagaactgggtatggaattcaggcctgtctgataccaaaatcatggatcttaagtaatttcatatatacaatttttatgtatctactttttctctgcttttctattaaggtaattttaaatgggaacaacttaatggtttaataatctgtgttacatagaattttccctagtatagatttttgataaaatttctcctttactgtttgtcctttaaactcaggcatatctgagcatttatgaaatatcatcaaatagggatcatttagaagcaaaactgaaccactaaactggttaaagtatccaactttcttgtgtattttaataaaacacaaatataggtcaggtgtggtggctcgtgcctgtaatcccagcactttgggaggctgggggtgggtggatcacgaggtcgggagatcgagaccatcctggctaacacggtggaaccccatctctactaaaaatacaaaaaataagccgggcatggtggcgggcacctgtagtcccagctactcaggaggctgaggcaggagaatggtgtgaacgtgggaggtggagtttgcagtgagccaagatcgtgccactgcactctagcctgggtgacagagcaagactccgtctcaaaaaaacaaaacaaaacaaaacaaaacacaaatatagcaatctctattaaacagtcttgatggcaagcatatgctgtaagtaaataactagtaacaggctttcaaaattgaaagtgacagcttttaaaataatgatttcctctaaactgcttgtctgtaattatttttaagatattacataggggactaattaggtacaagataccaaaagggataagaacaggaacaagattgattaattgaacttacgaaagttcctgggaataaaaaatgaattagattgggaagaactgactacgagacttgtgttctgaataatgattaaaaagaatgacaagctaaatttatgtttcttatctctgaatcataaaattctgtttttgcttttgcattgaagcaatgtgtacattaaattgaaatgcatgccttataaaatgtaaacattaacaaaattagggaatatttaagaataaattaaattttaaattgtgaagataaaaccaagaaatcttctacctacttaattcccatgttttcttccacatacaagccctttattatttatttggcactagctatagttattgttggcccaagttaactattatccaacatactttctttagtcataatttttctggagtatctgcaacatttgatgtttcagccatttttgacttttcttgaaaccctcttctcctttggctaacaggtcatcactacataaattgtactcattttttccactggtctcttaaatggctattcttttcctctcattcactaaatggaagagtttttctcaaactcagtctttcatttttctctcttgacagcctcagaaagacaaatgagatggggcctcaagggacaataatttttttttcttttgacagcttaatttggtcattgtgagaggttacagcctgctggcagccctcgcagccctcgcttgatctcagcacctcctcagccttggcgcccactctggccgcgcttgaggagcccttcagcccgcggctgcactgtgggagcccctctctgggctggccaaggccggagccagctccctctgcttgcggggaggtgtggagggagaggcgcaggcgggaaccggggctgcatgtggcgctcgcgagccagcgtgagttccggtgggcatgggcttggtggactccgcactcagagcggccggctggcaccgtgggccccaggcagtgaggggcttagcacccaggccagcagctgcggagggtgcaccgggtcccccagcagtgcaggcctgccagtgctgcactcaaattctcactgggcctcagctgcctccctgcggggcaaggcttgggacctgcagcccgccatgctggagtgtccccccgccgtgggctcctgtgcagcctgagcctccccaacgagcaccaccccctgctctgtggcacctggtcccatcaaccgcccaagggctgaggagtgcgggtgcacagcgccggactggcgggcagctccgcctgcggccccagtgcaggatccactaggtgaagccagctgggctcctgagtctagtggggacttggagaacctttacgtttagctaagggattgtaaatacactaatcagcactctgtatctagctcaaggtttgtaaatgcaccaatcaacactctgtatctacctaatctggtggggacttggagaacctttatgtctagctaagggactgtaaatacaccaaatcagcactctgtgtctagctcaaggtttgtaaacacatcaatcagtaccctgtgtctagctcaaggtttgtaaatgcaccaatcagtgctctggggttttggagaacttttgcgtctagctcagggattgtaaacgcaccaatcagcaccctgtcaaaacagaccaatcagctctctgtaaaacagaccaatcagctctctgtaaaatgtaccaatcagcaggatgtgggtggggccacatgagggaataaaagcagactgccccagctagctgtggcaaccagctggggtcctcttccacactgtggaagcttcattctttcactctttggaataaatcttgctgctgctcactctttggttccacgctgcctttatgaactgtaacactcaccgcgaaggtctgcagcttcactcctgaggccagcgagaccacgaacccactgggtagaatgaacaactcctgatgggaggaacgaataaccccagacatgccaccttaagagctgtaacgcttaccgcgaaggtctgcagtttcactcctgaagccagcgggaccacgaacccaccagaaggaagaaactccgaacacgcccgaacatcagaaggaaagaactccagacgcaccatcttttagaaccctaacactcaccgcgagggtccgcggcttcattcttgaagtcagtgagaccaagaacccaccaattccagacacagttggatctgagttagcagaatggatctaaacagcatttctccctgatacaagcttcactagctcatctcctcttaaagagatcattgcctcgacagggaatctcctatcattacactgccagtggatttttgtttgcctttatttccatatttcctttatatttgtagagtaatagtgtttccagtccctggtttctagtcttgagccctttctatggtgtgttcagatgtgtgcaaattaagtttttttctttgtgcttatgggaggtcaagagatactttttcctttgatgctttctttgcctggttttctcacttaagcctcattattttacatttgtaccacgtgagactagcgacgcttggcataacaattccttgacttaagtactcatgctatatgattttttttcaaaacctacctgtcagtcttgaacacctttggaagtccagttccttgtttcctgcaagtttttatttagatcttattcatgtcacccaagatcaaaagtataaaatcatccttgatttcttcctttctctttataaccagtcatcaagtcctaccaacttctcttttgcagttgtcctatattttcctcctctcactggcccaatcctagttctagtttgggactggcctatttatccaattctttttagcattcattctatctctctccaagctattctacatactgagctaactttctcatgttaattccctgctttaagaaacaaaacaaaacaaaaaactgcaagcagttaatcttcctatcagtatttcaaatagttgtgaagaaacaacaacaacaataaaaacagtaaatattcagatttccattttccatttccagatatcttaattaagtaggtttggaaaagagatcacaaaaatatgtattattaaacgagtatctcaggtaattatcaccaggtagttcaaacagttgctttatgagaaacactattttatgattcttttacttatctacttcctttttctcttcactaacttttgtttaccactagggcaattcactgtcttctgaagccactttcaaccaattgccaattagaagaattttaaatttatacaaccaagctgcacctcaaccaccttgggcacatgttctaggatctgagggctgtgtcaagggccatggtcactcatatttggctcagaataaattgcttcaaatgttttgcagagttcgaggtttttcactgacaaagctactctaatttcaaatcatgcatgtctatgtctcttgtatatcaattagtcatgtacttcatgctactacttattgtttatacctatgttatagcttctccaccaggatagaaacttctttaaagcgctaatctcaccttgtggatacgtatccccttacagcacttagaacaaatatgtgatatatatttgttaatttaacatacttttcattatctctgtagcacaaaaataatgtttcaggggccatgtgacaaaaaaacagaatcatattagatgtgcctcaaaaataaagggaacagagttgttgaaagtgaaataataacttaaaaagtactagtctgtttggaagttttgtttatatgtaaatgcaagtgtgtgtgtgtgtgtgtgtgtgaatgttaacattagtcaaagagtaagaagaattacaaggggacccacaaaacctttaccaatccatgtaatgttgtcaaagataataagtaatatctaatttcaaaatcaaaggagcattgtcccagtcattctttaccacttttaccttttaccttggaatacactaaattccattgtttgcccatgtatctattattttattaccactttatatgtttaactcatcaaatgttcttgcaaatctgatacaattcacaattcactgtgaagaattataaaattatactgttattaattagtccaggtcaaaatcagatccattttggacaaaatcaatcatgaaaatatatggttaattataatgtgatcttttatataaacgataaatatcaaaaaggtggagtagtacaacaatagatattataacagcgtttctttgaaagcattagaacatggcatcaaacataatttactagacaaattctgtattgtgcaggaaaaggagtatttactattttctgaaatacatctttcatcttcatagtgttatctatactattctcttctttgggatctatctcacatttttatcttctctgctatcatccacacagcacctgtgataaaatctgggacaaaataaaattgaataatactacatctttttatttgaggagaactcacaggccagatgtatttgttcttgtatgacagggacaatgaatgattaagcaaagtctcaaaaatgagatgacctttaaactgacccttgtagaataattgagttgatctgaaaaacaatgtagaaaggacattttaaaaagagagacttgtgcaagcaaagacatttaggtatagacattccttgaggttaagtgaaaagaatgcaatgaatatagaaattcagaaaagcagttacataggatatgcccagtagaacttcagagactggtgaagttgagacaatgaaaccttctgaatgttcactcctatgtacatcttttctatatggcacttttccccatatttctttttattatgtaagcataatgctgaatttattttcgtctatttaatgagaagctttttttttcttctttcgatagtcaaccagtaagatcagctacttgttaaagttgggaaaataaatattttactaacagaaaaaattgcattatccataagtgataaaaataaataaaaaccaatctaataactatgctaaatctttagcaagttattactttaagtgcagacctgaccttgattatattacaacagaatggggatagccaatgcctacaaccataatcaataatgaagaattaattctgataatttccctcatatctatcaatgttaaactacattttatgcttatgttattcatgtagttgcatctgttttctatttctgcaaaggttgttatttctgtaacataagtgacttaatagattccagttcttctgtgcatagtttcatttgcatttaatagggcttagtgtgcctctactgaaataggagtttttctaaagcaagaggtttagagtgactgttgtatcactttggggcctcattattaatcagtaattaatactctctggaaagcataagtttgccaaaatatttggcattcaatgaatggcattttgaatcccaatttaaatttggactaaaaaggcttagaaaaaaaatctaaattatttactatattaattataagtacgtttccaagaatgaagaaaactgtatcttctctctttagttccaggcttattcttaggtataagaaggagaactattttatgcattcctagattcttaaatattttaattttgcttgcccatggcagcaatatgtttccgtcatgaaatatatattttttctcatatatgcagaaatgtaatatttttctattttgaaaagtctgattatatatcattgtcatcagttcagcaaaccaatttgggatcaatggaagagcactgcctcaatgcatttggtttcagaaatgtattaataatagtgtataccatgtttcaaatcacatttccaaggaaacctattgtgcacaatgcaattttttcttggacagacaattttatgctatgagtccactggaatacatttttgtttcattgaaaatataattttttcaaccatatatttatataagatgcctaaaatttctgaaagaaaaaatgctgttaatgatattatcgtgttaattttcataaactcctctccatattttaaagtaatacattattaatatagtttctaaaacagtggccatatatttgtactataaatataaggctatgatcattcctgggattttaggactaaaaaataatatgtgacaggctacaatattgttacccaagttatagcagggatacttttgttttaagtcagtcaatcataggtaaagagtcattagcattatttgtcacagaccttctgttagaaaccacaaaagtcagaagaatgaaatgtattacaagcttgtaccctacagctaaaacataaaatgaaatcaatagcatttgagttgttttaccctcagtttaaagtttatcttaattgtcttgtaatttattcctgattgaaagtctagttattgaatcaaaacacaatgacatatttatagaaagctatggctttcttttttcatgtttaaagataattataattttaccataaagcaaaaattgccacttcaattatggagttacataaatcaatctgtgctgtaaacttgcatgttactgcttttgctctacataaaagaatgggaatgactctgtggcacaaatattaacataagcttctatagatgttctgggtacaggcttcttgaagcttctttgggaccaagtaacattatatcctaaaaacccaggagagtttgagtttttctgcaaagaaagagactatggataggaagaaaagatgactcataattttgaaataatgtattagaaatagcaacgcattcggctgggcgcggtggttcacgcctgtaatcccagcactttgggaggccgaggcgggcagatcacgaggtcaggagatcgagatcatcctggctaacatggtgaaacctcgtctctactacaaataaaaaaaattagccaggcgtggtgtcaggcacctgtagttccagctactcgggaggctgaggcaggagaatggcatgaacctgggaggcggagcttgcaacgagctgagaccgtgccactgtactccagcctgggtgacagagtgagactccctctcaaaaaaaaaaaaaaaaaaaaaaaaaaaaagaaatagcaacgcattcacatttgtctttccttttgaaactagtccaacagtcccacagacagttgttttcagataaacacagagattggctcttctgctgctaaagcttaaaacttttatttgttttatctgagctctttcctcagcaaaggaggaccttcaggcctctgaaaaaagtttcagttatttgaaacttaccagatcactgccccagaggcctccttgctcctccccagttcttgttttcttacactcttacgtttcttccctactacataaaccccctagctttagtcaatcagggagatggatttgaaactgaactcccatctcctcagcttcaacacccgattaaagccttcttccttggcaatacttgttttctcagtaattggctttctgtacagcaagcagcaggacctagaccaaactcctggtgtttcattaacactttgtaaaaggaagataattatttgatcaaattagtggtcaatatgggagtaaaggaagaaaatacggatgcttaacagaatgagacaggaagaagagataaaatgtagggagtctagagggccagaaagtttgagtgcaggaagaatgaaaaatcaacacctaatttctaactgaattgaagagagagaaaactccaaagcttttcagattccctgcaatttcaagtactgggaggaagctcctaagcacattcccatgattaaaacagtgtactgtctccatctgtaataatgactaaaccactgttatgaaaaggctgcaaatcaggggtggtgaggtgggagtgggcagaactggagcttagttagcagtcagccatcaggtggattgtatgagtggtatgtatgctacaaatttgcatactgttagcttgatatttaaaacgcttcacaatctggccttaattttccagactcactcatgcattggacaaatctttattgggggtatttatgtgccatgcattttaggctattgggatacatcaataaacaaaacagatacaaacttctgtcgttgcgcagactaaatccattttaacaatatccactaaattctgttctacagtctcactgaaacaatattcttaatatgaaaatatagaattataaaactctattattttctttcatactatctctttaatcctgctaatatgggctaatatctttcctgctgttgaataaaagctcaagaaattttataatttttaaaaaaattgttaatagtactatggtaaaggtaactttaaaaagaatttaaaaatgattctctagttcaatatatgaatctaatactccaaatttcatttaaaggtaaaatgtccttccccagcttagatatgttaatggaagttcctctgcctttggggaagaggctgtaagagatttctttttacttttttctttattaactaccaccacctccttcattcactagcagttgatttttatcactcagacttctattacctgaccttggagattatggagaaaaggcatgtaaggtaggtagcgaagttcctacttcaatattactgttgtgaaatggctgaatactctttgggtcagacctgggtttaaaacagacatggtcaatgagagcatcttcagcactggtatgcttttcttcagcaacttcagtttgccagcatacttcagttaattccagtttgtcattttataggaattctgcggtctatgtccagtttttgccttttgcagtatcatcactccttcaggtaatcctaccgaacaggatttaagaaaactggcattcacctgtgtcccaaatctggtcctttgggttggtttgggtataattatgcaggcaaagaacagtcacaggctctttgcctgcatacttatagaagcacagacctttctagatgtagctgtaatataatgtaatactccagtcattgtaattgcttgttgctctttttctgtctacatttatctgatatgtctcaaacatggatttgctgtgctaggccaacataagggcagcgttttttactgtagttgccaatgttaaacttgagaagggaaagcatatatttccccagccattgtattttggggaaaagtatactgttgaagtgaattcaagtacaactttacaacaaccctcccctataaaggaatactcatacaaagtcacttctaaattttaattcgcgtgaccattttcaattctcctcgagagtaatggtgttcagagtgttaaactctgttactggaacatgatggttttggtctaggttctgctgcttgccacacagatgggcaatcactgagacaatgagtattgctagggaagaaggttttaatccaatcgggtgctgcagctgaggacatgggagatcagtctcatggagacagatccctcatggcttggtgttgtctttgccatagtgagttctcacaagatctggttgttgaaaattgtgtggcaccttcccccaccactctctctctcccttgctactgcttttgccatgggatgtgcctgctctccctttgacttccaccacgattataagcttccggaggtctccatagaaccagagcagatgccagcaccatgcttcctgaagagattacagaaccatgagccaattaaacctcttttctttagaaattacccagtctcaggtatttcttttttttttaaattttattattattatactttaagttttagggtatatgtgcacaacgtgtaggtttgttacacatgtatacatgtgccatgttggtgtgctgcacccattaactcttcaattagcattaggtatatctcctaatgctatccctccccccttcccccaccccacaacagtcccccgtgtgtgatgttccccttctgtgtccatgtgttctcattgttcaattcccacctatgagtgagaacatgtggtgtttggttttttgtccttgtgatagtttgctgagaatgatggtttccagtttcatccatgtccctataaaggacatgaactcatccttttttatggctgtatagtattccatggtgtatatgtgccacattttcttaatccagactatcgttgttggacatttaggttggttccaagtctttgctattgtgaataatgccacaataaacatatgtgtgcatgtgtctttatagcagcatgatttataatcctttgggtatatacccagtaatgggatggctgggtcaaatggtatttctagttctagatccctgaggaatcgccacactgacttccacagtggttgaactagcttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatatcttcttttgagaagtgtctgttcatgtccttcgcccactttttgatggggttgtttgttttttcttgtaaatttgtttgagttcattgtagattctggatattagccctttgtcagatgagtaggttgcaaaaattctttacagtaatgtgctctaatacaaagagatgagcgagaaaatgatgaaaagataagagaagattcaacacttgtatactaggaatctcccagtgagacagaggagggatagaactttgggttcagatcacctctactagagcattatttcatgcagtcacactagtcaccagaccttgcaccactgtaaggtgatggcagcatcacctcactcatgccatccccactgaccacaagactgtgcaagctataagttacctagagaaactaagatgagggacattctaccatacatcttactcaaggaagttggcccccaatacccacatgcacagaaggctaaaaaaatgactgtggtggcaggcgcctgtagtcccagctactcaggaggctgaggcaggagaatggtgtgaacccaggaggcggtgcttgcagtgagcccagatcacgccactgcactccagcttgggcaacagagtgagactctgtctcaaaaaaaaaaaaaaatcacacggagatgtaacatgttaatgagacgtgtgacacatgaagaagcaagtcatcaaactgtgcaaatgctataaattcccatttctacatgctttaatgtcactcctttcatggctaggcctgttaaaattactctcttggctatctccagggaggcagcaagagcactttctcttttccgggctgctttccttgtgctccagcataagttccaataacgcctggagtctgggaaattttcttagccttctgtcagtttctattgcacaagagcataagaacttgtggccagtaacaccagaatagatgccacattaataaaaaaaaaaaagtctagaattaaaaaaaaaatccctaaatgagacttgaacagttatactacatatatagaaaatgacccagaattgccaacatgtagaaatacattgacaaaaatactgaactctaaagaaaaaataaaggcaattatttggaaattcagaaataagaccagtttgtcattacacatttttttacagtaatgcttcaaagaataagaaaatggaatgaaaaatttaatttaaaaaaagaaaatgagtcaagttatccagtcaaattggtcttcaatgttaaagccctaagataagcttttcttaatgcaccaaaacataggaaatagtgtctctataatcctgcatcaaggactttacttgggaatgggttactgataacaaaatgactgaattgtgttattaagagggataaaacaatatcactttcaattagatgtgtgggaaaatataagagatgaagcagaagcattgctcacaacaggaaacatatgagcagtgcaaaaaaaaagtgtaccatgtaatgtaaaagtaagtcgtagaacaaatgtgggcaaactacagccctttggtcaaatccagcccacagacagcctgttttagtaaaatgaattttatgggagcatagccaaaccctttggtttacgtattatctcttcttgcttttaagctacagcagagtagagtagttccgacagagaccatatgacccagaaaactaaacatatttgtcatctcagtattcccattttgagtatgatagtgaatcaactcattattttgaaaatcaataataaaaggaaagaataaagtttttttttcttgtttttcctatagttggtggacctcagggttactgagtatttgctatggagacgtttttctttataaaaatattttggctaatgaatatagaagtaataaaaataaaaaaataatggatttagaaaattactattggtggttgctactatctatatcacaaaaagagaatcaaagagatttaatgtttaaggaaggagtgaatatcacctatgatttatttgtttaaaaacaaaccaaaaataacctggatatgatcaagcctccagatctaactacttatttcctggaaattaaggaagcagaaagaatatgaaatgaccacttggagagacagtcatcaatccaggcttcagaaatgtggtttcttgcacaaataaatatcaaggtgaataaaagagcgtagtggtgaagcctacagattaaaagagacttaacagacctatcaaccaatggcaatgtatagaccttattttgattctgatgtaaataaatgttcaatgtgaactggatatgtttaatatgaactatgtttaataccaactggatatatattgatatcaaataatttgttacttttggcagcagtaatcatgatattttaattgttttaagagtccttaagatatacatatcaaaatatttacagattgaatgttatgactctgacctgcttcaaaataatgcaatagtgggtagttgagagcatagaggaacaactatttcccagggcgtgattatgttgaattagggagttgatacatggaggttcaccgtaatattctctgtaatttttgtatgtttgaaatgttccaagtaaaatgttaaaatatttaaatattcctagtgttaaacttatgaaattagctctaaaattttacattttaattaatttgcatttaaatattaaatctaatcacatcatggttgcacaatttactttgaaaataatttcattaacaaatttttggtaaagaagtcacaataaaatacttctttaatgaattacacttctgatttttattatccttattcaaatgatatgtggtagggcaactaattctgctgcagagatgaatatttagctaactaattaacctcaatttacataatggttgtatttgcataactaatgggctggggattgactataggccattaacagttattaattaatgagattgaattagaaatatatgggtttttatttcaaacttaggaggcaaaggtcaatcataaaaggttaataacaatattcaaagaatcaggcagtaaatattttagcttttagacttcatgcatttctgacaggataattcaggaattggtttcacctctacatgcatactggggcacatggaagtatacacatgtgcattagagaaacttttattagcctcagatttacatgtaaattaaagtaatgggagctagttgtattcacatataagaacttaatgcacctctattcataaaaatcacaggtatcacttgagaaagttctacaacctaaaatttttctttcttaaactgttcatttgtttcaaggaaagagtgcaggtacacttttcaattaatcttcctcatttttgcatttgcaataaaataggttacattatataatttagagttactccaacctttccactcctcatttatccaattcagtttacaattggaagcatcctctatatttttaaaaacataattgcctgtagtttaaagattttagaaactcaaagaattcatctgctatttttaaacaatttaattatgtgagtgatgcataattattgaggacaattcaattcctttaatttcaaagacacctgtataatctgatttttcaaatgatttggttgtatctctacaaggaactgagcagctctctacactgaatcagtaaatgaggttcacgataaatgaaaaggagtgatttctttttatgatcaactgccaaactgatacagaaaattctgtcctgcatcttctgcctgttgctcctgtcttgctttcttttctctcacactgcctgggttcttgctttatgcctctgccctcttctttttccctcttctcccttctaagaacgctcgcttgctgaaatgccttgaaatgatgtccagggatagtccctgggtgaatgtttcagatcctgtttctcatttcacactctgtctgggcctctattctattaatagttaacttaaactggattatcttgagtcttctagattttaaaagggttgctctgattacaaaaagatgattgcttaaatgcaaaagagtattacctcaatagatgggaaaagaatagcatttattgcattattgataacatctttaaatctgtgtcagttcccttcacaaattggcttttatatgcttctctgtgggggtaaactatatgccacagaaatgttgaagttcggagtcacagaacgtgggcttaaatctgtgacgctttgtttactgtcatttaaaaaaataacctttttaattattaacaaaatcttgcctttgtaaaacagggtagtaattctcatttcatagattaaaagtgtaggttaaaaagtgtaaattaaaaatgaaaaatgatgctacatataaattacaataaatgttagtcgctaattttaagatgattttttcttttctcgaagaaaatatgtaaatacaagaagccacacaattcaggcaatttctagaagtcattcattaaaaatatctatttcccaaggtttatccagagcttcacagtgggactaagttttattatttaacatacacagacaatggtggtattttaacaatattggatacacaatttgaaaacggtgttttattatctcgacatttcaggagtatgaaatcactccctgccttgtcatatattagctgtttaaacgaataggcaatcatctcagagtattaatgatctttctatgttgtccactgagaatgatattttagacataggtatttcatttaaaaaattagcagagacaccatacaattctggtaaaagctttaagtagtataacttactttttgaaggaactcggagattggcaaggaccacttccagggaatcagcttggactcgaagtacatagcttgtcctggtctcataatccagaggtccattcacatagataacacctgtgatgttattaattccaaatgtatctagaaattaaaatacaattacctggtcattgtctttacgctataaggaaagaaattctctttaaaaggcactgtgatttcaaaaacactaaaaatgcctatttataactagagtgatgcatgaaagtgacaaaatgctggcttttggaaactgttccagctctttgaatgatcaacatcaatacttcgctaaagtctgccttgaaattgtagggtttttttgtttttgttgttttgagataatcctggaaaacaaagttctatggtcaattacatttgggaaacactgaataatatattctttaccttagattcagatggtcttctgtcacactaaaggctttcagaagttgtttcaaagaaaaccatctaattttgtttaaccaaaattttctgaacttactggattattatactctttgtaatttatgaatattattattttgtagatttagtgttttgctaagaacacttgagagaaaataaaaaaatggataatttaatgttgccctgtgtctgtttatttaaataaatttgaatgaaaatcagggcactttggtaaactttataatatctccccctcttatgctctccatattctctccttactttattttttcatgtaattaataatcccttataatactatatatttctttgtttaataatttttattattaatctccgcttactggaccattaacttccatgagggcaggaatctattttgtacattgttctatctgtagtggctagaagagtagttaatacataatagatgctcagtacatatttgttgaataaataaataaatgtacaacagtcactgtgggggacagacgttaataaatatagccactctgctgtcttcaaagaaaaggacaaatagaatcaaaagagaaagtttcgggacggaacaggttgagaaatcatagctttagtcagatgttcgaagtccaaggaaaaaggaaatttagttatttttagggaggacacatagtagcacagtaataatgtagaaagaaaggcaataaaagtaagatattgaccacttgctacactacacgggcagcaatacctagtaatagtttgtcattaaaaagcttaacagggcctttataatttccttgcaaactcttttacattcactcatttctttaatatttactattgattaacttattacatgtatattaactatttcctgactacctacaatatactaggctatctaacataccaaaagggaaaacagaggagaacttgtggagaacaggtaaaacaaaaattaatgcgaaagattgagctatgaccttattcccagaggcctgcaaattcctatgattcttaaattacaaaaacttatatttttatttttaatcatgaattgtatgtctaatttgactattttgggaatcatataacatgcatagcttttaacatggatgtgactctttttaaaattcacaacttatttacaaccttgaagttccttcaggattagttaaggtatgaccaacatggagtaagggtcatggatggttcagacactggggcggacgaagctactgtaggcaatgatcatggccaaaagctgaaaatttcatgatgcattaattttgaggaaatgtcattaaaatattaccaaatgaggaaaagggcaaggtttcattaattagatacttaatatttcttaaggtacttaatatttcttaagggaaaaaatcactttagctaacatcactggatttttaatcgagttcaggatacatggttaacaattacatttaagatgggcacaattttattagaaaacaatagaatagataataatttcaattcaatctgaaattaggccaaatctaagtttactggttgatggtgagaacacaaactaaaagtctactcaccttcttcatttcctgaaacaatggagtacacaatactttgattaatggcagcagcagaaattacaccaaccatggtccctttggtggcaagttcacttactggaggaggtctgcaggtttagagaagatgatgtatttatttttaaatataatttttgatgtaactttacgttcacagaaaaattgagagaaagataagagatttctgatataccctctgccctcacacattcatggcctcctccatgatcaaatcccccacccaactgctacctttgtgataaatgatgaacctacattgacccattatcactgaaagtccatcatttacatgagggtgcatattgttgttgtacattttatgagtttggacaaatgtgtaatggcatgtatccgctttcatgtagtatcatatagggtattctcactgttctgaaaatcctctgtgccctgtatattcatccctcccctcaactcaacctctggcaaccactgatctttgtagtgtctctatggttttgccttttccagaatgttgtatagctggaatcacacagtatgtaaccttttcagattgccttctttcacttagtaatatgcatttaatgctcctcaacatctatggcttgattgcttatttcatttttagcactacataatatttcgcggtctgaatgtacccacagtttatttccataaataaaaaacatcttggttgcttccaagttttggcaattatgactaaagccactataaacatctgtgtgtaggtttttgtgactctaagatttcaactcttctgggtaaatactaattagcatgattactggattttatagtaagactgtttagtcttttaagcaactgccaaactgtcttccaaactgactgtaccattttgtattctcaccaacaataaatgagagttgctgttgccccatattctaaccagcttttggtgctgtcaatagtctggatttcagacattctaataggtgtgtggtggtatttatttttatttttttatccatatttatgacagagttttgaacttaatagaagaatgtacacggtagttcttccaagctacattatgcaattacattgtgctttcattgaaaccttttacaaaaaatcctgaaatacaaatttagtctgaagtataggctttataaatatctggtccaaattgctttgtttttggtactgctgtccatacacttaattgactaggttatctaaatgtaaagcagtctttctcacagatactctagcacctaatggtggtccatatattcattgcatgagcaataactgcttcttgctgaagaataagaaccaatctgtatcattttaaaatgaagtgtgtaaagtagatatttaatttactagtttatttacttacttattttactgtcctgcattttctttttgctttcttttgataacatccaaatattgttttcaataatcttgcctctttccttctctgtacaagtgctttgggtaaggctttgccaatccccatggtacatgcataagcacattaaccaactctggtcaatgggggcattttatcctttgctcagtgttcatgtgatgtatacgtctcatgtaaattcaatggacatactacataagattatgacttgactagattctcgctagccaactttttgggtatatccctcactggatttgatgaagtaagctgccatatggagcagtcctcgtggcaagaaactcaaggtgatggctgactaacagccagcaaggaatcgaggcccttagtccaacatcccacaagaaactgatttctgccaacaaccacatgtacttggaagtggatctttctgcagttgagcctcagatgagaccgtagccctggatgacaccttgattaaaagattatgtaagtccaaaaaggagaggacacagctaacccatgcctggattcctgacctataggaaattcaaaatgatatatgtgttgttttaacccattaagttcatggtaatattattatgccacaacacaaaactaatatttgaacaatggattgttaatttatgacagatcaagatacatactacttatcaaaagtttaatacaagaaaatatgtcagtcatattaggggataattttcaaaaactgaattcctatttgtggaagtagacattacttaaattgtttacttgtctatcttgttactgcacaagatagaagctaaattttatactttccataattcatctgtttgctattccttatacagtatggaaacaagacgtctgcaacttatgcacctttagctttaacatgagaaaaatgctatgtcgggccgggcgcggtggctcactcctgtaatcccagcacttttggaggctgagccgggtgaatcccctgaggtcaggagttcaagaccagcctcaccaatatctctactaaaaatataaaaattagccggttgtggtggtgtgctcctatagtcccagctactcgggaggatgagacatgagaattgcttgaacctgggaggcggaggttgcaatgagccaagatcacgccactgcactacagtctgggcaacagagcgagtttaaatctcaaaaaaacaaaaacaaacaaacaaacaaaaaaaacaaaacagaaaagaaaaatgctatgtcttctttcaaatattaaaaaatgcacgtgtacatttttgctaaccttaactgcacaattaggatagaaataatactaaaaaaagtaattggcataatttaagaagacatttaaatcctatgcataccactaaaagcatttaaaattctatttgttagtaaatgtttacaacagatttacttctagacaaaatttctcctcattaacctttgtcttaattgttccagtacacttgtttctatcagaactaaaacactatacaaatacaatcttctcccaaaaagaattaaatgaacctccatgataatgagcattagattaaaaatatcaattattttctattttttggcaggattacaatgtacaatattaataaaaataatattattttattattgttttaggttgtggaaagtaccagttacatgatggaggcaaattgcatactctctttggagtcacatatgtcttgaatacaaatgatggagttggtataaatcaggattcattaagccagatggacagagaaggtaggaacataaccaaattgaataaaatgggctgaatataaattaatagggagaggaatggaagttaggaatgagagagtatgtaactactgtacaataattcaagtctggtgtgatttgtaaatcaataaaggaaattgaaaattttgtatatgtttatgaacgatcaatgggaatttatttttttaaagcatcaatgactacatttgatctatgggctgtcagtttacgatttttaaagcagattaactatctctaatgtcttttctagttctaccattctgaacctgatataatgtgagttatcattcactcttctttctgttgagtataatcaaaatctattgctcaatttcagaagcaatgaattatggccaaatgaaacatttctcagaaggttttctaaaaaaatattttctctattaaattcataaatcttcaattcatccatttatgaaaaaaatgcatcactagctctcttccaatttaagcttttcgcacctgatttataacaaataattgtgagtgtctgaaatggaagaatactatctttcaaagctaaatttactgccaatacaactgacaaactgcactcttaaaagaaacacttgaaacagcttcagtaatggaactatacagcttactgatgtagcttgagatagataccaactagatggccattttccaaagatggctaagaggatgctaaaggaaatggttatttagcagatatgaactggaacatgggagaggctagtggtttcatgttttcataatggccttcagtaagggcttcctcaaaggccctttcacaaggcttgacctgaattgggtttgatgtccttgcatatccatgatggcagtgttggttcctatttactccacaacggcaatgcttctaactttcttggccgttttaaacaaaatctacaggctttgactaaaattccaaaatcacctcaactaaaactgaaatagaatccgaaataatatttgttttataaatatatttcctcattgttactatttgcattatccttaccttctaaattttacatgtaaaacagctgtgtattttcaaaattaataatatttttgtttttaataaaaatgttattgagaaataaattaagataaaaatactggcacaatgcctatgcatttcagtatatttatacttcctcccagaaaagttcaatggtctcagaattttttgtattcttatttattttttaattggcaaatagaaattttatatacttatggtgtacaacatgatgttttgaaatacgtatacactgtagaatggctaaattaaactaccatttgactacctcacaagtttattagtggtgagaacatgtaaaatctattcccttagcaatgtacaatattgtacattgttgtcaactatggtcaccatgttgtaaaagaaatctcttcaatttattcttctaacagaaattttgtatcttttgacaaatatctccccaatccttcccttcctacccagccccatgtaaccatttttttacgctctactttcatgagttcagctgttttagattccatatatattagctttattagatcactattagaacatgcagtttttttctctgtgcctgatgcattttagttaacataatgtcctccagatttgagacaaatgaacgtatttgagacaaaatagaatactaaagtctaggttcattcacattgtcccaaataaaagaattcccttcatttttaaggctgagtaatatttcattgtatatatatatatatatatatatatatatatatatatatatatatcacattttctttatccattcattcactgatagatattttgtttgactccatatcctattataaataatgctgcaataatcatgggagtgcagatatctcttccaccaatagcctgatttaaaaatggaccaaggagcagaatagatagttccaaaagaagacatacaaatgaccagtaaatatgtgaaaaaaatgttcaatatgagtaatgatcagaaaaataaaagttaaatctacaatgagatatcacctcacatctattagagtaactattaataaatccacttcatataacttgtgtgtgaatatgtctctcaccaggttcaggcactggtaatactgcagcccagaatgcagtggagggaagcatttgagttcctattccggctggttcacatagtgacactgtgtgctatcttccacacggtgagagttttcccttaggatcagttattagtgaacttccttcacactgacctaaaatgtttctgtttttcgtctactcatctcacttttcacctgaacccctggtaaccaatgatctttttactgcctctatatgtttaacttttctagaatgtcacatggatgaaatcatacagtatgtagtttttttggactggcctctttccttatcaatatgtgcttaagtttcctctatgtctttttgtattgtgatatctcatttcactttattgctgaataatattacaatgtattggatgtatcacaaataactgcacttttgtaagaagaaaactgatcaaaataactccaaaatggtttaaagtaaatatttgcagattaaatgcaaaccgaaaaagttaactgctttggaattcgcatgcacaatacttacaatataacctcatgaagatataaactaattcatacatatcctttttgttttgtttagacggagtctcgctctatcgcccagactggagtgcagtggcgcgatctcggctcactgcaacctgtggctcccacgttcaagcaattctctgcctcagcctcctgagtagctgggattacaggcgcccaccaccacacctggctaattttttgtatttttagtagagatgaggtttcaccaccttggccaggctggtcttgaactcctgacctcatgatccacccatctcggcctctcaaagtgcaggattacaggtgtgaaccaccgcacctggcccatatatatccttttaatatttctaagtgttttttgaaaatatagattacaataaatctttcaactgagtatatattaactaattttctgaataatgactatagtagaataacataatttgcaatgtctaaatgttagacccagtttttaccgtataaatatagatgaaacaattacaatttaaaatctacttttattgttgagttcaagaagtaacaataaaagtaaatgttgtatgtgtcaaataaagcttctaattattttaaaagccaggcaatttaggatataaaagtgtttgtaaatagatgctataaaatttcactaggattcaatctggctctattgctttctttgtactaagagacaaatctaatttattttgacatgtttgagttcaatatatttgcaaatcagtaccaattaagatactgtttttctacctactatgagaggatttaataaaaatgggaagggaagaataaaaaaaaaacacccactagaactccgattatttataatcttggagtaattgcatcagagtgatctaattttacatatttaaataagaaaaacagtttaaaaaagacatgaatcaggagagagatgctagttcttccagaatacttaggatggattttagataagaaaattaatgaagggccaaaagactagacactgctttttacgtatgttccaaagaatgcgtgctttctgtcactaagagttttgcttctattcagttccttaaagaatcttcatctggaggatacaaaaactgaagtataaacaatttatccaaatatttgaaagcaaaaactgcaatctaaggtgtttggtttttcctttgcttaaattattatattgttctcattaaaatagtgtgttctaatctctcatagtcattggctcttaaagcttaaatccataagaatgcgctggagaaattttttaaacttactaaagtacagaagatccctgatttatgatggtttgactttcggttttttactttactatgggtatgaaagtaatatacattcagtatgctcctggacttacaacggggttaggtcctgataaacccatccctgtttgtctactgccctaccttaattattatagagggcccttctcactctcaaaagtgccctgctttggacaataaattatatggtcttacctatgctggaaactatatggatatattaaagtagcaaatttattcctctcgcttgaaaatttacaatttttttttagtgagaccgagtgtacaggtaatcagaattctgttttgaattatacattatttgacattaatatagtaatttctgctttcccttgtttgtaattgccagatatacattttctgttcactctatttttgtgcatgtgattttggtttaagtacattacttaatggcataaaatcatgtgtgaaaagtttaccagaggtaaaaagcattcttagaagattaagtaaatggcacagctattaagcaccggaggagttgggaaatgaatgacttatccattataaattggtgataaaaatgtgatgattttgaatcaagatttaaatagtataaaattctactttccatggagattgtggaagcacaaagtgacttccattaagaggatatgcatatgtcatttgcctgtttaacaccattcaatgtcttcaaatttctctgtgataatgaacaaagtttttagtatgactcagtaagtcccttcacagtccaactctccctacttctccagactcatcaccataggactccatttagtatgctattttgtctcaaatatgtttgcattgattactaataaaataaaattaatgtatcctactgtatgttttacttggatcaaaatttcccatagatacaatacaatgaaataatgggacgtataaaatcactctttgtattgaaaagtttgtgctaaattctaaacagtggatgtaagttgaactgtttggacttgagtcctttgttgaaggaagacttgcttcactctgctacatgagcaaatgccaaaatgtgtataaccttggaaatgtgaaagagaaattaaattccatgtaggtgcacagggaacctatcaaaactgtaatgaaagattgtcagaatcattttgtcaatagttaaatgggcgaaacctattatgtttgaggcaaggttttaatagtgccataaaaagacaggaaaggctatcttcaggtaaagccagctcttacattggacaacaaatctaaattaaaatagaaaacaattttagcaatcgagttatgctctctgcatatgcatttgttttacattattttaatagtcttcagacagctttcattaacttatttgcaatcaagacaaatcattctttccaaactattgttcatcttattaaaatcttttctcaaaatctgtaagtccaaacttggaaggttttataagaatgatagcctgggcaatatagcaagacactgtcactacaaaataattaaaaaaaaaattagctgggcatggtggcatgcacctaaagtcgcagctacttaggaggctgagggctgagatggaagattgcttgcagtgagctatgaccgagccattgcaccacagcctggaagacagaatgagatcttgtctctaaaaagaaaaaaaaaatgatggctatgttcctcaacataaggtaattttaattctctttaataatgaaatgttaactagacctgctcacttgctatttctttggccactgtgataatattacttgcattttcatagtttacaaaaatgaatgccttgattataaattatactttttctgttttgtatatcaagaggtataatgctaatcctttgttaaatatactctaattttattctttaatataaagcttcttgagaaacttattttaagtataaattgtgtaaaactttcaacctgtcatttattacaaaactaattcgtatgaatcaaccaactagcaattttttattttaacagagaaagtggtaagattatcttttgaagaagagttaaagtttttcaaaatttcagaatgttcacatgtataatattctgattttgaatttgatatattaaattttaataataatagaaattgaaaaggacttatagtatattctctgagtttagcaatatatcaacttaagaggttaacaaatataacttagggatatttgcccttattttattatatatataccagtataaattttgaatttaggttgttatggaaattacacttgcaaatatacaaatcttaaaaattaacatgaatgtgacactaaatcatgcaatggttaatattcaagttgatacatttccatttttaaataaaaaacaaaggcctacctatataggtggcatatatctttgaaaattttgcaattaattgtatttggcaaattttttgataaattgtgtaatataatgcatttcccactcaaaatcaatattcacatttagactctatgatctattccagacgtgttgaccttttcatgatatttacttttaaaactgatgacaagtgaatttcagtgtgtataagtcttagtccatcatcctgaaatgaaggtcaaatgtcattctcattcttcagaaggctaacttacttcacctatgggagtcaatgtaatctcaagtagtatgtgtttgaactactattaggattttgctatttctgtagggtttaaatgaaagatatataaaaggaatttaatgactctgacattgtaactaatttctaaaatatataaagagataattgaccgaaaatctcttagtaaatatgaacatgcagtgacaatgagagtatgcctctcagatcttcaactacaggaagcacaattggtcaaggtcccagttactgtggactgaaatctgtttatgtttgtatgaaggacatagttcctaagggctgcttaaggagtcaagtattgaaatgattattaggccaactaaatgatctctatagtctatttcattcattgcataatgtgaatttgagaaaagaatttttatgaataagattaacacatttttctcaatttctaatgaaaaacaaattgtagaaaatgatttaaacaaagatatgcaattgtaaatagatatgaagaaactacctaatcacttgaatggttaaaaaatcaaagtttataattggaatatttctgtgtaatagggatattacccggacttaattcatttccctcccacccccaccaaaaaatgaagctagttggagataattttgagaaagagaggtggaggatgtttcaacaataaagaatgaagaaatgccattagctttttaagaactctttgtttagctctttgttcaaggaaagatagtagagcaagaaggaagaatgatcacatggggcatgcaaattctaagacactaatatcattgttatatctttgtcaaaaatagaaactgaaggaaccaaataaaagagaaacaatgcatgtggaagatttgttacaatttgagatttttggtcgtgtgtatgcttctaaaatatacaaacgtttgtttacagttgtagaaaatgtcacaggatccttgggatgttgcttttccagtaggaagcctctgtggctggtggcacctttacatgaatttttttcaggcctactgggcttgtttcacccactcagcctggcaggcttcacttggcttcttctaccggcccagatcccatgcctgccaagggtgagccaggtgcagagcagcaaggtggggatgagagtgagtgtggggtccaccactgtgcacagccaggcacgctggctgctgtggtgggaagggtggccccaggtgccagcacagatgccagctccatacaagccagtggctggatctggtgcactgcaagcagattccactgaaggcacccatgtctggatgaggagaacgtggtggcacccagtagattggagacaacagaaaccagagtcccaaagacggtgtcatagccctggctcagggagctcctaggtctgggatccctgaagggccacttcgcttctcttctctccttctcattgcccacaatgtggcaagcggggaggcatgtttcagccctgctggtattactgctctttcagtcctgccattcagcaggtcccaagttcttgtcccacatctaggaagaattaggtatatagccatctgaagggtgagcaaggcaaagaggtgcttcattgagcaacagtacatctctcaggagacctgaaataggcagctcctatatgcaggcaggctgtcccgatgtctgcagccctcagtggcgaggagacccagagtgggtagctcctatcctcaagcaggttgtcctgatgtctgcctgagtctggttgagactggggtttttatgggcttcagaagggagaaagtgatattgctgattggtccatgggcagccatgggcagccataggcagcctggagaaagcaccataagttctcactccagtccagggaactggcaggctgggcaccagccttcaggcaatccttggctagaaggtggggtttcaccagacccatccctttccacccaggagcctgtctgccttctgctgccattcatggcacccaggctgtttgtgcccaagaggttcctgcaggcccgctccaggccacccccagccccaccttggcttctctcccatgctcattggtgcccaaagtccagagtgggctgaggtggcaaggggctggtatgtcagcaccacatgagtgtgggaacacacagccaggtggtgacaatgctcggggcttgatgacagctttgctctgaaattggagcaggccctggaagcagggagaggccaggcattgggagaacacactttgagcatgcagcaggaggggggcccaggtccacagtctcagctgggtgattgcacctgcacctgagagctctgggctccagcccctccaactcagaagtgggtggggcccctgcctgttctcagctctcactgactctgcagagtgcatagccccagctgtgtttccctggttgcagccagcgtctttgcagcaaatgctccagacaggtcgctgttgtcatcaaaaggaatagtatacagtatgaagagatatatatttcaaaagttttaagaagaactcattgttttctggatagaacaattgatcattaatgacaaatgaagcacacaatgtcttgatcctccatttcacctaagtgactccataaaagattgatgtgaaaaggtcaagaaattaacaaaatgagtctgtttcaattactataacagccctacaaagcaaagagaatcaagtgtatagtaattcttatctactataactctggccattataaaagtaaacatatgaggcaattttcttgccattatgtgattactcctacccttaatgattattgaaagccagccaccaggaaataacatcagttcacaggatttgaaaaaaaaaatcaaatcttttcccaatacatataaaatatcttaatattataaattataaaccagaaaaacatcattttccttgagaaatgtgtttttaaataatgacaacctaatttattttattgagtatagggttgtctttgtaaaattcttcaataattttcaaacttcattaagggagcattagcagaaagtaaagaagtaatttttttgttctgttttgttttgttttgttttgttctgagacgaagtcttgctctgtcacccaggctggagtgcagtggcgcaatctcagctcactgcaagctcagcctcttgggttcatgccattcttctgcctcagcctcatgagtagctgggactatgggcacccgccaccatgcctggctaatttttttgtatttttagtagagacagggtttcaccgtgttagccaggatggtctcaatctcctgacctcgtgatccgcccatctaggcctcccaaagtgctgggattacaggtgtgagcaactgcgcccggctgtaaagaagtttttaaatatgcaaatgaaacagaggcagagcatgattaactatgtggaagaaggggctggttttttattatgttgttacttttacataagtcagaaagcctactaattatctgtcatcaaaacttcacaggcaaaccagtaggtttttcctttagtaaatattaaagtacttactgtggtgtttattacttgtgtctattattttgctattttacaattttggaagaagacaatgataggtctattgttatattccagcaactaatcaattaccaatagaacaacatagaagtgctttcaattctaaaaaaagaacaatggattttgtttctctgtctagctagaactggtatactgaaaaacgtatgccaaatagtaaatgcgaactctgaaccatttttgatcaaggtcttcacaatgctagttttcagctcataactcaaatttacactttgccattatgctttcatttttattttctttatattttacttctgtgaccaagacactgcaacttctcagaaaactggagaaagtaattcattgtataaaatattcaacctttagcttgaagtccagaaaggtttggcttggaatatgtaatgttaatactcattaaactgaaatcactaaaaatacagatttttaaaacaaccagaaatgttaatctgagatttgctttgaattaagaaaataaatattcattctcttgatattttaagaacaatttacttcactaacgcatatttaaatgtaaaaatgtttctattctatcattagctcatgtaccccatggtgcattctaactaatcagtcattttaaaatcactgtggcaattaaaatctatgaatctgtaaattgtttacaatcacatgtttaatgtgctaggtcttcacctacaccatttcccctttttcctcaacaactgaggttgaactaggacacagttgcctagcaaggaacagcattcctctcccctagttagagctaaatgtagacccgtacctggattctcacaacgtaatgtgagctgaactgaaatgtgcaattctcacctcacttggttaaggaaatctctagatgtggacttctgtctggtttcccctttctgctgactaaaatggtaataatgagttattttgaaatagagtgttgaagatggtgacccctgagttgtcccaggtccctgaactttaaaccattgatatttggtggtttcctattacagtgacctaaactaccctaactcagtctgattaccctgagatttaatgatttaatgactgtctaatagaaataagtcaacggagtcagtgacagaacggggacgtatgggtcaataattcagttaaacattctacgataaataaatactttatctttaaaatctctcttttatacctaatcatttgttaaatgctaatttttcctatggaattcaaacacaagtattggaacgaagacattcctgagatgtaaaagccatgtgtacctcagcttacagtgctagattactgctttccatttgtaacacattaccttcccctacaccctacaaagaacataaatcttgagctatcatttttatatttcccccaaatttgatcacaagaagtagaagttttttcactaggagcaatcccaacacgaaagaccatcctaataatcaaaaattaataatgtcatttagcatctctgggaataatgtgcatccagttgaggcagtaaaatgaatttgaaaaaattagagaagaatgaggcatatgaggttggcagaaaccattctgtgcttcactttttttcattaagaaaggaaagtgtgttggcctctaaagcagcctgaaatggcataggcatattgccaaagctagcaattgaacatattaaaagaaaataccatacagaaataaaaatattctaccatgaatattttcatatttccatatattcatattttgcaatatgaatgagaatgacttttaaatatgattaattaattatgcgattagttgttggaaactaataaaatgttgaacaacttatattagttgaaacaacagtagctaataggactaagcctgctcaggaaatgatgcagaccacttagttccatatttttttggccagaaatcagtcaaacggcagaattcagaattcatccctagttaataaggagaggaaatgtaatccagctatatgcccgtgagaaaaaggatttaggaggcatccagatactgctatgtatttcctcaatggtcttcaaaaagaatgaagagataattgaagatgataatcattagccttaagtttctttatagttcagttaaaattttggttcaaatttagacctatataaacatttatattcaattatttgcatttatccaaaaagtagtgtccttgttcatatttggcataacatttatttttcaaattttctggttatttgataaaaaattaatccttttaagtactcaagtactactaaatgcattatgatcaagatactgattcttagcatctctgggagttatgtgtgtacagttgtgtatattattaatacacagtaggatgcaacaagattaccaaattctctttataactcagaataacaaatgaactgggataatcaagggcaattttgtaattgttagaattctggaagatcaaaattctcccacatgtacccatgtgactgttgttaattttagtaccatataattggctaacttttgctctctaagttaacaacaactttattaagagaatctatttgtagttaatagttctatgcagagacggtatgaaatggtaaattatacgttgaacaacacattcgcatttttaaaacatggcattaagcaaagatacttaataaagaaagttaaatgagcaatgccctgtttcaatttatgaccttggcctcaatgccacaatattttagctaaaagagaagtctagaggcatatttctattgacaaggaaatgagctctaaatgaaaacctagagaaacagtacaccacttaagtttatttaaagaggaagtttaagcaatatatcactttcttctcttggagtttccaaagataattagacttgccgcaaggggctttgaagaacacagatgggaattttaagttaaaactgtgagcgtttttttggatccacttagaagactaagtatattttttgagaacacctgatctagataatttagtgagaaacaaagtgagtttatatccgtcctgttcttgagaactccaaaattaacatgttcagagaagttcttccaaaacagaaaactgtgcataggagtccccctttatttatgggggatatactccaagacctccactagaagcctggaacttcagatgacaccaaagcctatatttactatgtttttttttttttcctgataacccagacagttactaagtgactgatgggcagcctggatacaatggacaaaggaatgattcagctccagggcagagtgacacaggacagcacaagatttcatcatgatactcagaatgccatacaatttaaaacttacgaattgtttatttctggaattttccacttaatattttctgaccacggttgacctcgggcaacaaactgtgaaaaatgatactgtggataaggaggggactactgtattccatagcaaagaattggaatccaatccaaaggattggaagcacaggttactgtgtcagaaaaaaaaggaaaataatagataataatgtacatgtgggtgagaataaccttttaaaacagattaaacaagaattcttatttgttttacatatggtttacatctcgatgatttacatacatgctatggaagattttctggtaattatattacataatttaattttgtgtagattcttctaaacgcagctttgtatgagaggatgaaactgcttggttcagtgggttaagtgcttgcagatgtatccctcacctaccttattcctcagtaccttagctgctgttctagcttaaaattattaattcattctaagaaagtaaaaaacactaaagtcatcctagaacatgatcaagttctccattacctgaaatattcatttttcattatcctcaattattatcatcatccaactttcaatttttctttggatagactaaactactaaaatattctggaatttaatgtagactcccacaccccttatttatatttctgcataggctgaatatttggtgtggaatatccatctatatctttttggattgactaaactctacatttccttcaatctacaacttaaaactgtgttaatcatgttcaaatatagttaagtgtcccttagcctgcttcctcaatactgtgatcttatttctaccattgtgttctcacagtgtattatatttttcatatagttatttgtttccagagataccagagagcttgctttctctctctctctccagataaggacatggcaaaaaggcagctgcctattaagaccagaagagaccctgaacctgaccatgcagacaccctggtcttaaacttggattgtcagctaccagaacaataagaaaataactttctgttgtggccgggcacagtgcctcacgcctgtaatcccagcactttgggaggctgaggcaggtggatcaggaggtcagagatcgagaccatcctggctaatgcagtgaaaccccacctctactgaaaatacaaaaaattagccaggcatggtggtgggcacctgtagtcccagctactcgggaggctgaggcaggagaatggtgcaaacccaggaggtggagcttgtagtgacccgagattacgtcactgcactccagcctgggcaacagagcaagactccatctcaaaaaaaaaaaaaaaaaaaaaaaaaagaacagaattttctgtcgtttaagccacccaatttatggtattttgttatggctgcctcagttgactaaaacagtatatatactaaccataaactataatatataatattggtgtatatgcatatagtgtatatatataaatgtatatgtattatatatgtgtatatatagtgtgtatatatatatacacacagtatatatataaatttatgtatacacacagtatatataaatacacacactacatttatatatatatatacacactatatatatacacatgcactacatatttacacacacaaacgtacacacatacacacatacacactgattagatggaaaatatgattgcagattgcatgccaaaattggaaattgaatgaaatgttccacctggcaataatgagaaactaaagatctatttctcaccattcagatcattaattagaattgaaaccccaaaatataatgttgtattttaataagtttgcactaattttttaaaaagtatccattattcattaaaccattactaaaacatattttatactaaattgtcatattaaccatttaaaaatttaaactatattttatgttaatttagaaacgcctaaaccaaaattggaagtctactcataaattcatattacatcaattttgagagactcctttcaaaaatgccctaaacatttcgtgtatttcaaaatcggacagaaatcaatacctatattcctcctgtgtgaagcgtgggatctcaccaggatgtaagacaagaatcttcactgtggcactgctggacatcacaggctccccatcatcaaaagcaaccaccaccaacttaaaaagcaataaaaattcatgttaaagattataagtaagaacagcgtaacagcacaatttttatatgtatgtttttacttattggattgcctggttccagaaggggaagcaatgatcatttcctcactgcctaccaggtggcagacactatgctagaaaatactacgttctcacttaatctttacaataatccagccagataaatgttattattttcacttgctagatgagaatactcaaagaagtaactaactctatgattaaaaaacaactaccagtaaaacaagtgtattatactatatctctccaattaaagactcatttctataattccactgaagcccacagtaaatacacatgattttatagcaccaatacacttatttaagaagtgttaaattcagacacataaaaagctaattatcttgctcaaaaaagaaattaattttcctagtgaattagttgtttttgagattatagggcagaaatactttactctagaggataaaattggaaatctttatagtttaacactctttggtatactatctcttaaaaacaaattataaggccaagttcatttggtatagcagaaattgttcaaatgatgaaaactaagaaaaagctttagtgttgagatgtgatgtctgacattatttatcactgcaataggatttataattgattattttctttaataacctacattacatcaaagtaattctatgtttactttaagacatgttaaatactttcagaactatgtgcttctttggaatataaattgttttggaagctgcaggttaacaatgtaaactaattcaacctagatcacagaagactgtaaccaaggatcatcctgagagccacaattgacctttgggttaatgctaatttacaaactgatcagctgttccaaacagcggtaaaatcatgagagacatagtgctcactgatccttacgtggttaactgataaagctatttccctactgtagagtcaaagactttattcacagtgacaaaaattattctaagtaactattaaaaatggaaatgttcaaacacttaataaaattgtctacttatggtaatgcaaattattgttttaataccttgccaggtagagacaggcattattttgtcaaatatatttttaaatatgtaaaaaacaaaagagggaatatgttctgtttcattagtatttgaagaaaagtaaaatttgacaaaaaatcaaatagatacagatattttcctagatatatgcaaagattaacataacaacaatcagtattgagtggtattaggaaaatggatactctcaggaaagatgaagaatgcatacaaggggtatttttttcaaattttctaggattgtaatatatcaatcttatcttaaaaaagtgagtaagggaaaaatgatattcatacaagtagttgcatgatagcatttattgtaacaaaaaatggaaagtctaattataaagcaactcagtattatattaaaaagaaaaacaaaatgttatatagtaaaatactatgaaaccactaaaataatagtattaatgtcacttattggcatagacaacatcatattgaatttaaaaaccagtatgtataagactatgtgatttgaaaacatatatttatatatttgtgtttgtatgaaatgtcatcatgaggatagagatcaaaacgcaaattctagctatttccaagatgtgagataccaagtggttttctttttactatttttgtaagtttctaagagaaaaaaaaattgtaatttaaaaaaattaaaaaggagaaaaattgaaagaaaaaaatgtgctgtcatctgttaagccaaattctctatcaaaaattaaacatcaaatagaccacataatgaaaagagacactgaccttaaaaattgttgtaggttcttcattaagattgactcgtgttattactcttccagaatcttcttccacttcaaaaatactggcagggtaaggaaactgtacatcatctactctatacctcacacgacttgcaggtaatccctaaaataaaattattaattattaatttgctgttaccaagttaaaacacagtgcaatgataatattaaatggatctttaaaattcatggtcttttagaagtgaaaatcatatttccatattttcattctttcagagctgaaatgtagccagatcattatttcttcatgataactcaatctgaatcaatgaagtatctctactacaggttattttaaaatgatttatatgagagaaaaattaatggttgctttgggcatcttctctaccactttcctttaattatgtgaattacatcttcctcccaaaacacccaatatctccttttttaaattcagagacagggtcttcctttgttgcccaggctggagtgcagtggcatcaccatagttccccataacctcaaaacttctggtttcaagtgttcctatcccactttagcctcccaagtagctgggaatacaggtgtgtgcaaccatgcttggctaatttgagaggactgtagtaaagtgcaggaatggacatgaaagctaaaaaaacaaaaattatttaccatctacactgtgttgattaccatgctaggtatttctatacatcattaggttaatgctcaatcttttaagatgacattaataatgaagatgatagtaataatggtaagttaatgacgctaacaattgctagatgcttaccacttgccggaaccacattaaagatgatgtatgtgtactctgttacccattttagagctaaggaacttgtggcttacaataagttaaagagtgctgaaatattccagagataggccaagataagttgggacaccaaacaaagtcacttttaaagaaaacaattaaaatttgataagtttttaaaagaatcaaagtgattgtaaaggaacagtcaaaattttgctggctgtcctcacttatattaggtttcagattggtttcctttggaactatgtagggtgacattgaggtgagcactgtaacatttacagtgcttaggccttgtaaatttcttaaaacctagaagtcaaataaatatcttgagcagagaactagtatgtggtaaagttttacttcaaacctaaacactaaattacaacattaacttcttcagagaaagaaacactcctatttggcattattctgatgaagaagaagtaagaacattaccccccacagggtgttgatttggctggacttgacactttggtgtaaaaactgttctgagaacattgctttttatatttccattttcttcaagactgtccttgaaaataatctgttgctcatgttggttcctgaattacagttgggctatgagataaatatgagttttcaggatttgtataattccctattttctgttagttcagtcctttcatatactacacgtcaccactgatgactgtctccttgaatacattctttatttaacctttttccactattctgccttttctccttcccatctggtgctctgtctcagactctgcttgttcccactctttctggctactaaatgttggagttttccaaggctctgtttcaagaacttctacattttctacttctactctcggcccctggaacctctcccagtctgatagcttcaaatatcttctatttgttcataaatatcaaattttaatatctggctaaactctgaacattttaagtccaaactagtacacataattgtccacagatatgctattttcaaataaatgtattcaaaaccagaatgatttcatctcccaaatttataactcttctactatagataatggctctaccttttactaaggtgttctatctgaaagcctaggggtaatcattgatcctttctcttaagccccatagccaaatcatcatcacatcctgccaatacctcaatgagtataggccctaatgtcttctcatatcctctgtgttttctgtagtagactcttaattgactttctgcttccattgtattaaaattatctcatgactcctgcttaaacccttccaatgattttgcatcacacacaaaaaaaataaatacaaagttgttagtaagggcaatctgatcctaaaaacatttcttttttgcctactcatctgatttcatcttgttcatttccctttcacacattttccttgttcctgcctccttggctttgccaaggcaatagtcctttaccaggaaaataaggtggcaatataatacactcatctctcagatttttggctaataaatttaccttcctcttctccaggcgttctctaatactccctttaaattatctttcttcagcaaccctgtctgaaattatagcatatattttatgtatttacttgtttactgtttgtctcccacataagaatacaagctttattagggtagggactgtagctgagtaccttgaatgttacctgacccataatatgtactcaaggagtatttgaataaataattttttatttataaaaaaatttatttataaattttatttattcataaaatttttataaattttatttattcataaaatttttataaaattttatttattcataaaatttttataaatttatttaaaaattatttataaaaattttatttataaattttatttataaaaaatttatttgcataaataagtgaatggataaccacacatcaagggtgcccagacacttcaactgatatctaaagtattcatatatttgaaggtttgggaaatagagaacattgaataaaccttgaaagcatgttagggaactgccagttctgggataatatttttatataaaccactgatttcacctagtggtggatggtcagttcacccactgaagatttatagaaacaaggacacatttttttagaaaaactttggcctatatggacagaatcagacttattataatcatatacaatggcaaaccttgtatatgatttgcttgtgaaagagtgggggtttagcagaagacatcgtaggacttggggcacagtgtcatgcaatgtcagcaactttgcttgcatttgaataataatgataataacaagagttgttagctatcagtttgagtattttactatgtatcagactgcatgtattacatgcattttcatacctacaataagttcagaagttggtattaatagtacctacatttttttttttttttgagacagagtcttgtactcttacccgggctggagtgcagttgcacgatctccgctcactgcaacctccgcctctcaggttcaagtgattctcctgcctcagcctctcaggcagctgggactacacgagcccgccaccatgcccggctaatttttttctatttttagtagagatagggtttcactatgttggccagccaggtcttaaactcctgacctcatgatccgctcgcctttgccttccaaagggctgagattacaggcgtaagccaccgcgcccagccctactacctatatttttaaaataataaaatctaggctttaagaattatcttctgaaattttcttagctggaaaatgccaaagttattaattgaacaaacttggctcacactaaaaccgaagtcttttaataacaaatcaacttaacatttttcagtactatcttaaaggcaatagtcctttaccaggaaaataaggtggcaatacaattgagcaaaagtgcttggcaaagatactatagaatttgataccctagtaaatctcgccttagaacactttctaagaggttatgcagcacataattcaagtcacctccagaacaggaggtcaatgatgaaagaggataattatagcaccaactgcttcaagaacaaatttttagagtttttgctagcatgaggacccattcagtctgtaggacggtgactaaaattacttatgacaatcagattggctctcaaaaacataaaataagttaattatacttagaatcttctttttaataaagccaaaatttttttttgcatatggaattatgcctgtaattgataaaatgaaaaagaaaacatgctggtattatggaatgttatctctcagatgcctaaaatagtttgctatccagaacatcttagaacttcctggatgatttttacagataagattgtatgtatataaatatgaacatatgactaaaatagtttgctatccagaaaatcttagaacttcctagatgatttttacagataagattgtatgtatacaaatatgaacatacatgttacatagtgactacatcaataaactttttattctaagattgcaattattctatagatataccacaccatcatgaaagtgtggccctgagaggactcatttagcctgcaagaaacattttgattcttttatcacccttgttatcaaagcacattttattttatatcacatattatgataactatactaaataactaaaatgatgtagactttcctctcaaaacatttaaaagtttttttctctctctgtcctttcctaaaatcttccttcccttcttcccttctttttgctttcccttcctccctcctttcctttctttacttctttccaaagtctttttaaaatagttgcataaataagctatataataggtaaaggtaataggctttgggaaacagctctaattcctaatattatttctgggaaatttacaaaatgaatcaagtcaaattcattgttttaagaaattataaaaatagctgtggctttaatcttggaaaaaattgtcattttgaaacccagaatttcaagtactctaaaaaagttataaacttgatcacttaaaattatgaattagcatttattaagtatcttttaatactttattccactaaaatataatagatatgatcgaagtattctaatgtataaaactcacccttattagttatgttttaaaaactaaaataatatagtaaatgagtttatgaattatatattttaattattatatatgtgacaattaaatatttaaataatcattcatatatatatgtatatatattttaaagacaggatcttgtgttgtcacccaggctgatgtgcagtggcatgattatagctcactgcagctcacacaatctttctgcctcagcctcccaagaggcttgatatggtttggctttgtctccacccaaatttcatcttgaattgcagttctcataatccccacatgctgttggagggacctggtgggaggtaacttaaacatgggggcagttaccctcatgctgttcttgggacaatgagtggcttctcacgaaatctgatggttttataaagggcttttcccccttttgcttggcactcctccttgctgctgccatgtgaagaaggatgtgtttgcttccgcttccaccatgactgtaagtttcctgaagtctccccatccctctggaactgtgagtcaactaaaactctttcctttattaactacccagtcttggacagttctttatagccatgtgagaatggattaatacatagctggaactacaggtgcatgccatcatgctgaactaattatttttaattatttgtagagataaggatttctttatgttgcccaggttggtccagaactcctggcctcaagtgttcctttcagtttggcctcccaaagtattaggattacaggtgtaaaccactgcacctggcctagacaaacattaaatttccaaatatttgcttttattttaaattgtattaggaatagacagaagtctcttttatatatacccaataagttaatgtttctttcaattaaatacttcaaataatcatattttttaaagtaaactatagaaaacatttaaaatcaatatgaaaattttaaatattaatttctacttcattcatgataatatagtatgtatattctaccgtatctctctatgcatagctgtatatatgtcaagaggaattttttggaccatgaataatgataaaagctatctatttacaagtaaatcaatatttggaggaggttccaagatggccaaataggaacagctccagtctacagctcccagcgtgagtgatgcagaagacaggtgatttctgcatttccaactgaggtaccgggttcatctcactggggcttgttggacagtgggtgcagcccatggagcagggtggggcattgcctcacctgggaagcacaaggggttgtggaatttcctttcctagacaagggaagccatgacagatggtacctggaaaattggtacactcccactctaatactgcgcttttccaacagtcttagcaaacggcccaccaggagattatatcccacgcctggctcagagggtcccacacccatgaagcctcactcactgctagcatagcagtctgagatcgaactgcaaggcagcagtgaggctaggggaggggcatccaccattgctgaggcttgagtaggtaaacaaagtggacaggaagctcgaaccgggtggagcccaccacagctcaaggaggcctgcctgcctctgtagactccacctctgggggcagggcagagctgaacaaaaggcagcagaaacttctgcagacttcaatatccctgtctgacagctttgaagagagtagtgcttcccccagcacagagtttgagatctaagaacggacagactgcctcctcaagtgggtccctgacccccaagtagcctaactgggagacacatcccagtagaggccgactgacacctcatatagccggacgccactctgagacgaagcttccagaggaaggatcaggcagcaacatttgccattctgcaatgtttgctgttctgcagcctccgctagtgatacccaggcaaacacggtctggagtggacctccagcaactccaacagtccagcagctgacggtcctgactgttagaacgaaaactaacaaacagaaaggatatccacaccaaaaccccatctgtacatcaccatcatcaaagaccaaaggtagataaaaccacaaagatggggagaaaccagagcagaaaagttgaaattctaaaaatcagagcacctcttctcctccaaaggaacacagctcctcactagcaatggaacaaagctggatggagaatgactttgaggagttgagagaagaaggcttcagaccatcagtaataacaaacttctccgagctaaaggaggatgtttgaacccaccacaaagaagctaaaaaccttgaaaaaagattagacaaatggctaactagaataaacagtgtagagaagaccttaaatgacctgatggagctgaaaaccatggcacgagaactatctgaggcatgcacaagcttcagtagccgatttgatcaagtggaagaaagggtatcagtgattgaagatcaaatgaatgaaatgaagtaagaagagaagtttagagaaaaaagaataaaaagaaatgaacaaagcctccaagaaatatggaactatgtgaaaagaccaaatctacatctgattagtgtacctgaaagtgacagtgagaatggaaccaagttggaaaacactctgcaggatattatccaggagaacttccccaacctaacaaggcaggccaacattcaaattcaggaaatacagagaacgccacaaagatactcctcaagaagagcaactccaaggcacatgattgtcagattcaccaaagttgaaatgaaggaaaaaatattaagggcagccagagagaaaggtctggttacccacaaagggaagcccatcagactaaaagtggatctctaagcaaaaaatgtacaagtcagaagagagcaggggacaatattcaacattcttaaagaaaagaattttcaacccagaatttcatatccagccaaactaagcttcataagtgaaggagaaataaaatcctttacagacaaacaaatgctgagatattttgtcaccaccaggcatgccttacaagagctcctaaaaggaagcactaaacatggaaaggaacaaccagtaccagccactgcaaaaacatgccaaattgtaaagaccattgatgctaggaagaaactgcatcaactaacgagcaaaataaccagctaagatcataatgacaggatcaaattcacacgtaacaatattaaccttaaatgtaaatgggctgaatgctccaattaaaagacacagactggcaaactggataaagagtcaagacccatcagtgtgctgtattcaagagacctatcttatgtgcagcgatacacataggctcaaaataaagggatgaagatctaccaagcaaatggaaagcaaaaaaaaaatagcaggggttgcaatcctagtctctgataaaacagactttaaaccaacaaagatcagaagagacaaagaaggccattacataatggtaaagggatcaattcaacaagaagagctaactatcctaaatatatatgcacccaatacaggagcacccagattcataaagcaagtccttggagacctacaaagagacttagacttccacacaataataatgggggactttaacaccttcaggtcttcagagcagaactgaaggagacagagaaacaaaaaactcttccaaaaaatcaatgaatccaggagctgtttttttttaaaaaatcaactaaattgatagactgctagcaaggctaataaagaagaaaagagagaagaatcaaatagacacaataaaaaatgataaaggggatattaccactgagcccacagaaatacaaactaccatcagagaatactataaacacctctatgcaaataagctagaaagtctagaagaaatggatgaattcctggacacatacaccctcccaagaataaactaggaagaagttgaatccctgaatagaccaataacaggctctgaaattgaggcaataattaatagcctaccaaccaaaaaaagtccaggaccagatggattcacagccaaattctaccagaggtacaaagtggatctggtactattccttctgaagctattccagtcaatagaaaaagaaggaatcctccctaactcattttatgaagtcagcatcatcctgatactaaagctggcagagacacaacaaaaaaagagaatttaaaccaatatccctgatgaacatcaatgtgaaaatcctaaacaaaatactggaaaaccaaatccagcagcacatcaagaagcttatccaccacaatcaagtgggcctcatccctgggatgcaaggctggttcaacatacgcaaatcaataaacgtaatgcagcatataaacagaaccaaagacaaaaaccacatgattatctcaatagatgcagaaaaggcatttgacaaaattcaacagcccttcctgctaaaaactctcaataaactaggtattgatgtaacctatcttaaaataataagagttatttgtgacaaacccacagccaatatcatactgaatgggcaaaaactggaagcattccctttgaaaactggtacaagacagggatgccctatctcaccactcttattcaacatagtgttggaatttctggctagggcaatcaggcaggagaaagaaataaatgatattcaattaggaaaagaagaagtcaaattgtcccttttttcagatgacatgattgtatatttagacaaccccatcatctcagcccaaaacctccttaagctgataagcaacttcagcaaagtctcaggatacaaaataaatgtgcaaaaatcacaagcattcctatacaccgataacagacaaacagagagctaaatcatgagtgaattcccattcacaattgcttcaaagagaataaaatacctgggaaccctacttacaagggatgtgaaggacctcttcaaggagaactacaaaccacggctcaaggaaataaaagaggacacaaacaaatggaagaacattccatgctcatggatacgaagaatcaataccatgaaaatggtcatactgcccaaggtaatttatagattcaatgccatccccatcaagctaccaatgactttcttcacagaattggaaaaaactactttaaatttcatatggaaccaaaaaagagcccacagccaagacaatcctaagccaaaagaacaaagctggaggtatcacgctacctgacttcaaactatactacaagtctacagtaaccaaaaacagcatgatactggtaccaaaacagagatataggccaatggaacagaacagagccctcagaaataataccacacatttacaaccatctgatctttgacgaatgtgaccaaaacaagaaaaagggaaagcattccctatttaataaatggtgctgggaaaactggctagccatatgtagaaagctgaaactggatcccttccttacaccttatacaaaaattaattcaagatggattaaagacttagatgttagacctaaaaccataaaaactctagaaaaaaacctaggtaataccattcaggacataggcatgtgcaaaggcttcatgactaaaacaccaaaagcaatggcaacaaaagccaaaattgacaaattggatctaattaaactaaagagcttctgcacagcaaaagaaactaccaccagaatgaacaggcaacctacagaatgggagaaaatttttacagtctacccatctgacaaaagggctaatatccagaatctacaaagaacttaaacagatttacaagaaaaaatcaaacaaccccatcaaaaagtgggcaaagcatatgaacagacacttttcaaaagaagacatttatgcagccaacagacacatgaaaaaaatgctcatcatcactggccatcagagaaatgcaaatcaaaaccacaatgagataccatctcacaccagttagaatggtgatcattaaaaagtcaggaaacaacaggttctggagaggatgtggagaaacaggaacacttttacactgttggtgggacagtaaactagttcaaccattgtggaagacagtgtggcgattcctcaaggatctagaactagaaataccatttgacccagccatcgcattactgggcatatatgcaaaggattataaatcatgctgctataaagacacatgcacacctatgtttattgtggtactattcacaatagcaaagactttgaacaaacccaaatgtccatcaatgatagaccggattaagaaaatgtggcacatatacaccatggaatactctgcagccataaaaaaggatgagctcatgtcctttgtagggacatggatgaagctggaaaccatcattctgagcaaagtattgcaaggacagataaccaaacaccacatgttttcactcataggtgggaactcaacaatgagaacacttggacacagggcgaggaacatcacacaccagggcctgtcatggggtggggggaggggggagggatagcattaggagatatacctaatgtaaatctcgagttaatgggtgcagcacaccaacgtggcacatgtatacatatgtaacaaacctgcacgttgtgcacatgtaccctagaacttaaagtatattaaaaaaataaattaaaaaaacaaatcaatatttaaaattgcgttactacggcgatatatttcttttctatatcattttgaaattgtgataaaattgctttaatatgaacactaaaagcagtatacagaattactttcttaaagttcttactgaccagtaaattacttttttggttccgtactctcatcaaccaaatatagtgttctctatttaggtttagaaaaatcttgaggtcattagttatttccctgtattcacacagtattaccactagaccacagcatttaaatagatttttaaaagatttttagaaaaaaaaatcatagccattgctccttcactgctgaagacagaatgagatttggtttcaacaaatacttagatatgaggaagagcctttctaattggtaaagtaacatagtctccttcagaaggatacatgtattttagaaataaaatattcaaaataggagcatgctattacaggaaggttactaaatcaaagtgagctgaaaacgttgccaacatagaataataactgaatttaatgacaattttatatttgtttatttgtttattttaccttatttttcttgagacagagtttcactctgtcgtccgggctggaaggcagtggcgtgatcttggctcactgcaacctccgcctcccaggctcaaatgattctcgttccttagcctaccaagtagctgcgattacagggacgctccatgcctggataatttttgcatttttagaagagacagggtttcaccatgttgcctaggctgctctcaaactcctgagctcaagtgatccacccaccttggcttcccagagtgttgggattacaggcatcaaccaccacatccagccagaaattaaacacaatttaaaacaaatctctaggggctttttgttttccattagataaaatatacttaactttaaagattagtatcatacaactaagtaataatatacttatttatataagatatatttgtaagagaaatttaaaaattgtctaaaatattagaaattaaaaattttataaactactaacctgtcatcatgctcatatgttttatttctatttatttgtgaaatacagcattttttcagtccttgtttatatgaaaactgtctaaaggtttgatagttaatcactctatctttcctggaacactctttatatgggttatagaatatcatattccacactactggctgccttagtgatcactcttcattcttctatttagctgattcgtttacctattcacaactttcaagtgatggcgaccacaggcgcctctgccctttttcttattttttttttaaatttcaacttttattttaggttttggggtacatgtgcaagtctgttacacgatgtttcataatgctgaggtttggggtacaattgatccagtcatcgaggtagtgagcatagtactcaatatgtagtttttcagctcttgctcccctccttcccccacctcctctaatagtctccagtatctattgttcccatctttttgtccaggtgtacccaatgtttagctcccacttataagtgaaaacatgcagtatttggttttctgttcctgcattaattcacttggtataattgtttccagctgcatcaatattgctgcaaagggcgtgctttcattcttttttatgtttgcatagtattccatggtgcatatgtaccacattttctttatccaatacaccactgatggacactcagattgattccatgtcttagctattgtgaaaagtgcagtgatgaacatataagtgcatgtgactttttggtagagcaatttatttttctttggttatatacccagtaatggaattgctaggtcaaatgatgattccattttaggttaattgagaaatctccaaactgctttccacagtggctgaattaatttacattcccaccaacaatgaataagtgttttttttccccccataacctcaccagcatctgttttttgactttttaataatcaatactctgactggtgtgcggtggtattttactgtggttttgatttgtgtttctctgattattagtgatgaacattttttcttatgtttgttagttgcttgtatgttttcttttgagaagtgtctgttcacgtcctctgatttttaatagggtgtttgttttttgcttgtcgaattaggttctttatagatgctggatattagacttttgtcagatgcatagttcataaacactttctcttattctataggttgtctgtttactttgttgatagtctcttcgctggggcaaagctctttagtttaattagttcccactcatcaatttttgtttttgttgtaattgcttttggtgactgagtcaaaacttacgtgccaagagcaatgtctagaatgatatttcttagatttccttctaggatttttatagttttatgtcttaaatataagtaatttattcatatcaaaaaaatttttgtatgtggttgaaggaaaggcctagtttcattcttctgcatatggctagcgagtatactagcaccattcactgaataggcaatttttctctatagtttgtttttgtaagttttgtcacatgtcagatggttgcaggtgtgtgactttatttctgagaactctattctgttccactggtctatgtgtttgtttttgtaccagtaccgtgttgttttgattactgcagtcttgtattaataatatagtttgatgtagggtagtgtgatgcttccacctttattctttttgctttgctcatatgagttatagtaccatgcttaaccctaggtaatgtggggttcattcattcattcattcatttaacacgttcactaaatagaaattactgagttgtgagagtataaaaaatgaaaaagctcacaaggagatggagttgatctcacacccccttctcctgaatgttctttagaaataattcatccatattgaccttatcaaacaccaacctccttcctacctcaagcttttccatttgcttttgtctttgcctgtaagactcttgcatcattatcctcttttaacattctggtctcaaatgacacaaactcctctgcatatactcatccacaaactactctatcactattatttttatagcacatatgcttatgtgaaattatgttacatatttacttgtgtatggttttgcagcctgtctctgtccatcatctgtaagctccattcgagtagattttttttgtgatttgccattatttaagagggcaataataatttgttaaatgaatactacaactgatttaaactgtcccatagaagtgatatttacggtgtcttttaaataaacatagaaattaaccttctcagtcttaaaacttgagagagctacatttgttttatctgagttattttctaaggacaccaaccatcgggcctcccagagagtatcaaggaactgaaacttactagagcactgcatctgggcaacgagatacaagacccttcactgtcatgactggctaactgagtccctgtttactgttaaccaactcatcttctttatctgtccctaattcctgttttcctgcatgtagttacatttcttctctgcaatataaacccctgattttagtcagtctgggagatgtatttgacactaacctcccatctcctgggctgcagcacctgattaaagccaaccctggcaatgctttttgtctcagtgatcggctttctgtgcagtgagcaacaggacctagaccaaggatgtccgatcttttagcttccttgggccacattggaagaagaattatcttgtgccacacatataatacactaacactaatgatagctgaaagctttaaaaaaaatcacaaataaacctcataatgttttaagacagtttatgaatttgtgttgggctgcactgaaagctctccttggctgcatgtggcctatgggccatgagttcgacaagcttgatcctagaccaaacccctgacatttcagtaacacttacgtgtatgtgtatcatgagctgccaagatgtataacacatggggattatgagaaaaacagttcaagataagatttgggtggggacacagccaaaccacatcattccaccctggcccctttcaaatctcatgacctcacatttcaaaacacaatcatgccttcccaacagtccctcaaagtcttaactcatttcagcattaatccaaacgtccaagtacaaaatctcatctgagacacagcaagtaccttctgcttatgagcctgtgaaatcaaaagcattgttacttcctagatacaatgggggtataggcattggtaaatacacccattccaaataagagaaattagctaaaatgaaggggctacaggccccatgcatgtctaaaatccaggggggaagttaaatcttaaagctcccaaatgatcttctttcactccatatcatatccaggtctcactgatgctagaagtgtgctgccatggccttggacagcactacccttatggctttgcagtgtatagccccctcttggctgctttcatggctggcattgaatgcctgtagcttttccaggcacacacagcaaactgtcagtggatttaccattctggggactggaggacagtggctctcttctcacagctccactaggcagtgcaccagtggggactctgtgtgggggctcccaccacacatttctcttctgtacttccctagcagaggttctccatgagaattctgcccctgcagcacacctctgcctggacatccaggcatttccatacatcctctgaaatctaggcagaggttcctaaacttcaattactgtcttctctacacccgctggaccaacaccacatggaagctgcctaggattgagaattgcatcttctgaagcgatggcctgaactgtaccttggcccattttaaccatggctggagtggctaggatgcagggaaccaagtcctgaggctatacacagcaggggggtccctggacccagcccaggaaaccatttttccctcttaggcctctgagtgtgtgatgggaggggatgctgtgaatgtctctgacatgcccagcagacatttcccccattgtcatggtgagtaacatttggctcctcattacttacgcaaatttctgctgccaactggaattcctctccagaaaatgtttttttttttttttttctactgcatcatcaggctgcaaatttttcaagcttttatactctgcttccttttgaacactttgctacttagaaatttcttccaccaggtaccctaagtcatctctctcaagttcaatgttccacagatatctagagcaggggcaaaatgctgcgtctctatgcatagcaagtgtgacctttactccagttcccaacaagttcctcatctccatctgagaccaactcagcctggactttattgtccatatcactttcagcagtttgttcaaagccattcaacaaatctctatgaagttccaaactttcccacatcttcttgtcttcttctgagccctccaaactgttccaacctctgcctgttacccagttccacagtcacttccacattttcagatgcctttacagcagtgccactctacctggtatcaaattactgtattaatccgttctcacactgctatggggacataccagatacttggtaatttataaagtaaataagtttaattaactcatagttctgcagggctggggaggcctcaggaaacttacaatcatggcagaaacatacaagacatccttcttcacagggtgacagcaaagagaagtgcagagtgaagtaagggaaaaatcccttataaaaccatcagattttgtgagaactcactcactatcatgagaagggcatggaagtaacctccccatgattcaattgtctcccactgggtctctcccactacacgtgaagattatgggaactacggttcaagatgagatttgggtgaggacacagcaaaaccatatcaccctctaagaatttatttatctaagaatggggatacattgttggcaagttttcaatctataacctataaatatctgctaattttcgcattgacagcttctcatattcgtctctcaagatggtggacaaggatgagaaacataggtatgcttttgtactcatgggcctcacaattggacaggttggagagacaaaatgtacacataaaaacacaattatttcccaacatttctgattaaaactgtgaaaaggaaacatgtggtgctattaaacggaggtgctacaactagagaacagatcttaagatttatagtaaactagactttaaaactcactgcagacactcacaaatcacaaaatacacaaaatgtattttagttcatagagcgtatagtaattgtgttatatgtacagtctaatttagtatatcatttgagtattaaaatgataaactaggccaggtgcggcggctcacgcctgtaatcccagcacttcgggaggccgaggtgtgtggatcacctgaggtcaagagttcgtgaccagcctggccaacatggtgaaactccgtctctactacaaatacaaaaaaattagtctggcatcgtggcgggcacctgtaatccaagctacttgggaggctgaggtaggagaattgctagaactctggggcaggaggttgcagtgagctgagatcacaccactacactccagcctgggtgacagagtgagactccatctcaaaaaaaaaaaagaaaaaaacttaattttattaggattttgaacaaggggtaaaagtagacatatatcagtaggaagttacataaattaaagctgtcttttaaacaaaaagtcttcctaatttttggtaagaacgttattaaaatatgtatattttaaaaatgtgtgggattctaaaggccctgtcagcatattttcacgaaaactttcttctcgaatattacagtgccatggatgacatcagagttacttcaagagtttaggtattaatatcctaaagtttacagttgatgaggatgtaagcactgtaccaaactagatgcaaagttgtgtttttccatcactctggaagtgaggagaaagaggaggaaaaattaactaacatcaatgtgcttcacatgagctaagtgtgtcattctccatcaagcccaaacaataatccagcaaaatagttcttcttattcctatatgattacaaggtttaaagaggttaattaactgctgtacaatataatttttatgagttaaacaaaaacaacaacactagtgacatcagtcaataattttcatatactctagagtgcccaaacctaacggcactcaggaagaacatgatttatgacatctattataaaggaatcaattttttttggttcatgatttaggtatctttctaaatatgattgggggtagtatgtaacttatttaaatattatgtggtttccaaaatatgtaacaaatgatatcagctttgtgatgtccttttatctgctaaatttgaaatgtgtaaaattcaataattatgagtatggatatttactcatatctgtattaacatgaataacacatggcagacaaatcctgcattggtgatgctcacattagatttttaaaataaaaatgtgatataattctacagagtaataaggcgagaataattaatatagcagaatgaatgtaaatttacaccaagaaaatagaataataagatttcaattattttcttcattattcagcacattttctacttttgatttctattcttacagtgtgtgttaaacacaatatgtttcgacttagttatcatgagaatataattaattactacagaaggtaattgcatacctgtatgaaggatgtttcaaacttgaaaacttagggaatttcagtgaggcatcacgctacctgacttcaaactatactacaaggctacagtaaccaaaacagcatggtactggtaccaaaacagagatatagatcaatggaacagaaaagagccttcagaaataacgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaaggcaaaattgacaaatgggatctaattaaactcaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaaggtggcaaaggatatgaacagacacttttcaaaagaagatatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacacttttacactgttggtgggagtgtaaactagttcaaccactgtggaagtcagtgtggcgattcctcagggatctagaactagaaataccatttgacccagcaatctcattactgggtatatacccaaagaattataaatcattctgctataaagacacatgcacacgtatgtttattgcggcactattcacaatagcaaagacttggaaccaacccaaatgtccaacaatgatagactggattaagaaactgtggcacatatacagcatggaatactatgcagccataaaaaatgatgagttcatgtcctttgtagggacatggatgaagctggaaaccatcattttcagcaaactatcacaaggacaaaaaaccaaacaccgcatgttctcactcataggtgggaattgaacaatgagaacacatggacacaggaaggggaacatcacactctggggactgttgtggggtggggggaggggagagggatagcattaggagatatacctaatgctaaatgacgagttaatgggtgcagcacaccagcatggcacatgtatacatatgtaactaacctgcacattgtgcacatgtaccctaaaacttaaagtataataataataaaaaaatataaaaaaagaaaatataatggactaaaataattaggtccttagtatcaggggaaatcttgatttagtcatttttcttaaacacataattatcaagaaattacttactcaggctcacattgtttccttcataatttcttcatagttatagcaatcacattgtagcagggaataccaaacttattattatcattaaaaacaaatattaagtaatttgttttcaagaacacaaatattttaccccgacatggtttccaaaattctttttcccaaagtctttgaggcaactactctgactgattttgtaacagtgcaattcacaaaatctcccaagtatgatttaacatcaggaattactataaaggaattactataaagtggtttgggtgtgtgtgtgtttgtgtgtgtgtgtgtgtgtatacatatacacacacaaaatatatatatacgttttgcaggcatgtgacttagtcatattttagtgaatttaactggatgtcaaggtatccttaaaggacaaaagagaaagaaaaaaaaaaaaacagcaggcggaactcttcatgtaaccactgagaaagtcctgtgctttttttacttcttcctccctcttccctgtttttaacacctggaatgaccaatatgttttgacaacatgttggcaagttccttatgcagtttgacacttaatataaggtgtttgtatagttcagtttctacagataggatattgacacagctatttaagattgtaaaaaatacttgctttagggctatttaccactaaatgttttgggaaatgtgcttttcaaaggtaaacgtaactcgacccttaaaggtatgaaataacacattccttgtaaaatttatttatttaaacacagttgttaagtttatgaagttgacatttggcacaccgtcagactttcctaatacaaaaaattcatgtagccaaaggaacttagagatgaaccttatctgagctagtaattagtgaccctatattctatgccttaaattcttaacactgtcttcacaatctacaagattaagcaggatccaacttaggtttccctctccatcctcctgaaaaaaaaatggccttggtttttgaaacttactgttcttcctcatacttcagggcctgattcttttgttacgtgactttatcttggcataaccttcagacctccgctcagaatcacttctagaaccttccttgactctctagatacaatcatgctccctcttatctggtttcatagaaccctaaacatttctaagtgcttttctttttttttttttcttttttcttttctttttttttttttttttttgaggcagagtcttgctctgtcctccatgcttgagtgcagtggtgcaatctctgctcactgcaagttccgcctcctgggttcacaccattctcctgcctcagcctcccaagtagctgggactacaggcgcccaccaccatgctcggctaattttttgtatattttagtagagacggagttttaccatgttagccaggatggtctcgatctcctgaccttgtgatctgcccacctcggcctcccaaattgctgggattacaggcgtgagccaccgtgcctggccttacttgattgactttttaacttttatcctttcaagtttgaaataccaaggcttggaaccatgacagttttcccttatgcttaatctagcatctcttatataatagaatctctttaaataatattcaatgcacaaacatatagtaaatcttgaggaatttttattgtgtttggatctcaagggcacagatttgagttaaatattacctatagtttatgaaacattatcattgatggatcttcaaggcatatttgtttattcatttctttctcttcttttattctcatacctgtttttcctatctctctttgccaccaatggcaatctttttaatacatttaaggagtatcttttaactagaccatttatggtacattgtattatagtttagcaaatatcccctcccctttcttctacttcctattctgattttttgggctaggccatgtgacttgctttggtcaacagacatgaagaactgtgacacgggagcagtctttacatgtcatcatgtggttaggcaagttctcttaggattctattctcactatgtgaaaagcaggcctggttagccatgcgtccctgcagaaggagatatgtggaacagacatgagcccagacaaggtcagccaactcctagctgcctcacagacccataaataaaaatattgatctttgctattgcagaacagtgagattttggtgttgtttactaagaattgtttttgtaggaaaaactgtagaagcttctgtgtgcttaaaaaaaaaactttatataatggtattgctttctttttctattttcattgagcactcagttcttacacttcattctttttgctatgtgttaatcaaatcctgctgcaccagaagttcacagggtacttcacactaactaatgatcacagttgtataggaatctctggtatatgttagaaagttcataatatgacatacaatgttcctgacagtggcattgtcttgaatgcttttaaattatttgactctgtagtaaagatggcttgaggttggagagaggatggggtggcaggctctccattaccatggtgagtggaacagccaggtgtgaagccaaacaagctgtagcatttagccacaatggtagtgtagtcaaagggaaacttcaaaacagaatacttgggtccagtccttagattataaacacaccccgagaaaagatcaagcagggaaaaaattgtcatggtcatgtttcagaggcatagcaccttcctgactccctactaccttatgctacccacttcttctctacaacttatgctcaggttcctggacctctgacctttacaggattttccagaatgcaggggaaaagcacaaagagaaggaagcagatcacaaaatataaatatggatgacagatctcatagacttaaaccataaaaaaggtcagagtaaacataaaaaaaagatagttaatatatattatttactatgtagtaggcaccaactgttccacataaatgacatcatttcaacatcacagcaaccctataaagtatttcttttgtttttagaacacatgaaatatattctttaaacaaatttttaagtgtatcacacagtattgttaactacagtcacaattttggaaagcagatccttagaacaataccagaaaaacaaacaacaaataactcaattaagaaatgggtaaaggatttgaataactttttcaaaaaaaaacaacaacatacacactcgacatacaaatggccaacagtacataaaaatgtgctcaacatcattagtcataatggaaataaagtcaaaactacaatcagatatcgcctcatgctttgtaggatggcttttatttaaaacaaatttttttaaagttagcaagaatgtgaagaaattgctacacttgtgcattgttggtggaaatgtaaaatggcactgtcaatatgagaaacagtatggggtttcctcaaaaaaattactaatgtaactaccatatgatccagtagttccacttttgggaatttattcaaaatatttgaaatcaggatctttaagagatatctatctgtactcccatgtgtactgaagcattattcagagtatccaagatgtggaaacagactaaatgttcattgatggatgagtggataaagaaaatgtggtatatgcatacaagtgaacattactcagctttaaaaagaaggaagtactgccatttgtaacaatgtgaacgaatcttgaggacattatggtaagtgaactaagccagtcataggaccaataccgcatgattgcatttacatgagatatctaaaatagtcgtcaaactcaagaagcagaggtggttgtcaggggctaagggaaaggggaaatagggagtagctgttcaagggttataaagttttaattgtgctatttttgttctcattttccagatgccagaactgagggttacagtaaattaagtgacttgaccaaggccacagggctagtcagtgggagtttttgaagttgaaaccagacattcttgctcctgagcccacacttttgaaaccacttaaaattttattgagctgataaactatataaatttgcatatgaggggccatcatacaccagacacaattcatacaaagaaaagaatatctaaatatatactagtaaaaaactttaatataaaaatggagatttttttaagcagataaagctaaaatatctaaaaatgaagaaaaattaatttggcttcacactttataatttattaaataataaaaacatagcgaaacatcatctatatagctttaaagggaaaaacttttgacccaagactctagtagtctttcaagttttctaagtataagcaaaaaaaaagtgtcatataagaacttacaaagtgtatatcctcaataaattgaatacataaataaactaagagatgcagcaaatgcagagcttaagagtggatgggtcagaatataaaaggagtgttgcacgtcatacataggtttaaatatggaaaatataaatggctgtttaaaaatgcctaggaaatataattaaggcaccataaattatttttaaataaaatgtatgtgactaattcttcaaagaaaatataatgaaaataaacttacagagttaaaaacaaaaaggtgagtcataaataaatgtcatgtccccagatgcctcagacacatgaaaattaaaagagtaagaaggcagcatcaggagaccagaggccaatttaccatgaaggccgcccatgggttcctaatcaacagaactatggtccttcatttaaatttcattgtccttaccctgtctgcaaagtttttcaccattcatttccttctctccattgaaaacttcttttcacctgtaccacattactagcaggtttcccttccatcttgtcagtctttaatttctctggctctttccactaatcagtccttgacatatccccaaattctgagagtctatttccaggtttttctcttatctaattatgttttcattcttagagaatggatttactttcagagtttgaacctcaactcaggtaactcctgtgttcacgtttcttttttaagctcttagtctgatattttctgcccgatccatcccaggctctttaaatgcaaccacatcatccccgcgtcagatcaaagcaatcaaagcagctgcggcaactcaatacctatcatctagggtccttctcacggagttgctgatctgtgtgaaggcaaccttagcctcacactgccatctgcctctagcctcccctcagcattaggtttcatgtactccttggtttgataactgggcaacagataaggtttctgccagccccatggtacagctccttcagcctccatcctccacacctgaggccgaggggatgggggagggtgtgggtgccaatttttctcattctatagatagttgcactcagatgttttgaaatcatttaaaatttaatttgtcctaaaagtgacctcaggctgtgacacagtctctaggctatgttaggtctgtgtttgattgtagggctacggtccaaacatagccaccatgcaagaaaatgaacgaattgcaaagaggacaaagataagaccaggaattatgagtggcttaatttagagggtgttaaggccaagaatccaggtcatgagaagccaagataccctttcagagggtctgtttccatttcccctggcaagacactcagaataaagaatatcatttaagccataagggaggtctgtgggccagtcccagagaaagtctattatatttcactcaattttcttggaaatctgtcttgtttaaagtatgttgggacccaggtcctgtgaggtatattcttattccccactcccgaaatatgtgaattattgatactgttaaaagaaaagctttagacaaatttaagagtttaattgagaaaagaaaaaaaacatgatttccaaatcagcccctagaatcaaagaaaattcggagagactttggcactgtcacaaggtcaaacatctatgggaaaaaaatgtgatgtgcaaaaactaaaactgagatacagaaacagctggattggttacagctcagcatttgccttatttaaacaaagtttaaacagttggccgcctatgagtggttaaagtatacctactggaattggctaagactaagctgtcattacagggaaacatactactaaagttaggcttttagtctgtttacctgctaagtatctgagtatggacattttccaggctagattttagttttatttagtaacacattatgggatctgaaggacacttttttaaaggttgaaacaaacaaattttacgcacatttccatttataacaaaagaaaaatgcccctttagctctggtaagtatgacaatttctaaattaaaagagcattatttacatctgaattgttaattctaatattaatttcaagtattattaataatataatcatttttcactaagccttcccttttatacccgtttacactttcaaatctaattatattccactgttgttttaaagatcaagccccaactgtttcatggtgtaccttctttctaattaagtatttgagacaaatgggagtcaggctgggactatagcatgtcaattttcacaagctgacattcacagtaaaagtagttcttgattatttccctaacagctttgatgttaaggggaaaaaaagcaacaacaacactgagctgtgtatattccctcctcatgctcctgggtgagaaatcatagttagtagctgctgatcttaaaaatcagagtctctgctacattgttagcaataatctaaatcaatacagactaacaacacaagccagtatgtggtgagtcatgaaaaataaatcagtagtgatatcaattgaaaatgataccaaaaaactatattatctggaaggaaaaatacaattttataacactcttggtcctgaatagttttgactatggcacacaaagcaagcaagcagcgaattacatgactgttactttctttctactgttagcaccctccgctaatagattgtaacagaatgactgtttggagggttaagcattgggaaatgtccataattacatagcatgtttggtaacatcgtgacattttaataaaacacagatatacattatagaaaagaagatctagccatctttttacactctctagagatcaataaatgtacccttgaatgacagatgggtgttgaaacccctttgcaaataattcctcaggtagctcttctaagctctgaaacgctacaatagttctcaaaatctcaacagagggaaataaaatacttcacagttgtaatgattttctctttatatatatactttctgaaaaagtatagtgagaatactaagtatttgggaactgattttaaagtccataactattaaaaattgcaagaatttttatggagcatatttatttcataaatcagtattaaagcctgaaaaaagaagtcttaaaagtctacataattctcacaatgttatatatatgttatatatatatatgttctatatatgttttatatatgttatatatataaagaacatatttctcacaatgttatatatatatgttatatacatatatataaaagaaagttggtcaaaattgttcatattgagaggtgacaacatgctggtggccctcacttgctctcagcgcctcctcggactcggcgtccactctggccacacttgaggagccccttcagcccaccgctgcactgtgggagcccctctctgggctggctgaggctggagatggctccccctgcttgcagggaggtgtggagggagaggtgcaggtgggaactggggctgtgcatggtgcttgtgggccagcacgagttccaggtgggtgtgggcttggcgggccccacactccgagcggccgtctggcgccaccggccctgggcagtgaggggtttagcacccgggccggcagctgcagagggtgcactgagtcccccagcactgcccgcccgcccacgctgcactcgaattctcgccaggcctcagccacctccccacggggcagggcttgggacctgcagcccgccatggccgaaccccccccacccccgtgggctcccgcgcagcccgagtctccccaacagggtgctgccccctgctccatggcgcccggtcccatcaactgcccaagggctgaggagagcgggcgcgcggtgcgggactggcaggcagctctgcctgcagccccggcgtgggatccactagccaaagccagctgggctcctgagtctggtggggacttggagaacttttatgtctagctggaggattgtacatgcaccaatcagcactctgtgtctagcttggggttcgtggatgcaccaatcagcactctgtatctagttaatctggtggggacttggagaacttttatgtctagctaaaggattgtaaatgcaccagtcagtgctctgtgtctagctcaagtttgtaaatgcaccaatcagcaccctgtgtctagctcaaggtttgtaaacccaccaatcagtgctctgtgtctagctcatctagtggggacttggagaacttttgtgtctagctaaaggactgtaaatgcaccaatcagcactctgtgtatagctcaaggtttgcaaacacaccagtcggcactctgtgtctagctcaaggtttgtaaacgcaccaatcagtgctctgtgtctagttaatctagtggggacttggagaacttttatgtctagctagaggattgtaaataccccaatcagcactctgtgtctagctcagggattataaatgcaccaatcagcaccctgtcaaaacagaccaatcagctctctgtaaaatggaccaatcagctctctgtaaaatgggccaatcagcatgatgtgggtggggtcagataagggaataaaagcaggctgcccaagccagcagccgcaacccgctcgggtccccttccaccctgtggaagcgttgttcttttgctctttgcaataaatcttgctgctgcttactgtttgggtccatactgcctttatgagctgtaacacttgctgcgaaggtctgcagcttcactcctgaggccagcgagaccatgaacccactgggaggaatgagcaactctggacgggaggaaggaacaactccagacgtgctgccttaagagctgtaacactcactgcaaaggtctgcagtttcactgttgaagccagcaagaccacgaacccaccagaaggaagaaactccaaacacgtctgaacatcagaaggaacaaactctggacacaccatctttaagaactgtaacactcagtgcgacagtctgcggcttccttcttgaagtcggtgagaccaagaacccaccagtttcggagacaatattaaacatgttccaattactactctactttaaacaagaaccttataaattcctaaaatatataaaatataaggaatggtacaaataatgcttcacttgttggagatgaagtgaagatgaaacataaaccctatttatttatcccaattattccatgttcacatactcacaaaagactattctgtcacaatttaaccctgttccccaaaatctcctcataaatgcagtttcaaaaagaacaaaactatgcaaataaacattacacctgtagttttgttctgtcaaatttgggaatgaaacgtctctggtgaaaagaaataaacggttagccatttttaatttcaaaaatgatcagtcattcactattcatgtctcatgtgaactacataatgtcaacgctgtcacgaaagcacggtagaaaaaagagatcctctcagcttcaatttagtagagggaaaagttcctggaatatgtttttcctccctctggagcacttcagttttgcaaaacatgtattttataattcttattttgtattcaacaatagtgctctctctggctttcagagtttttccagtttctctgatatttcaaaaagttatggtgttgtcattttatagtttaacatgagtggttctcacttcattcaaaagaaacaggataccttgaaaacgatgtggccaacctctagaaatgaaaattattattgcttaataatagtaatacctaatatatgcaggggcagaagcctggttgagcatgtatatacatcaatcatttaattctcatagcccttacatggccaaactaagtcttggagatattaagaattttttctacagtaatacaaaattaaatttctggaagtctggcacattttgtcaatcctgaagaatacagaataaacgtttatttattcacctattcaattattcaacaaatgtttcctggcagactagtaagtagcaggcttagagttagacatgagaatacaaactgaaataagttttgattcctgtcctcaaggaccttacattctagtttggaagagagactattaaataaacctacagtgttaagatagatacttacagccccaggtagtggtataggatccctgaagagtatgaaattgaaactattttcttctaattaataaacatttataacagtaacagagtagaaaacacttggcaagcctatctgaataataattattctgtctttatggtaccaacataaaataagggtaaaaagcataacatttaaaaaaaagtaattatgtaatatagtaatttcaaaaacgttcatggaattgagcttttacttaggattcgtgtaggtgcaaccaaattgcaactatgctcacttaagggtcccagtttgcaacaatgattcaaaagctcaattctgatcatagctatatcaaaagattgttggtgtttccaggggcaaaactgagtctgataaatatatactcaataactgaaataaatagattcagtatttcaatggaatgactggcatccactttctatctaatgaaaggccaatatcaattattaaacgctaaaaattactactgggagtgcaaaactgaaaacctcttccaaagaaatatgaaatttaaatctggcaattttatttaaaagagcttcaaagtgtaaaaacagagctttctctttacataaatacttacgataagtaatttatcttctttatagaacagacaacagaccaagacaacttttcgcaccttggtggatgcgctctgaatgccaagccaggcaccacagtcattactaccaaaggggaagtaataaatttactgtctatacgaagactttcaggtctgtcccatgtaggtgaaaaatagcgcgacttttaatctctcatcattaacgccattaaactctatattaaattctgtgctgatgaaaattttttttaaatgtatgttagtattgtgtttccttacactcatttattacagagtgttatggtttctatttgcaattctgtcttttctataaaattttcagtttcttgagagcaaaaactggttgccacaatgaccagtatatagttggtgctaaaaacacatatgttgaataaaattgaatacatattcctaatttcaaagtaattgtacatgttacaatgtacttaaaaaacagaaaaattgccagtttcacattcactatctttattgatgggttcaagtctatgaaatttttgcctatcatatatcccaaagcacaataaagcagtttcaaagacattttaacacacttaagaaaaggagcttctgaattaaagcccaccactttcatattaacattaatacattttgattccatatagtcacaatagagtttataagacttgtccaaatcgaagctgaaaaatgttatgatggccattcacttttaattaaatacaagcattaaaagaaatactatttatattagcaatagaaaacagaacttctaaatcacttataagattcaggattttattttcttactcttctaaaatagttcatttaacttttatttgtatttttctaaaatttatcagccaccaacttacagtgtgagcccactcagagaaaaatttaaatcatcaggataataattaatatttataaaacaaggtatttatagaaagcttttttatatgtatactattaattatacatggtattttatcactctcactataataatattttaattaaaaccttgccttgaaagataatttgggatatctcaaaaaagtaaagttctatatgataaaagaatgttaactattttctgtaagcaatcttaagctttttaatttaccaaaataaacacattcaatataagtttcatgtgatatgttgatttggagtttgctaacaaaatagtcatatatgcatacagtggaaaatacataaatttaaaacatatccagattaagtgaagcttacaaatggagacaattcatatatatttatcattgttagataaattagtaattagtacattgtgcattctagaaaaacaaaaagcatattctttgtctaggttcaataatagtcatctgaaatatgctctgtacctgtggatgaaataagtaaaagaacataaaatgtatgaataaatagggtgaaatttacagagactacttttgctgtcttgtgattcggtcatttatgagtgttaaggatttttctcagtacagttcagaatattaatcaatgccttctacttacaggagggtctgcatcttcagcataaactgttgtgataggtgtacccttgactgcatccggagccaccatccctttgtatattcgtttactaaagacaggaggataatcattcatatcctgtaaaacacaattaggagtttagtacttcagttgaaaccaggttagggatacagttactagattgactcccagtcttcatatcacacaacttatttaccactgtcagccttccatcctctcaattccattactctcatttcagactggcacctcagaggaaactgccagagttctcatacaatattaatgtgtggatatcaactgaaggccgttccactggaataaagtctttcaccctcaaaaacatgccttttggagactgaagtgaccctggaatttttttctaacttctaatggtaagaggtaaaattttaacatttgaaaataagaacaagtttctttaaaagctacattctgtgaagcaggcgtaaaagattttttttaaatgctctttatatgtttttatagcaatgtaaattattttatatacttagcataatactgactagaacatttcagatacaaactgtgaaatatcctttgttgccattttacatgataaaaggagattttctctgcagcgcactaaaataatgacacttaagattagatatatttatacacagaaaacaatgttaatttactgaatttttttcagagcaacttatatgtatcttatttttccaatttggcgctatatatgcattgttattcatgcattgtcaagttcattaaataaatagttatcaggtatttcccactttcatcagatatttagcacttcagtgcgaggcactgaagatactgttgtgactcaagaaaaagatgtccctgtctttgtgtcacttaactgccattaggctagtaaaaatactaatctgcagaaaggctagtaactttgactaaattaatctacttatcagggccaaaataataaatcaagtcccctgaaaggaagaccatatttttctgaatcattttatcttttagagataattgtatataatcttttgtcaataaataatgcttattcatatggcagatttatttatttataatattttaataatccttaccctaccgtgttttgggtagtgtgggtcaaacatatttgaactgaaacctaaatttgttaattatctgctcttctcctccaagtcccctttttctcacttgctagtaaaaacaaaatttaaaaaattctacatattctttgatatttgcttagacacaacaattttcctgtacagtattaagctggaaacacataaattaacagatctcaaacttctctttttgcaaagaagtcagaataattatttcttactatcaaacaatgcttccttttatattcgccatagagttgagttctgagtagtcaatatgaataaacctgcatattctaataggagaacttgaactgtacacaaaactgaaaaataaaaaatatcatttcttctgttttgaaatacagtattcaccatctcttctatgaaaaatatttttacaataaattatggactttagaatctgaacaagtaaatgaaccgagaagttttagttctctataatgaggactgtgaagggtattgatcttgaggctccatgcagggagtaaatatataaaacattagcattcacacattttcgtgccctttccaagagtgccaattaacttaataagtggatgtggtaactaagggtgtggaaatcctttagcacccctaaattgtaacttctgaaggttcgaaaggaaggagcccaacactgcaatgtttccatgcatgagtttccaatgagctcattatgttcttaaaaattttattctttattttattctcaggggaaatttaaaaccttaatgtcacaaggtactttttggaaaatttgattcttcagaaacaaaaaaaatgtatatacttttccaattatgtcaacacagctgttcacagtgttgaatatgatgaactttttatttgcttgggaagtattcattggattcaccttctaacttgaatgtacagtgattcacaaactgattagacacacacctaagactgtaaatgactgaagcctatgaaaagattggttctcttccccctttattttctattgacaggatgaagaataaattaatgtagttattgtagtagtatttctttttatggcacgttgtacatactttggggttataatctttcattgtggttacaaaagcagctagttgcatatagtttttccacaatgcattatttcaagaggagaaatgtattgaaatgcaattccaacaagcataatcaatagttcactgtatttatgctcagggacatctgaacaaaaatgtatataaatcggcttctgtgcaaatgttctcttgtgcagtaaattaaggactcgctcagcactccaaaaccatgctcttttctcttgcccattattccactagagggtagtattagcaaaaagaaatatttcctcctctgtagttaagaattgtatcactaaaacccataatatttgtttcttttggtaaaaatttttattggtctcaacaaaaaatagttttaatgcttcaaaagagtattctgaatgttatgatttacaacttgaaaaaccttatggtttttttcttaaggaaaactttaaaaaatggttatactcataaagcctgcaatttgtttccatgtgtcaagcaaataaaattatacctgaaggtgtaggtagctaacaggagaaaactatgttttatttatttatttgctacattagagtctgtaataatcacagaaaccttttctcctttagcagactaccaagaagatgtaaggaatctttttaatgatcatgctaggaagataagaacttgctggtaagtttgtaaatgtaatgacaagttgaagttctacacacacaaaaaaaataaaaataaagagaaaaagatgataaaatttttgattttctggaatcacaggcaaaaacctatagaacagtttttatttagaagataagtagaaagttctaactagttggaacttgatcatctttttaaaaataacgtgtaggctgggcacggtggctcgcatctgtaattccaacactttgggaggctgaggtgggcggatcacccaaggtcaggagttcgagaccagcctggccaacatggcgaaactgtgtctctactaaaaatacaacaataagcctggcatggtggcgggcacctgtaatcccagctactcgagaggctgaggaagggagaattccttgaacccaggaggcggatgttgcagtgagccgagatcgcgccattgcactccagcctgggtgacagagtgatactcagtctcaaaaaaaaaaaaaaaaaaaaagatatgtatatagcaaatgccagtccttaccatactaaagctaattcaggctctatgaggagacacagacagtataagccaatgggcggaatgactttagttgtttctgtcttatggtctagcattagcattatccttgttgagctatatggctgctctataatgccttgaggtttatggagccgatacctacttttacgtgggtgtatggttgattgtttgcctcttaccagttctgttttccactactagacactttctatttgctgtccaagttgctgtttctcatatttctcatattattagcattctgctgggtttttttctctctcaatttctgtattgtctccttgtctttactgacttatttcccttcttttatgcttctgcataaaaagtcataaaaggctacatctgcagctaaagaaaatatttgatatttttactgccaggctaggcatattcaccacaagctgatttaagaggccatgggccataagtgaacattggtggtagcctggcagtactccccaagggtctttgatagtggcacagggtaaggctcctctgcttgtggagaaggactgtttctcataggttgagtgcctgctcagccacagtacacaagaacacaaggtagaattctaaggttttgacttccagacggtaactttgaacctgttcagggcctgggagatttttgccaccctgaagggaaagacacaggtctggctggctttgccacctgctgattatagagacccatggccttgaacaaacttaagtggtagccagggtggttacagcaggtcttggacaagacccagtgctgtgctgggtttaggtctgacccactgcagtcccagcagtggggtccacaggggtgcttgtgtcaccccaaccccagctccaggtggctccaaacagagacactctgtctgggagagagcaagggaaaagaacaggagtttctgcctggtaattaagggaattcttctggatcttatccaagaccattaaggtagtaagagtctgccaagaaccacagtgttactgggcttgtggtgcctcctaaagcagatacagctttagcaacacctacatcctttcaaatacctgaaaagctttccaaataacaaatacgaagaagtccagactgtgaagaatacaataaatacccaacgcttaaatgcccagacacagacaaacatccacaagcatcaatatcatccaggaaaacatgaagtcaccaaatgaactaaacaagccaccagaaaccaatcctggggaaacagagagagtgatctttcagacagagaattcaaaatagttgttttgagaaaactcaaaaaattcaagataacacagagaagaaatttagaattctatcagatacatttaacaaagagattgaaataattttaaaaatcaagaagaaattctggagttgaaaaatgcaactgacaccctgaagaatgcatcagttttttaatagcagaattgaccaagcagaagaaagaattagtgagcttgaagacagcccatttcaaaatacacagtcagaggaggcaagagaaaaaaaagaacaaaatcaatgaaacatgactacaagatctagaaaatggcctcaaaagggcaaatgtaagtgttattggcattaaagaggagacagacaaagagataagggtagaaagtttattaaaaggaataataatgaagaacttcccaaacccagaaaaggatatcaatatccaagtacaaaagattatagaactaccagcagatttaacccaaagaacactagctcaagttatttaataatcaaactcccaaaggtcaaggataaataaaggatcctaaaggagtaagagaaaagaaacaaataacatacaatggagctctaatacatctggcagcagacatttagcagaaaccttacaggccaagagagagtggcatgtcatacttaaagtgctgaaggacaaaaaaaattcctagaagagtatatctggttaaaatatccttcaaacaggaaggagaaataaagactttcccagacaaataaaagctgagggatttcatcaacaccagacctgtcctataagaaattctaaagaaagttcttcaataaaaaaagaaagttcgtgagtaataagaaatcatctgaagatacaaaactcactggtaatagtatgtacacaggaaacacagagtattataacactgtaactgtggtggtgtataaaatattcttatgttaagtagaaagactaaattatgaaacaaaaataactacaatcacttttcaagacatagtaaaataaggtataaatagaaacaataaaaacttaaaaagcatggagatgaagtatagagtttttattagttattttttcttgtctgtttatgcaaacagtgttgttatcagcttaaataaagggttgtatgatagtatttgcaagcttgatgataacctcaaaccaaaaaatgtacaatagatacataaaaaataaaaagtcaacaaaatcaaagcaccagagtatactaccttcacttaaaggaagacaggaaggaaagaaagaaagaagacaaaccataagacaaccagaaagcaaataacaaaatggaagcaataggtccttagttataaaaaataacattgaatgtaaagggattaagctctctaatcaaatgacatagagtggatgaacggattaaagaaaaaaaagacaaaatgatctgttgcctacaagaaacacacttcacctataaagacacacatagactgaaaataaacacatggaaaaatatattccatgctaatggaaaccaataaacagcaggaatatctgcaattacaggaaacaaaacagatttcaagacaaaaactacacagagagacaaagaaggtcactatataatgataaatgtatcaatttatcaggaagatataacaattgtaaatatatatacatatatgtatatatatacatgtatatatatacatatatgtatatatacatgtgtatacatacatatgtattcagtgtgtgtgtgtatatatatatacacatacacacacacatatatattttcaacattggagagctcaaatatataaagcgaatattattaaagctaaagagccagatacatccccaaacaaaaatagctggaaacttcaacatcccactttcagcactggacagatcttccagaaagaaaatcaacaaagaaacatcagacctaatctccactgtagaacaaatggatctaacagttactcatagagcatttcatccaacacctgcagaatacacattctcctcagcacatggatcattctcaaatacaggccataccttaggtcacaaaacaagtcttaacacattaaaaactttgaaataatatcaagtatcttctctgaccacaacagaataaaactaaaaatcaataacaacataaattttggaaattatactaacacatggaaattaaacaatacattactgaataaccaggggtcaatgaggaaattgataagaaaattgaaaacttttttgaccaaatgataatgaaaatacaaagtatcaaaaccaatagtgaggtgtggagttggcaggacttcctgggttgatttggggactttcacaaaagacccctgtgactcagggttttgagttcttaatcaataaagtgaaggattcaaagttaaccactccaagggaggattgaaaaaagagccactctcaatggacaaaaagaaagaaaggggagggggtaacacagggatataagtcctagccaccacagccagcagtggcaacccttccaggtccccttccaccatgtggaagcttccctttcgctttgttcaataaactgtgctgctgctcactctcctggtctgtggactctttttgagttgtaacactcactgtgaaggtccgcagcttcattcttcgaagttagcaagaccacgaatccatcagcaggaaaaactcttgattcaataggatatactgaaatttttactacgtgggaaatttatagctataagtgcctacatcatgaaaggaaaaaaacttcaactaaacaaaacaacctaatgatgcatctttaaaaactagaaaagcaagagcaggctgaagccaaaattagtagaagaaaataaataataaagatcagagcagaaataaatggatttgaaatgaagaaaacaataaaaagatcaatgaaacagaaagtttgtttttttaaaaagttatataaaattgacaaacctttagccagactaactaaaaaagaagagagaagacccaaataaataaagtcagatatgaaaaagaaaacattacaactaatactgcagagattcaagggatcattagtggctactatgaacaaacatatgtcaataaattggaaaatcaagaagaaacaaataaattcctagacacacacaacccatcaagattgaactatgaagaaatccaaaacattgaacaaactagtatcaagtaacaagatatagcaaataacaagtatcaagctgtaatgaaaagtcacctagcaaaggaaaagccagaacctgatggttttgctactgaattctaccaaatatttaaagaagtactaatactaatcttactcaaactattccaaaaaaaaaaaaaaaaaaaaaaaaacaggaggagggaatactttcaaactcattctataaagacaataatactgataccaaagctagacaaagagacatccaaaaaagaaactataggcaatctccttgatgaatattgatgcaaaattcctcaacaaaataataacaaagaaattcaacatcgtatttaaaagatcattaatcatgaccaaataagatttatctcagggatactaggatggttcaatatattcaaatcaatcaatgtgatatatcatcaacagaatgaaagagaaaaaccatatgatcatttcaattgattctgaaaaagcatttaataaaattcaatgctctttcatgataaaaaccctcaaaaactgggtgtagatggaacatacctcaacataataaaagtgatatatgacaaacccgtagctactcccatactgaatgaggaaaaactgaaagcctttcctgtacgatctgggacacaaccaggatgcccactatcaccactgttattcaatatagtactggaagtcttagcaagaacaatcagaaaagaaaacaaaataatgatcatctaaattggaaaggaagaagtcaaattatccttgtttgcaaatgataaaatctaacacttggaaaaacctaaagactacacacacacacacacacacacacacacaccacacaaagtattagaactgataaatttagtaaagttgcaagatacaaaatcaacacagaaaaatcagtagcatttctatatgccaacagtgaacaatccgcaaaagaaatcaataaagtaatcccatgtaaaacagctacaattaaaataaaatacctaggaattaaccaaggaagtgaaagttctctgcaatggaaactataaaacatggattcaagaaaatgaagagaacacaaaagaatgaaaagatatctcatggtcatggattgcaataatcaatattgttaaaatgtccatactactcaaagcgttctacagattcaatgcaatccctgtcaaataccaatgacattcttcaaagaaacagaaaaaaaattctaaactgtgtatggaagtacaaaagacctagatagccaaagctatattaaacaaaaggaaaaaaaaaaacacctggaggaatcacattatctgactttaaataatattacagagctatagtaaacaaaataggatggtactggcataaaaaaaaaaaacacacatatatccatggaacagaattgagaacccagaaataaatttacacaactacagcaaagtcaattttgacaaaagtgccaggaatgtaaccagggaaaggacagtctcttcaataaatgatgccaggaaaactggatatccatatgcaaaagaagaaattaggccccatctcatgccatatacaaaaatcaaatcaaaattgattaaagatatgaatctaagacctcaaactatgaaatgactgaaagaaaacatgcggaaactctccaggagataggactaggcaaagatttcttgagtaatacctcacaagcacaggcaaccaaagaaaaatgaacaaatgggatcacatcaacttaaaaagcttctgcacatcaaaggaaagaatcaacaaagtaaagagacaacccacagggtgagcgcaaatatttgccaactacccatctgacaaggaattaaacagaatatataagcagttcaaacaactttgtaagaaaatatctagtaatctgattttaaaatgggcaaaagttctaaacaaaaatttctcaaaagaagacatacaagtgataaaccggtatataaaaaggtgctcaacatcattgatcatcagagaaatgcaaatcaaacttacaatgagacaccatcttacaccaggtagaatggcttttatctaaaagtcaggcaatggcaaatgctaataaggatgtggagaaaaggaaccctcacacactgatggtgggaatgcaaattagtacaaccactatggagaacagtatggaagttcctataaaactaaaaatagagctatcatacgatccagaaatcccactactagatacatggccaaaagaaaggaaatcagtatatgaaagaaatatctgcactcccatgtttattgcagcactatttaccatggccaagatttggaagcaacctaagtgtccatcaacagaataatggagaaagaaaatgtggtacaggtacacaagggagtactatttaaccataaagaagaatgagatcctataatgtgcaacgacataatcaatgaaggttaaaagtatatgagagaggcactttctggtgtctcccagaaaccagtgggtgatatttatggagccatgggagagattctttactacgtagatatactatttttaatcctggacatgcacattttctttgttttctctggtttggatttttataggaaatatgttatatcttagtcctaaaactctagaatagtagaattaaagatattttctcctgctatcaccaagttcactgacaaatataatataaagaacacaccaataggaatctgaaaatgcggactagaagagagggaaacatttgaaagccatacttcaaagcaaccccaacagaacaattagcaagttgtaaaaaacaatattaaatctgaccatacaccaactagctggttcacagaaattatcatttattcaaattcccacctccagacaatacctcttacctccatacaataggtatgctgtagatgaaatgtccagaatttctgttttgtttgagtctgggacaacctcctggtctctcaagcatcagcttttctgatgaaatcaaaagcaggaccctatcaacactgtcatgatggagcatcagtagcacgtaactgcctctcaggtgtccacggtttcacaaatgctgccttggtactgggcactgagttttcatctagaaaagctatcctttttcttctattctatggggtagcaatatttctttctggagaagaaaactcctctgaaaggtggaaatcttagcttcattttccaagactcactgtgtttaacaacaacctcagcccttgttacaaggtgaacctgatgatacttcatttctcgtcatttcacccctccctgcctactcccacacctgcacactaagacaggcaaacacaaccaagggtcaatctagtctcccgtcttcacagaagcatgtctccctctctcctactcccatgcagccattctatccaaaattataatgagcaaaatgacttgggtcatctgtttatctcagacaagttctttatactccttataatgctgcttagtataatatatccatttacatattcagcttttcagattcatattcagttttcagtttgctgtagaacagcccttttctttctgtgtattttctatattatgttacaacgcagactctaagaccaggtttctattataacttagtttgtaaggctagttatcactctggatcttttaaaattgtttagaattttattttcactttccagagatttgcttatatcatctaatttactatcatcacagattcagttcttctaaatatttagtatatctagaaatatacaagaaaaatatttacaagtaaaatacacaagaaaatatctctaatttactatcatcacagattcagttcttctaaatatttagtatatctagaaatatacaagaaaaatatctacaagtaaaatacacaagtaaatatcttgtatatacaaggaaaaagccttgttacattgatgttctataaaatcttttcaagaaaaaatgtatgttatttgtttgatcatcacaggttttgttttggattcttaaaacttgacactaagaaagctgtgtgcagatgtcttgataaaaatttttatttatactgtggaaatattgtttttccaaataatacttgaattttcccattcttgctccaattttaaacaggtttgatggactaggcattaaacacttcatcttttattttttcctcttgtttacaaaagaaattatgtttctgctcattttgaaagaaagaacttcaagatgttttcctgtggtgactttttgggtccaagtatctcctagcgaataccatacaattatgttatcaacaaaacagcttttcagtactgcgagtaattagaccaagtatagacaatttgaaaagctggtaaagactacatttgtagagaactgagaattgtactccattcttctcttaaaaaaaggataataatattttatgggcctcagtagtatatactagaattttaaagttatatttgtgataatccccaccctgagttatcagaaaagaggaaagcaagtgtcagtctacatttgggagaatttcctacaaattttattatgcttagatgaacttggaataaaaaagtggtattacatatgtctagagttaaatgttaagttttgctttaaatgtataataaataggcaatgactttgcatgagtcaggacgccttgaccaaaggaatggtgtgatttctctaaataagataaagcaattgatacaacacgaattaaaccaacactcttctctatctgaggaataaattatcttccagctgctgatgtagaagcgttaagtaatacccccatattgaaataaagggatgttgaggcaacattaagaacttttttaaagaggtatgaggcccagatacagaatgagggttacttagggcatatcttgctttttgaggtgataattttggacataatttaactcccctaacattttccatcaaaacaagccaagcaaatatatccaaattgaatccagagctgccaagtcagaatctatgagtgtttaccataactgtctgtcatcaaccacaccctcatcagagaaaaggccacaccatttgaggatctatttttcgatctgggaagaaaaggggaaatgtcattaatagcaagtcttttttttctcttctttgtccaaaatcatcaataaatgaattatttttctatttttaatgttttaactgttcaattccaccaagtcatatgagtagacaagagtaaaccaaggcaaatttttcacctggtccagaagatattttgctatttagtctatatagatcactctcaccttagtctttttcatctgcttacatattatggcatcttcataaccaccaatattatattccctaaatatttttgtaacagatttctaaatgttataacacaatagtgtgacaaaatcatatttcaaaatacaatacaatcaaagccctcccttcaggcaatccataattttgtcttgtcccttgatcctttttccagaccactagagcactgataattattgtctcgggaaagagaggtatgaaaagaaaaatcaggttaccccagaaaagattttgacagtttgagttcctatttccaaagaaaatttagtactgaataaagttttaatttcctgaaatagacacatttcttacctcctgaaataaatatcttaggacagagagacacaagaacggaataattaagtatatagacatgtggacccccgagaaataaagaacccagatcctgataaaactctcccaacaggtttagggtgtccgaggatggaaggagcttacgatctccattccaaggtagtttagaggtggaaacagtatccatagaagaaatggcatcaatttgtgtgctagcagataatccaggtcaagtgtaaaaaaagacagcgaaagaggtgggggccaagagaactaactagagggagctggtgtgtgtcaatctcattgagaaaagaaaggctggcgagtggacactagctcatctgaaaaatccaggtggagacacactggaattcatcaggaaacagcataacacatagagaacagaggagagcaagacaagacaactgcccaccctggggtggcacagagtcaggggagtcctcccactgtggagaaacagtgagtaagtgagtccctggggacccaccttctgccatggacttttgcatccctggactcaggagatctcccccatgagctccccaccggtgcctccaggctgacacggagaaccatgtggagtcttggcagagccatactcaggcacacagggagtcccaggagacttgtatccccagacactctggcaccagtggctgtagctcctgcagcagtggaggccagacttgcatgcctccagtaaaggggccaaatccacgaggctgagcagtgaaacattgcaggcctcatctcagctgcaccttgcaggataaggcctactgtccattccagccccacctgagttcctgggtcgggagcagctctgtacttctctgggacggagctcccagagggagaggctggctgccatttttgctgctctgcaaccctccctgtttttgctcttaggcttgggagggacagggattagggactaatgccgacccccaacacagcgcagtttccttacagaaaagcgggtaggctgttttccatgtgggtccacacccttgctacttctcaccgggcagggcttcccaacctaggacctcggcaacccccgacctgggctcttgggccagtagcagctctgtactttcctgggacagagctcccagagggcaaggcaggtcaccattttttgctgctccacagtcctcattcctgttgccctcaggctcaggagggaatgtggtggttggagactgatgcaaacgcccagcacagcacggcagcattacagaaaagcagctagactgctttctatgcaggtctctgcctctgctactctttactgcccagtgcctctggacttgggcccctagcacaaccaccttgtcaatgcctaacacttcagtcagtggtgagaaaaccccagagacaatccacaacctctctgtgactgcagctacccttgggctggggaggaacaaagggcttggccactatgcaggaactccagcacaccacagccacaatatggacagaagcccagtgtctgtttcccgtgagcccccacctctcactctttaccaggcagtgcctaagctcgggagcacggaacagccaccccatctccagctgagcattctcactgctagtggctttgtgtttccttaaggaggggctcctacagtcaactaacagccactctgccactgccacagcagtagttctgcccctgctgcccttggactggagaagaaagaaagggccaaaggttttactcactcttccaggaggacacagtcatcatatagagagaagcccagactgtcctccctgtgaatcctcaacctcccgttctttacccagctcaggccagcagtgcagccaccccactccctggctggacattcccagtaggagcagttttgagtttccctcaggttgagcacccagggacaaccgaaagcccctctaccactgctgctgcagtgatattgcccttgctgccctcagactgtggagggagcaaagaccctgagtgctttagccacacctccagacagctgcatcacccacaagcttggtcctacaatgcagccaccacaccccaggctgactgtactgattagtagtggctctgtatttttctggggtggagcaccaagagacaagtgaaaggccatctgccacagccacagccaaggtcccttcccttgttgtgtctaagctggggaaagaacataaagcctgagcttgccccagagctacaatgtgtagcctgggagtgccaaacagatatacagccagcagtcaagtgcaaaaggagccgacactttcagatcactgagaaggggcacaacaatccttaggaaatagaggagactgacgaagagtctacctactggccattccagttaagtgccatctgctggatcacagcccaaactttactattaaaaatattttgctaatatattcttctgtgaaaccaaggacaagagctcagttacaaataaaggtcatgcacaaaacctcactcctctgaaaacatctaaataaaccaactgactgtactcaaattagacagttgaaagaacatcagcgaacacagatgagaaagaaccagtgcaagaactttggcaactcaaaaaacaagtgtcttctttcctccaaacaactgtactagttccctagccaggattcttaactcagctgaaatagttgaaatgaaagaaatagaattcagaatatgggtaggaatgaaaatcattgagaatcagggaggaagtcaaaatccaaaccaaggaaactaaggattacaataaaacaatacaggagctggtagatgaaatggccattataagaatgaaccaaaatgatctgatagagctgaaaaacacactacaagagttttatattgtgattgcattaacagcagaagagaccaaactaaggaaagaatcagagagcgtgaagactggctctctgaactaactaagaaggacaaaagtaataattaaaaaaagaataaaaaagaatggacaaaacccctgaaacatatgggattatgtgaagagaccagatctacccctcattggcgtcactgagggaaatggggaaaaagcaggcaacttggaaaacatatttcaggatattgtccatgaaaacttcccaacctcactagagaggccaatattaaaatttaaaaactgcagagaactgcaagatactatataagaagacaatccccaaaacacataattatcagattctctttcattctttttaaaatgaaagaaaaaaatataaaggcagctagaaagaaagagcaggaaacctacaaagagaacccatcaggctaacagtggacctttcagcagaaaccctataagccagaagagattgggggcctatgttcagcattcttaaataaaagaatttcaacccaagaatttcatgtccagtgaaactgagcttcataggcaaaaaagaaataaaatacttttcagacaagcaaattctaagggaatttattacaaccaggcctgccttataagagctcctgaaaggagtgctacatgtgaacagccactacaaaaacacacttaaatacacagatctctgacactataaagcaatgacataagtctacataatatccagctaacaatatgatgacaggctcaaattcacacacatcaatattaacactgaatgtaaatgggctaaatgacacaatttaaagctggataaagaagcaaggaccaacgttatgctgtctttaagaggcccatctcacatgcaatgacatccataggcccaaagtaaaggtttggagaaaagtccaccaagaaaacagaaaatagaaaaagctgaagttgctatccaaatttcagacaaaaagagactttaaatcaacaaacatcacaaaagacaaagatgagccttacataatggtaaaggatacaatgcaataagaagatctaaatatcccaaatatatatgcatccaacacaggagcacccagattcataaagcaagttcttacagacctacaaagagacttcgatttccacacaatagtgggacatttcaataccccatggacagtaatagacagatgatggaggtgacaaagtgaaaaagatatttaggacctgaattcaacaattgaacaaatggacataatagacatctatagaactctccacccaaaaacaacagaatatacatacttctcatcaccacatggcacatactttaaaattgaccacacaattggacatcaaaacaatctgtaacaaattgaagaagactaaaatcataccaaccacactctctgaacatggtgcaataaaaacagaaatcaatactaagaaaaacattcaaaaccatacaattacatggaaattaaccacttgttcctcaattatctctgggtaaacaataaaattaaggcagaaataaaatatttcaaactaatgaaaacaaagatccagcataccagaatctctggggcacagctaaagcagtgttaagaaagaagtttatagcactaaatgcccacattaaaaaagtcagaaggatatcaaatgaacaatctagcatcacatctacaggaactagagaaacaagagcaaaccaaactcaaagctagcagaagacaagaaataaccaaaatcagagctcaactgaaggaaattgagatgcaaagaccatataaaagataaatgaatttaggaattatcttagttatttgaaagaattaattagatagatggatgaatagctagacaaataagaaaaaaaaagagaagatccaactaaacacaatcagaaatgactgactgaatgaaaaaagacattaccactgaccccacagaaatataaaagaacactcagagactatgaacacctctgggtacacaagctaagaaacccaagaggaaatggatacattcctggaaccattcaacctcccaagtttgtgttaaaaagaaactgaatccctaaacagaccaataatgaattttgaaattgaatcagtaaataaagagcctaccaactaggaaaagcccaggaccagttagattcacagccaaattctaccacatgtataaagagctggtaccatccctactgaaactattccaaaaaattgaggaggaggcatccctccctcactctatgaggccaaaatcatcttgataccaaaacctggcagagacacaacaacaacaaaaaagaaaacttcaggccaatatctttgatgaacacagatccaaaaatcttcaacaaaatactggcaaaccagcagcacattgaaaagctaatccaccacagtcaagtaggttttatgcctgggatgcaaggttggttcaatataggcaaatcaacagaagtgattcaccacagaaacaggactaaaaacaaaaactacatgatcatctcactagatgcagaaaaggatttcaataaaattccacatactttcatgttaagaacgcttaacaaactaggcattgaaggaacatactttaaaataataaaagccatctatgacaaatgcacagccaacgtcacactgaatgggcaaaagctggaggcattctccttgaaaagagaaacgagataaggatgtcctctcttattgccactcatcatagtaatggaagtcctggctagagcaataaagcaatagaaagaaagaaaacccacccaattaggaagagaggatgtcaaactacccctgtttgcagatgatatgattctacacctagaaaaccccatagtctttgtccaaaactccttgatctaataaacaacttcagcaaagtttcaggataccaaatcaatgtacaaaaatcagtaatagcattcctatgtaccaacaacatccaagctgagggccaaatcaagaatgcaatcccatttgcaatagttacacaaaaaagtacctaggaatacaactaaccaggtggtgaaaaatctctacaatgagaatttaaaatattgctcagtgaaatcaaagatgacagaaacaaattgaaaaacattccatgcttgtggatagaaagaatcaatatcattaaaatggccatactgcccaaaacaaagtacagattcaatgctattcctattaaactaccaaaggcattattcacaagaaaaatgtattctaaaattcatatcaaaccaaaaataagcttgaatagctaagacaatccaaagcaaaaagaaaaaagctgaagatatcacatttcttgacttcaaactatactacaatgctacggtaaccaaaacggcattgtcctggtacaaaagcagacatatagaccaatggaacagaatagagatcccagaaataatgctgcatacttataagcatctgatgtacaacaaaataaataaaaacaagcaatggagaatggactccctattcagcaaatgatgctgggataactggctatacatatgtagaaaaatgaaactggaccccttccttacaccatgtacaaaaatcaactcaagacggattgaagacttcaatgtcaaacctaaaactataaaaacacaaagataacctcggaaatatcattctggacataagccctggcaaagatttcataacagagatgccaaaagcaattttaacaacagcaaaaattgacaagtgtgacttaattaaactaaagagcttctgcatagcaaaaacaaaacaaaacgaaacaaaaaaactatcaacagagtaaacaggccacctacagaatgggtgaaaatgcttacaaactacgcatctgacaaaggtcaaatatccagaatctataaggaacttacaaatcaacaagcaaaaagcaaacctcccacttaaaaagtgggcaaaagatatgaacgcacacttttcagaagaagacatacatatggtgaacaaggatatgaaaaaatgctcatcatcactaatcatgagagcaatgcaaatcaaaaccacaatgagataccatctcacaccaatcagaattgctattaaaaagtaaaaaagaaaaaaaaaaacatgctggtgaggttgaggagaaaatggaacaaagcagtttggtgatttctcaaggacctcaaagcaaaatgaccatttgacccagcaatcccatttttaggtatatacacaaagataaacaaattgttgtaccataaagacacatgcacatgtatcattagtatcatgctattcacagtaataaagacatgaaatcaatcaacctaaatgcccatcaatggtagactaaataaagaaaatgtggcacatatatgccatggaataactatgcagccataaaaaagaatgagatcatgtcctttgcagcaacatggatgcaactagaagccattatcctaactgaactaacataggaacagaaaaccaaatactgcatgttctcacttagaagctgaaggtaaacgttgagtacatagggacacaaagatgggaacaacatacattgggggctgcttgagggtggacagatggaggagagtgaggataaaaaaactacctataaggtactatgttcattacctgagtggcaaaataatctgtacagtcaaaccctgtgacacacaatttacctgtataacaaaccacacatgtatctatgaacctaaattaaaagctttaaagaaagaaaagtgttggaaattactcagaatcatttgaattactcacccgaccattccctaaaccttttgaattaaaataataatatgttttcagttacaagagacaacatatgttaagatataacatttattttattttattttttgagacggagtttcacttttgttgcccgggctggagtacagtgctgtgatctcagctcactgcaacatccgtctcccgggttcaagcgattctcctgcctcagcctcctgagtagctggggttacagttgtgtgccaccatgcccagctaattttttgtatttttaatagaggtggggtttcatcatgttggccaggctaatctcaaactcctgacctcaggtgatccacccaccttggtctcccaaagtgtagggattacaagcatgagccaccatgcccagccaagatataatatgtatttatcaaagttttatgagttacaataacaaagacatggaatcgacctagatgctcatcaacagtgaattagataaatacaagggggtacatatacaccatggaacactatgcagccataaaaaagaataaaaccatgtcctttgcagtaacatagataacagcttgaggccattatcctaaacaaattaattcaggagcataaaaccaaatactgcatgttctcacctctaaatggtaactaaatattgggtactcctggacataaaaatagccactgaaaattaatagacagaaattgggtggggtaggaagtgaagaagcgggggttgagaaactaattattgggtactatattcactatctagttgacaaggtcattcatatcccaaacctcagcatcatgcaatacacttatgtaacaaatgtgaacatgtaatgcctgaatctaaaataaaatatgaaaatgtaaaataagacactaaaaaaagaaaaggtagtggaatacttccgtgtttcactgtgactgaagaattatcttaaaaaaataaaatccataccccaaaattttatggtcaagaacattaacctactggaaaaatacagttatactaattatgtattggtgaaatcttttttcacatcattactttgttgtctaagaaaaccactagcatatggctagctatttagcaggataacaatcatactgcaacctaagaaaagtgatgatttcttcttccatcatttcaaataaaagaaaatcttatttgtagtccctataatatgagaattgtagaaaagttgcctatgaccttcttttccttaggaccctggatacatatagtcttctactaaggtccctcagagacatttgtgttgcacatgcagaatctgaatgatctcacataatagctttgctattgtagtactggccactaaacaaaataaaaataaaaataaagaaaaagggagtaatcctcaggaacttttatttttaggaataaatgtatctgcactttcccacagtcttcaggtaaccaacagaatccaaatgatatggaattgtcagtaattatcataggtaaattctgctaaacaattcaccttaaacacataatggactttaactataatcacttcaaaagaacaaatgaaaaggcattcatgggaacaaaatacaacctgaaaatataatactggcaaagattaagtgaacatagatgcctagagttatctgcatgatctccaggattagataacctaacaaagttggtaagtcatgtaactttgatcccactcagctcttacacattttagcgactatatgaagcatgaatagtatcaccatgtagtagacaatatgtggttgccaatatttcattccaatcctatggtatgatcctgcaactaaacatttattaaaaatgtccacatctttccacatttttctatctaagcccatagatttcattgttttttaacatagaaacttgatatctatagtcacttggtaaaatctgagccataattatcaattatatttttgggggtagaacatagatacaactgtgaataaaatataaatcaaaacatgtatactaaagttaaattgtttattcaactaattactcatattcatctattttattcatggtcattgatatactctataggcttctttgcaagtgcttcatttatcttatagatcttctgtctttttcctccctccactgcccttgctctgtgcaggtatctctattcctttctgaccagccctttttcatcattccaagtctattcaggaagcagaaaaaaacactttaaataagacttttttaagtttctattttcttcccttaccaaaacaaaaatttttacaatgtaccatgatagtgaatgaacttttactttatattgcctaagaaattattgtcatgtaaagtcattttttagtaatatactcatttagtaaagtaacttgaggatttttgtatatgtatctttgtaattgaagtaaatttctcaatatgggattcagatgtcttgtataagaaacatctgtgtacttttctcaaatgctgatgtttatgatggtccccatgggacaggtccttctttggggaaggagtagagaaatctgaaagtttaagatgacgctcagaggatcacggtatgtactactatttgagaactgatcaacttacagtacttcttctcatatctacttttgtctcttaaaaatcactagaaattcaaaaagttaaaaatgccatgctctttcaggcaatcatctggcacatggtattataataaatgggataacaaatccagagaggttaacaaagtccccaaggtcatagagcttaaaaagggttgagccagaatttaacctcaattccatctaacttggaagcttatttcattccagaggtttgggccctaaattaattttagggcctaagaactcttggcccttcagagtcatatataaaatttttttagttgaaggatttgtaccaaataattatgcctgatgctgtggaatttgaactaaaatctagtctagagaggttaggacttgatggaagtcacagagctgatgcagactcaaatttccatggtctttgtacacatatttactgcctctttcaaatttatcttttatagtcaaaaatatagttatttcttatgtattcataaatatttccattggaaaatctatgttatgggtctggtaccactgtgtcattaggaattgttatcaaaacatattataggtataatagaaggaacaaaacctacatgtagagagagcaaagcaggcaaccagaagtcatctctagcccttacctttacaatcactgtgacagtagcaataccaggtggcattgttccataaatatcaaaggcctctaccagaaaagtgatacttgcttcttggtctggaaatgcctcataatctaaactccttaaaagcgatagttctcctgtaaatggatgtagtgcaaaaaagtgcttcacttctgggcttcttatccggtaagacacatttgctccaaggtcgacatctttggcctgtaataagcagaagaatagttttattagtgacgttaccaaaataaagaaatgcaggaaggatggaagtcatgcgttagtgcctaggacagcatcaatttaacgaggacaaaaagacacgttttttgtttttgttttttaaaaaagcacattatttaataatttaccagggaagagaaggagggatgggggagagaaagatggaggcagggaggaaaggagggagacagtgagagggagagtcagagagagagagagagggatctttctataagattttgtcattgttgacgttattactgtatctgtttaacttgaaaaatcactaaatgaactatatcacagtaaaaaaataaatattgtcttaaatgactgtttcttattttctactgatttgataatcatgaacaaatattttaaataaaaataaatactgagtgatttccataaacataatagatggctaaagtactataagaaaactgagaaaatataagtagtaattatttgtcacagggatcctataatacatttctagagatcactctaccatacttcctttgatttaactaggatttgagtagtagttacgcacaaggtgctgtagagagcaccaaaatgaatccagacacaattactgccctacaggttatggtctcagagaagaaacaagacacaaatactaaaatagaaaggaaaaaaatgtgacatgctatctaaaagatgttctaaattgggaacgatatcctttagctgaaaggatgggttttcatgggagtcttgtagaatggctatttcactcagcagtacagactggcaaatgcacctcaggtacagaaaaccgaatggagcaagaatgaaaatggggaagatccagagtatgctataatgtgcatttttaaatgcaaacacctcctatggtgaacctcagccttggtctcctccaatcaattattgacttaacaatcagaaagatgctattaaagcatacattttattatgtggtttttcctgcttaaaatcccctggtttttaattcaattttcaatcaacgccattatccttaacatggtaagagccactacattttctagacctttagcccctcacccctcacactttcccatcttccatgattttgaccaggctttttccccccaactactttgaacaatctttcttccttttctgcttggatagctcttacttgtccctcagttcaccatttagaaataagtttctctagcaaatattctctttgccttaagattaggttaggagctccacctctattacctaggccctttgtactgaggacctacgttttaactactaattttcttgactgatagctaaaccagcctgaaaactcgaagaaagcagtaaatttgttttgttcacctttgtatccccaaagtctttgcatcccctaggacagcatgaatttaacaacaccagcaggagacttggcatactatacatactgaagacatgtttgttaaataaataacttaactaattaattaattgacagatgaatggtggaatagatgaaggaataattgttctctccctggccagtatttgccttatttagatttgttaatgtttattgctgagttcaattatggaagggatacagagtctggaaaagtatgctaaaaacattcaagttgtggactgcaggtggaaaaatggctacttttttttttttccaaaacataccttatagaccaactgagtcagtattaaatgaggtggttgcttaaaaatgcagatttatggatcagcctaatctactgaatcaaaatgttcaggactgtgtaatttatagttaaaaacttaaaaaagaggcttgatacagagatgtcattaaaaaggagagttagattactagaagatggcttttgtgtattgaatgtgaaaacaatacagaataatgggtataaacaatatttgtaaaatagaggggaaaccaatttgtaactctctatattttttctgtgtgtacacatttatgttatatatgtataacccacacaaattcatatatatatatgtattttttgacatttgtgtgaacacaaagataaatgtgaaataaatttaatgctgagtactctggaggcacaatgtgggagattattaacttttgcttcataaactattgtattgtcaactgttggaataaacagaatattacttttgtaaattaaaaaactattaaaaagtatatttttaatttcttacaaatagatctttctgcccttaatttttgggatatctttaaagtaggcttgccacataaaatacaatatgcaatattggagaaataataaaaatttattcattgtttatctgaaattaaaatccaacttggtatgttgtattgttacttgctaattttggcacacaaaccctaatagcaaatctcctaatgtaggattcatgtaataaatgctttttcccacacacctctatttgaaggatggtagtcccagctggcaaattctcttcaacaaggacagtgtatgttgaattggtgaacacaggactgttatcatcaatgtccaaaaccttgatggccaaggttagagttgaatgacgagggtgtactgctccatctgttgccacaacaacaagttcatagtagtccctgacttctctgttaagcttcactgctgtgtaaatgctcccattggatgtgatacgaaaaagattattaaagttacccaaactgtagtgcacttgaccatttattccagcatcagggtctgttgcctattaaataaaacaaaaaaacaaaaaaattcacgtaagttttgacgggctactgtaaatgaaggtaacagttaacaaattatggtatttttctaaccaaaaattatttggccctctaaggaggaaatgacaatgacaatacaatgcaaaatttaaaacatgaaaaatattatactttaatattcttcatttaaaattaacataacaaaaacggataatgtcattagcaataacaatactatgttatgacagaaaactcataaaaatactgaatctttgtcttatgattttaataggttttgaattctaaagtgagaaaaaattttgtttgtaattcatttaacataatctgccgagtgacaatttaagattatgtaggtttttgctcactgtatatattcattttatatttatatatgtttagtaataatgttacacattatgtttgtttataataaataatattttattatgttatgctgttatttatgtgataatgtttattataataaacattaatcatatttaccataaataatatttataagtataacctgacttaatcctcatgatgttgttatgagtaaatattattaatctcattttacaaatgagaacactgtggcttatggaaggttacacaagaaagaaatatctcagtgtcccagttcttaacacaatacttcatatataaaagtacttaacaaatgcttgtggaattaatgaacattagatgaaataaaacagatttgaaactaaatctgttccaaaagtcaaataggattaaaactacagtaactgtaatgtatgtgcaagggactctttttcaacattagaatatacatctctgcataagtaagaatgtttgataccataatatacctatatttactgaaaatttgaagtcatgtaaaatcactttgcatcaaataaaatgagaaaatattgagtaaatattcatcgaatgaaatgtaataagaattaatcttagctaaaactcaattgtgatactaattatgaatctcactatcagctactgtatattttgttttgaaaagttccatgtaaaagaaactgaaataaatcttagaaactgtaaaatattatataattatgccccaaactgtcaacaaggaaaggaaggaaaacaagacacttggctgccttatgagccagggacacaaaaatcactcgaggtccataaagcgtggaatgcaatatgatgtattttaacagcacatatgcagtggtatatccagttttacaggcaatggtaaagcatgcagaatggggatgctgaatatttgcatcttctttgaaacaagaatgtctaagatgtgaaaatcatgtttacaacagtgctcctatatgtcataatgccaagcatttcagcaggatttgtctctttgactcatcaaaacacaactgcccctgggagtttgacatctctgaggtttaattctgagaaaagatagaagaattgcagaaatacctgaagagaaaaaatacggtgacagagtagaatagtttctgttgatatagtttcttttacttttatactttgcctagaatttgtcttacgaattattgacaaatcagtcaagctgatcattctagtgaaaacaaccaacactgccttctccctttttcaccaaaaaaagagggtgatctctttttttggtctgaaattactcatcaagtaaatagataaaattgtaagccaagaacaaaatataaatatgttttgtttcataataataatacccttaaaaatttcagtcactttttctgtctatggaatatcttaagatcaaaaaaactaatcatttatgcaattagaaatttaaatgactcttgttcaagttgtttttattgacccatataattgaatatttattatggtagaatggctcaatttgactgatgtggctgtgtgtccgtgtgttttatacatgtccagctgcttaactatacatccactaggaaacatatctaaacatatctaaattagttttgtttttgctcccatagcaaattatcacaaatttagcagctgacacaaaacaagttcattattttaaagctctataggtcaaaaattcaagatggtctcaccagggctatgtttctttctggagactctaaggagaaacaacttctttgctcattcaagttgttgacagaattcagttgctagagtttgtagaactgagatccccacttccttgatggttgtcatgtgaggaccaatcccggttgctagaggtccccatatcccttggttcatgacacatttccaccatttttttttttttttttgagaccaagccttgctctgttgcccaggctggagtgcagtggtgcgatctcggctcactgcaacctccgccttctgggttcaagcaattctcctgcctcagcctcctgagtagctgggattacaggcacctgtcaccatgcccagctaatttttgcatttttagtagagaccgggtttcaccatgttggtcaggctggtctcaaacccctgaccttgtgatccacccgcctcggcctcccaaagtgctgggattacaggcgtgagccactgcgcctggccatttcttccatttttaaagccagcaatggtggtcaagcccctcacattttttgaatccctccctccatctttttccattttatctttctgacctactcttcaggcatcctccttcacttttaagggcatgtaagattacattatgctcccttggacaatccaggatagtatccccatctcagaatttttaaccttgatatatgtgtgtgcacatgtgtgcaagtgtgtgtatactgccatatataaatatatagcaatctatattttaggatgggatttttttttttttttgaaacaggtcttgctctgtcacccatgctggtgtgcagtggtgtgatctaggctcactgcaaccttcacctcccaggctcaagcaatcctcccacctcagcgtcctgcgcagctggcactacaagcacatgcccccaggcctggctaattttttgtatttttatcagaaacggggtttcctcttgttgcccaggtcagttttgaacttctgggcttgagccatcctccccctttggcttctcaaagtgctgagattacaggcatgagccatctcacctggccggataggagtttttagagaaaatatccaagcagatattcattaagcagactgacagtaaatgctaaatggggcatcctcaccaatagagtttcagaattttaaataatcagtttaaattggtataaattacgatatgtcaagtacacacacattttgactgaatctatgacaacttaattcactgaattcaaagctaccatgacaagaagtatatttgatgcttatggaaaaaaagactacaatatctttggctctgtttatatgctggattacatttactgatttgcgtatattgaaccagctttgcatcccagggatgaagtccacttgacagtagatgcagaaaaagcgtttgacaaaattcaacgacacttcatgctaaaaactctcaataaattaggtattgatgggacttatctcaaaataataagagctatctatgacaaacccacagccagtatcatactgaatgggcaaaaactggaagcattccccttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagaggataaaatacctaggaatccaacttacaagggatgtgaaggacctcttcaaggagaactacaaaccactgctcaaggaaataaaagaggatagaaacaaatggaagaacattccatgctcatggataggaagaatcaatatcgtgaaaatggccatactgcccaaagtaatttacagattcaatgccatccccatcaagctaccaatgcctttcttcacagaattggaaaaaactactttaaagttcatatggaaccaaaatagagccttcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgctgcatatctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagacttaaacgttagacctaaaaccataaaaaccatagaagaaaacctaggcattaccattcaggacataggcatgggcaaggacttcatgtctaaaacaccaaaagcaatggcaacaaaagacaaaattgacaaatgggatcgaattaaactcaagagcttctgcacagcaaaagaaactaccatcagagtgaacaggcaacccacacaatgggagaaaatttttgcaacctactcatctgacaaagggctaatatccagaatctacaatgaactcaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaactacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactagaaatcatgctgctataaagacacatgcacacatatgtttattgtggcattattcacgatagcaaagtcttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattgtcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataataaaaaaaagactacaatatcccccagaaagctactctaaaaattttaaggtgactgagacacacatctaatggaaacaaagggaacagaatataaaatgcagagctatttccttatctattcctatgtccccattaaattaaggagcataaataaggtgatgtaagttaagcaacatgagctggctaagcaaggcagttttacttctttactattctagatgaacatgtagatgttaaacaagataaccaaacatagaatcccttattatcagcagtactgtcaagaactttgcattgatgtttaatatttagtcaagcagctcagtgtatgatgctataatgaaaatatatattttcctagaaatcaattaaaagttaattaaatttgttaataagaaaaataacacatctcttttccccttgtactacatcaaagcaatgaacagtaatagctgcaactttataatcatctgtccatggttaacacatttttgtaatatacaccttactatggggcctgatttgtggctactaatttgtgaatgcatattgctgggaaattggctgatagcctgtagtcaaataaagacctcactggacagaactttgaataattgccagaaacaccacttgcaaaccttattcattaacaccaaagttagagtatatgaaagacaaccaagtaattacttaagaaaaaagtcaagggaatttattgaaccaaagttttttgtataatttttgagaagcgattttatagcatgccacttgaaaagggaaaagggaaatatatttcttaaacactaaattcattccccacccctttttttctcattatcttcttagaatggtctgttacacaattctttccatccataaaagtggaagtccattactgggtttgctaccctgggggttaccagtcctgtagagaagaccttaaagcatgcctgtatgggtggaatatactaggataaaacctcaaagaacaggttgatgtttgcactccttccactgagaagtccctgggtaggttacttgtgtaatttacaatgattcatttccatttaaaatatgtcaaatatccattcagattaattatttagatagaaaattttatgacaaaaatcagccccaaggaaataacttgaggacaaaaccaaaatgttatagctattataaaggtgtgaactaccatgtagcacctaattggcccagtgtgaagctgagagagtgctttgctctaccttttgcttgtcctttacagcgatttaagaggtcgtgtacatctttctcactttgaagtgggaaccataaaagctgttgatcagggaggttgggcagtgcatccttcatgacattattagtgaaaatacatttttaaaattattatctattaacttcaaaaagatgtacaatagttgtctttttttttttttttttaaggagctgagctatttcaagggctgtgattattagtgtaaaaggagacaagcaatttaaagactcataatgcaggtaaattttttcactctccacacaaatgcctcataatcattattgaacaatggcaagtagacttactggccagaagataacttgcataacttgaattaaaatcactaaaaacataaccagaatgaatagcttttcattctagtccctagaaatctagtccctagaaaacacatatttaacacaaataatttctcaaggggtcagctattattctaagatacacaataaactacattttatcctagcattcaaggctctacctggtcttgttctaacctatctttatgcatttatatccctcagactaactctctgacacaaactctgtgttttagtcaaaggagtctatttatggtatgaatcaccaccaagaaactctcaagtgtcagtggtttgttaccactgatgtttctttctcgcctatacagcacccactgtgaattccaaatccagctttactctatcttgtctttactcagaagagaagctaaaggagcaggcttcattggaatatgaagctcatgtggtgcaagaagaaaaaaagacatgagatagccaagctgcagcttttaacgcttctgcttggaggtcaacgtatcacctatactcctgcttcatcgttgaaggcaaatcacatgacaaggccgatgtcaaggggtgcagaaattccattccctcacacagtgggacagtgataaatcagaaacacttttacaatgtactaccctggttttccttgaaatgaccatgctctccctcaccttccctgatataggttttttttttgtttgtttttattttcccccaatccaacttaaacgttcaaaacctagcttcagttctacttcatctgggaaacctcttctttccatccagccttctggtccctcttgcacatagcaaaactcactttttattgctatttaagtatgctacgcaattaaataattggcctaaaaatctgtggtgtatccatgtattatgtaataggagacactgttagagaaaagaatctgtaaattgttttgtggagtgtacaatgtatgagaagtggaaagttggagcacagatggaaatatggtagagaaggaaaaaaaaaagatagcaagcaaataaaaataaacaatattcctgtagttgggtgttatttaacgcaaatgaactgaaggtgtcaaattaaataagacagtttaagctgttccaacataacctgcaggcctcttactaagtaagcattaggaagaaactttgcactaaaaacctttacatattcagttctcatgttaatggtaaacacttgaagattatgacatcaatgcttcaggaaaagagttgttgtcatgttcacgctcatacagcaaagaaagaaagtaatgttgtttcatgttcattaaatgtatttacatagtaaggctgtcttttccctttttcaaatattccttatagtgctgaaaacgaagaggaaaacctgggaggactcatttcatatttccccaccattgcttagtatttgataattatgcagtataggttgagtgtgtatatacctctttatgtgatggtaaaaaaaattatatattaaattatatttagttttccaacctcttcttacttctatttctccaacttcttcattctcatctttttctctgtgggcgaacatattcttaccactaaatctaagtgcattttgccatactaaccatgctatttcatgtctgctttatccagtcataaaatcttccccttatttccaaaactgattattcttcagccctagtatcacctctcagaagcatctgagtaagctaaatgcctcatcttcatgctcctgaagctcattgtatgtttctttaccacatgccctattgctttttttctgtcattttttaatagcccacatgaaattaagaattcataaggacaggatggcttatttatatcatacaatgcctgctttatttttctttttgcaatgacataggttagatatgcaataatttctgccaaaatttcttctgaagctatttccatttttcaattacatatcattcccaccccaaccacccaaacacatgaagaaataaaaattgccaattagtatttataattttgtcttaaaagaaggtatgttttctgtttattagaagaaatataagaaaataagacacattttgttctttaaataaaacttaagtgatcacataactacttattaaactttgtccttttgttacattttattgctttcttgttttcaattttgtcactatattagtcagttttcacaatgctataaataacttcccagaaactgggggatttataaatgaaagaggtttaattgactcagtttcacatggctggggaggtctcaggaaacttacaatcatggtggatggtgaaggggaagcaggcaacttctttacctggtgacagaaaagagtgaagaaggaactcccaatcacttataaaaccatcagatctagtaagaactcactcactgtcataagaagagcatgggggaagcctcccccatgatccagtcaccccgctccttggacaagtggggattataggtccctccctcaacacatggggattacaaatcgagatgagatttgggttggtacacacagccaaaccatatcagtcacctagaattctttaaggaaatctatttctaggtcagttttaaagtaagtacaatatatatacctatttttgtataattaaatatattagtttaacttttaacagtctattctagcattgcttaacctttttcattatcaactcctgtcaaaagaggattttaagatttttttctttctaatagaacccttataaatttgtacttccacagatatatttatgtatatatattatccatgctttatacataagaaaagtaaggttttcttgtctcccaaaacctgattttccacattggaaatgatctaccaccgttgagaatgcatgctctagccaaaagagagtcctctgtaacttccttatataccataaacatttccacataagcattgttctttcagcactcattacagtggcatcactttctaaaatgtctgtccatattactatatggggcaactcagggtatctctgagcttgtactcaatactcatcacttcttaagtaatgaaataagggaaaaataccatctccatgaattgcattttatgtgataatctgcttagcccaggccttcctatttatttgattatgcttacattttctgccaagttataacacaaagtattgtggtttgttttctgaataactattttaaatagtcttctctatgcttattgaatatgtgacattttgcttatcaggtgtttttataggtcctatatactaatccaagttttaattttcttttttctagtattctgttgggttcaatataaacatgcccatgcccttctctgaagagtcaagagtaatgtataccttaagcattgtccttctgtcacagggcttttcattatattacattgtctcacaaatcattttcttgtatcatttctagaaaaaaaattcttaactggaaactgaaaagaatgtgacagccagattggattctctgtgaaattctatacaattaaattttctggataacattcaagtaaaggattaacagaattgtaagtaaaacaagagcaataaaaatgcctctggctaatataataactatttaatgagagaaaaatatctcttaatttcccaatactatcaatcatttcatttgctgaatataagctcacgtttttcccaaacaatacccataaaattaaaggtgtttttctctattttacacacattgtcacaatttgacctaccttgataacatcacagggatagagccagatataggttccagttttattttatcatcactcattccttgagctagtttagtaattttcagctgtttcattaccttaatttgggatgtctccaaattggttgatttaaaaatgtatgttaggtattcattttgctgacaacaattcactgaagtaactgaggatcatgttttctaatgtcttgtccaacacagtaatttaaattaggaaaacagaattaattggaagaaacaacttatgtttctctatctactccctgggactgcattcaaagagctaagatgtacacaatgtgaaactgccttttgaattagaagttatgaactcagattctgctgtgtccttccttttccagctgccttccttcagatatactttcctagtaccttcctgtgtgctactatgtaaatagtaggtaactattttagaatcattcctcagcagcaggctttatgaaaagtgctgtcagtttgttttctttaattgtggtgtaaacagtactgctgcttaccttaatattaattatatacacacatttttagaagttacagatatataaaagggccaggtactttattaacatccttttttctttctggtaaaggtaaaataagccagattggagattaaaaagtgtaggaaacttcatttggatgccattcctttgttaattgttagcatgtaggcaataagaggaatatttcaatatcaattggccaagcagaaattttcctgagaataacagaatgttttcaatgacatgttatttatggagtgtaactgttccacaggagcagtctagtcagtagaattaaatgatactgtatactagaactggaatctgagataaaatagaagtggtaagtttacaggcacactctgtttcattgcacgtggctttattgtgcttcacggacgttgcattttttacaaattgaaggcttctgacaaagatgccttaagcaaatatattggcaccatttttccaacagcgtgtgctcatttcatgtctctgaggcacattttggtaattctcagaatatgacaaacttttaaattactactggatctgttatggtgatctatgattagtgatcttttaagttactattgtggttgtgttggggtgccgcagaacacaccatatgagagcaaatttaattaataaaggttctatgtatacatttttttgacacatggtccaagatgagatggtgtatgtgttctgatttctccacccactgaccattcccccatctttctcactttccttgagccttcctattctctgagacacagtgaaattaaaattaggccaattaataaccccactatgtatgggctctaagtgtttaagtgaaagagttgtgtgtctctgatttgaaattaaaagctagaaatgattaagcttagtgagaaaggtaggtcaaaagctgagaaagcttaaaaacttggcctcttgtgccagttagccacattgtgaacgcaatggaaaagatatttcataaattaaaagttctactccagtgcaaacacaaatcataggaaagtaaaacaacctgatgtgaagctgatgtgaagaaagtttgagtggtctggatagaagatcaaactagccacaacattcccgtaagccaaagcctaatctggagcaagaccttaactctcttcctttctctggagcttgagagagggaaggaagctgcagaagaaaagtctgaagctagtagaggtgggttcatgaaatttaagggaaaaataaaaagccatctccataacataaaagtgcaaggtgaagcagcaagtgcagatgcagaaggtgttgcagctagttatccagaaaatccagctaagatatttgtagagggtggctacgctaaaaaaacagatttccaatgtagataaaacagttttctattagaatatgccatctagaacttccgtaacttaaaacagagaggtcaatgcctagattcaaggtttcaaaggatgggctgactttcttgttaggtgctaagagctggtgactttaagttgaagccaatatttattgaccattctgaaaatcctagtgcacttaagaattctgttaaatttactctgtctgtgatcaataaatggaataacaatgcctaataaaagcatatatttatggaagcataaactatgtttacagcatagtttagcaagtattttaagcccatggttgagtcctactgctcaggaaaaaaaaaagacttctttctaaacattactgctcattgagaatgcacctggtcactcaagagttctgatggagatgtaaaaggacatcagtgttgttttcttgcctgttaacacaacttccactctgcagctcatggataaaggagtaaatttgaggttttcatcttattatataagaaataaatttcataagattatagctgtcattgatagttattcctctgatggatctgcgcaaagtgaactaaaaatcttatggaaatgattcaccattctagatgccaatagcaacatttttgattcatggaaggaggtaaaaatatcaacattaatagaagcttggaagaagttgatttcttccttcatgaatgactctgagaggttcaagagaggtttaagacttcagttggatgaaggaattgcagatgtgatagacatggtgagaactagaattagaggtggagcctgaagatgtgagtgaattgctgtaatcttatgataaacttgaacagttgaggagttgctttttatggaagagcaaagaaagtggtttcttgatatgatacctactcctaatgaagatgctgtgaacattgttgaaatagcaacagataatttagaatattttatatactttgcagcaaggattaagaagattgactccaattctgaaaaaaacttatttagctacaatgctatcaaacagcatcactagctacagaaaaaaatttaatgaaagcaagaagtattcaatgcagcacaattcattgttgtcttattttaagaaactgacacagccatcccaacttcagcaaccaccctcctaatcagtgagcagccaccgacagtgagacaagaccctctatctgtataaagattaagacttgctgaaggttcagatgattgacagtatttttttaagccataaaacactttaattaaggtatggacactgtttttcagacacaatgctaattgcagtatggagtatacttaatggagtatagtatagtgtaaaaataatatttatatgcactgggaaacctaaaaccttatgtgactcgctttgttgcaacatttgctgtattactgtggtctggaagagaactctcaatatgtctgaaatatgcttgtattaaaaatgtgtattgctttgagaaacagaaactctacaacctatctaccaagaatctttgcagataataaagaaagaagttattgacttatttcaaacttaaagtctgaggagtctaaatggagactgaagttacgtctaacatgacaagtgtgaaccactttgatttggtttgcccagaggaaacattactcctgctactttcataaagactgattgcttttgacagaaatctgtctgtgcagagttggatgagtatgatactgagaagtcataaaaccattagaaaagactgggctcagaggatctcctcataaaaatgttcacatagaaggaataagacagtgaaaaagaggctgtatttgctatatatccacgttttgaattatgacacacatagggaatatttccagagcttggtttcagaaatcccaatgaactaattcttctgagatatcataaactaaatagtgggaaagcaagccaaagaaatactgtctgatttatttattttgcagactgcacttagattttttaaaaaagagcctctcactttgattcttgtatgacttgaagaaaaagctatactgtataaaggtgtttgcaggtgggttctctggcaagcagacaatgaggcagagattagttgcaagagttttgttggggtatgctttgggggtcaacatttttggagggcaaaggacaagaccagaattggattcagggagaaagtcaaactactgtgcagggtcaactacagccttggccaacccaaggaaggagctgcagaattgcaattgcatgtcacagtttttctgagctggggtaaaatgtccagcattttacactcaggcatcagtcaggatatgggctacactgaaatgggtgtgactatgggcaagggaaccttctgtagataaggtcatctctgaagtggctagcagctgtacatccctctttactccttcatccctacatcactccaaaaagccaagacattcagctctaccttcaagggagatctgcttggcacacagtcttcataacaagcctctatcttggattggtttttttcttagagtataaaatccttgcttaacagaatatagcaaattttatacacatacacacatatattaaattattacaatatcattcattgttttcaaatgaaacagccagctacattattacctcaaaggtgaaaaagtctagggtttgatttttttgatccaaactaatatttgtcattttccacccctgtgcccagagacgtaactcatattttcctgttgaatttgtttcccaagtagaaacagaagtcttaaatatgatgaactttaggttttttcttttagttcttataaacacccagtatggcagttattattgtccatattttacagccaagaatatttcagaaaaacaaaaaataagttcattttcctttagctagcaaataagagtatttggatttgaatttagagtatgaatgtgccatctgtttgtaatttttgtgcaggtaggggatgctgctataactagtgtagcattattaattattctagctgcatgatagattggagtccagagatagaaagatgagctggacataatttagaattcactctgaattattttcatgatggggattaagggccatatcacacaaatacacacttgaaggttatcattacatagcccctcagactttacatatatttcattagaaaaataaaaatctaagttacagagaattgtcagtgggttccctcaatgtctcccttactctgtggcaagctagtctgacatgatatctaacagaaggaaaaacatacttcagataagtcatggaagtcataccatgaagtcatgagaattacagtatatagtgtgcccagagctgtgaattccactaattattttgaaacattgaaatattcatttcaaaataaatctataaaccatccaacatctgtacttatctttatcattctcctgctgctaaaattgaggaaaactccacttcctcctaggttctcaagggaacatatgacacttgagcttttgggactctgttgcctctctttctggcatttctacatccctctttactccatctattgccatcagttttcaaacctgctgaagaatttatcattacaaaataaagagaaatgagaaagaaaatataattgcttcctactatgtctgttttcctacaatctcttcacatcccaagattctatgtgagggcagtgggtgggggaagaaaaggacaacatatatatccattgcactcatttattaatgagttattttgttatttagtcatgcaaatcatgcactatacaaaacatacactatgtttcctaatactgtttacttaattactcttaaaaagtcataattagttctttaaaatgtaaaactaaaatatgacaaatgatgccatctttgctattgagatggtttggctgtgttctcacccaaatctcatcttgaattgtagctcccctaattcccatgtgttgtgggtgggacctggtgggagataactgaatcatgggggcggtttcctccatactgttctcttggtagtgaataagtctcatgaggtctggtctgatggttttataagaggtttcccctttgcttggctctcattctctcttgcctgctgccatgtaagacgtgccttttactttctgccatgattgtgaggcctccccagccatgtggaactgtgagttcaataaacctattttttctttataaattaccctgtctcaggtatgtctttatcagcagcgtgaaaatgggctaatacatctatattcagttactaaatgtgttctgtgaatgaagttggatgttgaatgcagatgctaatgtactgccacatgccagttagacacaattatgtatgtatggagatatatataataaagggtacttgtttaggaatattttacaaaagcatggcctgtcagtgtgcaccatacatttcagagacatgatgaaaaaacattaccactagagtgtcacactacaaatgtgattttttgaattctctataaaaatgtcaatttcccaagcttagcatatatgtgtgtctaaatgtaatggcaagcttcataaatgatgagcatgccaatatacgaagatttggatgcaattatttactctaaaacttcatcaatattatgtggttgcaggtaacttttaaataggcccttttggatctcacatgaattgaaataggaaaaaaatctatttaaagaagtcctgaagtagacgtatatgcttaatattaaacattgtttgaaattgaagagtctggcttaacacactaaattaagaaagaagaaagaaagcaagaaagttggatgttgaatgcagatgccaatgcagtgccacataccagttagatagcatgtggcaagttctaatgggcacaaaatgtgccttgttcacattaatgctttagtgtagcactgaatttgcctctcagtaaatgttaactaaatttaaaaaatagtattattttccccaaatacatcaattcataacattacaaaataattatgctataagtttgatttgacttaaccatacatgttttcatccatcaattcattcatttattcacccacatttattgttgactttaagctgaacaacattttcagggctggggctctaactaaggacaagagtaatgtgttctttgatcttatgtcacttgaaccaaggtgaaaaagtagatattaaaaaataattgccttttaaaaattattacagtgataaacctaagtaataaagtaaatatgcattgcataataagagcatacagcaggacttttaacccggcctcctgaaaattacattctaatgggaaagacaaatgtcaaccaaaatattaagttacgaaaataaacaacttcatattttaatggacattatgaaaaagtaaagtgaactatgagagcacataaatataggtacttaaatccaatattgtgggttcaaaaaggaaatgacattcaacagcatccagaactcttaaactttagttttcacactgtcaggaagtttggaatcccaacggtgactttcacattacttgtattaaataaaagtcatgacaaaatgattacatttttcccattagtttacaatatttgtaaatacaggaaatgacaatagatacagtacctcttgatgttagtaacattcttgagattatttgatattagtaacattcttgagattatttttagtaattaagatagaaaaaaaatgttttctatataatggcataatgacttagattcagggatgactgaagaatcattctcaagttgaatgtcaaactggggaggctctgatggcacgaagcagctttctataacaatttcccatggatgaaatattgccagacatttttgtaacgtcttgggtgatggtaaattctctcttttaagttttagggaatcctattaattaggactactctctccatttcatagctaaggaaactgagtttcatatggattagatcatttgcccaagtcaatagttactaagtgatgcagctagaatttgaatgcagacaacctaaataggaatatgctatatttgcaggcagtcaaaaatgctgtaaagaaaatttaatgttggtaaagggaaagggggtatacttgtttctggaggacagggagagtgctattgaaatggggtactcagtgaagtcatccttgcaaaagatgtctttttgaatgaaagagtgaatcacacagagagttagagaaagagtgctccaggcagaggtaacaacaagtacaaaatccatttgaaggtttggtaagcgtagctgtgttcaagaacagcaagaagcccagtgtggctggagtggagtgatgcaaatgatgttggagagagcaggaggagccaagtcatgtggagatatgaaggctatgaaaaaggagtttggattctgttctaacacaatgagcatccactgaaatgtctgagtggcaaaatggtgtcatctaatttgcatttttaaaatatcactcttgctgtagtgcagaaattgactgtaagaggggtagcacaggtcaaaaagtaagatactatttacataatctaggggaaaaatgattgtggtttagaataggtgaggagtacttgcctttggaatatgtttcagacagatttactgataatgcaagaatcagaagtggtcctaggaagcagatacttaagatgagattttggaatttgctaatttgctagccaaatggcatgcttactgtacaggagttcagagtaagtcatgattcatttgaagccttcacctgagatgaactgatatggtatatgggggaatggggagcctggtttaatgccatatctgtataatttcagatttatcggtgaacattaattcataaaacttacagagttgattggttgctaaatataacaaaggtgttgaaaaagaataaatgaagctcagaaccagcaatatcaattcagaggtaaagagtaaaaaccaatgacctccattagcacgtttaaagaagctccatatccacagacaatgacagactttactcaaaatcatgctcaagatgtaattacaacctgctctctctctctctctttctctttctttcttttttttcgagacagggtctcactcccatttcccaggctggagtgcagtggcacaaccacagctcactgcagctttgactttcctagctcaggtgatcctctcacctcctgaatagctgggactacaggtatgcaccaacatgcctggctaatttttgtatttttttgtacagacagagatttgccatgttgctcaggctggtctcaaactcttaggctcaagcaatccacctgcctcagcctcccaaagtggtgggattacaggtgagccactacccctggtctcaagacataattacaaggaaagatgcaatcaactccctgacaagtcttccacaccagtattggtagggaaggagagctggtctgggcacatgtggctacaaacacttcaaaaaaacatactgattctctggaacttctagactgaaaacttcactttcttttcatttttagatgagaacagtatccctcgcctggagatcaggtaatgacttcatctgaattagataccttaccatcttgtaagcaagatgatagatgtcctctgtacctatgtccctgcattgcttttgcaccaataactaaagtcaagttgcagcatgttctaactgtccctgctatgagtagaaaaggattattcccaaaaagaacagcaggatatgccttatagtattggcagcaccaggaggacatgactgaggatagatcttgattatgttggaaggggttgaagggagaaaagtacatcttaccaagagtttagtggtatggagatactttgtcataattgtggccaggacacctggagttgattctaaggtactgctggattattccccaaaggttgtgaaaaacagtggcctataataaacaaggtgtaggtagtgaaagtgcctggacagggatttgaagttaaaggtatatagaagtgggcattttagcatggatttcttatgtatgaccagagaaaccatctattagttttgttcctcaggagagcctaggtagcactcccaattctgaagcaatatagaaaggtgcaacaagaggtgctctggtatcattgaaaagttcagtgatggctctcctcaccaggccagagtagagggtagtgaatgttgctatgaaacttgtgttccttagtgtcaatgtgagtggaagaattctggattcagaatccaggtggaaatactccaatatcagaggcagatggatgaaatgtatcatagcaatcagcaaaaaacaacgtcaaataagctgctacgaagtgcaaagatctataaggatggctatccaaccacggtgttcccaaagcaaatacagaaaggcagccaagaaggctattgctggatttatataatctaaaaacatcaaaatcaggtaaactaaagccgcatcattgtgttctttcctgtgattaatacacatttgaagtatgagttgcttttttattgctgcagtgatttggccaatattaatagctgaggacactgactattctgactttgtccagaaaattgcacataacatcaattccaaccaagaagttcatctcatggcaaagttaggtgcaatcatatgcataggaccactggatctgttggcactaatatacagtaccacccagcagtgctgacctagtagaatactggaaaagcctcttaaagatagagctaaggatgaatttgggaatgaaatttttcagggccacagaaggaatgaccattgtatggtacatttttcttgataagaagactagatggaaatgacaaatcaagggttcagggtgggaatggcctctctcatcatcatcttgactaacccatttgggaaaggcatactttcgtccttgcaaagctaggctctgctgcactagagatcctggttttctgaagaccggggtgatgttttcactgagatgacatagtaagggtcccattaaaccaatatttatggttagtcagtagaaattattggctctttatgccaacaaatcacaaagtacagaaagaaatcactacacctatgaaaatagctaaaatttgatgaaaaagatgagagagcttgctctgctaggtatcaagactgtatgtaaaatcactataattgagacagtgtgctattgctgcaagactagactaataaaccaacacaatagaatagagagcccagaaacaaaccctcatacacatgtatatgggatttatgataatatgtattgcgagtcagtgggaaatatatatatttatatagaagaaaacaaattatactcccacctcactccacacacaaaaatcatttcagatgataaacctattacgaataacaagacaataaatctttaaaaagcaggtccttcatgacctgaggaagtaggctattttttaagcaaggtcaaaagaatagtaacacttacaaaatgatggataaatttgataatcttaaaatttaaatctgtgtgtcaaaagatatcttgcaggaagtgaaatggaagctcgagaatgggagaaatgtttgaaacatatataacaaaggaggggctcatttctataataatcaaagaactcccacagataaaaaagaacattcaagaagaaaacacatttactccaacagataaataagaaactcaaataggcatttcggaaaagacgaaattcaaaatagtaagtaaatatatgaaaagattctcaatgccattagcaaaatgctaatcacgatcataatgcgatatcactgaaaccgtaacaaggtggctcaaattagaaagactgacataccaagcacacagacaggaaccatgaccaactctcatatacaactcttggcatagttactatggaaaacaatttcgcatttccaacaaaattgaatagacacatgttcataacatagagaaactcaggcacatgagcgccaggagaaatgatataaacatattcacagcagcactgaagataacatcctcaaactggagagctctcaaacactcatcaacatgagaatgtgaaaataaattgtggcatagccacaaacagcaaataaatgaatgaacaggtagaaatgtggctgaatagtaaaaagttaaatatgaatgaaagaagacagatactaatgcacacacactctaaaattctgtttacaggcttcgaaaaaagacaaaactaaactataatgtttataaatgcttacttagatggtaaatgtgcaacaaaaaaacccaggaaattaacatagtggttaactctaggtggaggaaagcaattgcgcctgagaaggagcatgaagaaagattttctggtgatgcattctatacctgatttggacttacatttatgtttactgtataataatatactaaactgtacatttatctttaaatcacttttgtgtattacattttttttcttaaagtttaaaggacaagagttggtcttaataaaaatctccggatatagctggaattctttctgtaaaaccaagttggttgccaagcttattcctcaggtaggcaataaagtccacgtaagtaattgtagtgagttataatatttgtagagaaggaaaactgaactgaactaaagtgaataggtcatgaattttcatcagtctataaaacagaagtgcaatttgtataaagtaggatctcataaataagtaatgtagcattaaaatatatagctagatagatgtagcaggggtttgtgaggcaaaattacttggtattgcttcttggatatacattaaataatttaaatggggaaatggaaaacacaatttcaaatacatgaccaaataggctgatagcatgtctgttatacttttcttccatgtagtttttacgcctgggaaatgccttcattatctttgcctgtcccatgagtgggtaaagagatgtgctattttttccagtaccaactataaatttcaattgttctttgcattcacactgctgtgtgtggtggggggtgggggtgataatcacttttttttttttatttcaacttttatttagattcatgcatggatggtacatgtgtaggtttcatagaagggcatatcatgtaatgctgatatctggggtactaataattctattgcccatgtagtgagcatagtacccaatggttgtttttttcagttttcaacccttgtgcccctcccccagtctcttctctagtagtccctagtgtttattgttcccaactttatgtccatgtgtacccagtgtttcagtcccacttacatctgagaataggtggtattcggttttctgtccctgcattaatgtacttaaaataatggtctccagctgtattcatgttgctgcaaatgacatgatttcattttttatgactgtttagtactccatgctatatatgtaccatattttctttatcaaatccaccattgttgggcatctaggttaattccataagtttgcgattgtaggtagtgctgtcatgaaaatacaagtgcatgtgtctttttggtagaatgatgtattttcctttgggtatatacccagctataagaatgttggttcaagtggtagttctgtttttagttcagccactgcagaaagcagtttggagatatccacatttacatttccaccaacagtgtatatgcattcccttttttccacacctttgcaaacatctgttatcttttgactttttaataatagtcattttgactggtgtgagatggtatctcattctggttttgatatgcatttcttgatgatttatgatgtggatcattttttcatttgtttgttggctgcttgtatgtcttgagaagtgtctgctcatatcttttgccaaatttttaatggccttatttcttttttgtttgttgaattattttaagttctttatagaatcaggatattagacatctaaaagctgcatagttagcaaatattttctcccattctgtaggttgtttactctgttgatattttattttgctttgcagaagctccttagtttaattacgtcccacttatcaatttttgtttttgtggcaattgtttccaagacttagtcataacttctttgccaaggctgatgtccagaatgatatttcctaggttttcttccaggatttttatagttttgcatcttacataagtgattagtgcatcttgacatactttttatacatactgaaagggaggagtgcagttttattcttttgcatatggatagccagttatcccaacatttattgaataggaagtccttttctgattgcttatttttgttgactttataatcaaatggtttaattctggggtctccattctgttccgttaacctatgtgtctgtctatgtgtagcctatactactgtaggcttgtagtatagtttgaagtaggataatgtgatgcctttggttttgttctttctgcttaagatcgctttggctattcaggttcttttttgtttccatgtaagtttcagaacagttttttttttttctaattcagttaaatggtactggtagtttgataggagtagcattgcatctacagattgctgtgggcagtatggtcattttaatgatattaactcttccaatccatgagcatagaatgcttttccatttgtttgtgccatctatgatttctttcagcagtgttttgtaggtctccttgtagcaatcttccacttccaaatttagatgcattcctaggtattttattttcacttgtgactattgtaaatgtaattgcacacttgatttggctctcagcttgactgttatttgtgcataaaaatgccactgattttttttaccttgatttttgtatcctaaaactttactgaagttaccagtttcagtagccttttaatggagtctttagggttttctaggtatagaataataatttcagtgaggagagatattttgacttcttctgttcctacttggatgtcttttatttctttctttgcctgatttctctaactaagatttctggtaatatgttaaataggaggggttagagtaggcatccttctcttgttccagttctcaaggtgaatgctttcagcattttcatgttcagtatgatgttggctgtggatctgccatagatggatctgattattttgaagtattttctttcaatgcctagtttcttgtgggtttttatcatgaggaaatattggattttatcaaaagctttttctgcatctattgtgatgattttttttttttttgagacggagtctcgctctgtcacccaggctggcatgcaatggcgcaaccttggctcactgcagtctctgcctcctgggttcaaacaattctcctgcctcagcctcccaagtagcttgcactacaagcacccgccaccaagcctggctaatttttgtctttttagtagagatagggtttcaccatatttaccaggctggtctcaaactcctgaccttgtgatccaccctcctcggcctcccaaagtgctgggattacaggtgtgagccatggtgcccagctttgtcattttgagatactttttagtatgctgtgaaattcagttaggtagtattttgttgaagatttttatgtctctgttcctcagtggtatgggcctgtagttttccattttaactgtgcatttaccagattttagtatcagaatgctggcctcacagagtgcgttagggtggagtccctcctactcgaagttttggaatagtttcagtaggactggtgccagctcttctctgtatgtctggtagaatttggctgtgaatccatcctttcaagggcattttttgatcggtagatttttcattactaatttaatttcaaaactcattatttttctgttcaagcttttgatttcttcttgattcaatcatgggagcttgtgtgtttccaggaatttatccatttcatctacattttctagtttgtgtgcatagatgtgttcataatagcatctgaggatcttttgtatttctgtgaggttaattgtaatgtcatcttttgtcatttctgcttgttcttaattggatttcctctctttttatttgttaatctagctataggtctataaatcttgttcatcttttcgaagaaccaacttttggtttcattgatcctttatatagattttggggcctcaatttaattcagttctttctgattctagttatttgttctcttttgctagacataaggggttttgtttgtttgtttgtttgtttttccctagatcttccaggcatgatgatagagtattaatgtgagttatttctatatttttgatgtatgtatttagcactatagactttcctcttaatgctacttttgctgcatcgctgagattctggtgttgtaacactgttttttaaatcaactgtattgatatggtttggctgtgtccccaccaaaatctcatcttgattgtagttcccataatccctacatgtcatgggagggacctggttggaggtaattgaatcatgggagcagttacttctatactgttctcgtgatagtaattgagttctcaaaagatctgatgttttacaagcattttttctctcccttcactctgcatttctctgctcctgctatcatgtgaagaaggatgtgtgtgcttccccttccaccatgatcgtaagtttcctgaggcttccccagacatgctgaactgtgagtcaattaaacctctttcctttgtaagtatccccgtctcgagtatgtctttattagcaatgtgagaacagactagtacagtacattggtaccacagaaagtagggttgctgtaaagatgcctgaaaatgtggaggcaaatttggaagtgggtaacaggcagaggctggaacagtttggggggctcagaagaagatctaaaaatgtgagaaagtttggaacttcctaaacacttggaaggctaggaagacagaaagaagtgggaaactttggaactctctagagacttgttgaacggctttgaccaaaatgctggtagtgatttgtacaatgaagtccagctgatgtggtctcagctgaagatggggaactcgttgggaaatagagtaaatgtcgctcctgctatgcaaagagactagaagcattttgcccctaccccagatacctgtggaactttaaacttgagagagattatttaaggtatcttgtggaaatttctaagtgccaaagggttcaagagaaaacagagcattaaagtctggaaaatttgcagcctgatgatgtgatagaaaataaaaactcattttctggggagaaattcaagcctgctgcagaaatttgcatagataacaaggaaccaaatgctaatcaccaagacattggggaaaatgtctccagggcatatcagagacctgcacagcatcctttcccatcataggcccagaggactaggagagaaatggttttatgggtcaggtccagggcccactatgcagcctcagtacatagttccccatgttctgcctgcttcagctccagccgtggctaaaaggggccaatgtataggtccaggtgttgcttcagagggcacaagccctaagccttggccgcttacatgtggtgttggtcctgtgggtgcacagaagtcaagaattgaggtttggaaacctctgcctagatttcagaggaaatatggaaatgcctggatgtccaggcaggagtttgctatagaagtggtgccctcatggagaacctctgctacggtagtgcagaaaggaaacatgtggtcagagcccccacacagagtccccactggggcactgcctagtgaagctgttagaagagggccaccatcctccagactccagaatggtggatccaccaacaccttgtaccatgtgcctagaaaagccgcaggcactcaatggcagcccatgaaagcagttaggaggggggctgtacccgccaaaaccaaagggttgaagcttcccacggctatgggagtgtcactcttgcatcagcatgacttgtatgtgagacatggaatcaaaggaggtcattttgaaactttaaggtttaatgactgccctcttggattttggacttgcattgggcctttagcccctttgtcttggccaatttctctcatttagaatgcatgtgtttatcctacgcctgtaccctcattgtatctaggaagtagtaacttttaattctacaggctattaggtggaagaaacttgccttgtctcagatgagacttaggacttggacttttgggttaatgctgcaatgacttaagactttgggggactgttggaagggcataattgtgttttgaaatgtgaggacatgaggtttgggaggggtcaggggcagaatgatatggtttagctgtgtccccacccaaatctcaccttgaattttagttcccataatccgcatgtgttgtgggaggaacccagtgggaggtaattgaatcatgagggcaattacctccatgctgttctcatgatactacgttttcacaagattgatggttttctaaggagcttttccccgcttcgctctgaacctctcctgcccccatgtgaagaaggacacatttgcttcctcttccaccataattgcaagattcttgaggccttccaaactatgtggaactgtgagttaattaaacctctttcctttataaattccccagtctaaggtgtgtctttattagcagtgtgagaacagactagtacatgtaagtatactcttacacatactgaaattctaaaagtggacatatatccaatatcaaagctttttatttatttgtcaagagaacttatttatgtgtttgtatgcttgtgaggtaagacaaatatgtatgtttagatgctgacatatactttaccggttctctttttacatttaggaatcttcattacaaaactttacttttagataattttatgtcattaaatttagtttcatttcatgtatgtacatacattatgcaagggctaagccaagcgttgggctatgtagtgaaatttctaacatcaatctctactttcaagatgtttagataaatagacaacataaatatactctagcaattactatcaaaatttgtacacagtattacatgagaccatgaatagaaaacaccgagggtataggaaagttcacaaaagattttctggaaaagattatagtggctaaattttcaagtatctgagttatctttaaaaaatggagaaaaagaaaatcaaggtgggggtataaacagatgcaaagagacatatattagcaattgtgagcaagtgagtatggctagagataaagttgtcaaagtaatagtgtgaggtgggtactgtgttttgtttgttctgtgggtaataataaccatattgtgtacttaagttatttgttagttagagacataattccagaatttacatcacagataattataaagtgtcaagaccagtatcaggataactaactcacaggctgtagcaatagttcaagtgagaaataataagagcctgattatggttgttatgagagagagaatgtgagaaaaatttgtaacatgtaaaatgatcaatattggtgattacttggatatggagagtgagagagaaagaggagacttagatggctccttagcatttggcttggggaatagttaattgaggtacagaattcagaaggagccctttctggggaagacgaaaataagacttcaatcttaaaaatgttgaaatttagatgctttctggaaattcaagtggatattttacagatatatgtctatttgaggctgtagcttaaaggagtagaaggaaaataagcatctcaatgtaagtaaagctgtcggctttaatgtaattgcaattgataaaaaaggaatacatagagtcaaaagggcaacttagatgatactttcaaaatccaaagtttaaggagcaaacagataaggggaagacagaattagatgtgcttaaacatgaaaactagcagcaagcaggtagtagaatcttaagaaaaaagagagacagagagagatcctatagcaatagagcagtaaagtgacttagataaagataacatttaaaagcacagtggtcatttgtgaccataaagtggacacagatatcattcattgtatagctgggatttcacaactataaatatttacacatacacacacacacaataatgtgtatttttctaatagctgatattaagcctaaacattgctaaaggggtaggccctaaataaatattgtaaaaatatattcttaaaattttctaatctatttatgagctgctaattgaatatctgaaacatgaccacatttcaaaaatagtcacagacattaggtagatttctattgtaaatattattatgtagcacatttatattgacataaccaatttttcaaattgtgtgggcttttttctttatcagaatgagttacagggtttgcattatatagtttggcttaaaaagagaactcataaaattccccacttgcagcccacttaaaaaagaattattacagttttaggcactgttgagtgtcatactgagctacaaaaaataagaaatcaccataatgctctccaccttcattttagttttagaaccccacacagggagacaactatagtaatcagagttaggccactgaggttcagatttattttgtttaatattaaattgtatagttgaaggaaacatcatttttttaatgactgtatcactacccttccaaacactgtagtttactaatgattttaaaacttctttaagtgcttaagacagaaacattcctacaatatcttagctaagatttagcatgcaggtctcatactgggaatacatttgtgttttaagttaaataaattcagcctcttatttagaactggaagaacatgttgtagacttatggttctatttttgttacctagacctcaaagaagtcagttcagtagaaaaatttatacaaggtattacatggaagtttactgggaatcagcttactctatattatacaatgctgagaacattgtttaatctttgtttaaacattgtttaacaggcagtatagtttccaagtgtgccttctctaatgcatttgtgcaagcatttatgcccagggttgctatgaaaaacagagataaataatttagtccttaaacttgagaattctgaccttagcagactcctcaatgagatactcctacaaaggccagacacctctgatattagctgaaagccttcctacctccacttccctcccccctcaacctccatccacccatgtctcacatacagaaatgcactaaagcatatagtgtgataagtgtgctgaagtaaaaggccacctctttttcttttatgctgaattatgttaataagtacaaagaagtttttctcatgatcatgtatcttagacagaatttactgaaatagatctttatcttctcactttctaacccagactgatgattgaattcacagaacattagttgagaaaacaaatgaaaatgacagaaaccatgttgaactatgcatcatgttctcctacttctgatgacatcaggtttataatgagaccagattcatctgtctgactgttacacattagcataaattattcccaggaaatccttcaattctcttttaggaataaataagattctgagaggcacatccaagtccattgttgggattatgccatttttaattgatatataatatatgtacatatttatggggtacatgtgatattttgctggaatgtgtaaaaatcaaatcagggaatttggggtgtccatcacttagagtatttaccatttctgtgtgtggacattccaagttctctcttcaagccacttgaaaatatacaacacattgctgctaaccacagttgctgtattagtctgtcctaatgttgctaaaaaaggcatacctgagactggataatttataaaagaaagaggtttaattgactcacagttccacatggctggggaagcctcgcaatcatggcagaaggtgaatgaggagcaaagtcacaccttacatgatggcaggcaggagagagcttgtgcaggggatctcccatttataaaaccatcagatcttgagagacttattcactaccatgagaacagtgtggggaaaactgcccccatgattcaattatcttcacctggcccctcccttgacacatggggattataattcaaggtgagattttcgatgaggacacagccaaaccatatcatcccatccccagcccctcccaaatcccatgtcctcacatttcaaaaccaatcatgccttccaaaagccacccaaaatcttaactcatttcagcattaactcaacagttgaagtccgaagtcttatctcagacacagctagttccttccgtctatgagcctgtaaaatcaaaagtgagttagttacttcctagatacactggggatacaggcattgggtaaatatacccattccaaatgagagaaattggccaaaacaaaagggctacaggccccacgcaagtccaaaatccaatggggaagtcaaatcatgaagctccaaaatgatctcctttgactccatgtgtcacatccaggtcatgctgatgctaaagatgggcttccacagctttgggcagctccacccctgtgactttgaagggtaaagctcccactcctggttgttttcatgggctcatgggctggtgttgagtgtctgcgacttgccaggcccaaagtgcaagctgtcagtggattactattcttggggctggaggacagtgaccctcttttcacagctccactaggcagtgtcccagtggggactctgtgtgggggctcccacccacatttcccttctgcactaccctggcagaggttctccatgagggctctgcccctgcagcataactctgcctggacatccaggcatttccatacatcctctgaaatctaggcagaggttcccaaaccttaattattgacttctgtgcacctgcacgatcaacaccatgtggaagccgccaagacttggggcttgtaacctctgaagccctggcctgagctataccttggccccttttagccatggctagagtggctgggatacagggcactaagtcatgaggatacacacagcagaggggtcctggacccagcccaggaaaccattttttcctcctaggcctctgggcctgtgattggagggcctgccatgaatgtctctgagataccctggagacatttcccccattgtcttggtgattagcatttggctcctccttacttatgcaaatttccactgctagtttgaatttctcctcagaaaatgaggttttctttactactgcctcatcaggctgcaaatttctccaacttttatgctctgtttcctcttgagcactttgccacttagaagtttcttctgctagatatcctgaatcatctctttcaagttcaaagttacacagattcctagggcaggggcaaaatgccaccagtctcttgcatagcaagagtgaccttaactccagttcccaacaagtttctcatctccatctaagatcacctcagcctagactttattgtccatatcactatcagcattttggtcaaagtcatttaataattctctatgaagttccaaacattccctcatcttcctgccttttgagccctccaagtctctaggaagtaccaaactttcccacattttcctattttcttctgagccctccaaactgttccaacccaggcctgttacccagttccaaagttgcttccatatttttgggtctctttccagcagcaccacactctactggtacccattcactgtattagactgttttcatgctgctaataaacacatacctgagactgggtaatttatcaaggaaagaagtctaattgactcacagtttcacatggctcaggaggcctgctttcatggcagaaggcaaatgaggagcaaagtcctggcttacatggtggtaggaaagacagcgtatgcaggggaactcccatttataaaaccatcacatcttgtgagacttactcactatcccaagaacagcatgagaaagacctgccctgatgattcagtcacctcccacctggtcctttccacgacgtgtgggaattatgggagctacagttcgagatttgggtggggatacaaccaaaccatatcggtcatatccccaaaccatatggttggggatacaaccaaaccatatctgctatctaacattagaacatatttctttctttctttctttctttttttttttttagaccaagttttgctcttgttgcccaggctggagtgcagtggtgcaatctcaactcactgcaacctctgcctcctgggttcaagctattctcctgcctcagccttcctgggtagctgggattacagagatgtgccaccatgcccagctaattttatattttcagtagagacaggatttctccatgttggtcaggctagtctcaaactcccgacctcagatgatccacccgcctcggcctcccaaaatgctgggattacaggcatgagccaccacacctggccagaacttatttcttctaacagtatgtttgtaacaactttcttcatcagccccatcctccaccaccaccactcttctcagcctctggtatctatcagtctactctctatttccatgagaacaactttttcagctccagcctatgagtgaggacatgtgatatttgtctttctattcttgatttattttacttaacataataacctccatttccattcatattgctacaaatgaaaatgattttcattatgccacttttaaacatgaacatttgacaagaaattgacttatttattattgttatgtaaagtaactagtttaggctaaattgggtctactgttgggagtatgcacaataacagtaatacaataataattatgcataaccccaacaacagacccagctttaccctatttatcttatataacaataagtaaatacataatacataaaagaattttatatttttcctctaacacataatatttctttatctcccttttcctttttctctctttcttacatatacacatgcgcttgtgcatggcacaggttagtataaaccagaatcaatggcagagctcactaaaacacagatttctggccccaacactagggtttctgattcaatctctgtggtatagagtatagcagtctgcatttctaaggtgtttctattggtgctgatgctgatgctgatgctgcttttccaggaacaacactttgatagccacctaacgcatgtttgtattttttcagttcagatacgcatgagcaagtcacaggaagcatggtcattggagaatcctgtatagtagagtggttaagaccaaacatttgaaagtaattcaaatatgtacaatggaaagcatttagaatagttcgtggcacattgtaagaattcaaaaattgatagtcattattactgattttttactagagctgtcagtctatccaatatgcttctttcaatgcaagctccacatatcccactagctggacttattttaagatgaataaacaaaaatacaaaaatcaggatcgcaaccatgagctctattttgataataacaaatatctttcatttcctttaaatttctaaaatatcctacaaatgtgactatatgcatatatatgttcatgtactaaatgttgatttgtacatttgttattatcaaagaccaagctttggctaacacacttaaaaaggataaacgctgtttataatctgactgactatgattgtttgtagtgatgcagtagaagaaaatcatttatcaacttaagattttatagtttcttaagaacagtacttccattaaaatgttctctaaatatggtaatattaggcaaatgcaagagtgcaactaccgtatttcgaaaaatcataaacaattgtttgcatttagttcatagtgttgtaaaaaatattactttctataatatacgtagccatactttataaattatttagtatttaacataattataataaaaattaagtgcatattagcttcattccttattttaaacctgtacatatattatgtgtatgtattaatccttcaaatcactacttgagatgaattctattattatctccattttgcgatagcgaaatccagtcccagagaagctaaattagttatccaagattgcattagttattttggcaagtcaaatttgaactcaggtagttttattccatggcccatattttaagctgttcattaagttctccatcttgttgggatgctgggtctggattcatggagtcacgtgatctagtgacaggatgaaccaagtgaccagggagtggtcgtctcattaaagtatgtaaggagcataagaggtgagggttgttaggtaagatgagaagtccgggatccctgtgtggtgagtctagaagtcacagtccagtataaaacaggcttttaaaggtaagtggctggaaagctggacactgatttagtagactggcttagagtcagtctatctaaaggctgaatggaccttcacagaagttatatcatgctctgctgttgtatattcccaaatgcctattcctttgagacttgaggggtccaggaccaggcctgcagatttgatcagaatatgactgcatttgggggcttctactggcatctgctcccccaaagacttgggatcatctgagagttctgcagttgagtatgaggcctctagtaagaggcctctcatatctgagacccattctaaagatcaattatttgcatgcttgtggtccacagtcaagatatgcatacaaatcctctagattctatctcctgtgaaatactctcaaggatactaggcaaaatattacactaagtcttcatatcattcactatttcattaggccccatctgaactcaatgtatttttaatcatttttccagaactcctttaaacagctcttccattattgtcagaatactgacttagagtcctcaaattgcttcttcagctggattatatttcatattacatttttttggctggtatttttatttccttttttttttaaatttccaacaaagatttcactaatacattgaaaagaaccaagaataatctgcttttctcatgaaccctaacctggccacctcagtctattataatgtctctttttccttgcagtaaagaatttatagcacccatttgacacttgacacagagtatatacttactgtatttactaggttttgagtatatcttttcatacatattgttacagttttcaattctaaatgcacaaggtataatatgataccttgtgaataaaaagataaacattaaaaattgttgattggtaggttattttttaatatgctggataaaactttttgctatgtataatccataaatttgcttcaaaagtattccttagttattatttgttactacaacactacctttaaaaactaaatgaggccgggtgtggtggctcaggcctgtaatcccagcactttgggaggccaaggcgggcagatcacctgaggtcagaagttcaagatcagcctggccaacatggcacaaacctgtctctactaaaagtacaaaaatttgctgggcatggtggaggttgcctgtaatcccagcgactcaggaggctgaagcaggtgaagtttgaacctgggcggcagaggttgcagtgagccgaggtcactccattgcactccatccagcctgggtgacaagagtgagattctgtctcaaaaaaaaaaaaaaaaaaaaaaaaacaaaaaacaactaaatgaaaactcccttcagcattttaattcaaatattggattattcatattaaaatatcaatagaatataaacacaaagttgataactcaaattcagtatagtaattaacaatatgtatcttggttttaagtcttaatagtttttgatgacaattaaaattaaattttacaagcagagcatgagtaatttagtgaaattaatatatgatataattatcattaggtagcaaccattatgagcatcaaaattccatcctataaacattacactgtgcagaatcagttagatgcagcctgccttggatgtcttcctcttcctttttgctttcaacatcgttttagtttttatgaaaacaagttattgcctaaagaccaggctaaggtccatatttcaattttaaaaactgaaataaattatagaggccatttcttatcaaatttaagaaccaggagacaacaacaaggttaacacaataattcaagaacaaagaatcactaggaaaagcgggaaaaaaaaaataagaaaaaaaggaaaagaaatttaactaaaaactaatcatcatgttgatgtctacttgtgtgtttttagttatatattccatctgggctttatctctccaagctaaataaattaagaaaatgggaaagatcatttttgtaaataatttcaatgcttgtttgtttttaactgaatagttaatatatatatggctaagtgaagtttttcagttttcagcaatgtggcattttaaactgacaactgtaatataacttaattatcattaataaagacgattacattagttcaagcctcatatgcctggtttattacaattgcctcctacttctgccttctggatttagaatctcccatttcaatatatcaggagtaatttttataaaatacaaatcagatgttgccatacctcagaccctttagtggctcccccgtcaccttctacaacatggtatagaaaagtgtttatgacatggtacgtcttattcattgtaactatgctatgtcacactctgatttctctgtgcctttacttatacaactaactttccctaacagattccaacttctctcaacttctctcttacctgtgttcttccttcttgagtcaacttcagcatttctcctttgatgataatttttgcacatgcccctgttatagactttattaccttgttttcttggtgtagccaaacttgtcagtgtcctatgcatgtccctcagagcatttggtatgctttggccaacttccacctcctggtattgtcactggatcctaagggtgttgcttttccagccagaaacctctgcgggtggtggcgcctttgcccaagttttgctcggactagctgtgtttgtatcacccactccacctggcaggctgtgcttggctcatgctactgggctaaatccgacactttgccagggcaagccaggttcagagcagcgatgggtgcatgagcgagcaagtgcagggtcttgtcactgtgcatagccacgcacgctagctgctttggcgggacgggtagctccagccgccctctcccagcaaaccttagattgaatcagatacagggcaagagccttctgctgtgagcacccgcgtctggatgaggggctccctgaagagccgcaactcttctctcctttttgttgctcgccacatggtgaggggggtggcagctaaacaaggttttagccctgtttgtgttaccgctctttcattcctgccatttggtgggtcccgagtttttggcccacatccaggaagaatgaggtacgcgcacagctggagagttaaggtggagaggaactttacaaagctacagaacagctctcaagagaccgaagtgtgtagctcctatccataggcaggttatccccataagtgtccagctctcagcagagagaagacccggaataggtagttcctttctgcagaaggtggtcccaggagacacgaagaggaaatctcctccctgcagctggtattcttgatgtctgtgtgaggctggctggctccagggtttttttgggctcagaaaggaggaagtacatgttgattggtccacgggtggccatgggcaggcccggtaaaagcaccgtaagttttcactctgggccacggactccactggaactgatgggctggtccccaggcttcaggccatccctggcttgaaggtggggcttcaccagggacaccccactttccacccaggagcctgtcttctgctgccatcaatcatgttgttcatggtgcccaggctgtttatgaggagaagtgcctgcaggcccacagtgagcagccctctgtcccctcttggcctccctcctatgttcattggcgcccaaagttcacaggaggctgaggtggcagggggctggcatgtcagcaccaacccaagcacgcacacacccagcctggttgtgacagcacctgggctcggcctgaactttgcttcaaaattggaaggggtgccaggagctggaagaggtcaggcagggggaacaggcacttccgactctgtgggggcaggggagcttcctggatccctgagagcacagagatgcctaggtctgcagccacagctgggcagctggagctacacccaggatggcagggctcccaccctgccaacttggaagggggttaggttcctgcctgctccttgctcccaccggctccctggagcatttagcccaggtcatacctcctctgctgtagctggtgtctttgcagtggctgctccagatgggccactgctgccatcagtatctacagcctgactcagtgcccttctatcagattatgctgagggaatttgactacttgcttctactggaggcaagaaaatccaaaaacttggcagcccattggccaacattgcagctaattactctcaggatttagtgtatatgttttccagttccataacctctcaggaactggacaattaaaactatcaggacagataactctgatgcatgagtttgcatctttttctagagtttgcccttggagtgaagtttcagttctccttatgattgctggtttaatagcaatcttgttactggctaccttctcttctttgcctcactttctcacttccttatcactgttatctacacttctcaaaaaatatttatacatgaatattttgtgtccagattttctgttggagaatccacagtaagccattggacaccagaggtactacagtgtggggagcagagccttcagatgggatgctggagttgaatcgcttgttggccagttggtatcaagaccagttggcattttataacatcacaatgaccaagattatcccctatgtgaattgggatggcataaacatataaggttatgtatgccttatgcagtatttccagaatttgagatagtgacaatgataatgataatgactgtggagttggtagttgcaagtattgtcagtgatctaaaggaaaaaatgacttttaaaaaagcttcaactggtcaatcaaaatctcaggacatggtgtgaacatcacaagatctctataacaccatttaaagcaaccctctccttttgcagtttaaaggagattgagctaaaaatcagatcttgtgcctggttataagaatagcagaacagtagagaagcctcacttgaaagcaccagcacgccttctgtggaaaagtcagaaccttcacagggaaggagtaggaccctgaactctgggtttggaacatctgggtggctcacacctcactaaaccaagattctttcctcccctgaagaccacataaacacctcatctgaggttgatacttcaaattgtgcacatcttcctccaatttttttcttctttgtgacttctagaccaattattatgttcaagaccaagaatggcccaaatgaggaagtactgtctctgttttaacaataaaggaattattcatcaaatgaaccacagacaccggctaatatgtccaggtagatccagaagcacttagaagaacactaagagtaagtttactacgagtaaatcttctgagtgctggaaaaggtgtgtgtgcaaaatattagaaacacacggtagactctaaagatagtatttacctaatgtaatgaattcaaatctaaatatatatattttgaggtctaaatgtccacatccatacctagtagtatacctaattacatgtttctgtaaaatgttttaatttcagaaactaaaaatatatattaaattagcatactatcacattaatcaatgtttaaattatacaataattataaaatgtaaatctgtatccttgaaagttaattaaaatatataggatatgattcattttttaaagtcttgaagaatatccagcacagtcatttaacagattacattagctgagtttcttttgagaattaaaatgtaataaacttacactctttgaaaaactacatataagatctatataaatattccacttacttttacttgacccacaaaggcattggcttcttcttccaccacagataaatttcttggcagataaggatcaaacactggagcattgtcattgacatctgtcaccactatgtttactgtggcagttgaggtcttaaagaaaaacacaagcattaaatgtgagaggagctatttttacttagaattcatttaagtagtcattctggcatttgtctatctgaaaagcatctcatttttctttctaatccttagctttccaaaaaataaaaataaaaaaataaaaaaattaaaaaaaagaagcttgcaaagaagcttcccacctcaaaaaacagatgggaaaagcaaatgatgatattaaagggcaaacatctttttggaaatgtcaagtatttcctggaggaaaacggttttacctttatcttgttcacattttatgggtggcaagcttttgtttatacacacgtacactgctttatctctgaaatgtgccatttctgtagtttttgctgcttgtatgtttgactgtttaaaaataaaaccagtacattataaaatagcatggtacatcaaatgagcattttctggaaagctcatgctatcgaaaaatgctaccttaataattttctaggtgtacatttaaaccaagagtttgagtaccatatactaggcatgaaatgattatcttataagcatacagcttacggaaatggtatgcaggtaaacctaccagtagtgtgtgctacctagttaaaagttaaatccctggcctgctgcagtcaatattatgtaggtcaatgacttctgcacaatcaatgactatcttcataagtgattcaagctggaaactgctctctctaatcaaagcctgagtacagcacagaacctctacctagctctgtcacagtgtggggctgatcacaaaaggctgagagcaaaggtacagagagaaagaatattaacctggaaagtaagaaacctggtatgctatggtattaaatatttagtaactataaataaaaaggaggaggaaaaagcaaggtgatactgtcatgagagaattatccaccttttgtttaaaaaaatgcaagttccattaattagtaagtgatttgtagtgagaggctaaaatcctgagcactaagaagtgacttgagtgaagctgaaaaggttttgcagcagtcatggggctaaggagtcaagtgattttttttattttttatttttttttatttttttagctattaaagaggacagatcttggtaaatacccaatgctttctgttggggtcacagaagttctataccatgcaagtcatggtgcttgggaaaaagaccaaacctccctcaaatgtaaacccagtattgaaactctgattggatttaggtgatctgcccttattttaacagaagcaaaagcaaatactttttttagtaatgtaactttatcccaagcctctataaattttttcatgcacagtgttcagtagtcacttaataattaccatgcatagcagggaattcctgggtattagtgatggcttatttctttatttgtatgttggcttaccctttgaaaatttatgttgctattcatatgtgatttgcacacatttttgtatttaaagttaaataaaatttttatttaaagacacgtacaaagatggtcagaacatcattatatagtcaaaatctggaaacaacccaaatgtccatcgatagtagatggttatacaggattgtgttttatatatgcaatggaatcatatgaagtactgagaatgtacgaactactgctataagtaataacatggattaatttcatgaacctaagtttctagaacataaataacacatactatatgattccatttatataaacttcaaaaacaggcataatccctacatggtgataaaaattagaatacgggtcactttgaagaagaagatcgaatagcgacagaaatgatcacaaagctgagcttctggagtgctgattaatttctgttttttgttatgagtagtggttacataggtgtgttctctatgtaaaaattcattaagctgtagaattattgtttgtgcattagtctgtgtgttatattttcttaagattatttactttaaaagatgcacacacacaaacatacacatgtgtgtcgatatatgtaagtatgtttaaagaaattcaagtgctacttgactagatggaatccagatcatttcattttcctcgttacttttatatattttctaaatgttctcccaaaaggctaccatgctttcatgacaaaaagtattttaacaaatattatttctttaaaatttgccttagaattgaaagcagtaaagaagatgtgttttttacagttgcggtagttcccaatttgcctgagggttaacaagacattgaaatttacagcctggatccaaaatctaagaatggtgaccctggagtttgctggcttttcttcaaattgcctgaccccctttacaccagcctgtctttacctgtcaatccactgtttttctcatcctattctttaaaatttatattcatgttttcagagtattctgtatcctcagtttaagactgtaactcttaagtggataatgaagaatacaaccagatcactaagtaaactaagaagtcaaataacaattccataattttgtgctaataggggatgatatttatgggacatgcaggcattttcttcatttcttactgaattttatatgacatgaaaaaaatccatgtcttacagaaatgtacagtcacatctatacatagaataatttccagtttatatatttcttgaagttttttaataccacttgcttcagaaatacttatgtaaaaatgaggatttcagggctatccattaggtctattgactattgttctgaacctatggaaatatttataaattagttaggtgtaaatcatatttatttaatttttcttgattggttcagaaggatggcaacaatatgcttcaatgtggatctgtgccatagagaatgtttatgtcttattaaggaaagacttcttttcattgttcaagcttaaaaattagcaaatgaaaacagatcactttaattaattgttaggaccatatgtcattaacacatgttcacaattaattttaaatatgaatatatatataatgccagttaaattaaaaagatctcaaactaataaacctaataaataaaaagttacgtattttccatcaacggagtttgctcactgattatttcctcaaaagttgtattaacttataattccactagctggaaatacttgcatgttagtactaaatactgtaattgaacactttcatgttcattatttaatttaaatgtgtcttagaatttccttttgtaatatcatagaagaattttcaaaatatatgtctcattctcaacaatgcaagatatttctgtttttgtttgtttgtttgttttgagacaaggtatcactctgtcattcaggctggagtgcagtggcatgatctctgctcactgcaacctccgcctcccaggtttaaacaattctcctgcctcagcctcctgagtagctgggattacagacatgtgccaccatgcctggctaatttttgtatttttagtacagatggggtttcactatgatggccaggctgatcttgaactcctgacctcaaacaatctgtccgccttggcctatcaaagtgctgggattacaggcgtgagccatcgcacccagcttactgttgtaatttgaatacacatttatttttataaactagtatggctctgaaagaaggatattaatatagcatctttttttattttcattgttgttgttttttttgagacatgtctcattctgttgcccaggctggagtgcagtatgtgatcatagctcacagcagctttgaactcctaggctcaagtgattctctcacctcagtctcctaagtaggtgggactacaggtgcacgccactatgcccagctaatttttatttctttattttatttttgtagagacagagtctcagtatgttgcctaggtggtctcaaacttctcatctcaatcccaccttggcctctcaaagtgctggggttataggtctgagccgcgatatccagctcatcttttgttttttgttgttgttgttgttttttaatagtataaaaaaagtgagttataaagccatagtcaaagaaagtagtgtaaattcatctatcaatacacaatgcattatttgaaattcgtgagaacatacattaagagtatcttatttattctcttctagtatttcctatctcaggaaatgacatggcaaaataattaactaattttctaagtcactttatctcatacatgcaatttattagtcaccaagtcctgttaatttgaccttgtaaatgcgccttgtattatacagttttgagcaatggataaataatacaattttcatttcctgagtaaatagctggaagtcagataactgggttttctgattagcatatgtttagctatgtaagaaaaccagaaatgtgttttgctcaataatttaatgaataatttttaatacattttcttgttaatcaacttaatgaacacttttaagggcagtgtgtaatactacgaatttaataagcaattttggctttaatcctagagaggataagagaagggatgtttgttttttatttaatcacaaaaaaatgcatttttttatcatttaatttttacatcttttgacacaaaatttgttaaacatttcatggctagaaaactatttctttatattttgtgtgcatctcatagcacagccatttgttttgtgctattacatttatattagatgattgaaattcaatgacattcaatacatggtttaagaaacatgtatgcttagaatttatctgagcagagactcatggtatgtataggaatcagtcaggaatatttcaatttgttcattaagaaagcagaaaacattatcagaggtaaggtaacactataattatggagcacttatcatttatctatttcttaaataaaaacatgagtgtttaatttcaaaggtgcaatttcttttctatagtcaacaagattcactatatattctcagaaataataaagacattattttattaagaaatgtgtctaacgtgtttactaatagaacacacaatgtcagctcaatgaatatttttagatactttaaatatctatttttattataatttgtactacatgctgaaataaattaccttataacttattttatttaaatgtctgaaaaaagaagagctagaaagaatattgaaaatttccatctgtgagaaaacacaagaaatgttatttatagaacacaaagttttcctatctgaataaaaatcttcactactatatctaaaattcttttcaataacaatgggacaatgaggatttatagtttagaattcaatcattttttgtttaggccaataaaacaagaaaaatacatattcaataataagtatagtatttagagaatattaatttaaaacattttcatccttaagcgcaagtcatcttgttgctacacagttcagagccaagccaacttcattcagattgtagagtttcattcatgatgtagagtggaggtccttcctaccattaaagattagccaggaggctttctttccttctgaaggaaaaaaatatacataaaatctagaatttctttgagaaagagaaaagggaagttccttctattatgaattacgggaaggagaaagggagacacagaagagacatgaaggcaggaggcagaggtcctcctcctcatcccctactgccactttggacccctccttaagtgaagaggcactggagaaacattttggaagaagggggaaatgatgactgggaaactaagagaaatttgggtgaaataatcacagtagttttcaggagtatgtaagcctccagaaaatttccacaggttccatgggaggtcccatctaataggttatggcactgaatatacagcaatggcagagagaggtgtcaagagagagaagccatactaccagcataaaggactggtaaatacatgttacatctagaccacaattttagaatgaagtcagggaggagaggtttggttggcagcttaactagtgagtatttatattgtcttaaacagataatgctgaaatactgttctaagaaacttaagtgtgacccagattacatctattccctacctgtccaaacacatatttatacattattgtctaagtaggaagattgcatcaggtataaaaaataaagaagcttttttttctctgtgcacatctgagtgtagtgtgtaaagattatatatgtatgtgtgtatgtatgtatacacattttatgcaatcgtgcatgtttttatataaatatatattttcaaaaatatcagaaagtatttatagtatacctgtatactatagtatatataatatagaactatagatataaatatttatatatttgtacataaacattttgcatgttacatatattgtaaagattcacatatatgacttaaatgtttaaagttttactattctataaccatacgtattgtgttctaaaatattaaatcaactattttgaaattcaaagttactttaacttcacacattttctcacgcatgtatttttgcttttgttaaagtttcctatttgattatgaagttaaatgctcaacttttaaatgttaattgttcatttatattgccatgtttcaaagaaatttaggaaataatattgcttcaagacaaaaacaaagatgctaagtcttctagcaatctgaaattgtgaaatattacaagtgttcagactgaaagccataactgagtaattcaatccagtaattcaagagcattttacagaaatcaaaccatgatggaatcaagttacctattgtatcaattaaggaggaaaataatattgctgaacacacggaatctggtcagaaatatctaggctacagaataacttcacattttaaatgaaaaaaattactgatcactgttcgcatatttatttatatctttcactgtgttattggttgattaacacagctgcaatccataagccctacttcctagctatttttctacccactgttgctacttacagataagaatatctaaaaggaaatctgctagatggggtttctgaaaaaactttggtgctttgttaaaataaagcaggggtgcagactcttctggcattcatctttatactttgtctggtatagagaattgacgtctagagttgcagaagatgggaatgaaagtagacaataaaaatggcaaagcagaaaatagccagcaggcatcctcaatggcactgatgtgcacctgcaccatctcttcactgtccacctctagattttttttctgtatttgtttgtactatctcaatttttaaatgtaaaatgttgtggtattaagtatattcatattcttgtgcaaccatcatcactatccatctctaaaactcttttaatctagcaaaacaaaagctctataacattaaacaataactccccatttctcttttctttatcctctggcaaccatcattctactttgagtctttgtgatttttgaccattctaagtaccaaaatataagtggaatcatatggaatttaacattttgtgactggctaatctcacttagcataatgttctcaagatttatctgtgatatagtgtatgtcatactttcttccatcttaaggccgaatgatatttcattatatgtatataccacattttgtttatatattactctacataaacatggaaaactgggttgcttttacatcttagctattgtgaataatgctgctatgaacatgggaatacaaatatctcttggagactctgctttcaatttttttgatatataaatgaaagtgtgattgggggctcatatagtaattctatttttaattttttgagaaactaccactgttttccacagtggttgtaccattttacattctcaccaatagtgcacaagggttccaatttttccacatcctcatcaacatgttatgttgttgttgttgttttgttttgttttctgtttgttttttataatagcgtctctactgggtgtgaggtggcacctcattgtggccttgatttgcatttccataatatttagcaatgctaagtgttttttcatatgtttactggtcatttatatatctcctttggaaaagtgtctattcaagtactttgccaattttgaatcagtttgtttatttttgttttctttaaaaaattctcgggctgggcgtggtggctcacacctgtaatcccagcactttgggaggctgaggcaggcagatcacgaggtcaggagattgagaccatcctggctaacacagtgaaaccccatctctcctaaaactccaaaaaaatagccaggcatggtggcaggtgcctgtagtcccagttactcgggaggctgaggcaggagaatggcctgaacccgggaggcggagtttgcagtgagccgagatcgcgccactgcactccagcctgggtgacagagcaaaaatccatctcaaaaaataaaaaaaaagatctatatattttgaatattaatgacttatcatatatatgatttgcaaatattttctcccatttttatgttgcttttttattctgtgtctttgacacccctttacaaaatcacaaattccaacttgtctattttttgttgttgttgtctgtgtctttggggtcatagccaataaatccctgacaaatgcaatgaaatgatgcttttgccctatgttttcttctaagagttctatagactcagttttcattttaggtcatgaatcacttttgagtttgtttttgcatatgatgttagataaggtccaacttcattcgtttgcatgtagaatgatcatagcacccatcttaaaaattatctgaccaattaagtgaaagtttatttttggattttctattaaattacattggcctgtatttctgtttttatgctagtactactctgttttgagtattgtagctttgtagttagtttgaaatcaagaagtataagttctccagctttgttatttatttttctttttggctatctggggtcccttgaaattttaaagataagttttagaataagtttgtttttttaaaaaaattatttctacaaataacatcattgggattttaatagaaattgcagtaaatctgtagattgcttgggagagtattaacattttaacaatattaagtcttcccatccatgaacatgggatatttttcaatttagttatgttttatttaatttctttccaaaatgttttgtagttttcattatacaagtcttttatctccctggttaagttaattcctgagtattttattcttttggatactattgcaaattgaattgttttcttaattaactcattcattttcaatctatgaaaatgcaaatgattttgtgtgctgattttgtactctgatactttgcaaaatttcttagttccaacatttgtgtatgtgtgtgcaaacatgaaacatgtgtatggaatcattaaagttttctatatgcaaactcatatcacctctaaacagagataactttacttcttccttttcaaattggatctttctctctttctctctctctcttttctttctttttttgcctaatagctctggtgaggacctctgatactatgttgaacacaaatggtaaaagtagacacccttgttctgaatcttcaaaaaaaaattagaatcgaaaaagtatagttttatctgtacccccgatagctaaaaaaaaaataaattacatgacacatgcaacttatacagatttttcaacaatcattaacaaagaaaatttagaaaaggacagtcaaatcaaacttcctccatactgtctacaaataaactcacaatgaccaatagaatgtgacctcttatctccatcatccccattttgagatggtagaaaacgtgtattctcatgatcaaattttcaaactcatcctggcaatttgtttcacacaaattgcttgttaacattttcatttcaataaattccatccatctgtctgtgtttattaaatatctgttttaaaccacatgattcttaagtttaaaaggttaattttactgtaattactaaatatttagataagaaaagtgctattaagacgtgagaatattattgttatataatcactttttttcttcaggaacccactgtgtatgcctacatataagtatatccgtaaaattatataaatgatggaattaactgaataaacttttgtttgaaatctaaatgctttctactctactgatattctcattacaaactttacaaatgaacacaaaatttactcagaaaatcagaattttaaagcaaaatgaaacctgagtgattatatgaggaaacgaggacctagaaatgctaagtgtcctgtccaaggagaattaaaatatacaaataaattactgaacaatgaactagaaagaacaaaactactgattttagcccagaacttattttggttttaagtagtcaaaagtattattagtagattgtgactattttccttccatctgtttccttgtctaagaaactttaaggacagacttaaaatgttctagctaatattactgccattagtttctgatttataatgtggcatatttcaaagctatgtattatcctttctttttttcctattttattggttgacctgaatgctttcttaatttcacttcactgtaattatacctcttaatctatgctaaataatttctccttctcctccttagaatattttctctcacttattgcctagccgagttaccctctaaactttcatcataagtcaagttcttcaattacttcctccagaaactctcactgacttctttacatacatctaacacagacatactgtaataatttagggcaggctgggcgcagtggctcacgcctgtaaccccagcactttgggaggccaaggagggtggatcatctgaggtcaggagttcgagtccagcctggccaacacggtgaaaccctgtctctactaaaaatacaaaaattagccaggcgtggtatcatatgcctgtaattccagctacttgggaggctgaggcaggagaatcacttgaacccgggaggctgagtttgcagtgagccgagatgtttccattgctctccagcctgggcaacaagagcgaaactccatctcaaaaaataataataataattaggtggattgcttatataaaaattagccataggttttatttacttttctatcatctaagtacctattatcctcactgtttactacaactgttctgtatattttattatatgtataagtatgtttatttatgtaatgtctgaaaaatgttaaatagcttactatggacagactgcaattaccaaatttaattatttctatttatctcacttttagttaagatgagaaaactattcaggtatcaattttatatttttattataataaaatctcagaaatcctcctaaaataaatgtgaagatacatttattttacatttattattacaataataaatacattattattgtatactttcagccaatgtagtatatagattaaatagatcatttcaaggagccaggagatatgttgatatttaaattgagtgagccttgcttatcaatctgtaatgggtttgaaattatttctagacaatagcactgagttgacacataagcacctgattgaaaaaaaaaagagaatcacctaacacatggcatagaaatggtgaaaataattattaacaatggtaatattacaatacatagaaagcgggatgctggcagttgtgaatgagatcgttcaaataacacagacaagtgattttaaagcagttcagaatgtctaacaattttttttttttaaagtgagttttaggtccaaaggaaatagaatttatcttctttggaattataagcccatttaaattatttagataaccaagaattacttatgattcttactgctacttacaaatgcctgtggaaacaagcaaatcactttcctaagtgcttaaagatatttatccacaaaatccactcttcctccctgacccttaaaaaaatgacgctaagtgtaacaggttccaacataataaactgccagaacacatttcatggtgcagtgcaaatgacagacacaatggaatacctgttagaataaagtagatttcattttccctacaagttaggtgagaatgctgatctcaagtatctgttctgtcaagtcaaaggttgcagcacaatagcaaattcagagtataggtgcatgtattaatagcctgttgaagaaaagagcaacacttctagtaattataagaagttgctccagatgaaaaacattaattcatgtctgtgatacattgtttaagactctctcagttgccttaatactatttttaaaaccccttcacagggagcatactcaccccatctggcctgccatctgaagctgtgatgatcagaatgtagcgatcagtgctttccctgtccagtgctttccctaaggttagaatccccgtgctagtgacaaaacaaacaaacaaataagacaaaaagagatattatgtcacaaggagagtcttcttagtatagtgaattacttttgatagctttttttcccctctcagtaatcacagcttgagtattttagatgtataatactaagattcattctgaaaattgaaaacagcttttaaggctgtcaaatttcttagcagtatccatgaaactgacactgagctgatttcctaccttccaggaaacaaaacataacaaaactgtgcttaattcattccaagaagaacagtatctatcttgttttcgattatttcaagagaaaagacttcattattccttagcagtctcagaattctttgaaacaaggaatggtttcctataactaatgtatatcacctcccaatttatgtcatatgtatgtccattatgaaaatgcaaaaacccatctaaatgttatctctgacaaactctatggataaaagtttttcttttttcttacttttaaaataacagagacccattgtacaaaattagaaaatagaattttttcaaattacagaaattatgttttttgtaatgtttctttttgtactttattataaccacatttaaatatatgattgtttcagaagaggaatcattctgcatattttacattttttaagaaaatataattgtattagaattcatgttctcattttataatttgtttaaaaccccttttgtggctacactaacaattttagtattttgttattctttggaaatttagctgtttcttaatttaactgatgtataatgggagattaacagcacttgggaaaattattgcacttacaatatttttaatacctactccttatcttttcactgctcagaataaatgtttccaaatatttaagactttattcacccatgtaatttattttataacagtttggcttgctctctaatgtaggttctacatttatttcttaaattttacatctgatattgtacacattttaatcgagcctaacaagtatccactgtgtagaagagtttatctgaatataataacacattaaaatatatgtaccaagtccaaaacataaattgtttctaatggataaaatgctttcattttaaggtaagtgcttttattgtaaagaaaatttaaacaattcatatcacatatggtagttgagtacagagagtcaaagccgatgaatcaaaataagaatcacagttactcaatttgcttattatgttgtaatggttgacgtggactttttaaaaagttctgaacatatggcatgcccatgaaaaactgactttgcttcctgtacattttaaaaatgttttgtcaaaataattgaaaaccagttcccagagcatgttcacaacaattaagtttggaccagcttcctacagtacagaaggtccagataatcccattttaaaattacattaaatgagaaaagtaagacatgtatttcttctgaggcttattcacaagtatcttaagaaacaggaaagctgaaaacctagccatggtataataagagaaagaaagaaaattgagttaccattttcattttgtttcttccctcagttaattatctatattcctccttgtacattaaattagaaaattactaaaaagtatattgtatatttacgatgaattacaaaactcacgtgataactgagttgatttcctaccttccaggaaacaaaacataacaaaacttcgcttaattcattccaggaagaaaaatatctatcttgtttttgattatttcaagagaaaagatccattattcctcagcatgttcagaattctttgagacaaggaatggtttcttataaataatctatatcgcctcccaactgtatatagtatttggaatatatatgtatactctatatatactatttaggatatataatactatatgtattattccaaaaatactatatgccgtgaacaatatagtatacagtatattcatacttagggccattttaaacacaaacagctaattgtctatggtctggtgattattatagaggtagtttttatgtaatacgcgggccttgcgactcagtgttgtaggcagttgtgtggtatatttgggcaatgcagaaggggagaaacacaggcagtgtattttgggattcatagctgaaagactagtttatgggtttacctgtgcatccttttattaaatccgagaaatagctcacaaaaagtcttattaccagctagatggaggctatcaggccaggatacattggggtacacttagtaatgcaatacaccttataagttcacatattaaaaatacataagcttcttcaattgataaagcatcaataacactgctacttatacaggattgaaaatacatttcccaggagtgatgtcagtggaaatggagaagacagccccaagagatggtctcgccacaaaacgtcaaaaaatcacaattaagcagggaccttcaacagcaaatttgatgaaactctggaaaacagtcacaggtttatagcaaccagatgaaggcagaatttgttttaaaaaaaggtaaatcaaatctggtagaagaactctgtggcattttgacttgtctttatcctaccatctcactggctcagagtggccttgaaaacatcagtgaacattcccagtgtgacactatggtctttgtttctggagggagcgagctatccttattcataaagaactgtgggggtctattctagtctgtctggagactgcctgaaggagtgattcatggcacttatctttgtttcatcaaacttggaaatcactcaaagcagaaaagcagtgggcattcctcagaaatattgtaaggcaggggatagcccacaaacacttgaggcgtataatagagtgccaaaaacttgccaggaaagtctgggtaaatagtttcatggaaaattcaggcactcaaaagtgtactggggaatacagaataataaatataattgagaattcataaatatacccacacatctacagtcatctgattttcaacaagaatgccaagaccattcaaaaggaaagaatagtcttgtcaacaaacggcactggaacaaatggaaatctatacgtaaaagaattaagttagactacttcacttcatacacagctattacctcaaaatggatcaacaatttttctaaacacaagaattgaaacctgtaaacaactcttagataaaaactagaggtaaatattcataatcttggatttggccatggattcttagatatgacaccagatgcacgggaagcaaaggaaaaaatagatatactgaacttcgtcaaaataaaaaaaaaaaaaccttttgtgcatcaagggacattatcgagaaagtaaaaaaaacaacgcatataactggagaaaatacttacaaatcacatatctggtaagagtcttatttccagaatatataaaggattacataacttaacatcaaaaagaaatcccaatttaaaaataggcaaaagactcaaatacacattttttccaaagaagatatacaggatatacaaataatcaaaaagcatatgaaaatatgtcattagtcatcaggcaaatgcaaatcaaaacccacaaccaagtatcacttcacactcactatgataattatatttaaaaaaagaaacaaccaccattactaacaacaacaacaaaaaataattgttggcaaaaatgggaataaatcagaatcctcatatatttctggtgggaatataaaatgcttcaatcactgtggaaaatatttgacagttcctcaaatggttaaaaacacataattacactattccctagcaaatctattcagtatatacttaaaaaagccaaacacaggtacttaaatacacgtacatatatgttcacagcagcggtatttgtaataccgaaaggtagaaaaacagcttaaacgtctatcaatttatgaataggtaaacaaattgttgtatatgcatgtaatggaatattacgtagccatgaaaagtagggacctacttgcacatgttgcaagacagacgaatcttggaaacattaggctacaaaaaagaagctagacacaaatagtcacacattgcatgattccatttctgtagaatattcaaagtaggtaacttgatgaagccagtacgcagattggtgtttgccaggggctaagggaaataaggaatagggagcaattgctaaatgggttcaggtttctatttggagtgatgaagctattttagaactagacagagttggtaggtgcatgagttctgaatctcctaaacaacactgaattgttcactttaaaatggttaattttgtgctatgtgaattttgcctcaattatataaattatattgcagagtattttccatcaccaagcttttgggctacgttcctgaaacatattatgcttggcatactcaattattatagaaaatagggtttgcctaactataaaaatggtgttcaaacataatttaaaaatttggccaggcgcggtggctcacgcctgtaattccagtactttgggtggctgaggcaagaggatcacaaggtcaggagatggagaccatccatcctggctaacacagtgaaacactgtctctctctttttttttaatgtgcacttttttttttttatttttttgagacagagtctctctctgttgcccaggctagagagcaatggcatgatctccgctcactgcaacctccacttcccaggttcaagcgattctcctgcctcagcctcctgagtagctgggattacaggttccctgggagcttatttaaaagctctgtgccatcagttttcccttctgtcaaatgggaaagtgaaaccccatctctactaaaaatacaaaaaattagccgggtgtggtggtgggtgcctgtagtcccagctacttgagaggctgagggaggagaatcccttgaacccaggaggcggaggttgcagtaagccgagaccataccacagctctccagtctgggagacagaacaagactccatctcaaaaaataaaaaaaataaaaaaataaaaattatcacctgtagtcccagctacttgggaggctgaggtgggaggatcacgtaagcctagacttttgagactagcctgggcaacagagtaatacccagtcttaagaaaattcaatgatgtaaatagaaagtagcagaggatatctacttccaaacaaaacaagctaccgaatttaaaacctgcttctataagtaactgtttttcaaaattccgttattaggaaataccgatgcagcatcattataaactattatctcacatatttcatgatgtataggctttgcttatttaaaattttgttaaaaattctacagcttgtgactgaacatttacacttggaggtgtctgagcctttgacagatttatcacattgcttttgggcactgagtttcaggctttacaatgatatttaaagagattagagtatactttaaaatgtacagttgcttcaagtttgacatggcatttcatattaaatagcaattagcaattaacaaaaacctactaataaagggagctaggtattgacagcagtttggggaaaagatgatggtggcatgaactaaggtagtagagtgaagtgtgagaaatagtttgatttgggtttaatattttgaaagtagagctgagctgtcagggaataaaataaatatctttcttatatattatttaattttcaatataatcataaaattcaaactgatatgaaaaatataattgagcattacatgtaatgtcaaaacaaattaatcaccaaagaaaaaattaaaatgcaagtgaagaaaaaaaattttaatagaatttggaccagagatggagataatttttgaaattctcttatttagcactgattttaagtgttggcatcacagaccccatgcttcagtgataacaatccataaatatttgagagatggcatttcctcaacctcccttaataaataactataccattaggccatcatatttataagggaagttgccatatatcttatttaaatgtgtacttatttgtggatgattgctgagtgaatatttgctaaatcatatgccactatcaagacagacactatgaaaagatactagaaaaatgcattatattagaatcatacagatatggccacttaatacatgacactgaatgatttgtattaccaatgtttgtgatttttaaaaaaccaaggctttttctttaaagacccagtttctttcttggctgtgtgactaagccaatttattaaaataataattcagtactttgtaaaaccctactgacattaagatgattattcattactactaattttttaaaagaaatacaagaaaattttggcatacttttatttcattaaaggaaagtaatggtattataatgatgcgtattgagagaatttgcattatagcataaaataatatggtatttaaagtatacaatagacatgtaaatattttttcattttgctttaagatataaaatataacccaaatagcatatattgaagtgtctgatgaggtagaacattgtttatttttttagcgtacctgtcttagtccatttgtgttgctataaaggaatacttatggctgggtaatttataaagaaaataagtttatttgtctcacagttctacaggctgtataagaagcatactgccagcatctgcttctggtgaggggctgagagtacttccactcatggccaaaggtgaaggggtgctggtgtgtgcagagatcacatggtgagaaaggaagcaagaaaggaggggtggtgccaggctccttttttacaaccatttgttgtgggaactaataaagcaagaactcattcattacctctggtaacaagccattcataagcggtctgcctccatgacccaaacaaatcccattaggccccatctccaacatgagggatcgaatttcaaaatgaggtttggagtgtcaaatatccaaactatagcagtacctggattgttcatatccttgaaagttatagagaagtggtagtgcaaagttttgaacatgaatctcagaagtttcaaagaaggtggcagttgaaatgtcagttattgttctccatttcaaatgcattgaaatgtattgctagtggttcaggctactctataaatatcaatgagaacaacagcattgaggtggtggaaacaaagtgaccataggatagaaggcaaagggcccagtgtacaggaccctgaatcaagaatgatcatcaaaagggatcacacaaccattatagggacatgttctgctttagctttcctggaagcagtttgtgtcttaaggagatgtctgtccaggttgacctaagagctttaacattaagaatcatggtcaatttagactaaaaggattttgcattgacataatttacacctttaagaacctctgtgacccagccattatctttttcattccaaatgcagagatgagaggagcactagagatataggaaagcagtgcatttagataatttatttggcaaaactagtagctcactggatttcacaatcagcaattgaaaaatctcttggcatcaagggaaaaacaggaatagaaattcttaagagacctgggcttcctgcttaccagagcaggtgaaaacttcattgttgtctttttcttttgttgacagctttgttaacattttaattcagatatcataaaatccaccaatttaaagggtacaattcaatggtttttagcataatcgcagagttgttcaatcatcactgtaatcaattttagaacattttcaacaccatatctattaacagtcactccccattctctcccactcctcattttcaggcaatcattgatcaactttttatcttatagatgtgcctattatgaaaattttatagaaatgaaataatataatacgtgctctttttgcaactgacttatttcacttagcataatattttcaaggttcatacatgttgtagcatgtttcagtacctcattaccttttattgatgagtaatattatattattacagacaggcaacattttgtttattccttcctctgtagatggatatttgacttgtttccacttttgtaccattgtaaataattcttttatgaactttctttgtgcaaactattatgtagatgcacgtcttcatttctcttgcatatgagcagaatgctggcttatgcggtaattctgtttaccatttggagaaaaggccagttctccaaagtgtagtcatagtttgaatccatgtccttgcccaaatctcctgtcaaattgtcaccaatgtaggagataggacctgctggaaggtgattggctcatgggggcagtttctcatgaatggttgagcaccaccctccttggtcctgctctcttgatagagttcaggagatctgcctgtttaaaagtgcgtggcacttcccctccctctctcttcctcctgctcaggccatgtgaagcgctgactccccgctttgccttcagtcatgacttttaagtttcctgaggcttccccagaagcagagcaggtgccagcatcatgcttcctgtatagcctgcagaaccgtgaggcaattcaacctcttttcattacaaaatactcagtctcaagcacttctttatagcagtgcaaaaacgaactcacacatgcacattttacatggccacataaatttacgcagatttcagtatctccacattcttagtcatacctggttttgcctttctttatcactacagacacaaagtatgtatgaagtcaaatctctttacagttttaaattgcatttctctaatgacaaatgaacagtgatcgtgatcatatttccatgtgcttgttggccattcacatatccttttttaaagaaatatctattcaaatattttgcccattttaattagattatttctctttattaagttgtaacagttctttatgtattcttgagacatgtttcacaccatatacattattttaaaatattttctctgattgtaggttgtttctcactttaggatggtgctccttgaaatacatttttaaaaattgacgagacccaatttatcaattttatcgttaatctttgtgcattttgtgtcatatctcaaaatgtactgactaatccaaataatgaagatttacttctgtattttcttctatgtggaatgcagttttatctcatatattgcaatttatgatccactttgagttcatttttgtgaatgatgtgagataaaaattgaaattcattctcttgcatattgtcccagcttcatttgttgaaacaaagttctttcctgattggattatcttgacccctttttgaaaatcaattgaccataaatactagagttatttctggattcttaagtctgtccaggtgcttatatatctatctttatgctaatactacacagccttgcttaaagtttttaacatttttattttctttaatgatgattgtaaattgtagctaatttttgatttctacatccctatgagataaaaatgaaaacagttaaggctttttatttttcaaatagaagtttacttatctgtggaaaacactgttcttgtctatagtttcccaggcattactaactcatgtttgtaaaattctatttaacgtgaaatttcaggtatttctgggaagactaattgaccagcacatggttctcttgttttggcattatgccccacatgttcctgagtctgatgtggcaatgtattcatttgtcaaagttttaactttataatcattggccaagtttacatttctattccttctgaaagtaaaactattcacaggtacacaggaaatatcagggaagagccaagctctttagaaaccagccacatgtgacagcagaacagctaccttgctattgcaaaagggaagcatacagtctctctgaagccctaaatgcctccttttaatgcctgctcccagttttctcaatagttatcattagcaatatctcagatgtattcagagagataagtagaatgacactgatctagacctcaaagaagtttggcatgaacacgtattttatttcattgtgctttttttcttaaatatacctatgttaatctgaaattgaaggatgtgtttgtaacacatcttgcctacaagcctccctttgaatacacagtttggtgctaagtaaccctttgtagtaatgtccttgtcattatcagtagctgacaacattaaaaggatctaattaatcccagttgtgccttccaatgaaatgtttccacctcagtagattttacctagtaaaaatgttaaaaataaacagtctcctgggtaatatttctgggctcagaattatcctcccagctaccattagcattcatagaaaacagaaagggaagtacaactacaaacagctgaaagcctctgattagaagtctgctttcttactaacagtacgttgctgtacatttttttaaagtaggaaatcatttttaacttacgtttctgaaagattaaaaactctctgaggatctccattctcaatggcatatgttattgagtctccctctcgatcagttgccttcagagagaaaacataattcaattatcaagtaattgatatggcgcccactcattacagagtaatataaaagcttgaaactaatagcacagaatgtccatgacactgttaaagaataaagattaaagcatggcctaatggcaaggtgtaaaatcaaacatttcgtatctgatccatttctgaatatgtaatcctacctgatgtggaaataatcattttcccaaggtttacttatttaattaacttaattaatgaatttaatttcaatgtctgtttataatttaaataaaagctgctggctgggcacagtggctcaagcctgtaatcctagcactttgggaggccaaggtgggcggattacctgagatcaggagttcaagactagcctggccaacatggtgaaatcctgtctctaccaaaaacacaagaagttacccgggtgcagtggtgcacacctgtaaccccagctacttgggaggctgaggcaggagaattgcttgaacccgggaggcagatgtttcaatgagctgagatcatgccactgcactccagcctgggcaacagagcaagatcttgtctcaaaaaaaaaaaaaaaaaaagtgctaaactatgtttacagtgtcgataaagtgtttaatgtatattcttttctttttctgttcagaatatatcaagacaataattcaaatcagtctaactttctggttaaaaatcctgaatttatagccacaaagcatgacttcaaaaccgggctccaattgtcctatgtgattatttctgtgtatccatttctaaaacgaggactatacaacaatacaaatgttaatagatgttgagaggtttaattgaaataatatatatcaaggcacatagactaatatctggtacattgtaagctttcaataaatattaacctttttgttggtttttcttcccttcaacacccaagtcggagaagaaaacatatagtttgactttgagttccgagtttctcttgaccaaaataaagatgctcttgttttatggcactgaggtctggagttttaccttaaaaaacatcaaatcagttctttttccagtgagtcattcgatcctcttataaaagacatggataaagaaagaaatttggatgctatcagagagttgacagaatgatctgcctaagcatgatgctacagggggggatatatctgataaaggttcagatgtattttatttttaggtgactagcctggcagaaacaccagcctctccacagacaggaactgccctggagtcagcaggattctgagagaggaataagtatgtgagtttctgtcagtgactacataataactgtcccagccataagaggctgagtgtgaaattccctgtccagacaggcaggaacgtattgttcttagtggtagatcagttggctttgacatggattacacagtcctgctcacagaacgtccttatcagctaccacaatggattgatggccagaagcctctcttggaccacaaaaactacagaatcaagggaaactgaaaataatatttcagtcagtaataaactactgaatattgactatgtgctaggttctgtaagaaaatctttgcaagattatttaatctgtctctcataaaagtgatatacttccttcgcatggctcctatgacatcatattgtcctgctttcaatcctcacattatcaatggtagttcctcattttcctttgctgatttctcctcattttataagacttattttatattggattgttccaaaggttggtccttgaacttcacttatttagtcaactcattcaacagtgtagctataaatactgtctatctgctgaagacggtcatatctctaggctagccctttcctctggatttcagatgtgtatccaattgcctacatggatccacattagatgaataataataagcctccccaatttaaaaggttaaaagccccaaatctagatctcctttccatcttgacgtacctcaaaaaataaaagaaattcaaacaataatctattgttttcactgcttcatcatctcagtaagtacctgcaactccatcctcctactttctcagggctcatagctacactttgagggctcactcttacattccaatgcaacccatcagcagatcccaccagatttacctaaaatatctgctgtatctggctgtgtctgaatttcttctctgccaccaccttcctcatggattatggtagtaactattttactaacgtgttgcttcttcccttgtatcctcacaatagtcaattttcaattcagcagacaaaagtacttgtttttccaggccaattcttttatttctttggggtaaagtctattgctttctcccccagctccccaccctccccatgccatacacactaaaataaaatggaatcaaaaaaagtaaatgaagaagaaagtaataaattagccagggtaaaatatttttgaaacatcccatgttagtcaaaatccaaaattttatatttcattgagttagtcataatggaagcctaggagtagaaaaaaaagaagcaaacaaatttctaagaatacactcaataaaatggatagtagacgcttgatatttttcccttgcattctgttctttgctagataggaaccacaaataatgatactcagctaacattttgaagaatcagagaattatatctggagactatatcttaaccccaaaaagcttacagtgaactttttctgttgtttttctctcggtcaataaatttttcttattatgttgttatagatatgatcatgttcttttggtttgtttattgatatgtggttgctgttttaatttttttcttgagaaacattttataatcttgtgtttcataaaagccagaagaaatgcattctgaaacaagatagcttcatgtaaacaattttaagaccagattaatatcgaatcttttattatatcagatctactctaatatttaatatcctttatgtaagatgagaacactgtatttatatttattatttttatgttaattcctttcaatcccagaggtagcttgaaatatttcttcagttttatttgaccactcaaatacctcagtcttttaaggattgtgaatgtcaacaatttgcctacttcattcttatgtgaggttatgcccatattggaaactttgaagacttaggatttaaaagaaaattcttatttgattcctttcttcatttttatcttttcacacaatcctttattggtgttccagggtcgagggtggtataataattaggaagtatttatagtttttcagccaagaaagcaaaaggaaatggtgtaatctgtatcaaagttctgcaatctatgcattacatgagttagcacttgtatagacaatatcatctttctttgtcaatgtccaaaggtgagaaataatccataaaaagaaaaattggaaatatcaacagaagcatttacccttcaagtattaggatttgattatgtgtgtatatgtgccctaaacatatttctatcagcaatatttaaatgttttctatatataaatctaaccagccatctcaaaataattgcttataatgtgtcagaaactatattaaaattttgcatgtcttgtctcatttaaacctaatagtaactttactggtaaatagaaaatgcatatgacttcaattatattactatttctgccatcattccaaccagatttctctgtactttaattaattgaaagatgcatcttttttatctagagatagtaataactgtatcatcttgaaaatgggagcatagtgttattcagtattttccataatataagagatataaattgcttctttttagtgaaaaaacattttatgtgcttatttttgataaatcaagtcatatccgagtcccttcttcaaagcctgagaaaagtatgacagcagttatctttctggggcttattttgagtttaacgggggagattctggagccagctacctggattcagcctcagctatactatctcttctcagacaatgcactcaagtacaaaatgagaatactactactactacttaatcactcattaattcaacaaatatttattgagcatctacgctgtgttaggcactgaggctgcagcagtaaaccacacagacaaaaatcctgcccttatacaatttacatggtagtggaggaaaatgaagttaaaaattaattagaatattttgttttcagatctttatacgcgttgctcaactacaaaatatttcacaaaggacatatatggagagcagggtgaggatttacacttatagaagtgatcatgacagacttactgaaaatgtgaaattttggcaaatgcttgtaaaaggtgaaagagtaagtcacgtggggaagaacattccaggaagagggcagagcaagtgataaaggccgtgaggtgaaaacaggcctggtgagtttcaagaacaacaacgaggttgtcaggtctggaggcaagcagcatgtggaagaggagctcctcagtgtacttcgaccactttaatacctcaggttaaacgaataaatgatgtgtattttggatagctggcaagtaatgcactttagccactggtttgctaatatatggttaataacatggttaagattaaagccaatctttcctttaatttttatttaatttaatataattttaattttgcctgaagaacaaatgattcctttaaaaatcaaagcaattactctttccagtccactcaaccagattacttgcagcatctgacttagagtccctgatttttcagaagcaccaatagggaaacaaaagtatttatccaaggaagcagtgttcttagacactggcaaatggaaaatttggaaaagaaaacaaattttctctaaactaatcttctgttcatgttaaagatgaatacagccatcaaataccgtctgatagagtgcattttatgtgcaaggaatgattctacacatttcacaggacattaagacaaagtaactgcccttagggattctaaaatagataaaaatcaatggatttggatgattttctcacttaggcaaacaagttctgatttatgttattaaaccacttgagagcaacaaataaagctttcaattcagtacagcagtgtttcaaaaaatgtatacattcattcctggtattacattttttggcctttaacaaaatgttataatatttaaataaaaattaatgaatatattttattcatgtcaagtactgttattttgtcattcataatgataatataaaatgttattttgaagtaagtgtaagtaaaaggtcagttcattaaatattccaaacaatataaaatgaataatattatatagaatatacatataacatatatgaaacttggaaatgtagctaaatctacaatgacaaaaatataaatatgctcaaaaataaaagaatgttggaaaactgcacacaggagagccataaaacagctctttttcttacaatattggtatggattaatgatcttttgcccaggaagcaaaataaaatgccttatgctaagaaggcatagcagaatcactgctggtagtgttgaaaataaatggcatttggaagtgagcataaatttatttgtcacatccagagaagtgtctgtaaattaagaagtccttaataggaaaaatacctagacttccgttagatttagggatactctatgaaggcttagtcttaaaaaaattttgttgtacaaaatgggtaaccttggaatacaaagagatttaatcaattctaaaataagcctgcaattctaattttgtctagggctcaaggaacaatcaacaaaataaacttagaactaatgtaaatattcaaaatgacgcatccaaataatggttaccattatgtattaagcacttttaatatcccatctcatttaatcctcaaaacaatcttctctggagagcactacaatccctattttacacataataaaatcttaagcttaaaaattaaataatttgccaaagtttacaaactatagaatcataattcatattctatgccttttgaaactcattttctatcactagcaaagtcccctatgtcctaaacttatctcgagtttcccttcacctgcttgcttgaaccaacaccaagttcttcttaagaaccctaatttcccagtatcccttttgattggtgagcctcagagtagccttcttgtttctcaatgtcactgccagattattcttctggaaatgcatcagctttaattcttataccataagcattatactgcattaactgctactcttcattgttaaagtcatactctacactatttatcatacttcctgttttttgctcattgtcagtctctctctttgcctgtcattgctgtcattgtcaacttaatccaatatcaaagtttcaaataatatgtaaaatgctaatgacttcaaaattgtatttcagttctggggctgagagattcaagatcatggcactagcagatcccatgcaccttttgtggtctgcagacagctgtcttctcattctacacttacatagtagaaacagagagctctggtttcttcattccccataagggcactgaatgccattcatgaggactccactctcatagcctaagtatctctaactaccaaatgtcctacttctaaataccatcacgttggggattttggcttcaatatgtgaattttgggggaacacaaacattcagtccatagcagatgtcaaaaagtcttttcaaatacagtatggccaatattgaattactctttctctaacagtcttttaattttggctaatgacaaatcaatgtttccagttactcaagctgtatcttaatacctattcttaacttctatctccccttctatatccaattcattaacaaatcatgtagtttttaaccaccaaaatataaccagattgaaatgacttctcattatttctggaaagatcactccaggcctagaatgtgctgacagagcatatcaacaactctccataatttttcccaggcttcttccacagaccattttcaatgcagcatccaggattatcctttgttaaatttggttgattatgtcactgctatactcaaatttttaactgtacctaatttcgtgcagagtaattatatctatccctctcctattactgaatgatttcatctctactactgtctgtttcttttactttactctgtaaggaggagtatttttcttcttccttaaacatatcaggtgtgtctaaacttcggggtcttacctttgcacctgaaatacttttcctcagatacaaccatggctcatcctctcaccttattcaactatttgctgtaaggtcactttctttgtgaaataatcactatcaaattgtattttcccatgcacttcctctctagctttccttctttcattttccccataacatcttctaaaattccacataactcacatatattttgttaattttcttctctattagaatggaaccttcataaaagcagaaattttgtcttttttatttactattatatcctagcatttttagttgtgacaccataagaagttaatatttacttgtcatttggtccttgcaaagttataagccttaatgattacattataatgagaaaaatgaatgaaagaattttggaaaaatgaaaaaggaaggtattaagtggacacaggtctctccctgctcctgttttcactgggaggcaggaaaatgcacacctcaggaggggagggcatgggacattctggcttctccctgatttattagactgcaaggataaactaagtccaggaaactcagtcagagctctgttctgtatatgcacattcttcctcagtatcataaagggccttcctttgtacttcctatgactgggagcctaactttaatatactgaaggaagtacagcatttcaattgtatctggtacttgaagcaactgaatttacagtaaaacaaaacaaaacaaacaaaaaaagaaaccccacatgctttttacctattgtatatactctgtgtgtctctattaattgcttccaaacttgacagagaaaataaagttgtgtgtgtgtgtgtgtgtgtgtgtgtgtgtgtgtgtgtgtgtcctattctacattttcagaatacctgtcctaggttaaacacattccaaaagactgttagggaacagtttgttctgggcacactgatataaatatttcagttatctttatttataattattaaaaaatttgctatcaccttcatgaatattggacatgaatattcattgctaacatgaatggctcaagataaaggaggttatatgaataaactatatgaaaccaggaaggcttttgtcatctggaatgatgctgaaaagatgattccataagtatgaatttagcccaattattcttagtttttattgcccaatactaactgtaacattaccctgagagctgtctctagaatagtgtttggtttgcctaaattgaacttaaagaaaaatgttgtcaggcctctgaaaggacaaatcttacttgctaataaatatactgtgcatagtagtatttggcctgagacaaacttttccaacctttctatgaaggttgtgacagagaatcctagccctcttttactactacttattcgtggctattgatacttagaatctaattattgtggaaagacaattggctttggtcagtttacagccctcaacatttaatgacaaaccaaatagaaaaaaatcagaatcaacatttctgtcattaaaaaaatttcttcatgatacagctcttgtccagatttatataaatagaagtttatttgttctttgttttagaactatgaaaaactggacacctacgaagcaatttacttaaactcttagaatttagttcaaggttttctcaaagctttcctcagagcctactcacttttctaactagttagatttctcagccttcactagataaaaaccagatatgtaaaataataaagttatccggacacaggcaaacagtgaatgaaatcagtacacagtgaatggcttgacagctgtgagagaagtagacagaaagtgcaccttaaaaacaatagacacaggctgggcgcagtggctcacgcctgtaatgccagcactttgggaggccaaggcaggcagatcacgaggtcgggagatcgagaccatcctggctaacatggtgaaaccccatctctactaaaaatacaaaaaattagctaggcatggtggtgggcgcctgtagtcccagctactcgggaggctgaggcaggagaatgtatgaacccaggaggaggagcttgcagtgagccaagatcactccactgcactccaacctcagcgacagagcgagactccatctcaaaaaaaaaaaaaaaatatatatatatatatataaaacaaaaaacaaaaaaacagataaaacaagcatagttatcaaagatcaattgtccattaagccccacacatcacagcactacttatagataaaaatatgtaatccaatttaggaactattaatcacacaatattctgaattaaatagacaaaaacaaagcattaatttgatgcccattataaacaatatatgtactgctagaaatgagaaataatataaaactattcaatatagcccctaccttgagaaaatattaatctttgtgaaataaacattgagaaatagtgttcactatatgctggttaactgtgcatttgtaaaagtaatccaggtctagtatctacaagattaagaacctagtcttaattctctcacttttagccacctagggtctagggaactagcatgtatccctagacatctattctaaatcataaaatgaaataaaaaatacttcaagcatctactttatgtagtagatatagaatcagatgaggtaatagatatttaatacacttcagaattccattcaaatagaaggtattgctcagtggtcgggcatggtggctcatgactgtaatcccagcactttgggagcccaaggcgggcagatcacgatgtcaggagtttgagaccagcctgaccaacatggtgaaacctgtcactactaaaaacacaaaaatttgccgggcgtagtggtgtgcatttgtaatcccagctactcaggaggctgaggcaggagaatcgcttgaacccgggaggcagaggttacagtcagccaagatcacatcattgcactccagcctgagtgacagagcaagactccgtctcaaaaaaaaaaaaaagtattgctcaataaattaatttaatagttaaaatcttaggctttggagtgaaaagaaataggaatgaaatgggactctttcacttataagccacatcctctttgagcaagatttaaggtatttatatctcagtgacatcattctgatactcagataaaatggcacaaggctgtcatgatgatagaatgaaagagttcatatctagaattcagcatagtgcttagcatgcatttactaaactcttactattgatgttaatatttagaaagaagaatgcacaatagaattcaggcaaaaaaaatcgatttgtaaagcagtgtttcttaaagagactacaactctgttatcaataaaactctcacttctggaatactcagcaacatatagtaagtgatatgataccatattagcagagatagtacatcaaattcccggcaaccacttaaggtggggggggatttttttttttcctattcttagatacaaaaattttcatctgcaaggttacatgtatactttaagcactgcttgctcttcatgtccactttatatactgataaacagaaagaaagatctccagttaaggtctgaaaatgtgtctaagataggtagatattggttgatatggcttgtctgtgtccccacccaaatctcgtctttaattcccacgtgttgtgggagagacctggtaggagacaattgaatcctgggggcaggtcattcccatggctattcttgtgatagcaaataagtctcatgaaatctgatggtttgaaaaatggtagtttccctgccccagttctctccacttctctgccgccatgtgagacatgcctttcaccttccaccatgattgtgaagcctccccagctacatgaactgtaagtccaattgaacctctttcttttgtaaattgcccagtctctggtatgtctttatcagcagcttgaaaatggactaatacattggtcaactatattggcagtggatggtggggaggggaacataaataaatgtttataaacctggccatcaacactttgagctaaaaaaatgacaaatgagtgaaatacacaattcacaactaatacttagcatgtattattttgagcaaattaatagatcaaacactaacataaccccttagtatattttcagttgatacatatatcaaaaagtaaaaataagcaggattggagcatacagcagagacacttctccaatgacaaagtgaggagctacactgaccatctcccagtaaaacaatcacaactgctaaaaaagaaaccttaaaaattaaagtctcagctaggcgcagtggctcatgcctgttatcccagagttttgggagactgagaccagaagattatatgtggataggagtttaaaaacagcgtgggcaacatggtgaaactcatctataccaagaaaaaaaaagataagaaaattagctgtgtgtggtgttgtgcaactgtagtctcagctacttgggaggctgaggtgggaggataacttgagccctggaggtggaggctgcagtgagccatgaccacaccactacactccagcctgggcaacagagtgagaccttgtctcaaaataatattaataatcataatagtaatataaataaagttttaaaatagtctctaaatactgttctaaagacatatggcaagtggaaaaaatatttattcaataaaacctactaaatctcactaagaattgtgaaaactgttcttagtgagttcactaagaacagcctgtctttctccctttccaaaaacctattcagcacagcataatgcaggcatagtcaagaacatgggaattcttcctcacagcttcagtctgaaactaggctatctgcccatgaaggcaggccacacaatttcttatcacccccagcaatgtgctgcagtggctgagaagtctgatgtttccggtgggccttatggacaggaatggagaaaaaggcatttgccaagtcaatggctgtatatcaggtaccaggagatgtgttaatttgctcaagcaatgaaaccacatctggtacggaagctgcaattggagtcaccacttcattaagcttacaatagtccactgtcattctccaagatccatctgttttatgctcaggccaaataggagagttgaacagggatgtggtgattaccacccctgtagctttcaagtccttcatagtggcattaatctctgcaaaccatccagggatgtgatactgtttttgatttactatttttctaggtagaagaagctctaatggcttccatttggcctttcctaccataagagccctccagtcagggagccaatgtgggggttctgccagcttctaagtatgcctatgccaattattcattccagcactggggaaatgaccacagcatgagtccaaggacccactggataaccactataagacagatccgagctgaaaccccattaattatctgacctctataagcccctactttaactagaggaccacagttttgggtccccaagaatcaacgtcagctcagagccagtgtccagcagtccccaaaatgactgataatttccctttccccagtgcacagtgaccttggtaaaaggcccgaggcctccttggagaaggatggaagaaagattaacagcataaattggtgggtagtgtaatgggattcttcctcaaggggacctggcctccccttcattcaaggagttctgggtctgtaaactggctcaactctggaaattgactgaggggtcatgattctctgtttttataattcaaattagtcttttgtccattctacatagaagttttctgcttaaattaagtaggaatgcagtaggcttcctattaatttcacttctaggaacaccctgattaattagccaatgtcagagccttacatgagtcagactactctgatgctgctttgcctctgctgtccattatggtaactacacccaccttgcctttgatggttgagcgccaccacttggcccatgccaccttgggatccaattactcctattgtatttaaattttgtagttgagtgactgtggttcacactgtttgatctgacatacagagaagagcaattatagggctcttcaaagatgcaggtgctgccctcataaatctcttttgcaaagcactggtcaagggtatatcttcaggacccacccagcagggatgagtaggtctaaagtgactagtccactccaccatcccaaactccctaagcctttagatccctttctctgcattaaaccaagagagatccggcatttccagcaagctcagagttggctctcttttaatccatattttagctaaccagacaaataaattattataacctttttttaactcctgaagctgcaacattaaatgcagaatccctacttggtgggcccagatcaataaattcagcctgattgaactctatgtttcttccaccattatcccatacccataatatccattcccatgcctgttctccagatttctgcttatataaattaaaaaaacataacaaaacaaaataaactcgagcagttcttttcaagtgtagcacacttcctcatgggtcacactctgaacttacctctaggggcccacaaggactttagtctagttatagattcagaagcaaacaggagtgttggggctggctcctgaggagaatcaacattatttttcctggcaactgccttaggggaggccatcactgttgcttcaggcagtgcaaggtttctctcctcagacaaaagtggaaaggctgatggcagcatggattagagagaggaggtttccacgactaggaatggagaagccatttcttctgacaaaaaagtttcatcagagtttacaagctcagtgtccccagccttatcagggtcctcccacacatccccattccaagttgcagggtcccattcttttccaatcaatgccctcactttaacaggggacacctggcgaggctgtgattacacctgttgttgcaggtcagccactagcatgataagagtttgtgtctgattttccacaattttagctctttctctacaggagctaagactctcactcgggaaaatcttagcagatttgaggctcagtatctgcttctgaagccaggagttagaatccctgagttcagccgggcgcggtagctcacgcctgtaatcccaacactttgggaggccaaggcaggcagattacgaggtcaggagatcgagaccatcctggttgatacagtgaaaccccgtctctactaaaaatacaaaaaattagctgggcgtggtggcgggcgcctgtagtcccagctactcaggaggctgaggcaggagaacggcatgaacccaggaggtggagcttgcagagagccaagatcgcgccactgcactccagcctggctgagagagtgagactctgcctcaacaacaacaaaaaaaaaaaaaaaaaaaaaaaagaatccctgagttcatccttttctttcatcactttgtccagtaaacttaggagcaaccaaccaacttcatagtcaaaggtattatgtatagagtcactaaactctttgcctctcacaagtggtgaatcaggagtgtcaaatgcatttattttgcataactgtctaaataattcagagcaaggactatcattgttcaccatactattagaagtaaagtacttagcattttttgatctaatcatattaaacagccaactccagaaaccccaaaaccaatgaaagaactccatccttaatattcagttcctctagaaccactcctggcaccaaaatctgtattagtcagagttctctagagggacagaactaacaagagatatagatatagatatagacatatagatggagatatatatatatatatatatatatatatatatatatatatacacacacacatacatatatatacacacacacacacacatacacaaaactaataggatatatttaggagtttattaagtagtattaactcacacaatcatgaggtttcacaataggctgtctgcaagctgaggagcaaggaattcagtctgagtcccaaagctgaagaacttagagtccaatgttcaagggcaggaagcatccagcacaggagaaagatgtaggctgtaaggctaagccagtctagtcttttcacatttttctgcctgctttattttctgattagatggtgcccacccagattaagggtgggtctgcctttcctagcccactaactcaaatgttaatcacctttggaaacaccctcacagacacacccaggatcaatactttgcatctttcaatccaattaagttgacactcagtattaaccatcacagtatcatataacacagcaattccattcttaggtttctgctcaagagaaatgaaaacttatgttcacacacaaaaatatatgtaaatattaatagcagtattattcataatagtcaaaaattagagacaatccccatgaccgtcagctgatgaatgtataaagtgtagtatatgcagacaattgcacattattgagaaataaaaaataatgaaatatcaatatatgctagaccatgggcattaaaacgttaaactaagcaaaagtaaccagatacaatagatcacacattgcatgattacatctaaacaacatgtcagaatagacaaatttaaagacacagaaagcagactggtagttgcctaggactggtgactctggagtaaatgaggagtataggctttttttatggtgtgatacaaatattctaaaattgactgtggtgatggttgaacaactacgtgaatatatactaaaaacattaaattgtgtactttaaattggtagattttagggtaaatgaattatatcttaatatagctgctaataacaagcaagaattattccacagagatgatggagttagcacagcttccttgctgtccacactcagtagcaatctatttgttttcctggagctaatgagcttcttgtggcttacagacagggaccagagagaaacacagaaagtgtcaggtcatgggatgtcttaacacacaggtatcttcctaagggaaatgttaacataggtggatcctataggagtgagtctggtctttataaagcccaaaatcaagaaacagctaaatagaatggatatggaaagcattcctcctgttactgaagccacaaaagtataacgagcataaaaaacagacttgcttcaagtggtataggattagacaattaggttcgtacaatatgaagtgtggatccacacacataagaaaatttcacacacaaaaaagagagttgacagtacaactagttaggaaaaagcaaagtccttcatatatgatgctgtttggtgtttattcagacagaagaaattgaaattgatttcaaatttcattatatacacaaaaatacatgttatatagcttgaaggcttaagtgtaaaaaataaacagttaaaacattggaagattattttgtcaaatacacatataatccaggtcaagagatcagtttattcaagaaatattgaatctggtgatatgaagatatatttgactctatgaacttggataccttgcctatcttccttccttcttccttctttctcatctatctcagctgtctatctcctagaaccagtaaccaaatgtttatacatggtattaattttcacgtattaatattttattaatagaatcaatagcattgatagaattttctattttgttatgttctgttctcttatatactacttgatttcattaacaagagataatattaacaccaaaaattgattttgtgatccaaagtatggcttgaaaatctgctgtagagactttgaatgtttgcatctctttagtgtcataaatatatgtatgcttcctgacttcttccttcctgattttcttcttgaataagtaatttcataaaccattacaacgcttagtatgataaccgtttgctcctattgcgggtatgggctgtggtctggtagagagaatcagaaccccagagggggaggaacatgcagtagtatttgtggcagcaacgtgcacagcaggaagtattagagccttagtcaaatgagaaaggcatctgagagggtgggaggcaaatgtggccatgtttggaagatgaaatgttttggggagccaaatggactggcagtgaagggccagcaagaattgttaagagtctaatgagggtgagtagggcatgcccatgaagtgggggacagcagcagtgtaatttggggtgtcctagactgagtgatatcaggctatctgggctgggtggggtgttgtggaagtgatcaatgtaaagaatcagagcctgggtggggtttcagaaagtaaacggtgtcaaaaccttggaaaagggttgccacagcagcctggcatggggtcatcaaacccaagagaggaaaaggaggtcattcaagatgtctggaatgggaggtcagaacccaaagcaggtaagcagaatgtttaggactgggtcagaatgggaatgatgatttggtgtgatttcaaagcccaaagatggttacaagggcatttgtgtagactctcatatgtgttgagttagggaataatgagggtaatcatggtgtctgcatgggaagggtgtcagtaggacagcagtctacagtgggatgtcaaagcaagagtggagagagtggagcaagatggtcccccagtaatcatcccctgaaacaaacaactttcataacaagaaaatgtcaggtgagcactcacagtacctggctgtaaatacatatcactgaaagagtcactgatgaggataggaaagaaagtcttgaattgctgatgccacccctcccccatcccctggcagaagacacatggcaagaagagaggatctgtgcacttgagagagggagagtgcagcaattgtgaggctttgcattgaactcagcactgttctgtcacagcagaaagcaaaaccagaatgaattcagctgatgccggctcacagaaggagtatataaaccaatcctatccagaggagaataacccaaaccagcagttgaaacttaagttccagccagccttcccaccacaggctaaagggctctggggttctaggtaaacttgaaatgcagtctaggccacaaagactgcaactcctatgcaagtactagtgctgagctgggcttagacccactggactaggatggcatgtgacctacggtgacaatggctggagcagctaagggagtgcttgtgcaacccctccctcaaccccaggcagcacaactcacaggtcagggggatactctttacttctgctgaggagagaagagggaattgtaaagggaacattgtcttacatcttgaataccaggtaagccacagtaggataggacactagtcagtcatgaggctcccatttcaggttctacctcatggctgacatttctagacacatcctgggcaaaaatagaaacctctgccttgaagagaagaacccagtcctggtaggacccatcaactgacgcaacaaacaaacaaacaaacaaataaacaaaaaaccttggtccctgaataaccagcagtgatacccaggtagtacactgtggtgagatttatgagacttgctggcttcagatgagactcagtccagctgtggtggctatgggagagactccttctgcttgagaaaactcttgcatgctgttcgtataaatgtaaatcagtacaactactattggcaacagtatttgaaattcctcacaaaactataaatagaagcatcatatgatccagaaatctcacttctaggtataaacacagaaggatgaaaatcaaaatatggcagagctatctgcactccgtgtttattgcagcactattcacaatggccaatatttggaagcaaaataagctcaataaatggtcctgggaaaactggatatccatacactgaagaataaaactagacacttatctcccagtatataaaagaaaatcaaaggcatcaaactctgaatctgtcatggtaaattgtgtatgcatccacaatggagcattattcagccataaaaagtgacattctgtcattttcaaaaacatgattgatctggacatcatcaaattaagggaaataagaaaattaagggaaataagccaggcacagaaagacaaactttgcatgatctcatttattcatgtgagctgaaaaataaaactattgaattcatgaagatagagagtagagggatggttcccaaaggcagggaagcgtaatgcaggtttatgggggaagtggggatagttaatgggtacaaaacatagttaaaaagaatgaataagacttagtatttgttaggacaacaaagtgactacagtaaaaagcaatttaattgtatgtgttaaataacaaaaatagtataatcagtttttttgtaacataaaggatagatgcttgaggtgatggataccccattatcctgatgtgactattatgcactgcattcctgtatcaaaatatctcaatatcaccccaaaatatatgtacccacaaaaattaaaaatgaaagaaaatttaaaaatacaagtacaagtggaatgaagaaggcaatagtttggggtatggtatttgtggcatgtagtgtgaagtgttggactttgaacttggtaataagtttgtctgcgtggttgtcggtggggtgagggctgcatctgtgctgcgccagtggcagccaggcgtgtggtgtcaaagcatgagtggagtgaggagaccatttgtatggggtcataggcaggagattggtttaacccagtgacatttacttagtacataaatacaatgaaggtaagaagcaggtttcctatcagagaatagagacaaaagtgtggaaagattaaaaaaaaaaaaaaaactagagtaaatggtatgggatcagattggaattgaagttttagtgtgaactcataggtatatatataagtaaacaaaggaaaaataagtataaacaggtctttttagcctgctatttggggcattacactgtgaatttttcatctttactcatgaagacagcttctgattccaaatcactcagcacacagtggttaaattaggacaactgtagcagcaatcaagttttgctgtgctttctaaccatttatttatcaaaatccgaatgaactacctttattttggaggagggaggtaaggaatggctcagtccacttctattgctagataattgtgtctttgtgtctgaaatttatgttttttaacctggagctttctttaaaaaaagctttgttcttatgtgtgggtgagacaagtgtatgactgggaaaatcagagacgaagatgacattttttcccttattttcttttaaaaactggttttggatttaatgaatctatggtttttaaaaaagtatttgaaaccacgagacatataattgaatttttcagttttcttaataactcttccaatgtaaatattctttacttttcaatttaaaatacattgttttcttagctccaaatcaactaattcttggtagttaagtatagaaacaccatagggactttgcaggatcagttgagtctcccattgttctcactagacaactgatacttattagcagtttattgagtatacttcactaacatggtttttgttcctttctatttatcaaaatctcagaaaaattacagcctttatatacttacactttaatcaacaatagctgacagcatgtgaagcaataaatagcttcaagacatgcaataaactctgaggtttatttacaaaacaacacagtgagaatcatttattgccaagttactaaaggtaatagtgattactgctattaaaataccagaagctattaaatagttgcccaagcaaatagtctacattcaaacccagaattcaaattagtcttttttcatttaactttagaaaaacagaatagtttaactctgttcaattagaaaggaaaaaaaaaataaccaagaaacaacaaaaattctccaattcaaacaggtttagaaattgtaagcttttctttgggtcatacaatgggcttttggcctgaagcaaatggaagttttcactttctactatagtcataaacttttgctgataggtcatttataagaaggaatgaataaaagtaggtctctaccatttccataaagatagactaacagagaacatgcagtatcagttgattatcacttaggaaactggaaagagtgtttcttggctttaaaagagacatgatagaaatctaaaagcacagcagataatagggaataaaggtctatttgaagtgtctcttccccagaactccaaaatacacctttattatgacatataattccctagtgattgcctataaaattctattaaagataaagatcttggccaggcgtggtggctcacgcctgtagtcccagcagtttgggaggccaaggcaggtagatcacttgaggtcaggagttcaagaccatcctgcccaacatagtgaaaccccatctctaccaaaaatacaaaaaaaaaaaaaaacaaaacttagcttagcgtggtggtgggcgcctgtaatcccagctactcgggaggctgaagcaggagaatcacttgaacccaggaggtggaggttgcagtgagtcgagatcatggctactgcactccactgagtgacagagtgagactctgtctcaaaataaataaataaataaataaaataaagatcttctattctacctcattcctctggcgaccatattcctctaagtcggggttcctcagtttggtaccaatgacatttttgaactggaaaattctttgttggagaggggatttcctgtgcatttagggtgttcagtagcatctctgacctctatcccttagttgtcagtatgatctagtccccagtcatgataaacaaaaatgtctgcagatattgccagttgtctccaggtggggggtgggggcaaaattgtatctgacagagatccattgcttttatcaatctcaaaatgcattatctgtcatagagtccaattaaaacaacacatagtttttgaaattgagactatctcataaaagctgagacatatgcttcctgaagtcagagttattgtaaccaaccacttgttactcatctcaaaacacattcactgatttctacagtcctcccctgctctgaggatttggttttcaggcaggtggagacataaatactatttaatttctaatgcatcatttcccatgtctctcaaaatgttcccaatagaggtcacacatttttacatataagaaaaaaattcagagtgaaaatccacacaattttaaataataatatatttaaagctaatctaaactcacaataatcttggggatatgaaacctggggtaacagttcattacagttcaagaagtctcatggatgtttgaaacttcaaaggagagcactattgctgattagttacgtagactgaagttttcagtctcttgagaaaagtttggtatttcaaatctgaaaatgatttaagcttactggggaatgaaataaactgcaaaacctttctagcactctaaatcctgatatcacagagattacatctgatattagcatattttgtggtgcctaaagcagttttaggagctgacaattgccagggaaaaagagaatttccgggaagtttggtcctaggaactggacatgtgtaggcatttctccaaattcaaattcaaatatgtataacaataacaataggcatttgtataatagtgtacatataaaacaaatttatagttgaggggatatattttattatatttgtagtacagaggcagatactatattaccgaagatgttttgtttactccagataaacaataactaattcagcacgtttaagcattcatcttgactctcctcactttccaactctacatcattctctgaggcagcaaaacatgtacactcagtggcctcactacagcagtctctccatcttagaacagtgtgaatgtgctctgggcaatatctgtagtgtgaagaaatgtggcttgagtttgttaatttgtaccgtgtcctcatatgcacactttctcaaagggagagtcccagagtccccataacagtcttttaaataaatcttgttctttatactgtgttctgcacttctctaccggtccttctcccaacacagacacacacacacacacacacgcacatcttaatttagaaagaatagcaatcattatttgtaaagacaactgttgggacagcaacaattctctggagaaaagtctaaaacatatcttcttaaaatgtattcctttactattaattatatttgtattagtttttttcacactgctattaaagaccccaaactgtgtaatttataaagaaaaaaaggcctccacatggctatggaggcctcacaatcatggtggaaggcagaggaggagaaaggcatgtcttacacagtggcaggcaagagagagagcatgtgcaggggaatttccctttataaaaccatcagatcttgtgagatttattcactatcatgagaatggcataggaaaatctcgcccacatgattccattacctgccacctggtccctcccacaacacgtggggattattacaattcaaggtgagatttgggtggggacacaaaaccaaaccatatcaatattctgtctgctttttaaatatttttttattttttgaatttctatagtgtatttattatacttcatcacttgggtttctttttattttagaaaaccctgaatccgccatttcctagatgtcatctcaaggctacataacactaagtcctcattacagagttagtaaaaaacaagatggttatcataactgtcttcattacagaggctgcttgaaaatgaagtctacacagagctaaccaataagaagacagtagaaagcaacacaccaaggcaccatttgaaacctcagttgcagcctttcttaaaatcagatccacatgatagtcaacaattttttattgattacatagtatattccaggcactgttgtagttactagggatataatagcaaataaaacaaactctcggtgattatggacctaatataatacttggcatgacaatataacacaaaataagcacaagtgcatataggattacagcaaagaggataaagttaacagaaagcacagcatgttggaatattattattttttataaggtgggtaggtaagaccacttcactccaaggaaatgtaagcaaagtctgcaggaagggaaaaactaagtcatgagaatatctgaacaaggagcctttcaggtagtggaaatagcaagtgaacggttccagaggtaggaatcactcagtgttccaggaggtcagtaaggctagagtggaatcagtgaaaggatgagaagtaggagatgaggtcaggtagctatcagtacaacatttgtttttatcttaggtaatctgagaagccatgtcaggaatttaacaaaaatgtgaagtcattttaggtaatttttttaaaaagtattattctgttgcctgcaactgaccacaaaagggcagggcggtgggctggagcagtccagtagggaagctattgcaataatctaagtaggaggtaggtgatggtggctaggattagggtgaaagcagtgggaatggtgagaaattgtagaatcatgtaaatatctttggaccaaccaaatttattgattcattggtgacaagggggcctgtggataaagagaaaggtcagggttcacttaaagggttttggcccaagaatttggaaggataaagttgccatttactgggtagggaaaatgcagaaggaccacctgttttcattaagataatggaaagtaagtgtcaagcattgagcatgggaaatactaattttgagatgctctgataaaaaacaccatgatatgcttcacacatcctccttcaaggaatgacgggattattcccttatacattagaaatgttgcacactgaaaggcttcagctatcagtcctattcagagaatgcctcatctgaggaaagcccaaggtcaagcagctttctgaggcaacctgcgtctaatgaatattgatgcagacatataaacagcctatctccttgtcacagccttacaaccctgaaggaccatatcacatccataattttccctgtaggcagctgaaagctttacttggactgcactgaagtttaacttctccatacatacaatactgctttcttcccctcccttcaataggagttgataccccaaacactccctaataaagatcctgtaattgaatcttaatttcaaagtctgcttcccagaaaacccaacctacaaaagatgtttctttagtaaccaaagggaaatactgttgttacagattgacatggatctatagttttgagacagagagctaaactagacatttgaattagaagttatgagcatataccacttaaactcattagatctgttgaaataatctttggagtgaatggaaataggaaaagaagaggttaaagttgaaagaagggtgtttcaatttttaaaagtcagggaagttaaggggaagaagtatcaaagaaaacaaaaatagagcagcctgggagtatggaaaaagtcccaggagattggggtacactgtaggtcaactaattaaatttttaaataaagaagaaactatcaattctgtcacatcatgaggatgggttgagtaagatgagaaattaagttgtcaatggaatgggcactgaaaatgcaaaaaaaaaaaaaaaaagccatttgagtggattaatgtgactgaaatcctggttacaatggagtcaacagataatcctggaaaggagaataaccacaactttcttcaggccagtataaacaatatatttgagaagtttccacagtgaagggaagcacagaaatggataaattgctagaaggtttacgggaccaagagaaattttgttgttgttgctttgtgttcaattgcaagatataatggcagtattgcatgctgatggaaatgatcaggtagagcaatggatgcttatgatgtaagaagcacatagggaaattatgaagcaacatccttcagagtagacatacatggaatcagtagaattcaatcagatcagagtcagagtaaagagcccacaattagaaggtgtgtgttttagatttgcattgggccttgccaattacatttccagtcctaagtgctagtgaggtccaataaccagtgtcattctgcaaagtgattatggatcatgatgagacattaaatactgagttgtgtttagaaaattttaaagtgatttgacagtaattttatatatgttgaatctaacagttaaaatggctttcattttacatcttttgtatttcatttttctagtaattcatttaaatgcaccctttataacagaaactttaagaagcactgatctagcatgcaagtgaaagaaatggtttatacagaaatgaggagtgcttatttttaattactgaagtacaagtatcacaggagctttggtgttgcttcgccagctggaaacttctgcggccaatggcaccttctacctgaggattgcctgtgactgctgggcttgttccacctatgcagcctgacaagctgtgctcggtttgtgctactggcccagatcccacatctgccaagtgtgagccaaaagcagagtggcaaaggggtgtgaaggtgagtgaatgtggggtccagtcactgagcacagccaggcacactggctgctacaagagggcaggcagctccaggtgccagtataggaggaaggtccatgtaagcctgtggttggaccagatgcaggcacctgcatctggatgaggggaatatggtggcttgtggaagcttggagatgccaggaactgcagaaccccaaggagggtgtcacagccctggtttggggagcccttagatctgggttccataaagggccacagctcttctctccttcctgttgtctgcattgtggtgtcggggatggggtgcctgtttccgtcctgtttgtgttacagctcttcttttagtcctgcccaaccagcaggtcctgagtttttttcctacatctaggaagaatgaggtacatagacaaatggagggtgagcaaggcagagaggagtttcactgagtggcagaacagttctcaggagacccaaagtgtgtagctcctttcctcaggcaggtagtcccaggtccagcttgtcagtggagaggagatccacagtgggtggctcccttctgcaggaaggtcatctcattgtctgtgaagccctcgtggagaggagacccagggtgggtagctcctatctgcaggcaagttgttatgtcatttgctggagtctggctgagtctgggggttttaatgggcctcataggggaggaagtacatgctgattggtccatgggcagccaggggcaggcccaaaagcagcaccctaaattctcattctgatctgccgaactgacagctgggcccccaggctattactataaagctaccaatgtcattattcatagaactagaaaatactattccaaacttaagtggcagtgaaaaagagcccaaatagtcaaagcaatcttaagccaaagaacaaagctgaagccatcacactacctgcattcaaattatactacaagtctacagtaaccaaaacaacatgctactggtagaaaaacaaacccatatactaatggaatatattggagaacacataaataaagccacacatctgcagccatctgatcattgacaaagtacacaaaaataggcaatgaggaaaaactccctattaaatcagctggctagccatacatagaagaatgaaactggattcctagttttcatcatataaaaaaaagtaacccggctgggtgtggtggctcacgcctgtaatcccagcactttgagaggccaaggagggcggatcacgaggtcaggagatggagaccgtcctggctaacacagtgaaaccccgtctctactaaaaatacaaaaaattagccaggcgtggtggcaggtgcctgtagttccagctacttgggaggctgagtcaggagaatggcatgaacccaggaggcagaactggcagtgagtcgagattgtgccactgcactctagcctgggcaacagagtgagactctgtgtcaaaaataaataaataaataaatattaaaaaaaataaattaacccaagatacattaaatacttaaactaaaaactaaaactataattcctagaagaaaacctaggaaagttttatttttatttttttttgtcaaaatgatgaattagagactttggtgcgcctcagccacttgaaaatagcaaaataaatcataaaaatgaactctgtgaactttaagaagaaaaacgggaatccaatggaattatgaagaataccccagatcctggagaggaaaacaccagcaaacagctcccacgatggtgtccagttgataaaaagaaagaaagaacaaagaaaatatcccacctgcatgaaaaagttacagaaattaaaaatcctagtgtctccagataagaaaacatcagtgcaagaattctggcatcatgaaaatctgaatgtagtgataccaccaaaggattccactagattttaagcaatggtccctaaccaaaatggaaactcagaaatgacagataaataatataaaacatggattgcaaaaaaattcaataagatccaaaacaaacttgaaaattaacacacaaaaaaattctaaagcaattcaggaattaaagaaaaagataaacgtcttaaaaagtaatcaattacagcttctggaatcaaaaaaactcttgaaaaatgttaaaatatatcaaaagctttattaatagactggatctatcagataaaagaatttaagagcttgaagataagccttctgaagtaacccagtcagacaaaaataaagaaaaaagaattttttaaaatgtacaatgtcttcaagaaataaaggattatgtaaaacaatcaaacctattaattattggcatttctgagagagaaagagaaaaagaaaacaacctggaaattacatttgagggaaaaattcaagaaaatttccctgatcttgccagaaaggtagacatccagaaacaagaaatcaagagaacatctgtgagatactatataaaatgacttcactagggcatacagccacgtgactgtccaacatcaatacttaagaaaatttttttttttagcagtaagctcaaaatagcgaatttcattgtttttttaaattattattattatactttaagttctgggatacatgtgcagaacatgcaggtttgttacataggtatacatgtgccatggtggtttgctgcactcatccacccgcgatctacattaggtatatctcctaatgttatccctcccctagctccccactccctgacaggccctggtgtgtgatgttcccctccctgtgtccatgtgttatcattgttcaactcctacttaaaggcagatagagaaaaaggaaagatcacctacaaaggtaaccccatcaggctgaagcagacttctgatcagaagacttacaagccaggggagcctggggatctattttcagcatgcttaaagaaagcaaattccaaccaagaatttcatattccatcaaattaagcatcttaagcaaatgagaagtaaaatattttcctgacaagcacgtactaagaatatttgttaccactagaaagccttcaaagaaatcctaaagtagttctaaacatgggaaccaagaaccatatctgctaccacaaaaacatacttaagtacatagcccacagaccctataaagcaacaacaaaatagaaactacaaagttaccagctaacaacttaatgatagaatcaaaatttcacatatcaatattaacctggtacataaatggcctaaatgccacccttaaaaggcacagagtggcaagttggattaaaaacaaaacaaaaccaagatccatatggctgctgtctccaagagacccaccttatatgtaatgatacatgaagtaaagtaatgatgctcaaagtaaagagatggagtaagatctactatgcaaacagaaaaggaaaagaacagggattactattctcatatcagataaaacagagattaaactaacaacactaaaaacaaaaaagaagaaagaaagaaaggaactacataatgataaagggttcaattcaaaaagaagatttaactatctagaacataaacacaccccacattgtagagtctagattcacaaaaccagtactctagacctatacaaagacttagccacacaataacagtgagggagatcaagaccccactgacagcattaaacagattgtcaaggcagaaaactaacaaagaaattctggacttaaactcaacacttgagcaactggatccaatatgcatctacagaatactccacccatgcaccacagaatatacattcttctcaactgcacagggaatatactccaagatttaccacacgctgagtcataaagcaagtctcagcaaatgaaaaaaaaaaaagaaatcacagcacccatattcttggaccccagtggaatgaaaatagaaagcaataccaataatatttctcaaaaccccatgattacatggaaattaaacagcttgctcctgagtgacttttaagtaaacaacaatatcaagccagaaacataaaaaattatttgaaataaatcaaaacagaaacacaacataaaaaatctctgggatgttgcaaaatcagtgttaagaagaacatttatagtgataaatgcctacctcaaaaagttagaaagatctcaaattaatgatctaacattatactagaggaagtagataaacaagaacaaactaatcccaaagctagaaggaaaataagacaactctaattagagttgaaccaaatgaaattgagacccaaaattccacacaaaggataaatgaaaccatagtttcatagttggttctttgacaggataaacaagatcaatagactgttagttagattaataaagagaagaaaagaaaaattcaagtaggcacaatcagaaatgacaaaagtggtgtaatgtcacagccgatcacacagaaatacaaaactccctcatagacaactatgaacatttctatgcacacatactagaaaatctagaggaaatggaaaaattcctggaaacacacaacctctcaagattgaatcgggaagaaattgaaacactgatgaaaccaatattgagttcaaaaagtgaatcagtaataagaaacctaacaaccaaaaaacagtaataataagccccagtccagatagattaacagctgagttctaccagaggtccaaagaagagctgatagtaattctattaaaactattccaaaaaatcaaggaggggtgattcctaactgattctatgaagccagcatcacctaatatctaaaccgggcaaagacacatacacacacacacacacacacacacacacacagagacagacacacacacacacacaatgaaactactggcccatgcctctgaagaacacagacacaaaaattctcaacaaaatacttacacgtcaaattcaacaacacatcaaatatttaatttacgatgatcaggtagggttaattcctgagattcaaggttgtttcatcatatttcaacatatacaaatcagtaaatgtgatccgatcacatgaacacaatttaaactaaaaccatatgatcacctcgagagacgcggaaaaagctttcaacataattcaacatcccttcatggtaaaatccctcaagaaactaggcatcagaggtacatatctcaaaataataaaagctatctacaacaaacccatagccagcatcatattgaatgatcagaactgcaagcattcctcttggaagtggatcaagacagagagatcttgtctcaccactcctattcaggacaacactggaagtgctagccagatgttaaactttttttttcatatatttgctggaggcaagaggaagaaacaaaagcatccaaatagcaaaaaaaaaagaaaaaaaaatcagactatctgccttcactggtgatatgattttatacctagaaaaccctaaagactctctcaataagttattagaactgatcaacaattttagcaaggtactaggatacaatcaatgaacaaaaatctgtaggagttctatacaccaataactaagagccaaatcaagaacacaattcaatttacaacagccacaaaagaagtaaaatacctaggcataaatctaaccaaggaggtaaaagatctctgcaggaagaactacaaaacactgctaaaaaaaaaaaaaagggaacccttgacaaaaataagcactgtggaaaggactccctattcaataaatggagcttggatagctggtgagctatatgcagaagaatgaaactggatacctaccttttactacatacaaaaattaactcaagatggcttaaatattttaatgtaagaactaaaactataagaatcctagaagaaaacctaggaaacactattctggacatcacctttggcaaaggatttatgattaagtcctcgaaagcaattgcaacaaaaatgatcattgataagttggacctaattaaactaaagagcttctgcacagcaaaagaaaccatcgacagagtgaacagataacctacagaacaggagagaatattcccaaaatacgcatccaacaaatgtcttatattcacaatctacaagtagcttaaagaattaaacaagcaaaaacaaaaaattccatcaaaaaatgagtaaaagacattaataggcacttctcaacagaaagggatacaagtagccaagaaatatatgaaaaaaatgcttaatatcactaatcatcagagaaatgcaagtcaaaaccactatgagatacctactcacaccagtcagggtggctattatttaaaagtaaaacaacaacagatgatgggaggctgcagagaaaatagaatacttatatactcttggtgggaatgtagattagttcagccacagtggaaatcagtttggagatttctcaaagaactaaaaatagaactaccatctgacccagcaatgccacccaaaagaaaataaattgactgaaaagacacaggcacttgtatgctcacagcagtactcttcatgatagcaaggacatggaatcaacctaggtgcccatcggtggtggagcatataaagaaaatgtggcacatatacactacggaatactacatagccctaaaaaaggaaattgtgtccttcttagcaacctggatacagctggaggccatcatcctaattgaattaacacagaaatagaacaacaaatattacatattctcacttataagtgagaactaaatggtgcatacatgtagacataaacttgggaacaaaagacactggggagtactagagggggctggctgagagggagcgtagcaaggctggaaaaaccaactgttgggtgctgtgctaactaccttggtgacaggattaattgtaccccaaacatcagcatcatgtgacatacccatataataaacgtgtacatgtaccctttgaatctaaataaaaacggaaaaataaagaatggcaaaattaaaagaaaaacaaacaatacattttgctaaatgaaataagtcagacacaaaaggacacatgctatatgattccacttatataaggtagctataacagtcaaattaatagagacagaaagttacatggtgggtgccaggagctgtgggctggtgtttggggagttagtgtttactgagtacggagtttcagtttgggaggatgagaaagttctggaaacagacggtgatgatgttgcacaaaaatgtgaatgtacttaatgccaaagatggttataatggtaagtatcgtgttccatatttttattacaactacaataataaaagatatgtaggaatttgccagatgaacaagatgaaaaagggcattgccatgaaataaacataatgaatctgaaaaaaataaaagcatctttgattgcaaaagagcaaattgcaaatatccaaagtaatccttgtaatacacgtgacattataaattttacgatgcagtgcctatgattcacgcacactgtacctgaaccagctgtgaaacattcatgaatcataaactcctgtatcatcttcagagcaaaaatgcatcctattttacaagaaatattcatcaaaaaagggaaagagaagtaaaaaccctgaaatttctagaacctttcaaagatatcagaaaaacaaatcaatacctctgacaggacctgttaattcagagggtcatgctgtaagacagcttgcatttaattcaaactgttttggaacaagatcaattctgtagtgagatcaaggcagcagaaatttttcctcagggctaaaaataataattccttgaggcccagacattaaattccatggcttcttgaaactattcaaaaatgagaagaatggataaagattaaaagaaaacacatgctgcaagctgacaaaacacctttttagacttacacccaattcgttcattagtcaaatgtgtggttttttttttcccttcaggtaactggaggtgtcaacattcaacttcttggtctgtttctcgtcattttctattttctcctgctatttgtctctgagctgttatacctgttattgcagtttccaacaagaaaaagccaggaaaaggaaagagaatcaaagcatcagagcgagtcacctcactgggaggtggaaccagaagttttaaagcagtagcaaaatttgtatgttctgggtgtcagtggacactttctgtataataattttattttacttttgttaagaatcatgaagcaaccacaaaaaattaaatcaaggcttatcaagtagatgtttgaaagagaaacaatgattcaccttataggtagatgtactttgctattgaagggattgtgggcaagtctaagcaaagctgaagggaataaggaaatttcattccttagagaagacagcatagaataatagtacagagagtgtagggtagaacagcttgcattctaatcccacatctgcaacaggattctctttgacataggaaaagttacttctgctttgttgggagtattaaaaatggagaagttttcaagtgcttagtgtagttcctggcttatgatagcatcaattaaaattaggtattgatgctattattattaatattgatctcttagccatctatatcttcagcatccaaagtgtcagtttgttctttaaattgcaattgacccttttttctcaatagaatagctagtaaaataataaagtggaatttcttggaatgtatccattctcctcttttacatttcatttttttattcattatttcaaatgcccagtaccttcttgttcaccctaaaatcttttatgagtttatgagttaacaggaaaacagattccttttagaaaattggaataaaaagaattaccattttttttttttttttgagaccgaatctcgctctgtggcccaggctggtgtgcagtggcatgatctcagctcactgcaagctccgcctcccaggtgcaactgattctcctgcctttgcctcccaagtatctgggattacaagcatgcaccaacacacccaggtaatttttgtatttttagtagagacagggattcaccatattggccagatgggtctgaaactcctgacctaaggtaatccaacccctcagcctctcaaacacttttttctacatttcaaactctttgcaatttacctgctatctcatttaatctcctcttccctacactgaagacaatcaacctccctcctattaaccaaccacttatcctgcctccttatgtaccttaaatacgaaagataagatagtccccattattttaataaatatttattgaatatattcttgacaagtaatcctgcttgtatttttagctagctaatgtgagatacatctttgacatggttaaatgtatgatcccttaattaatttaatataataaactaatgctacattataggggtataaacacttttaaaaatatattttctattttaaagttggctttatacttaacataaatataatggacactttgtttatttttgaatgattatcaatcattcaaaggtcagtacatctgacctttcacaaaaaaagtaaaaggtcaaatgtaaaaattgtaggttttgtggttcacatatagactctgcatattattctttaatttttgtttttggttccatatttttgtttgtttatatgtttcttacaaaccttttaaaatacaaaaaatattctatcttacttgtctctcaaaacataggccatttaacccaggaactgtatttggtcaatctgtgcttcactgtaaatgttctttgttattttaaaagcaatacggacatatttcaagtaaattattgttttcactaccactcattttcagatgtaagtccacaggttaacataaataagaaagtagcagccaaaaacaaaaaaaagagagaacagtaagaaaaacattttaagtcaaaggaaaattgccagcttttatcttctcctaaatcccaatccttcactcctaaaggaacacattaagtgcaaagggggtcatacttttattccattgcaaaaagggtcatacttttattccattccccatgtatacatttgttatccatttggcaaattgtggttgaatttctcttgggatgacctcgccagcagtaggtgaatggatcatttgattcaacactagttcgtaagtgattgttcttttcaatcaggcacacactcactgctgataactgcatattttgactatttgtagaagtgttaaaggaactaagaattttatcgtaaataagccatgttggaacaaatatcaaggccttgagaataatatactttatacctttgctcaacatataatgtaggaaaatatccaattaagagtctagaaatggagtgaggaagggccagctgagtattttgtttaatttttaattgttaactcttatagtaccttcataaagtttccaaatcttttcctttttcttgcttttgctgtaaatacaaaagtccaagcctgcattatattatactcagtttgaataaggaatatcagctccttaagaataaaatgaaacagttttattcttcccaagatcttttcaggcttttatattgatcatcttcatttctgctgtgtagctggcttcatcaatgatgtctcaatttatgtctataattgttattttgcaaaactgtctcattttaattaatatgatgccttactcattatttttaaattattttcttcattattttaaaactaattttatttctaaggactgggaacagggtgggtggatgtgataatctcacacatgttcttgtcttttttccttttattttccctctggtgctgggatagagaggatgaagaaagaaaaatgtattcgttagatgaattatctgtattgaggttgttctaggattactgtgctagaggaaggacccccaataaattccaccattaagaggctcaatatcaagcaacaatcctgtgatctagtggcactgtatggaattctaacgtatcttttagctaatgtccaggtggtagtctgtgttacatcttgatatgcatacctctcttcttcacatgcttcagtatcctttattttatttataattagaagcacaaactctgagatttacggatccaggcaggactgatctcacctacaatactgggcaagatcttcaaggggacagttgatgctttcttgccaactgcccactccaccaccacatttctctccaatgttctctcccttgttttagttgtactgactcaaatctaagcagctatttgattagagtattgaatggtgatcttccctgttttgtgtgaatttctttgggattttcttctctcaatccttgccagactttttttgtaataacactggactagcaacaatttcaacctcacctatttataaaataatgttatctagtactatttgagacctctcttacttggattttttggagtattgtactcagaatcaggaactttttgagataaaatctgagaaatgaataacttttgctcaattgtgctttattcaggttcttatctgtattctattctataatctccaagtgaggaaaatagtcaattcatatttctctaaagtgtttcttcataagagccttaaaataaattgtatatattttaaacattagtacatttaccccaatataacatcacaaaattaacctttggaaaatacagaactaatgtaatacaaaacattcccatccctccaaaaacagataaaataaaatataatagttctctacagcctaatctaaaagaatgtgatgtaatggatagagcactgatttattaatcaaagggagaaaaactaatgtggctcataaacctttccatttctgagtctcattcttttcattttcccgataataatgataataagatcgacctgtttgttagggtcaggttaatgaccaagtgaaatgatgcgttatacatatgtcaaagaaatatagcctcttaaaagaaagttaacgcagctgacattcagtaacatatctcggtttgtaagtaaaaaattagaaataaactcaaataaacgatcaatacatattatagtaaaaagtaataatttgaattaagataacttgttgaacactgatttatcaaactctattgaactaacccattttttaaatttatacttttgtttgtttgttattagaaaaacatttccctagatagaagctgctccactattctgaagggaagtagaaacgatgaaaagcagaactggagatgatccatgatggacatatagtgtgagtaagaaatatatattatttgttttaaatcactgagattttgagtttgtgtatgtgtccataatatgagctaactatccttaatgataccataagtaaagaatttaaagtaaataagatgtgcctgaccgcatattaagtgccacactaagtgttaattatagctccctggcggtaaacaggggactggttccagacttctgagtatataaaaaatccacacatactgaagtcccacagtgggtcttatggaaccctttgtatacaaaaggttggctctccaaataggcaggatttatattatatctctcaaaaaatctgcatataaatggatctgtgcatttcaaacttgggttgtgcaagggtcaactgtgttactattttatgggatgagacggcagagatgatacatggaaattttgtgtttaaaaaaggagaaatatgcaaatggtggtggggtgggccaaatggaatgtgagttacatgaaagggtaatttggaaggaaacaacgcttttgtgaagaaaagaaatacttgaatatttgagtataaaacatagttttatttagtacccttgcctcatctttagtatgataaaaatagataaaaaattcagacagacaaagagggaggaagctgcttgagtgaacatactctgttgatgtaaatactcgaggaaattagctctatattgggtggtgtgctgatgaatgcttaacaaaaaaactttgaagtgaaaggcactgatttgttgtatttgatgatttctgtggcataaatatgcccaccatagcaatgtttagctggtaacatgacatagctgcacagagtcaggaagagatgcacatgactggctctcacgatttcggcgcggtctggctccagcatttgactgtgacaagtttcactggccggtgagaacgctggaggaaaaaaatctacctataactgacccttattagcataacaggtttgagaaagcagagccctattttcctcaagtgaatgccatcaatacagccgtcaggcaaaactgcattcatgcactgaggaaaatcactgcttctcaaacaacttttggataccataaaaggcccgttcttaaaaggggaagtgggaggaggggaaacaagaattgttgcctgaaaagaaacgactttgatctccatcaaaacagattagtttgaagccaatttgctgctatcttcaaaactatatttcccctcaaattctgtcttccaaattgagcagtgcgtcagctgtaggtagtgctagagtgtgaaaaggatgaggatggaggcagccagggtacctccaatgcatcttgttattagaagacttttgaagagtaatttgacgggagcttttcaacttttaggtcactagtttaaatgtagtctcagttgatcatgaacaaaagtgggtggttagtggcctatgaaaagtaccttcatggtattacccttgttctttctaatagagactgccactacagttggcatcctttcttttccttctaccagaagcacaaagggtgaatagaaatgtcatttcaagtattttttcagcctttgtaccagagaaatttgaaatatgaaaaaggccaacttcttttcatctttaactcacaggtagaattattgaactataatatgtttcctagatcttcctggattttattaaaatgaaacctgagccactttacaagtaaaattatgtcttacttcatagaaagttaaattacataaaggcacatacttgacaaatatttaaatataaaatgtataatttcttgacctgaatcttacacatgtaaaatttattttgttttccttttctttctcttatttttttcttgcttcaataaatgagttcccatgaatgtaaagacaaagatcttattactccattaaatgaactatcttaatatttgattttttctattctttatcattacaatactttgacttttttttcctcctaaagagactgtaggttttattccctttcttttaattatttcatgaaaatcctccaaatttccatattactaatatctctaccttcatataattttgtttcaatattaaatgatcaattaaagcaaactttctctaagtacctggagaaaagcaacagaataaatattagagtagagacacaaagtagtacttggtaatgccaagaaaatttcagcagctatcagtaatcagtaggatataacagaaatagccctgttttagaagtgatgaaaactcaatcaactgattttaagcagcagttactttctatggggttagctttccacatctcaaaaataagattgatgtgttatttttgcatcattttcaatacaaacattctatgaaatcttcacttttatatcatccgaatttaagtgacagggtgttaatattcgaatgggatttaagcgagatgtagctgtgccttatgtcacgtcagctgatggtaaagattgatgctgggattttcctgggttagtcatgttaaaatctcccctaggctttaaggccagcttcatgaattctcatatcagcaacttctgcaattaccacataacaccagaagataaactctgttctctgaacattcatatagaaaatagtacgtcatcttatgattcttatgattggcatagcaaagtgaaaatatatcaacaccgtatttagcccaacttgaagctgcatattcagtcaaagatagagcttttcctggccaaagatactttggtcagaaatatataaacagtgaacaccaagctatcatcttgcaagtaacacatatgctcatgaatctctagctacaaataaaaatatcagctaaaactacccccttcttctaaaggaataaaaaccacagcaattacaagatttgcctatggccataaaatgaagtggggtttgtctcagaattagaatgcctaccatcagcctttgagtacaaagttaattcccctacacaagactgcatcaaaaataaatccagctggacaaaaggcatacaagacagaaaataatagtcagctgcagactctttggatccaaagtataaaatattcaagtatgtgtttccaatcccttcattctctcctgtaatgattgcagctaatccctgcctgccaaacgttagttcttcaattgtggcgatcaatagaatagattagctgtggaaaccctccatccatattacccttgctttcctttccagatggaattttcattcactagagtggaggcaagcatgtgaggtttctccctccatacacaaatataaactcattaaatgccaagcttgtcactttagaatttatacacacacacacacacacacaccaaggaacatacctgtagatttaataaaacagcaccaaccctcatggcttcactaatttcaaggctatacatcagctgtgggaagcgaggagggctttgattatttggtggaagcacttcaatatacacagtgcagatggagttcctgcagagaaagagaggaaaagaagatggttacgaatctgcatcacatttaatgttagactgcattgtttattcagttgttgggtttacaggagaaaaaatttccaaattttatgaaaaataatacaatcaaaatgaaaggatagaaaaaactaccaccaaagtataatggttttatgaaattatcttagtaaaagtaattgactccagtatctgtttttcctacttagattaatagtatgaattaaaatggaatagctatacaaataaagctaataaattaacttgccttgacttctgactttgtttttaatgcttctctaatagcaaaatcattctataaacatctggtaataaaagctgtccttggggcttttttgctgttaaaccagcagagggagtattgattacaataactcacaaaacaaattatgggctgcgttttatcagttctgttgctgacatcaatggcttaatgtaagtgcatgtgaggagtcaggatcataaagaatcctacgtaaaatagttgcaaacaaaactaaatacgttttaaaatcttctctaaaaagcaatatatgataagctaggaattagatttaataaagcccttataatgacaggagcttttcttgaaggacaagataccttatcattacaaggaaaaaaaattagcattgacatagtcaacttctttgatatctctgaactttgaatttgttttataaaacaaaaactgaagaagcatgttagtcaaggtttgtaaggtggaaacattagctgaaatatatcaatgagatctgaaaatacataaggttagccctctatcgtgaaaaaacatatatatgtatacatacacacacacacacacacatatatacacatatatacacacacatatacacacacacatacatataacattttgtacaaacataccaccactgcctaagatgtatgctttgaatttaacaaagtcatgatttagttcaaaacacatttgttataatttctatttggggatgagaatctttatttatttatttatttatttatttgagacggagagttgctctccagcccaggctggagtgcagtggcatgatctttgctcattgcaacccccacctcccgggttcaagtgattctcctgcctcagcctcccaagtagctgggattacaggcctgtgtcaaaatatctggctaatttttgtattttcagtggagatgggttgtgccatgttggccaggctggtctcgaactcctgacctcaggtgatccaccctcctcaacctcccaaagtgctgggataacaggtatgagcaccacacctggcctagaatctccttaaagtagtcccaaactctttataagatgcttcaattaaaagacatggtcaccaaaaatatttgtctgagtttattaactacaacattctacttttcaaaaccttttgaaagaaattcaggctgggcacggtggctcacacctgtaatcccagcactttgggaggccgaggcaggtggatcatgcggtcaggagatcgagaccatcctggctaacatggtgaaagccggtctctactaaaaatacaaaaaattagcttggcgtggttgcgggcgcctggggtcccagctacttgggaggctgaggcaggagaatggtgtgaacccaggaggccgagcttgcagtgagccaagattgcgccactgcactccagcctgggcaacagagcaagactccgtctcaaaaaaagaaaaaaaaaaaaaagaaattcagatcataggcactaaaatttcgttttatagcttgtcactttataatatacctaaattcaagttgtttctgagcatatcatcagtagatagataccaatagaatagtaagcataaaagctacagtgacttttaaaaatttcatggttgggtgcggtggctcatgcctgtaatcttagcacttttggaggccaaggtgagcgatcacaaggtcaggagttcaagaccagcatgaccaacatggagaaaccccatctcgactaaaaaacacaaaaattagccaggcatggtggcctgtaatcccagctactcaggagtctgaggcagaagggagaattgcttgaacccgggagacggaggttgtagtgacccgagatcgtgccattgcactccagcctgggtgacagggcgagactctgtctcaaaaaaaaaaaaaaatttcatgcttacatttatcatgatattgttctaaagtaatctcactttaaattaaaatattttaaactttcatagttaaaatatctgtattcatttctgcctctgattttatctatttagtatcaaaatttgccaatacagttaatcagattatatttcttaaatgggttcaaactgatgatgaaatgttgcttatatacttataattattaatgtaaacatgaaacaatgggaagttacaaaatgtattgtatactgcaaagattcccacttccgtgttgtgagaacaaaagaatcgtcattctgaggtagacctaacatccttccaggtggtgatctgactccagaagcagccccaagatgtaaaacattttccctgatattacccttgaagatcttggcttcttttagggtctgttgttgatcaagtttttaaaacattttatgaatctccttcttttctctgatagcacattctctatgcataacaagtcctacaacgttattggtaataaaagtaggtgagtgatgttgaacacagaatttgtaaccagatattcctgagttagaattttgacgctgccctcaatgatctagagcaaattatttctttcagcttcattatttccacataataagtgggaataataataacatctaaggtcagcataaagatgaaataagtttatatatttgtatatgtaagtacatgtatacatatatatgaaacatacttttataacttattttaataaattactcaaaataaggcttaaggtttcttattccactctatgaatagtgcaaacgatcttgcattttccttagctacatcctttataatactgtagatattttaattgaatcctttcacttggctaaattcctacaaaggcttgatactccttcacccctcctgagcatggggtatgttggtgttagaatttgagcatgttgtatcataatctttagggtaggatacaagaatctacaattttcacaaatttccaaagttctacttatagaaactagactttgaagaccactgcttcagaatctcatgaaaagtacaatatgtagactcacctgttttttttaaattacctcaggagaaaaactctacaaagtcacttaacgtcttcaataaccctggatccaagagacttcctcactgtttaacatttttttttttttgacctggaacatatctgtactgcagattcgaagctttctttcaaaagctaggccctttctgcttcgatattctttagatcttcagtttactggtcaagaatactttataaaggttttacaagaatatcagtgtcttaaagcttgtgaaagtatagttaaactacacttattatactttttgtatttctttattcctttccctttcattatcttcccattgtagagggttaaagtgagacaatgctacaataaggaccttaaactcgtatgagttacttggatacttgtcacagagtcgaaaactttaaaatgctgaaacaaagaggactctagtctcagacaaaacacagagacaaattttagcccaacatgaccgtctccttgatccgtccttactcctttgcttcctctgttcctttccacaataattcaaaagctagaattgctaattgtgttcccccacccccttggtcttgaatgttagttatttggaggagatcatatattaaggtcttgtatttttcatcttcaacatcctggcatgtccctataatgtgtttaaataaccaccaggcttcttgagggttactgccttttaaaatgctatctcctttttatccctgatgtcagcacagtgtcagagttagcttttctaaaattaaatacccatagtattaacaataaaataatagtatttatgctgtaataaatagtagtatttcaacagcatcatttaagcacttaataaaatagggcagtcactatataaataacactttacgcaagcattttgtattcatattttatcgctaaatgcataaaactgagcatctatataagaaaaattttatttttgtaatatagccagtatgatgcagataaatctccatttctaaaaacgaatctcataaagctttattatatttcacctggtaataaaggtcaaagtagcacaaaagaggtaatatatttcttatatactcttgaaacctacccaatagttccataaatataaatacatatatacttttttttgataaacatagaaattgacccttctggtcttaaagcttgaaacttaacatttgttttatctgagctccttcctcaggaaacaaccttcaggcctcccaaaaaaggtatcaaagaactgaaactcaccagatcaccacatccgatgagatgccagacccgtcattcattatgattgcttcctagcccctccctagttcctgttttcttacatattgttacatttcttccctgctatgtaaacactaactgtagtcagtcagtgagttggatttgagattgtcaccaatttccttagctgcagcaccagattaaaatcttcttctttgacaattgttgttcagtgattggctttttgtatgaccagctgcagaatctaaactgaacccctggtgttcctgtgacagattttcgttacctgaccaagaacacattgcttgtgtcttggctgccttgagccaagagtcttagaaggcctcctaagcagttgctcacccaattttcactggaggtgttttggtttttttctggccccacagcagctacccccaactacattcctgattgtctagtcagaacagcatttgaaatttgacatctgcacccggataggtgagtgtcaggttctttgtgggcctggacagcatgatcccctcctctcagtttgagaattttttaaagaaatttttatttgtcagttgaacaagcccaaatgactgaaagtgggaagcatcctgtgttagtatggacactttttgggggtttcagtatgaacactcttgggggcttgtttgtaattgtgaggtgtgtgtgtgtgtgagcaagtgtgtatcttttgtgggactagacagtgggattggctcctctcaatttgagaaattcctaaggaatttttctttgtgggttggtcaagcccaaccagtagaaagaagaagcaccccgactgtttcagtttggatgctcttagggctcgtttattgtttcagcagtaggattgtgttggcgattgtgtgtgtttgatatagtcatagcaaagtagaattcagtaagctaatattttctgaaacactgtttggctccaatattctttggaatctggagtttgctattgaatgggaaagcatgacagagttccatgtatccagacttttgtgctactgctctaaccatggtcaggcctggtcagtatgtgatgttctcttgtgatgctgtttggttccagtgttctttggagtctggggaggtttagcctttaaaaagcaaattgccatgaaaactattctacccaaaattttgattcacagccttcaatggattacctactgaggtcaagaaagtgtggctatgtaaaccagtgagtttctattgctatatcatggctataattttgaggtaaaatagattggatctttatgtgtgtttatatgcgtcttaatggtttatgtatgttcatgtattacgtttttttttgtctaccaaattggtttataaataaaagaatacacataagtaagcccaaagtatttttcaagttcaaatgagttaagtcaaccacaataagcaagctggctttaacatttttgataaaataaaaataaaaatgcctttagaattgtcagcatacatttttgctgagttttatatatgtctctgctagatatgattgaggtgtcatggtttggcatagaaggttatagaactataaacccagctaacataaaatgatcttggtttgtgtaccttctttgacaaatgagactaatgtaatgttgttagttgattcttgtgagttaatggcaaaaatacccatatctttaattttaagatttagttgaggacctgacattcatcagctattaaaaaaaaaagtaatgaacaaggaaaaagctaactttaaatgatggtgtctaatatttcagttttcagaagaaatctggataaactattaaaatgaaataatcaagtacttgtaaattgaataaatgttgtaggtacactttttgtgtaatataaaatttttaaattgtttttggtgctcattgggtgtctgggtcatttccaattaagaaaaagttatggggaaacatatttctaaaaattgtggaatggttctcatctgtaaaatgctaatatctgatagtcagctcagaatttcttgcttctcagatgttcactaaagttttgttcactaaaatttaaggctactaagaattctaaagaagatgtgtttttattgagaaaacgaatctgtttgtctagttcagaagttatctaaaggctaattaaaattatgggcttgaaatggttagttatgaaacaaggcagaagaaaaccaataagtagaagaaagagatgtgtaaaaagttatagatacgaaaatatattttaggaaggtgataatgaaaaaaataacaatttttataagaaaagattttgtatggtgaatgtttgtccaaaattaaaataactggttattaaaaaaagaacagaaagaaaatctaagacaaaacaaaagtccaagcatgtcatggatggtctgtgtaagtcatatgccatttttcctgtttctctgtgtgtctatcttcatgcctgtacaaagaaaatacaaagttgaaaaagcttagataataaaatatcctttaaaacttgataaaataggaatgctttggctaattagcattgttcatagttaaagctcatatcttaatgaatgtaaaatataaattattgtaaagaaatacattagcagtttggcaattttttaaatatagttaagcccaaagctggatgtaacatggagccaaatttcatagtatatttgctattctgcatcacatacctaaagtgaatttcttagttacagaaaatgtatagtggtactgctggacttaaagacagtaaatatcaaaaaactgaatcaggaataaaatatccatcaggttaattttttttggctctgggtaacactgtaaagccaaagttaattgagtagaagataaattgagggttggactactgtttatttctgcttttttttttttcttgagacagggtcttgctctgttgccaggatggagtgcagtggagtgatctcagctcactgcaacccctgcctcccgggttcaagtgattccccttcctcagcctcagtcctcagctgggactacaggtgctgccacctcacctggctaattttttgtattttagtagagatggggcttcaccatgttggtcatgatggtctcaatctcctgacctcgtgatccactctccgttgtcaccaggctggagtacagtggcacaatcttggctcactgcaacctccacctcccaggttcaagcaattcccctgcctcagcctcagtcctcagctgggactacaggcatgtgccacaacacctggctaattttttgtattttagtagagattgagtttcaccatgttggccatgatagtctcaatctcctgaactcgtgatcccctctcctctgcctccccaactgttgggattacaggcatgagccaccatgcctgacctatttttgcttctaattttcatttatttgctatttgttctacttaaatatacaaatatatacacatacacatatttatatgtatacatatacacataggtatacatatatgtatatatatttgtatacatatatataatatataaaactattgatgctttttagtttctaatggaaagcttttatttggttctatgaatagtcattttgttttctatgtatttccaacaattcaccatttgttctgtttattgaaagttcctaaactacctttgtcaagcttcaaaacattgatgaaggacagcagccatttaaatttgattggtttttcttacctctgagtatattgatagctatgataattttaaggttcttggcaaaaatcttataaaagacttatttttatgagttctaaacacaaatagtacattatatattttgtaatttggaaaagtagatgagaatagaagtgtttaaatgatgtttatttccaatgtaattcaattcaatcaataatttcagttggttcagatcctttcctttagtgaagaaaaactgtgatatgggttaaaagttttaatgttcaggaaagactgggctgtttttttaagaaaaattttattgattgggatttctctgaaactactttcattgtgtttaccactattaacattaagtgacactcaattgaattaggtagtaattgctttaaaaattgtgacactttgttgtaatttttgatccaaatccatttatctctgatgggcattcatgtggtacttgaaaacaaaatatgcacaagtgttgcactggtttgaagagtttggtgtgaaagttacttaatcagttgtaagtactgtatctagaagtaaatcttagaaatgtgtgatgatgctcttttaagtagctgaagagagattattatgtggttttcactttgtccttgctttgttgtatagtatttaagtgaaatgagattgcttatccttattctgaatttccaaagctgatatttgcatttgccatttttcaataatggaaaaaaaaacaacattagttgtcttgctttcaaaagtttgtcaaaggacctatcaaaactttgatgcttttggtcacagttctgtcactaaaatgctagcaattagacatatggaatgagtaacctaactactttaacaccgtggtcagaagtgctataagtagtatctgctaagctccaagccactgtgttttaatttgtgacattttagaataataggctttctgtagtataaatatcctattaactaatccttgtgctgttaagttacaggtctttgaatcctcagtctgaagaaagcactgacttctgttaaattttgagcattgataccagtcaaagcctcatcttcagacacaggagaaggtgacaatcaaaatgaactgctttcatgagacacagggccagaaattaaaactattcaatccctctagacccaggaactattgtggaaactgtaggtgtgtgagatggtgagggacaattttgagggacaaactcagttcagagtttctgtaaattaaacgttaatgtcaaaagcacaatgatgcaaggtcagtgtctgggcctatgtgtcagaataacagggttttcttggtgcattgatctgctctttaatagataatcgtaaaaggctataagaactttgtcaaactgattaaaattagatagatttgtttataaggttttattaaaattagatttaacattaataatataccatacaaagatacaattttgttttctcttttgaacaaaaatttcatgtaagaggaaactgcagggaaaaaaaggagaggggagagacagaataagttggcctcatgctatcttaagtattaggtcttattgcttaagaaacagagtctcctctctatcaaaaggtaaatgtttttgttttattattttggctaaataaatgaatattttatagtgacctgtgatcctattttgtgatatcgagtgtcttaaacctttgatactcgacagaatttccaacagcaaaatttcaagttctaaattcagtctttgtgaactcaaaccaacctttttggatattagttgccctgaagttcaagagagacatgtaaggcttattaggcttagttgttatgttagaattatgcaggagatattgtcaaatctgaggtggtgctaagtttcctttgggtgatatttatatggatgggttgttaaaatgtgtttgaggattatatgagattcctgtaattctgatatgtcttaatataagttgtcagtaataattatgattattatgttacattgttgtatgccacagaaataaccaaatttctttatctactgtgcctttaactatgactctcttaagacttttgtcatctacaattattgttttgctttgatccttctcaaaaagtgacttataatcagctacagtctagggattgcttctttggtgttcgtgaaaagaacttttcaatgcaggttactgataactttggagattgtgccattaggttagagaggaaaattccagggcactaattgaaaggctgatgtgttcataaagattgttaacccaacatgaagcagagcaataattgattgcatggactaaactaatgaaggactgaaataatttttgtggcttttatctttggaatattgctgatttttttgttttgtttttcagagtctggataattttttagatctacttataagctttaagttatgctttaagtatattaagtagagtatacttttgtaaacagaacttgaggcatattttttctctgcctattttctccggaattatattcttaattcatgtgtgttagtttgcatacatttaatgacaacttgttttcttgtataatgggacacaattggaggaagtggttattttcttagggctttgaactgaaatgggcttgggaaaggttccagaaaagccagtgtaggtcctatataaacaatgaaccttgttgcactttgggtggttaatcaggctaagtatatgggcctgaagcttcttttgcaagtagatttgtcctgctatgacttgcctttgttggaagttggggggctgaagagaaaatgctgtgtttcagaagaaaatgatactattagattagcctttgatttctgggtggccgtgaaatcacctgtagtatgacgctgcccacgatgcccctcctcagtattaagcagccagaaagactgacaaccagtttccccatgattgaaaattgataaatagaaaggggggactgaaaccgaccaaacagtcccatagatcactttttcgataaacatagaaattgacccttctggtcttaaagcttgaaacttttgtgaattgttttctgttttatgtgagttccttcctcagaaaaccacttgcagcctctcaaaaaagtattaaagaaatgaaacgcaccagatcaccatattcagataatgagatgctagacccctcattcatcatgattgctttcttgcccctccctagttcttgtttttttacacattgttacatttttttccctgctatatattcccataattttagttggtcgggaggatggacttgagactgatctcccatcgcctcagcggcagcacccaattaaagccttcttccttgcctataattgctgtgtcagtgattggctttctgcatggttagcagcaggacctagaccgaaaccttggtgttttcgtaataatcttataattgaaaaagatccttaaaacaatgtaatttaagtctcattttacaaaagaggattttaaaaatggaaaagatttgctgactgaatcaagattataacattaattagcaacagcagataaactaaaatacaaggcttctgaattcaaaatctgctttccatttctccctacgtcctacaagaacaaatatgtaaaataaactggagaatttttacttatctatgtgtgaatataaaacatttttggtttgtaataaaggatgttaccttacaggaagccataaattatttcaagtctgaggttcagactatgaagtcacaattttaaattattaatactgtgaatcaaacttcatctataacacttattgtaagaataacataaaatatgaataaagaagagggttggaaaatagacttaagatactttaagtttgggaatgatataattataaaaagacaactttttcatatgacaatagtaattagtagtaatgagataatgttgctagcttatagaggattgtattatcttattattattttctattatatatgtcaatatgtgctacaaggagtctatttgtaattctgcatttctagcttatttctaagatgaaggttacagatatttatattgctttttctggtagatttcagacagattaattactgtttttgttttcctttgtcttctaccaatattgtgctagaaaagctatgtttacagtttgatgttcacagattgtattctattatttttgaaatacatatagaaatctacaagagcaaaaacttcacattgaaaaccaatataggaggacagagaaaacttttctggagaagttacagggcagagttttaagatagaagatgtatttatatataaataccacagaacattaatagacagaggaaaactcacatgtcaatttacagaagattaaagaaaagaaatgtatgttttgtggaactaaagagaagggtgtaagtaaagcagtagtaagagttaaggtacagaggtgggactcatgggctatatctgttgatataaacttcatcttgacaatgaggctcagctggtaaagtttaagcagattagtgattataaccaaaagtgccaagtcattcacagttctttaacacactactttgttttgtttcttttgatcttcttgtttcctctgctgggatattccattatcattcttgcccaggtaaaactgcacttgtatttatctactgctatctgtctagatttacctgtgcctgcatctgaatcccatgtgggcagagatctcattttacttgttttatatttctagtacctccccaagagactaatatttgtgggaacttagacaatttttataaaaataaatgaataaataaatagcctcatcattttttactaatgataaacttagcatgtacatttgtcactagtaaaatgatcttttaaagagaaaattgtattttaaaaagaatgtataatcacaatgggaaaataattgtatttcaaagtaaattatttcatctcatattaattaaacatagccttgcattttatgaaaagaatgggaatttaaaacgtatgttagcccatgcatcagtcatttttatcgtaattttattagaagctatttggggagagagagtgtctcttattatctaattatcaaacagtagtgctttattcatgttaggatgaagtaaatatttacttaatttaattggataacgtaagtataagttaaccaatatacacgactaaagaatatcccaaaataacttaagtgttttttaaaagcttttggtttttatttcttctgtatgcttatcaaagtctcaaaaaaaagtaaaacaaaacactaaactatgtactattccttctctcactctctgaatctttagctggtttactaaattagaataacacagacatacgtatttcattcatattggacttattttcagtcaatattactacatttatggatgaaagctgtcaattttaaaataataatatagaaaactgtctaaattctgaagcctgctgtcattttttgatgttattatttagttagcttacatgccatggttgctggctgggtcgatctgtaaaaaaaatcactatatatatagtgtgtgtatacatatatatatagtgtatatatatagtgtatatatatataatgtatatatatagtgtatatatatataatgtatatatatagtgtatatatatataatgtatatatatagtgtatatataatgtgtatatatacaaatatataatatatatatttgttcataatctttaaatataatcttccttataaaagaagtctgaaagcaaagcctcataacttttcagttcattcatcaattcaatttgaaggattaactcctctccagaaaatagcaaatatgattatcctacagtgaacatgacattatctcagcaggtagaatggaagtatatggattttattctctgcaggtcccacttgatatttcaccaaacattctaaggtgagtttttagtatccaagacattatttaatgaaaataaatgtgaagctaggtcaactaaatttctgatgtcacagaaaagacgtgtatactcagaatctgaagatggcactttgttttctggcgtggaatacaattttacttaagtaaaaaacatttattgtattgataattatagacaatatattatccaggaaaatcaatgatatgtcttacaaatagaaactgagcaaaaagaggaatataagatctcattcattaaataatcaataaagtgatttaaaacacttcaaatgtaatatattggccacatatagatcagaccagatttatttagcacaacacaatcttcaatgaaaaatatgtatatataataccaacttgtggttggttttattttaatattcaagactaataaattaaaagtcttgaatattaaaagactttaataaaatcaaaataaaaaaacaaaaggtgactttgttcttataaatagcattattatcattgctactaaacaattatagttttcctccacaacagtaactacaaagattatagatatgaaacagtggaggaaaaagctttaaatctaacaactctgagttcaagttatggtcctactacttgtttactaggggagtggaagtgggaaaggggactgctgagccaagtcaattatcctatttcagcctcagatttctggtgtgcaaaactaaattatgcaaaagtcatgatgctattgttaatattagaaattatatatataaaggagctagcaaggtatctggtcctagtgtatgctcaataagtattatcaatcatctttaattcctcttcagaataacctagcacagatgaagctattatttaaaacgcactcaaaccttacttggctcttattgtagattctgtaactactcaatgtataaaagtattctatatatttcttctaagaaggagcccttagctgtttatcaggttcaggcatacagagtcctccctcagcatccatgtgggattggttccagagcccataaggatactaaaatctgcagataatcaaggccctgatagaaaatgagacagtatttgtatataatctatgcatattgtctcatacactttaaatcatctcgagattacttgtaatacatataaaatattaatgctaatagttgttatactgtagtttagagaataatgacaaaaaaagtctgcgcatgttcagtacagatgtaatgttctccccaaatattttcaattgttgcacttagttgaatctactgatgtggaagccgtggatatggagggccaagtgtatatttgctttttggatatattaagtttggccacatccaactaaatgtgtccaaaattaaattgatgtcctcacccaagccatgtgcacccctattgacatcaacatgacgtcaccttaagcaaaaccctgggaaatattttatcttatttttgacaaatctatttctctattcttcctaacatacccagttcaaaacattagcagtatttcctgtagactcttgtgcctctgctcccctaaaatctgcctcccacagagacaatcagatggattttacaaaaacatgttttctcacttgactttctaatttaaaagtctttccaagaattcctcctattgactagataagtctaagtttcttataaaagaaaattaaattttctgtggcatggccttttaattttccagccccaccttgaatcagtttatgccccagtaacactgactaataattatctataaacaagaagctatttcagacctttgaggctgtgcaaatagggtcacatacttctttttcatttggtcaacctcatcctcttattgtgggatgacttcttggtactccttcattatcgtaagttccccatcaataaccccagaaagcccagaatttaccttaatctcaaaattgctatgctaaactcaatttaatttatattctttatatactttactgtattttgggggctttcaaatgatggtactgtagttatctttgttttccagaatgtagtaaatggtagtatgtaataaatggtttgttgggctgaaaggaaacttttcctatcacagacacctgaaggaaatgaggccattgagaaatctgagaaaagatccatccaggctgagagaagatgaaaatcaagctcaaaagcatataggtagctatgatcctcagagatagagaggagactggtgccacaactggaatggactaagaaaagcagagttgagtaggagatgaaatgtataaactgttgacatgagggagtgtcctacctgtagtgatagctgacaaatttcactgagcccttttgaatttattttaatgatttgccttttactcagagtgaggtgtgaaagcactggaaagcttgagtaatggattgagatgttttccatgttaccaggatcacccaggctattgtgttgagaagagattgaagagagcacaggaagacttgtaattggaagaagttttcaacactctagactagagattgcagtggcttggactggaatgctaataaccaaagtggcagcagttgttgctttctgaatacatttttagagtagaacacagaggagttgctccaggttatgtgtggagttggggaggaagaggggcattgaggatgactctaagggtgtttggtcagagtgactgcaagatgggagacgccttaaacctcttattggatataaagtcaccaataagtttgacaggagtactgttgaaatgaatgtcaggcatgtaggaagtaaactcttccaagtgtgacttccagtatgtagatgacaataggatatgaggttagaaagaagaaaatttattgggaagagacctatcatctgtcgatgacagcaaggaggggtaatgggcgttataattattttttgacacgagattcaaaggaaaacaaactattgaggaggaggaaatctagtttaaaaatgtaaatgagaatctaatactccaccaaccgtatctctgtgattaatgatgatcacacaccctgcaaagtttagttacagtccatcaagtttcctacacctggtgtagtattgagttatctgacaagtttgatctcgtaagattcttgagacttccttttttttttgaactaatattagtaaactgtatcttttagaagaatcatccatttctgttttcaaattttgcatacatttaagcaaagttgtctctgaatcctactttttttctatttatatgtagtttcttcattagattttattgtatacagttttacttgttctttttttcttgattaggttagatagtattttatccaattaattatgtctttatttttgttgtttctttccagagaaccaaattcagtctcatttatttgttttatatatgtttataatacattcatgtctgatattatagttattaattattttgggggatttcttgtgtttttatttgtttcttttatgaagtattatgacaactatacataatcttgataggatttctcaaaaagaaaagtacagactaattttattaaataaaataacagcaagcatataatatcagcttatttcaagagaaaaaaattatgtcctaatagaatctacaccatggatgcaaaatagatccatctaagccatggatgcaaaataggagctatagtaagatcagtcattatatcatcaactcaagaagaaaagtcattactgtcctcatatatggtagctatttatttgatctgagaaaagcaccattactattttaaaaagtcaataaaatagaaatagatgagtatttttttaacatattaatagtttttaaaaccatagaccaatctaatggggaaacactgaggcagtctcattcaagtcacaaacgagacaagcatttttattggaagtataataggaaatgaaagtaaagaaagaaaatggaggccaggcgtcgtggctgatgccagtaatcccagcactttgggaggctgaagtgggaggatcagtagaggccaagagcttgagacgagcctgggcaacatagcaaaattctgattctacaaatttgtttttaattagctaggattggtggcctgaacctgtagtccccactactagtgaggctgaggtgggcagattgcatgagcccagagtttgaggcttccattagccgggattgtgccgctacactctagactgggagacagagttagacctgggctagggggaaaaaatgtaaaagaaaaaaagcctatttacaataaaaacaaaagatgtagaaatagatcaagtaagaaatgtacagaacttacataaaaagaaaaacaaaaagcctgctaaaaaacacaaaaaaatgcatggacaaatgcaaatgcaaaatgttcttggatagaaagattcaacatcaaacatatataatatattcctaagtaattaatatataaatctcttgtgttcctaataaaaacacagttaacaacaaaaacactgaactagcttatttaaagtcaaagagaaaacttaacagaaggagagggaacattttggagggaaaacagcattgaggtaagttagtagcaccagaggatagagcatactatgtaagcttaatcattaaaattgtgtggtaataggttataaaatataaataatagaattgaatagaacatttagatcaaaatcaaaacacataagaaaatatatgatataataaatgcaacatctcaaatttgttcatcattggatgaatatcacaatgtattgtgtggggaccacagagtatttgactggaaagaactatggctgcattaatacctcctactgtgtactaagatacatctcaaatacaataaagatttaaatatacaatatgaatccacataaacactagtagaaaacgtagaataactgtaatctgggcttaacataccaatataaaaaactgatatacttgcacatattcaaactgatgcatgttgagtgttaaatatttctccattgtcaataaaagaggataaatcgaaaagtttatcaataatagacttcttctacagttttatacttattaaggaatatgtttatcaataatagacttcttccatagttttatacttattaaggaatattacataactgtgaaaaaaataatctgaaggatttatctagtatctacatggagaggactccaggatacattcattgtgaatggaaaaaaaccccagcaaagtgaaggaatatattaatatttattcatattttcttggaatgatactgaaaatctggaaataaacaataaattaacaaaagggatttctcaggtgggagactagaaagatgcaattgtaatagcaggaaatcttttagcttgctgtgtgtgtgtgtgtgtgtgtctgtgtgcgagtctgtgtgtgtatacacatatttaaatacatgtattattttacataactattttaattacctatacactcagaagtgactttgaaaccctgagacattacatgccactgacacatctgttaatttctttgaagaaaagagcctttctctgtctgcagccttacttttccataataaatttgaaatatgcctctgatattgtcctcttcccaaaatttaaccaaatcagaatatgcatgcagttcctgagaatctggtctctctgattttctgatctaatttagatgtttataggataaaagaatacttgccgcgcttcttaaatttaattacagggttaaacgggcccgatgaaaagactgcattggttctaatataaattaccttcgctctgcaggaggagcattatccgctgcttggaccgtgagtgcgtaagtccgcccgactatcatttccacccctggagcgatggtgataagccctgttgttttattgatgatgaagtctccctgagccccaacaaggatttcatatgtgatctccccatttgacccttcgtctgcgtcgactgcagtgagctggaattgaaaatcacaacataaatcctcttgggtctcaacttttcaccaccatgtcgttttttcccccaacaaaagaagcttgctttcaaagaaaaaaacacaggaaagtttccttgacatatatactgttttttgttttttgtttttttaactgaggctactgtgtcctgttacaatactaaagcaatcacaaaaataagagtgattttgttttttgtgagagtgattaagaaataaactttggatcttgaaggcttatctttattttaatttaataaagggaaaaagaggaaagccctaacagaaaatctaatatccctataggaaatttatttttcctgtcttgccttgcattcttgacacataaactcatattaaaacagactgaacctggaaaaaatgaaataggcatagtcggcctttgttactcccaaccttccttttactctcatttttccttccataatgttctcctccctgtctcccagacactctcatctttgtgtcctttttgtttacaattgctctaggaaaggttattaacttgcacaccctgatttataaaggactgataagtcgtagagtattaatgtgtcaacaatcaaacaaatgcatctcccattgtagaatatcaagggtaacatagcccaagaaatgtttctttggggaaagaaaatctattcggagcccttgaaattaagcatgtaaacatctgtatagccaatttacatatatctataatcattttgaaggaactggtatctaaaagactttatttgggatattatatgaaaagataacaatgattaacttcatcaagcaacattaaagcaacagtgatttattatattaaaagtggctccttgacttgctgataaatataaattaaaggggaaaaagaatataaagggattctagcagaaatcttatagtaagcattttacatacatcaatagtattttctgtattcatcatacaaaaagtgaagaatgaaagaaagtggtctcaatttacacatgagggaatataattaaaagttttctgtggaataaagaaaacacatgtaattgtagtaaattaacctacctgtagaaatgttttatttacttatatttatattttcaatacattacttctaaaaatagtagtttttatagtttgcagactcctttgaaaatacagtaaagatgctggtataccttccttgatcaaatgtaaacatacacatttaccttgaaacttgaattcaatttcagaaacatcatattaactaatttcccattcaaaagttcatgtttaatatcctcaataaatgtaaacaaagtactttatacactgtactgtgctgaaggggttatattatgcatattctattttttattatatgtcatgcttagagtgataatgtccatagacatagcagcaaaaaataattgagaatgaaaaaggaaatgacattaatgcaactaagtcctgagactggctatttgggggtggacagatgtggttgctggaaggaaaggcattttatgacatgattctgcgacttgtataagcctgacagacatattcctaaaggcaaaggagaaacatttgcagaaacagtcaaaatgaatggcatatatttatagagagctattcaagccagacaaactaattctgttttgtgtatggataaaattagaaaattagaggatggggataacagaggagatatcaattttgattatacttaaatcacttaaaatgtctcaggaaatcttaattaaaatttagcacaaattggattcaatattaacattcttcctgggacttaaattggctaaaggaatgtaatgataaatggcaatgcatcaagttaagaaaaggtgttaaggagtgtgcttcagggatgtcagcattatagctggtcttatttaacattttcataaatgatgttggaagggaggataagctggatgataattacattgaagaaggtacccacctgggagatgctagaaataccaaatagtactgcaaaacacaggagacagaaacacccactaaattgcagagatagtcaaccacagttgagctaaggtattcagggaacacaattagctctgcagaaattattaggaggtagaaagcttaacaagtacacaaaataaggattctatgtttaagttacctagataacactatttttcagtcttttactactaaataataaaataatgggttatgagtcaatataatttgtttgcatgtatgctaacaaagatattttaaggaaattaatcgtagtccaccgtcagaaaaataagctgagacactgattctgaatacccaaatcataatagtgtcttccatgtaagatcccgaaaactcaagacctttttttttttaaacctcaacattagcaggagaattgcttgaacctgagaggcagaggttgcagtgacctgagatcatgccactgcactccagcctggcaacagagtgagactcttaaaaaaaaaaaaaaaaaaaatccaaaacctcaacgacattacacagtagatgtccccttctgaagtctattagatgatgttgaatggagttgtagttgctaattttggagctaacctatggcaagaatttaattcaattatagttcaatgactctgtgaccagtagatagtgtctatgagatggaaatatatgaagctcatttctaatttagcagggaaatctgcttcctaaatgaaaagggcatttatttacatggggaggccaatattttgcttacaagtttcagatgaaagtaaaaacaatactataactttaaagtgtttattgaaacattgtgatatctaaaaggtaagaaattgtgagctatttgttttttttatttcttttcgatgatgttttatagttctattcaggaactttagccctaccctttcataattccttcctctcagtgtttcaacatgtgcatattccaaatgtccccatctgtattagtctgttttcatgctgcttataaagacatacctgagactgggtaatttacaaagggaaggtttattggaatgccacgtggaattccacgtgggtagggaagcctcataatcatggcagaaggtgaaaggtgcatcttatgtggcggcagacaagagaagagagcttgtgcagggaagctcccctttttaaaaccatcagatctcatgagacttgctcactatcacaagaacagcacaggaaagacttgccccaatgattcaattacctcccactgggtcctcccacaacacgtgggaattcaagatgagatctgagtgggaatacatccaaaccatatcattccaaccctggcccctcccaaatctaatgttctcacatttcaaaaccaatcatgctttctcaacagtcttccaaagtcttaactcatttcagcattaactcaaaagtccacagtcaaaagtcccttccacctacgagcctgtcaaatcaaaagcaagttagttacttcctacatacaatggagatacaggcattgggtaaatacagcctttccaaatgggaggaactggccaaaacaaaggggctacaggccccaagcaagtccgaaatccagtggggcagtcaaatattaaagctccaaaatgatctcttttgacttcatgtctcacatccaggtcatgctgatgtaagaggtgggtttccatgctcataggcagctctgtccctttggctttgcaggggacagcctcccccccaactttgtttatgggctggcattgagtgtctgtagcttttgcaggtgcatagtacaagctgtaggtggatctaccattctgggctctggaggacagtggcactcttctcacagctccactggtcagtgccccagtagggactctgtgtgagggctctgactctgcatttcccttctgcactgccctagcagaggttctccaggagggccctgcccctcagcaaacttttgtctgggcaaccaggtgtttccatacatcctctgaaatctaggcagaggttcccaaacctcaattcttgacttctgtgcacctgcaggctcaacaccatgtggaaactgctgaggcttggagcttgaaacctctgaagccacagcctgagctctatgttggaccctttcagccatggctggagtggctgggacacaggacaccaagtccctaggctgcacacagaacagggaccctgggcctgcccatgaaacaattttttcctcataggcctctgggcctgtgatgagagaggctgctgtgaagacctctgacatgccctggagatattttccccattgtcttggggattaacattcagcttcttgttacttatgcaaatttttgcaggtggctttaacttctccttagaaaatgggattttcttttatattgtgttgtcaggctgcaaattttccaaacttttatgttctgtttccattataaaactgaatgcacttaacagcacccaagacacctcatgaatgttttgctgctaagaaatttattccgccaggtatcccaaatcatctctctcaagttcaaagttccacaaatctctagagcaggggcaaaatgccaccagtgtctttgctaaaacataacaagattcacctttgctccagttcccaagaagttcctcatctccctctgagaccacctcaggctggactttattgtccacatcactatcagcattttggacaaagccatttgacaagtctctaggaagttccaaattttcccacatcttcctgtctttttctaacactccagactgctccaacctctgcctgttactcagttctaaaattgcttccacattttcaggtatgttttcagcatcaccccactctactggtatcaatttactgtattagttaattttcacattgctgatatagacatacccgagactgggcaatttacaaaagaaaacaggtattgaaattacagttctatatggcggggaggtctcacaatcatggcagaaggtggtagcagataagagaggagagcttgcgcagggaaacttccatttttaaagctatcagattgtgggagacttattcactatcatgagaacagcaagggaaaatcttgcccccatgattcaattacctcccaccagatccctcccacaatacttgggaattcaaaatgagatttgggtggggacatagccaaaccatatcaccatcaatcacccatgtgaccacaaaataatctaagttgctcctaatgtttccttttaaattttggctgcagtttactactctctttaattgctctttcctggttctgataaaaaaaatacagcttgatataaaaggacaaatataaagatgattgaattgtgcataagctgaacaaaaacattcaaattggagtctcaaaaatgacacagaaagccacagttgatataaaccatatgcaagaatataaattgtaatgcaagagtgtaaacacggtattttatatgaataaatatattttttattagaagtgaattatgggccggaagctgtggctcacgcttgtaattccagcactttgggaggctgaggtgggcagatcacgaggtcaggagtttgaaatcatcctggctaacacggtgaaaccccatctctactaaaaatacaaaaatattagccaggcgtggtggcgagcacatgtagtcccagtgtttttgggaggctgaggcaggagaatggcatgaacccaggatgtgaagcttgcagtgagccgagattgtgccactgcactccagcctgggtgacagagtgagagtctgtctcaaaaaaaaaaaaaaagtgaattatggcttaattgataatgcatgaatgtgttgatcatttgatgtttttgcctcttgggcatccttggctcttgcttccagtaaaagtcccttattttcctttggggagcaattggcaaaaaaacatgtcaagttattcaagttggtatagtcaaggtgactcctagaactactgtaaaagagtgtttttttcttcctctagggctaaactggtaaatttatatctggtgtttctgctggctttccagtcttcattggatgtacctaagactgagacccatacagaagaagacatgtcaagaaataagcagaaaatatcgctcatgacatggtttctgcttatgcctgaaaccaaattcaccactttctgatagattaaaaattacatattttaaatgctaatttattttgaaattatgtctttcaaccgtaagaaccctaaatatataaaatagttttgatgcttaactactcttcttggtttgctttttgattatttttctaggattattgtgcttcgagattttggtttgagataccatgtaatcattaatacaataatgtaatatataattattcattacaataggcaaagatattgcttgaaagtggtagaattgtccctgtatagaaataatattgaattactcaataagtaaaaaaatacagataaattagctggtaaatatttccatcaagagaggacagactcgatttcagggaaatatttaaatgagtattgctttgttttttcttcttcataatttcatggatagaggattcattcttacatagatatgagcaacctcagcatacaatttttttcattattaagatgagaactttcacattttaacttaaaggaagcactttcatagcttctctttgatatatatgaattgccagaatcactactcctgtgctttgggaccattgttatgtaaaataagggtaccaccacaggtaatctaataacagagatagcttctaagtgactcatgggcagggagcatagatgtcctggagatgctggacaaaaggatgattcatgccccccccaacaagctggggacagagtaggacacctcaagatttcatcacactactgaaaatggcacaaaatttaaaactttggaattgttgatttctagaattttccatttaatgttctcagaatatagttgaccaaaagtaatagaaaccatggaaagcaaaactgaggacaagggaagaatactgtaaaaataaacatgaactgagagatttacctcacagcatatgtaaaattaactcaaaatgcatcacagacctaaaggtgaaagctacactatgaatactaggagaagataatataggagaaaatctttgtgaatttggttggcaaattttcttaaatatgacagtaaaagtatgatacaataaaaaataaacttcctaaaaattaaaagctttttctctaccaaaaacataagaacatgatacataaaatacagattatgtatttgcaaaatatttgcagatcatatatctgataaaggacttgtatttataatttatagagaatacttaccagtcagtactaagaaaacaaacacaaattttttaaatgagtgaaagatttgaatagatatttcaccaaagaagatcaataaatggctaataagcacatggaagtatctcaaattaatttgtcattaagggaacacaaaatcacaatgagatactaataagcatctgtataatggctttaacaaatgaactgacaatactatcagagaggatgtagtgggtggtaaaatggtacaagccactgttattaaaaagcagtttgacagtttatttaaaaagtatatatttaccatgtaatctagcacttttcgtaagatatctatatataacaaacagaaaaataaacatatatgtgtatatatatgtgtgtgtatatatatttacatttccaaaaagtgacttatatagaatattcacagtcacattaaactggaaacaactgaaatgcccatcaactggtaaacagataagcagaatgtgttttcacaagatggattctattaagtaactcaaagaaacagatatatagcattgattcatgccacagcatagatgagctacataaacattatgctatttaaaaagccaggtaaaataaaagtaaaagatacatactatgggactccatattttttaattcctagacaaggaaaacttttagaggcagaaaccaaaacagggggtgtctacagctgaaaatgggagtgagcattgactacaagtggtcatgagtaaagttttggggtgatggaaattttgggggtgaaagaaatgtatagaactagattgtggtcattgttgcacaactgtctaaatttactaaaaccagcccaactctttcatggaactgatgtttactggtctttgaataaacacagaaattgaccccccacccccaccccaccataccctgtcttgaagcttgaaacttacatttgtctcatgggagtttcttcctcaggacactaaccctcaaccctcctagaaaccaaggaactgaaactcaccagataactgtatccagaaaatgagatgccagacctctcatccatggattatgattccagtttaccaattcctcttccttaccctaccctaatatttgtttttgcacaagtattttttccctgctatataaacccctaattttaatcatttggggagatggatttgagactttatctcccattctcctcagctgcagcacctgattaaagttttcttctctggcaatatttgttgtctcactgattggcattttgtgaagcaagcagcaggacctagatgaaacccttgatgttttggtaatatacatacatgaggacatgtaaattataccttaataaagttatcgaaaataacaaagataattccacccacacatctgacctttttaatgatatttatccatttttttctgctacattatagaatgcccttcaggctacttgttcatgtattgtttcatcatttgagtaactttcttccttcttcctgccttcttatgcacctcacaaagtttagatcttgattatttgtttctttctttctcttttaaaccactgtatgttcctctgccttcagagactttactatcaactccatgaactccatgctacctttgtaaaactacttcttcctcctatgaatggacaggtatgaaagctctggcaagcaaagaaaagccagacccatggaagaaaagcagaatgtaatcagctaatccaactatgaaaggctgtctgtgttgagaaaagtaatcagtagaagagaaggtgaaattgtggaatatagaatggagagcacacaaacaaagatttcaagataagataccttcatattttcctctgagagaacattttatagcaagagtataatcttcttagcagctcccttcagatgtggtaatgattaatggccaatgctggagaattgcacagatttggcagaaatcaaggtacaagatatacttgagaactctactgggatcatttggggttaatgtctccttatgacatgccagaatatgagataggattgtatcacttgggcctttttcgttggttatatttatcctaattttacatttgaagccttgagttaaattctaactttgaccttatctgatatgcagtggctggcagccatagcttatacatgtatagatatgtataaaaatgacatcacttaaggcattcttcggtggtttcctagtatgacagagtcgatttttcttttttgcctcaccagatgtgtttaagtgtgggatgaaatataaacaaacgtttatggaatcagtattgtaaacaagaaggtgaacagtaaagttatatggtgaccccatatcctgatgatttgttcctagaaattctcaagggcaattataaggatccttttgcacactcaggttgaacttcacctagaagtagaatatgcctaatctacaagcttctgggagaaacaatacttctgtatgcacacaatatacttgaatcgtattcatatcatatatacttagaggaaatgtatcagtctattttcacactgctataaggaactaactcagactgggtaatttatgaagaaacgagttttaattgactcacagttccacaggcttaacaggaagcatgactgggaggcctcaggaaacttacaatcattacagaaggcaaaggagaaggaagcaccttgttcacatggcagcaggagagagagagagagcgagaggagaagtgccatatacttttaaaccatcagctctcatgagaagtcactcactatcatgagaatagcatgggagaaatttgcctccataatccaattaccttccactaggcccctactccaatactaaggttcacaactcaaggtgagatttgggtggggacacagagccaaaccaaaccgaggaacaatccttgagtcaccttaatcaacactggacataaagaactaagagggatttgaagttcaataaattagtttactgaatcaagtagagatggcttttaggcaaacatattaacctaaataagcagagtagggaacattctttttcaataacttggcattactcaggaatgattacagagtaatcaatgattactgaaataacaattataataaattctgatgtatttaaatggttctagttggctatactagaagatcaagtcaggagggacatatctctgggaactacggacaatctaaactataccaagatgtcatttgtaagtatgggcattatcaatcttctattacagtcatatttctatgaactaggaaacaaacatcttcttcatggtacctttggcgaagtttggacagactaagaatcaatgcattgctttattaaagaaaagtgactggtgtgctgcattcatatgcagaagctttcgctagtgaaagtttattcctaggggatggtttatagttatgctatcagaccagatgcagaattgtcggagaaagagtatctaatgactactctggtaatgtaaaatgtatgatatgtaggaaaagtctattttttgctaggaaagttgagaaaataatttggaaatattaaagtgtattgtgttaaatatttcatctctctgcctcagctctatcgtgtgataagggatttttaaattcatttatgtagttagataaaaataaaatctgagtgcatactgatctctaggacagaaagattatttggatgggcaacataaaacttacaactaggtaatccttatgtagaaggatttgccagagaaagaattgaatttacgtgtgtaaactaatatacccagttgaatgtatcaacacttataaaaaggcagaagtaatagaggataagggggaaaaattgtctttcaaatgttaaagaaatatcagaacagttaagtgaatctatctatggttgttaatttgctttgtagagggaattccaacttcttagtgtatgaaatatgctctggtgatagccagtgttttaacatctatttttaatgcactagatattatagaagttagtgtaacaaaaattttaagaagattcctcagaaatgtgtagcaagtgggtaacacataatgagtgcagatgacttagaagtcataagatattatatctaaagttacaagacttctactatgctattgccatagaagctatattgttgcctgcctggtatccttaattaaagctaaatcaacttggagctgtgtaaggtctactgggtctctccaggttggcattcagtctgaacctaaggctgctgctcattaaactatcactggaaattcactattcagtgtgatttctgatggaaaaatgatataatgggtttgcttttatgtttgttgatttcttcatgtgtcaataacattcaggaagttcttcaataactcctgctggccaagcaaattggggattgcaaatgtatttattttcagatttattctctgtggccttaatgtgaacaagtgatgctttaaagccaaaaagcataacaggctcccagttttcccccttctcttacgcatatcctagaataatccaagatgatgggcacctcagtagggtaggtggctggcaaatttatcactttggttgtataatttggaaaaagatattgataacattaataataacatgatcattaaatacttatatgaataattgtcaccgaagatgaatctcccatctatgcatttttcttcccaaaaaaaggcaagaaataaaacaacaagaagatgactttaaagcatttcttttcacagcctgactatttaaagggcttgtttcttttctgcagcaacttcatgatccttttgtaaaggttcattggttctaattactcaaactctgagactggaaactggaaccttaagtgctctaatgctatcaaattctctcatgcccaacttacactctcaaaaaaagatttcctcaaagttggcttccattaatttccatctcattagctttaacccatcgatttaaggacccagtctttcatacttcttcaagaaatctcacgttgtatacaatgccaaatctaaactactctacatgcaaggtagccatcttaaattaatttataaataattggatccatttattcagaccttaatttgtaccaaatgtctgactccgaaaaatgaagagtggaaaagaaacagaaacaataacttctgtcaaacagaaggtgctctaggaaaggagatgagagagaaacctatctttaaatgaaatgctgttacagaaacataaaaatactttacaaaagtacagaaaagcctgtcatgacaaaggggctgggagaataaaccaacatatatttgacttagtaaaagaaaagcaaatctttgagcattcagttcctcttctctccaatgccagttaaatttgtatctttaatgcctcatgaaattactatgcctttggccgtatcatttcatcttcaacatcatattatcttcacttgcctatctgagtactctaacagatcatcatccccactcacttttgatgaattctcgttagtgctcttagtctttctcatcaaatttaacaactcaataattgtgatgttttctgattatttcactgtgaagaaggattatttcttgcaaaatatagtcaactccttgaggattagggctgtgccttactcgttctacgtatttttcagagcacttagtttagtacgaatcacctaaaaatctgtgtagattaaattataatctagccaagaaagtaatacaacatgtagcatacatatattaggacttgcacaatagtgcttttgtttgtttgtttgtttcctttgccaaactggatgagcaagtttactagggttttaagaaatccctactgctctatttaaatgtttgttttttcccctaagatctcctgtatttgaaatatctcaatacccaactatttttattttactcagatgactatgcttggacattataactgtcaggcctctgagcccaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctcgctcatcctggctcaaaaagcacctccactgagcaccttgcgaaccccactcctgcccgccagagaacaaaccccctttgactgtaattttcctttacctatccaaatcctataaaacggcctcacccttatctcccttcgctgactctcttttcggactcagcccgcctgcacctgggtgaaataaacagccatgttgctcacacaaagcctgtttgatggtctcttcacatggacgcgcatgaaatttggtgccgtgactcggatcgggggacctcccttgggagatcaatcccctgtcctcctgttctttgctccctgagaaagatccacctatgacctcaggtcctcagaccgaccagcccaaggaacatctcaccaatttcaaatcaggtaagcggcctcttcttactctcttctccaacctctctcactgtccctcaaccactttctcctttccactcttcaatctctcccttctcttaatttcaattcctttcattttctgggagagacaaaggagacacattttatccgtggacccaaaactccggcgccggtcacggacagggaaggcagccttcccttggtgtttaatcattgcagggacgcctgattatacacccacgtttcaagggtgtcagaccacacagggacgcctgccttggtccttcacccttagcggcaagtcctgcttttctggggaaggggcaagtacctcaaccccttctctccttgtctctaacccttctctgcttttctgggagaggggcaagtacccctcaacccctcctctttcacccttagcagcaagtcccgcttttctacagggcaagaacccccaatctcttatttccgcaccccaacctcttatctctgcgccccaatcccttatttccgcaccccaacctcgtatctctgtgccccaatcccttatttccatgccccaaccccttatttccgtgccccgaccccttatttctgtgccccatcccttatttctgtgccccgacctcttatctctgtgccccaaccccttttcccacttttctggaaggtaagaacccccgaaccccttccctctgtttccctactctctcttttctctaggcttgcttccttgactataggcaaccttccaccctccattcctccttctactcccttggcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaagatctaaataattcttgtcgtaaaataggcaaacggtctgaggtgcctgacgtccaggcattcttttacacatcagtcccttcctagtctctgtgcccaatgcaactcgtcccaaatcttccttctttccctcccgcctgtcccctcagtaccaaccccaagcatcgctgagtctttctaatcttccttttctacagacccatctgacctctcccttcctccccaggctgctcctcgccaggccgagctaggtcccaattcttcctcagcctctgctcctccaccctataatctttttatcgcctcccctcctcacacctggtcgggcttacagtttcgttccgtgactagccctcccccacctgcccagcaatttactcttaaaaaggtggctggagccaaaggcatagtcaaggttaatgctcctttttctttatcccaaatcagatagcgtttaggctctttttcatcaaatataaaaatccagcccagttcatgacgtgtttggcagcaaccctgagacactttacagccctagaccctaaaaggtcaaaaggccgtcttattctcaaaatacattttattacccaatctgctcctgacattaaataaaactccaaaaattaaattccggccctcaaaccccacaacaggatttaattaacctcgccttcaaggtgtacaataatagaaaaatgttgcaattccttgcctccactgtgagacaaaccccagccacatctccagcacaaaagaacttccaaatgcctgaaccgcagcggccaggcgttcctccagaacctcctcccacaggagcttgctacacatgcaggaaatctggccactgggccaaggaatgcctgcagcccgggattcctcctaagccgcgtcccatctgtgtgggaccccactgaaaatcggactgttcaactcacctggcagccactcccagagcccctggaactctggcccaaggctgactgactccttcccagatcttctcggcttagcggctgaagactgacactgcttgatcgcctcggaagccccctagacaatcacggacgccgagcttcgggtaactctcacagtggaaggtaagcccgtccccttcttaatcaatacggaggctacccactccacattaccttcttttcaagggcctgtttcccttgcctccataactgttgtgggtattgacggccaggcttctaaacctctgaaaactccccaactctgttgccaacttagaccatactcttttaagcactcctttttagttatccccacctgcccagttcccttattaggctgtgacactttaactaaattatctgcttccctgactattcctggactacagctatatctcattgccgcccttcttcccaatccaaagcctcctttgcatactcctcttgtatccccccaccttaacctacaagtataagatacctctactccctccttggcgaccaatcatgcaccccttaccatctcattaaaacctaatcacccttaccccactcaacgccgacatcccatcccgcagcacgctttaaaaagattaaagcctgttatcacttgcctgctacagcatggccttttaaagcctataaactctccttacaattcccccatttcacctgtcctaaaaccagataagccttacaagttagttcagaatctgcgccttatcaaccaaattgttttgcctatccaccccgtgctgccaaacccatatactctcctatcctcagtacctgcctctataacccattattctgttctagatctcaaacatgctttctttactattcctttgcacccttaatcccagcctctcttcgctttcacttggactgaccctgacacccatcaagctcagcaaattacctaggctgtactgccacaaagcttcacaggcagcccccattacttcaatcaagcccaaatttcttcctcatctgttacctatctcagcataattctcataaaaacacacgtgctctccctgccaatcgtgtccgactgatctctcaaaccacagcaacttctacaaaacaacaactcctttctttcctaggcatggttagtgtggtcagaattcttacacaagagccaggaccacaccctgtagcctttctgcccaaacaacttgaccttactgttttagtctagccctcatgtctgcgtgcagtggctgccactgcattaatacttttagaggccctcaaaatcacaaactatgctcaactcactctctacagttctcataacttccaaaacctattttcttcctcatacctgatgcatatactttctgcttcccagctccttcagctatactcactctttgttgagtctcccacaattaccgtcgttcttgacccagacttcaatccggcctcccacattattcctgataccacacctgacccccatgactgtatccctctgatccacctgacattcaccccatttccccaaatttccttctttcctgttcctcaccctgatcacgcttgatttattgatggcggttccaccaggcctaatccccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagttcgaggatttgccccacccaggactggcaaattagctttactcaacatgccctgagtcagataactaaaatacctcttagtctaggtagatactttcactggataggtagaggcctttcctacagggtctgagaaggccaccgcaggcatttcttcccttctgtcagacataattcctcagtttagccttcccacctcaatacagtctgataacggacgagcctttattagtcaaatcagccaagcagtttttcaggctcttaatattcagtgaaacctttatatcccttacggtcctccgtcttcaagaaaagtagaatggactaaaggtcttttaaaaatacacctcaccaagctcagccaccaacttaaaaaggactggacaatacttttaccactttcccttctcagaattcaggcctgtcctcagaatgctacaggggtacagcccatttgagcggtatagatgctcctttttattaagccccagtctcattccagacaccagagcaacttaagactgtgccccccaaaaaacttgtcatccctactatcttctgtctagtcatactcctattcaccgttctcaactactcgtacatgccctgctcttgtttacactgccggtttacactgtttttccaagccatcacagctgatatctcctggtgctatccccaaactgccactcttaactcttgaagtaaataaataatctttgctggcaggactatgctgaatctccttaggcactctctaatcagatatcctgagttgtcccaattcttagaccttttatacctgtttttctccttctgttattccatttagtttctcaattcatccaaaaccgtatccaggccatcaccaatcattctatatgacaaatgtttcttctaacatccccacaatatcaccccttaccacaaggcctcccttcagcttaatctctcccagtctaggttcccacgccgcccctaatcctgcttgaagcagccctgagaaacatcgcccattctctctccataccaccccccaaaaattttcgccgccccaacacttcaacactattttgttttatttttcttattaatataagaagccaggaatgtcaggcctctgagctcaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgactttaccttgtgaaagtccttttcctggctcatcctggctcagaaacacccccactgagcaccttgcgacccccgactcctgcccgccagagaacaaaccccctttgaatgtaattttcctttacctacccaaatcctataaaacggccccacccttatctcccttagctgactctcttttcggactcagcccgcctgcacccgggtgaaataaacagccatgttgctcacacaaagcctgtttggtggtctcttcacgcgcatgaaaataacaaaatttactaccagtgaaagctgaaaagaaaatgagctcttttttggaaacaataggtgaataaaagctaaaattgatcaaagaaatgtttcatttattggacatatactaaagaaaatagtataaaatatattgtacattttgtttcttctagagcaatatcatatttcaagtcaaatatctagtaaaccagcaatatatagaaccataagtatgagcgtgaatatagtcaaaattaaaaatacacaatttacatgattgtaaaaacaatcacatacaaataagcagaagcttcataaaaaatgcaagcacctaagcattaattattgaaaccggaccatgaaattggacaactttcactatgacaaccaaaaaacatgatacagaaatataaaagtaaataattgtgtttacaaatgagttttctttaaaaagctacactgttaagtatatcaaggaaaggggataacgtctgaaaaataatataaaatctaaatattctgttttcagttacacaaattcaaaatgcaaggaattgtgattactataatgctagcattagtatttcttcaaatttatcaaatgggaaacctcagcctaaactacataagccctaaggttttaagagatactgaaatatgtgctaaacacttaataatgtttaatttgatgatctaagtcatatttgtcatgtattataaaaccaaaatataatttgcctttcttcattagtagtctagtaattacttaaggtcataaactatatgttgatagtttctttatttcttatgatttggcatcgtgcgcaatactttaaatgctctacacaataaatcattttcaaataaatgtgttaattattcaactttgcctctttaacagcatatatgattgacttatgttttcagtcagtttagcatctcaagagtctttttgaagtgattcttctgaataatcaagtttggaagtactacgttatagggatactaatataactgtagtttaaaatattttactttgtaaaaaatttaaaaatgaattaacctgaaatataagttatttcccatgactcataaataaattcctaatacatattttacctacatctattagttctttttatccatttattcatttaacaaataatatttattaaaggtcaatgtgctgggactgtgtaaggtgttaggcatacagtagtgatagaaaaagaagaaaagtatgcaaaaaaattgacaataattttattccatttgagcctataattaagtgagagaaacagatagtttaaccatataattataaatttttaaatgtgctgtgaaggagaaatcaggatgctccaagataataaaggggtaacattgagaagaggaaatcatggaagtcttctttgaggaagcggcatttaaattaagacctaaaagacggaaagcatatgaatgaaagttatctcatcactgtgggagcatcataacaaataagagaaagataaaatgctaagtgaagaaattgaacgctaatccagtaatacaggatatcgattatgggcttcatttttatagcagtagaaaaccattgaaggggtcaagcatgctaattatttgagtgatttcaaatgtaatatagcccactggctaatgaatgaagaagagggaaagaggagacataaataatactcatagaaggacatttcacaggtttaggtgaaagttgatggtggcagtgaaagaaaaattaaggccgggcgtggtggctcacacctgtaatcccagcactttgggaggccgaggcaggcagatcacgaggtcaggagaaccagaccatcctggctaacacggtgaaaccccgtctctaataaaaatacaaaaaaaaaattgccgggcatggtggtgggctcctgtagtcccagctactcaggaggctgagacaggagaatggcgtgaactcgggaggcggagcttgcagtgagctgagatcgcaccactgcactccaacctgggcgacagagcaaaaaaaagaaaaaaagaaaaacaggtagatgcattaaataagtatatgagaaaaaattggtaggaggtggtaatagattggagatgggagtaaatgagtatgtttcaagaataactttttccaatcaaatggaaggtgttgctattttcttttccttctttcttttttctttttcttttctttttttttttttttttttttgagacagagtctcgttccgtcacccagccgggagtgcaatggcgcgatcttggctcactgcaacctccaagagattctcccgcttcagcctcctgaggtgttgctagtttcttagattggggaatatcatccatttgaaaaaatgctgatagtgtaatcaaacttggaattcaattaaagtcctaagcatgagtgaataacctgtataagttcagaattacatgttggtgtatatatttcaattctaatacaaataggtttagccaagaaatggagtggtctttagaaaaaaataaaatgcttcaaatatcaaaaataaattaaaattgtgtactaatgtaaaaataggtccacatttttgtaagctttgctcatgaagactttatccggtatttgctgaaatactgaaccccctcaagaccttaagtaaatataaccctcaaactttaatcatgacattatacacacaaaccaaagaaaacaaaatcattatttgaaagaaattgtcgtctatggccataccactctgaaccctcccaatcttgtgtgaaataaattgtcaagagacattaaaatacgatgtagttttatcttaaacttgaatatttgaaattacaaaaacagaatttaatatgtaattttatatgttatgtacgtgtcctccacagagcactaaataacacaggacactcagaagtatatacagataaggtagcaacaaatattaataatcataagtgctttacataatttatgagaatggtacagtaataatagcaagttaccacatgcagcatttgctaagcatgcatgtgatagtagtttatatagttagtttaataatcacaacactcttttgaggttggtactattattatcaccattttaaagattggaaaactgaggtacaaaaggttatgtcatgtaatggtacaaagtggcagaaagaaatgcaactagctagcctgcctcccaattctattgtctttaaattggattctacttcatctctgtcacttaaaaccctcgttaatttggaacaatcatctgtcattatattaactcacatttttctataaaattaggctataaaaataattatgttcaaagttttttcctatgatatattacctatgatatagaataactacctatgatataggtatgataattacctatgatataggtatacctatgatatagaataactacctatgaataattacctatgatatagaataactaagaaattaaaatatttccaatttaagagcaggaaggggtagcttggctaaagctgtgaagttagagatcatctcgggaaaggactatgtgaggtgatacttagtgtgtgatagaattcttacgccaaatagaacatatatctaaaattaggtgttttctaaactcattgagggtacattagtcgagggaattaaattctatggacattaactgaattcctactgtgtgtaagtcattatactgaccactcgtggttagatcattaaaagtttttgtcttaaaggaacttacagatcagtaggggagacagacacgtaaaagttagccttaacgcaagccacaataaaacatgtgggagatacagttgatagctggtacgtggaagcaattaattttgacttgctaggaaaatatagcctttattaaagaggtaacaattgtactgtgtgttaaagattttcttttttaaagatacaacttggatcaaaccttcaacctgagagagctctcaatagttacagaataagaagaatattccatgctaaaaacaagtaaaacaaaaccctatatattattctcggattcataacatgaagggatgtagcaggagatgaaacaaatatatttaagagtattacatagatgtccttgactgtatgtgtggagctttcttccttccattggtaggttttccaggagggtgaggatctgttctgactcagtttcagaataatcatctgaaacagtgtggtaggaaatccattgaaatagccagattgcccaacatagtttactgtagtagcctaaattatggcagcacataggcatggaaaaggaattggtggtggaaatgggaatgcaaattggtacagtcaccttagaagacagcttctcagtttctaacaaagatatccatattcattctatatgatccagcaatcccactccttggtatttaccaaaaggatttgaaaatttatgtccatgtaaaaaaaaaaacttagcatggatgattatagcagctttattaataatggccaaaacttgaaagcaaccaaaatattatttcatggaagaatgaataaataaactgtgttacatctagataatggaatattatacagccctgaaaagatatgggctattatgtcatgaaaagacatggaggaattttaaatacgtattactaagtgaaataagccagtctgacaaggctacatactatatgattctaaacacatgctattctggaaaaggcaaaatcatggagactgtagaaagatcaatgattgtcaggggaaggaagcaagcaagggggagggaagcataggcagagcacaggatttttagagcagtgaaactcttctgtgtggttctataatggtggatatatgtcattagtacaaaaccataaaatgaagcaccgagagtgaatcctaatgcaaactacagactttggatgataacaatgtgcgaatgtaagttcattaattgtggcaaatgtatcactttggtatggggtgttaatattggggcaggtatgcatctgtggggacagtgagtatatgggaaatcactgtatcttcctctcaattttggtgtgtacctaaaactgctcaaaaaaaatctttaacaaaaaagatgaaatgatgatctacaaatacattctaaaatagaaattgcctaaactgaacaataatttggatgtatgcaggtaaagcagagggaaaacaaacaagactgcaaggtgcctatcctgctgcctgtggaacctaaagattaatggtgtgcatcatgatatagctgcctccaacacgactagatgcatgtttttgagtgtctgtgtttgtttattaaaataaagataattgattagttaatgtatttttggatatgtgcaatttgaagtgcttgtaaaagatctactttgtcatgtccagctgatatctggaatgtcagcttgctgcttgggaaagaggtcattacagggcatttaactttgggagacaagtatatatagaggtgatgattgaaaacttgagaacagatgaaaaagagaagaagtatatatacgtatttgaagaacgttaatttttaaagggtgataattgaacaaggggccagtaacatctctcagccaacagagaagtaggatgggaaccagggaagtttttcataaaagggtatagttgagagtttcaaaaagattaaggacttttgactttgacatgtagaaatagactgatgggatatctaattttatatgattttagtggtgtgatgtgagtgaaacccagagtatattctatacaagatagataaatacagatagaaatatagagatagatatagatcaatatatgtatgcaggcacttagattgatacatttttgtcgataaggaaaataatcagagtgggatagaagcatgaagaattatatctgggagtagggattagaccagaacctggggatgttaataatgttaattgggcaaagggaagggattagtcactggagagagattattgcatcaaaaaaatagaataattggtggagcacagaaattggaaggagtgcagtctaagacaggaaagaagagtaagaagcatcacagaagaagggaaggagaactaaaaaacaaaagaacaatgaaaagaagtggggtgaggatcagaggactcaactttatgtgggattccatcttaatgacttaagaagtaccagaatctacaatgaactcaaacaaatttacaagaaaaaaacaaccccatcaaaaagtgggcaaagaacatgaacagacacttctcaaaagaagacatttatgcagccaaaaaacatgtgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggattgtaaactagttcaaccattgtggaagtcagtgtggtgattcctcagggatctagaactagaaataccatttgacccagccatcccattactggatatatacccaaaggactataaatcaggctgctataaagacacatacacacgtatgtttattgcggcactattcaccatagcaaagacttggaaccaacccaaatgtccaacaacgatagactggattaagaaaatgtggcacatatacaccatggaatactatgcagccataaaaaaaggataagttcatgtcctttgtagggacatagatgaaattgggaatcatcattctcagtaaactatcacaaggacaaaaaaccaaacaccgcatgttctcactcataggtgggaattgaacaatgagaacacatggacacaggaaggggaacatcacactctggggactgttgtggggtggggggagggggcagggatagcattaggagatatacctaatgctaaatgacgagttattgggtgcagcacaccagcatggcacatgtatacatatgtaactaacctgcacattgtgcacatgtaccctaaaacttaaagtataataataataaaataaaatttaaaaaaaaagaagtacaattattcagtggtacttttaaaatattgttgtttaaaactgtaactctcaaaattggctgcatattagaactgtttcaatttcttaaataaaatctgtctaagtgagtccgttatgggtggccaaatcatttaaatacaaacatcttagaatgaagtgctggcatcaatactttaaaagttcctcaggcagaatgctaatagtcaattatcattgagaatcacagtttaagagaattgcagatgtttgcgaatagtgtttatggagcattaattggatagctagctactagtatttaaattgacatcttcaaaatattaaaatctgtatcctgtatagggagtaattgtcttttcaagaaaactagcaatgtgtggattggtattagtggagcatagtatttattagtttcaacctatacgattgcattgacatctgataaaacggtctgcatggaatgaaaaatgaaattatctcatgcagtaattttcccttaaacaaaatatgtgctaataatgtgattatacttcagctccggttacggaagatgatgttggtgctttaaggcatcactcctctaagtgttgttcatgacccatgtgcatgagaatcactccaggctttttgaaaaaatcaagtgtaagagacatatataaagtcagaagctcaatttataactgagaacttataacaaggatctggttaaaactttataaccaactcatttgctccttgcagacagggtagatacttaataagaaaaatatactgtacttaaaaaattgagtatgcactcacatcaggctaaaagagtctcatggctacattgaaaatgacaataattaaaacctgttgcccaagtgtctctttcctttaaagtgctcattgtcacttttgtttctgacactttcagtctttgacatcagtttactaaccacaaagtaaactgatgtatcctgtgtcaggtcaatggggaaaggcagggttgtgatgaggtgtagcatagggacctatgtcatgactcttaaagggtatatgtagatcagagttctgtatcaagtttctttgttttaaaaatattctctcaatgagaactagtttatgtctaggttcttggaggatgttttatagcgagaccattcttctaccacataccagaaataacattaaaatactaattataaagcttaatttgttgacttaaataatttttaaaattgtgggcatgctgacacaaacaacagtctatcttcataatctgcatagttcaggaaaatatataaaagtcttgaaaggcaaggaaatatctgttttacaaagagatacataagggaaattaacttttgtagacttcaaatgaggaaataagcctttgatcccctaaggcaaacatttttgagatacagtttctccatataattgctatgattttcttacttacactttgtagttccctgctggctgtttttctgtgtaaacttactttcatttccaattatgtcattatagagatgaaaatcagctctaattaaataagaacatgacaataattgtcattcatttatttatgtaaactatgatttttctacctgtgaaaaggtgatttagcaaagaaaaatgtagctctcatggtccatcaattgactggaactaatagtcatgtatctacagcttcccattctctcatatctttattcattcaatattacttgtctaagggtcttcctttctttcatcttcaaataagcatttattaagtagctacactatatttattttattttataattttaacttttatttcagattcagggggtacatacgcaagtttattacctgggtatattgcatgatgttgaggtttggggtatgattgattctgtcacccagatactgagtatagtacacaatagttaatttttcaattgtctcttctccctctctccctccatagtagtccccagtgtcttttgttgccatcagcagctaccgtattaaacatctactatatgccatgaactatagatacagatgccacagatacagaaataaactagttacagttttgccctgaaatcaaatgctttaaaacacattcattttattaatgtgacaagtaccataccaatatattaaaaaatttaccatagcagtttgaaacgttttttctctctttaccaaatacacagcagaagctatttacacatagaataaacattccggtgaattcccagtccccaggctatcatgtcaccccttctatagaactcaagaaagcatatcttaattcataaataaaaaataatagcattgaatgatttcttttttctttcacattttgcttgtttgtttgttttttgtgtttttctttttaagacggagtctctctctgtccccaggctggagtgcagtggcgccatcttggttcactgcaatctccacctcctgggttcaagcaattctcctgcctcagcctcccgagtagctgggactacaggcgcatgccgccacgtccggctaatttttttaaaaatttttattttagtagaggtggggtttcaccatattgcccaggctggtctcgagctccttagctcaggcaatccgctcgcctcggcctcccaaagtgctaggattacaggtgtgagccgccatgcccagctgcattgaatgatttctaattttaattaacaattaatgcaaagttggtgatgatttatccttggaataaatatttactgcatggctaatatgtctgccatgtgctggcattacagtggcaaacaagacagccaaagttgctaacctcctgagttttccatttggagtaagggaaagaagaaaataggttaatttcagatatgggctatgaccttgatgagagaggaaaagagagaaaaaaagtgtgtgtgtgtgtgtgtgtgtgtgtgtgtgtttgaaataacttatttaagtgtaataagcacagataatggtaaaaataagataaatcaggaataaagatgttgcctgacttacatgttttcaaagttaccatttactatctaacttaaattttctctgctgtaatgattatattttatctaggtaaccaatatctagtgggattatgcatcaatttactaaggcagttttttgtatttatctccaagtgaaatttaatcaatttctacagtagtgaaaagtaatttgaagatttaatatattcagtattttaataaaatataaactggtcaaatagctatgcttttttttttaaagtaacaaccaagcatttattcacttactacaaatagctatgtttacctctaataaccagttaagtctcctttagagtccatatagatatgcttttatttgtttttggttttttgtttttgtttttgtttttttttgagatggagttttgctcttgttgcccaggctggagtgtgatggcatgatctcagctcaccgcaaccttggcctcccaggttcaagcgattctcctgcctcagcctcctgagtagctgggattacaggcatgcgccaccatacccggctaattttgtatttttagtagagacagcgttggtcaggctggtctcgaactcccgacctcaggtgatccacttgccttggcttcccaaagtgctgggattacaggcgtgagccaccatgcctggcggatatgcttttatttgaaaagtaacagaaatttaaagctatttaaactaattatgctatacaataagtgtgaaatcaatttctgtttcttaagtaatttcttcatgagcatatcgtataatgcacatgtaaataacagctttgagtgtacacttatattatgtgagtagttacctgtatgacactgtccccaggtctcatgtctgtataaacatacacatcataggatatttcagggaaggttggcgtgttatcatttgcatccatcacttgaatattgacgatgactggctcactttcttgtacaccatcaaatgctgttatctttgggaggagaaaaatacacttagtagagatgttctgcaaatataagtagtacagagtttgctcttacagtttaacaagtttcttacaggtaatcttacaatttgaaagggtgcaaaaatattttgttgataaaaggacgtaatagagacgtaatattacatatattaaaagtgttctaatatggtaagaagcaagtattgaagattttgttttaaggtattcaactccaggcatattttaaataatcagatatgcaaaatatcatttaaagtgggccaataacattgctgactcttagggttaactacaatttaatccttaaaaacttaattggaaaatattatttgcatttacatattttgtatacaatagttccttgtacagtcaatgtgtttataccatcaggaaggtagacttcctagatgtactttgtatcacagtaattcacccaatggcaattttcaaaggactaagtggtatcatttaattgtgatattttatactttatcaatgttgataatgtatgttatactttatcaatgttgataatgtacattatcaagattttaacaattcctgccaaatcagtgctacagcaccaccatctttgtctaaatccactttgtatctaacttttaacaatcacataaactttcctggaagttctgatctttttctatgtaggcttctccagaaataatttctacatatcttgtttaacttgtgctttctcttagctcatctttctcctgtgactgattcaaaaattgggatataattagaagttacattttttctttatccaactgtcaaccctactatacttgttatttacgtgtttgtgtgcatgtgtgtgtatgtttatgtgtgtgtgtgtatttccctatctcatgataaatatttacaatcacaactttaataacctttactttttttcccccttgattagcctaacccatgatttatctacctcagtgctattgacaccttgggacagataactctttattgtgaggggctgttctctgtattacaattagcagcatcctttatgtctacctactagatgcctatagtaactaccccttcacaattgtgacaaacaaaaatgcctccagatgttgctaaatgttcactggagggaaaatttattccctcttgagaatcactggctcaaccttatgactaaataaaaaatgcaagaacaacaacaaaaaaggttaggaaataattctttatacctcaatttaagacaattatgactgtttagtaaagactgaaattctcactttcttttttttttgaaaagttttttcttctgtgaggaagaatgttaatatagctacacaaattacaaaaaaagagcaatacatgtaaataatttttcattgatcttctctctggtattgaaaataatgtatttttcccccaagtcattgattttttcagttttaaccagacatctctttcagttccatacaaacatacatacatacattcatacatacatatgtatatttacacaaaagctctttaccgaaaaggtgtaagtttgctgttcttccctgtccactggttgaagtaaggtgaggtagcgagtaataccagtctgtgtgacggtgaagactgaggtgtagtcattcagaaaaaggtgaagctctgggtcttttgtctttgaaaaaaaatgacatcgtttcaaacgttgaataaataatgtagctattagttcattacctagaagttaatgtttgaaatttatagcaaaaatccacgtgaaagtattaagaatttctaacgataaaagatatttaactagatatttactcaaatgatctaaactattcaaaagatggtgacctatatcgtggaatacaaaatactgaaatacaaacaggtataatcaatgtgggaaaaaaggaaaaataatagaaaaacagaaagaatataaaaactcccaattaaatatattcttactgattatttgttatcaatattttccaaaatagcattggactggagaaataagaaataaaagcaagaaaagaaaattgcatttcaaaattttagcaataagactttataattacttcatttatagtaataaactgcatatatacatattactatcttgttcttacttataatgcaaaatagaaataaaattggttatgtattattcattacctataaatatcatgcttactctttcttattttaatgctgtaaaattttccaaatggaaacatgtttactttaattaaaatatttcagataatttgatttaaaatatgcataaatttagcaaatgtgtctgatagaaaagtctagaaaaaatgatatatacttaaaaaggaagggatttcaaaattcaagtctgagagacaatcaacttagcattgaagaccctttgcaatttcattgccacccctgaaacagaagacaacatactctaatttagagaaagaacagcaatataaagtaagaaggctagcactgatgtctgcatagtaggaaagaaaggcaggtggagcgaagaaaaaaggaatattcagagagtggactattatgaaggctttgaaaaagagagaaaggagtgatacagggaggtaaggtgttgttctagattatactatcttttaaagtatgcatagcatgatatgaaatggatttaatatcataaaacacttctttaagtctgatgtcaaggactgaggcaagagcaaagaatagaaaattgttaaatgtgtttaatttgaaaataatagaactcataatttcaaaatttctatgtaaaatacaaaagttgtaatgcacactactataataaaatgtgaacatgatttgatccacaatatacttgaatctgcccatcttttaaacattgtgatatgtgtagatttcaaataaccttgaaataaatggtttcatttgaacctaaaacaagttatgtattcataatatctcattctgtagtagcttctatgttcaggattttgacttaaggtcactgtgctacatttatcctggaacaataagaaagtaatactacacataataattccaactggcgtatttattataaaatgatcaaaaatattgagaaaaagttcaagaggcttcacactctgatattttcaaacaggcacttcagttgtttccatttcagtgtcatgaacccaattactcagataactagaaagcgggatattctaaaaaatctaacatgttagttttaaaaataaattatgtatttttaaaagtcaattagaaaatgcatatgtctattctgaatgatattttaagcattcttattttacactttagagtgaattgtgattaaattcaattattagagttgataaaaaagttttagttaacatgcagtttcagtcaaagaaactctaagtatgaatgtctgccatttgttttgtgttcatcctggatttacctaatcactgggcttttaagcacatatacacttctctaaatgcaccaacaatggtgccatctggcatgccttaatttattcggacctttaaaccctaaatgcaagctgaggaagttttgctatgtaccttgtttaccaaatatttactttgttccttttgttcaaatctcatcattctctacttcctttataccttaattctctcaatttattttcttcctttcaaccgtaacctctgttaataaatttgttaggtatattcactcatatcttcacatttttaagcatttttgtgtgtcaagtatttcgataatgcaatatttcaataagtattgagttgtcaactagtgtgtccaaatgtgactgtagtataatatgtttgtgtcacaaagagcacttactttttaccactttcaagaaaacctctaggttttgtttgtcaaatgcttttcgtttgaagataatgcacacatcaatactccataaatagacttccttatattggataaacagaaacattaaagatcttttgttaatttaactgtctcagtttcttgagtgcttttataataactagctggagaaagataacatttcccagaactacagtgtatttgctttttgtgaagaagataatctatcacagaaagctagcactatacatggcatattatagctcattctgttttgtttagttaatctctgatcaaaatataacatttacatttatgtatatttaaaataataatcttgtacataaatgctactggtaaatatcctcgtattaatttaagtaaaaaaatttaggaagccagatttggaaatgttcaacaaattgtcactcaatgtttaataatttatattcatttttaaagatagtgcaagtttcaaatgttgtgtatatatttatgttccaaatattacagcatatcattttatgagttttatgaaaattttaagtaatatcaacataaaatgttaatagatacatatcagtaccaactaacctattgttttgattgacaatatttacagttcaaggttttgctacccttcacaagaaaggtgtatcaaaggtttggtaagaaacaatgtgcatttgaagtcaaatatccttctctaaatctctttataaacttaaattccttcttgtcaagctgcattccgatacagtttgaatttcacaaatatatttgaattttgcaattcctaaagagtaacttgagtcaacacttgtatatttgcaactcttttaatcatgttagagttaatagcttataagtttcatagactaggatgtacatggacaaataatgctctggcttaatattccaataggggtagcagactttaggtagctgttgtgtctataagtttatttaaaatgaatttaagtgttaaatcaataggtacacagagagttgattaaaaaccgttaattttcctctgacattaggtaatatttattttaccctaaaatatccagtcagtatataccaaaagtatgatatattaattcacttatctgcatattatattttgagatggtaaaataagctctgacatgcacacataaaaacagaaaaaaatgcaaaagtaaatgcatatgaaaacacacaggtaaacaaacatatgaatataaaataaacaagcattctatcatataaaactatgttcaaagatgagagtctactgtttaaacaccaacttggggtttctaatgggaataaatataggatatcacaaacacacaagaccatatgcatgcacatatataggcacatacaacacagacatgtatagacatatgtgcacatatatatgtatgcatatacaagagcatacatataaatgacaaagcataagagaaaaatgacaaaaaaatgttatctcctcagccagttttaattacttggtagtagttgcctgagtatttagttcaaaaaaattcaatttcaaacttacaatgttttagaaaaaatgccatgataaattaccaatgtttgttgtggactgagaaaacattaataattaagcagtctttgcctcagttgacaattaaatttggattttacaaaatttcatagtactataaacaatagattatgtaaatatttttaccttttttaactttaaaatatttttaaattttaaaccaatgaagtaagtatatttaaatttatataaagtatttgtagatatccttataagggataatgaagtaatacctacgtgttttagtgaagaaaaaaaagaacaaggaaataaaccacagcaattaacaaaagaacaatcacaagcttaacacctagtacctacaggaactccactgggtggaacctatacgcaaattaaacatgaaataaatattgtaaatgtaaatgatcacaaccgcacatatgaagaaaaagcaaaccacttccagcacactagactgacaatttttttcagagtatacaatttttttattagcattgtgacccacatataatggaataacgatatttatgaagcatataaatacttaactgctttatgagtatattgaattaaatatcaaagatacctcttcatagtaaaataacgttaagcagagaaacaaatttacatgaagttataaataagtatctttttacaagccaaatgagtaatctttattgattattattctttgtcattttttatgatcagcattcaataatcaatttttagcatctctgacactgaaaacctggtggtctcagacatgcctcttaacaccttgtgccttacctattctacttatattatgggttattttgaaattatgatgtggtacaagtactctaaaaggcataatgtataaactgatatggttcatatatgtatacatgcatgtgtatgtgtgtgtgtgtgtgtgtgtgtgtgtgtgtgtgtgtatgggtatatgtctacatctatatagcaataaaaagaacactggtgcaaatatttcttttcctttcttttcagtattactgtggcccttggaattctttctgacttaaaatctacactgtgaatactatcacaactcacattcctggctattgtttcttaaaatgtggcttcactttccactaaattaaagggagaaacacaacttaaattttacgcaaatggatccaaacttgtccccttcttggcatttaccatctggaatagctatgcttgaagcaactcttgagagccaagccctgcaatgacaacttccacttttatgcttgaggcttaatctctaatactatgctgatattgtatgaggtggcacactgtctctctcaaagagtttatccctataatgatgattgtcactaattctgacactcaaaagcaacaggattttgtttcattttgttgaattagggtcccaatttgtcatctagcctgcagtgcagtggtgcaatcatggctcactgcagcctcgaaccagtgggctcaagggatccttctgcctcagcctttcaattagtgagactacaagcatgaaccaccatgcctggctaagttttttgtttatttttgtagagactgcatctccatatgtagccaaggctggtctggaactcctggcctcaagccatcctccagcctcactctcccaaaatgctgagattatgagtgagccaccacacccagccaagagtggcatgatttaccttgaagtaaaattcatgcccataaactaaaatggctttaaagttttcttttcataatacagatcttttgaaaatcccagaaatgaactaatttactttataaaaataaatggtgctcggtctataaaaaacagatgtatcagaaggacataaatccatcttctaatatatgaatgactatttcatagatttattttgtgtgctggcaaatggaagatttaaggaataatagatgaattaaaagaaaactggtttcaactcagtatgaaaaacagctttctaagaattagagttgttcaaacatgggataggccatcttgtgaaatacttaatgcaacatcattagcatctttgaagcatctgttagataacctaattcattcaatagtgactgaatttatgagtttattgaagagttcccaaaccctattaagtgctggaaactgtgttagttcttcagcatacaaaagttgctaagatataggacctattctcaacagatgtaaactcatgagggagaaagacattattttcaagttggaagtatagaattagagaaatgcactgagggaggcatgcaactaaaattggataatgaataccgtggaaagattctcgaatgaaggaatgcctgaggtgagctctaaacactgagtataagttatccaagccagcctgtgcaacagatgaaagatttcaaagcctagaacatgtaatgagcaaacattagacaagatgtagcttggcacatgaaagaaacgacaagcagttgccaaatgttataggtgaattaggaagtttccaaaactcaggccacaaaaatgttcaggtatcaagatacagaaaattgtgtgagcttaaattttcttctctagaggaataggtgtcataaaagtatatcaaatagaaatgtgggccagacgcagtggctcatgcctgtaaacccgagcaaggtgggtgtatcacttgaggtcaggagttccagaccaacctggccaacatggtgaaacactgtctctacaaaaaatgcaaaaaaaaaaaaaaaaaaaattagctaggcatggtggtacaagcctgtaatcccagctacttaggaggctgttgtgggagaatcacttgagccagggaggcagaggttgcagtgagcctggattgtgacgctgcactccagcctgggtgacagagagaaactctctcaaaagaaagaaaagcaagggaaagaaaaaaaagaaaagaaagaaggagaaggaggggaaggaagggacggggggaaggaaaggaagggagagagaaagaaaaaaataatgaacggagagaaggaaggaaggcaggaaggcaggcaggcagaaggaaagaagaaagaaacaaaggaaggaaggaagaaagaaaaaaaaaaaagaaagaaagaaagagaaagagaaagaaagaaagaaaaagaaagaaagaaagaaaaagaaagagaaagaaagaaaggaaagaaggaaggaaggaaaaagagaaagaaaggagagggagagagggagagaggaaggaaggatgtagttagatgttagatttgagcttttgaataaatcactctaatggccctgcagaagatagacttgagtaagaaatcaagagaccaagaacatcaggaagtaattctaataacagaccaatagggtggtggttataaggatagagagaagaaaagagattaaataaataattaggggacaaaataggaagatctggaagatttcttagttgtggcgaataaagaaaacataaaaatcaagcaagacttctaggattctaggttgcatagcacaataaaacatctatcaatttctgggaaatgggttttaggagaggatttcatacagtactggaagtttaaactatttctaatattctatgagcttatttatattttatatatagaaactacatatgatatttttaaaaattttattactagaagactaggcatacttgttcactctctggacacctaatgacagtcactcaccatagattattttagaaagggggtgagtctaagtaataaacaaatgatcagttttgctgattaattacttgacacttttataaaagttatgaagcatgccaccctccatgtacatggcatcatctcagggaaattttctctccatgccctttcctaccagtcccaactaaagacacataccaaggcagcaatgattgctaccatatagatgactggacaagagggggcacctgatgagtatgaaactcacaatgttatacagctattacatgacagaaccaggagtcaagccaagatctgtctaaatccaaagcccaaactgccaaaaacacttcagagcatttcatagactaactggtactgtacatctccaagagttgaattataagtagtgtttctcaaaggttttagacccctgagctctctccactttatttcatcaatgccctgtgagtactactgtcttttacaaagttccttggaacacaattttaacatttgtaatttaaaagtgaacagacaatccagacaagtacggggtcacataggcaagcatagggcttagtgtgtaaccaatagataatatgaacacactgagaaggtataaatacataaattttgctattgtgtaaacttaaaactacctaactttagatttagatttttctaaccaccagttctattaaggtatgacctaagctatcatacactttcaaattgattagtcactacttaaaatatgagtatgtattcaattgaaaagcaaaatccgcactaaaatttgtgggacattagtagatctacaaaatacatttgctcagcctggattgaagttattaaggtgactctaggtgttttctagtggggattcagtagagacttttttcctgtgactcatgaaacccactatacatcagagaatccctaaattctcttgactggcatatgaaactgtgtatagattaatgtgttcacttttctaggaaaagaacctagagcattcttcagctatcattatagtcagactatgatcaaagtatataaaatatagagtgcttaaaattgagaactttgttttccataaaccttggcttaaggtccatttctactgtttactaacactgtgatcatggtaaggcatttaaactagctttaatatccctttctgaaatagggataattgcatctatcatgtttgttgtgagatttaagggaattaatgcaagaagaatttactgtattgtttgacatgtactgagaactcaatgacagatattgttaaaacttgtggtttaagaagacactaaatgtgagagaccaggaaagattgaaaaaaaaaaaaaagctagaatggaaaaagaaaacaaagcaaagagaaacaaaagaataaaataaagcatctggtgggaagaggtggagtgccaacaagaattgtcatagcctctgtggagtgttacaaaatttatttagaaagagaaaaaaaatctgaaagtgccttcctaatttcctgaagtgattataaagctatgtgtaatgagatattagggaacattctagagctctgctgccttatgagtgacatgtatttatatttaatttcattaatattaagcaaaatttaaaagttatgtttttagtccagttaaattttaagtactcaatagctgtataagactagtggctactatgttggacagtacagttacacagtaattccatcatcacaaaaaaatccatctatctgagagcaagcactgttaagggagaaatgaatgaatcaagaattatataacagcaagtaagaaatccaactatcttttacatatagttatgcttataatccaaacacagttgtatttacttgctgttttatatatatgtgtgtgtgtgtgtgtgtatgtatacctgtgtatatatctctatctatctatctatctatctatctatctatctatctatatctgtatgtgtatgtatacctgtgtatatgtctatctatctatctatctatatatatacacaaaacatatgtatacatatttatgcagtgaggatactgtggtagttcacaaactcaaaggaaaatctttgggaattagaatacctctggggaacttaaaacttaaaagacaggcactcaatgggactctcttttctgtgtgtatctctcaggcttcattctctcccactgataattggctttctcatgatgtcagcaaatgtggctacaaaggtttcagattcatttccacttctctaatacatgataccaaagtctttcagcccttctgttctccattgtaaattcctgggaggattctggctagcctggtatagattttctgtccctttataacattcactctggctaaggaggtaaagtgttctgatttgctcagcctggaccatttcccactcatgtagatagtgtgagtacaagaaaaacaaaagacaatgatttgtggagtgaagcgtaagcatccacatagtcactggcagaagtatgaatgggtcagctgcctcaaatatattttaataacgatgccctcagacttgaagaaaagtctctgagaatcacaatctaggggtgctttcatgattttttactcatgtagtaacaccattatttttgctttatcaataattatataaaacagttctcaacatatgttaataaaaatattgccctcgtcattaaataaacatcaagtaaaacattcattttcttacatatactgaatatctgcaagctgaaaaggaatagttattgaattcaaagatactttttaaaatatccttgttttggaattaaattataacactaaaactcacttacagtgacttaattctctcttctctagcttatgtagccatatctttgtcatatttcccattaatggaaatatgagatttgttacacaaacaagagcaaaatatgtatttaacttacatcttctatgtccttgtccagagctactattcttaaaggtgaagtcaaattgagactgtccgaaatggttgctcccactggggcagattccaggatatagccttgataactgggcattgtaaaatatggactttgattgttttcatccagtatttcaatgtgtagaccggcaaaggcaggaagaggatgaccattgtcttgttcagcctaaaattgaaaagaaaagaaaatatttagaaagtatatgtcgtgctatctttttggagtttcacttttcatgcaatatatagggttctctttttaactaatatcatcacataaggaaaaaatacgttaaagggccatttgaaaatataaatgaggaaatgaaaatccagtgaggcttaattgcttcagtcttctgttttaaaactcagtgtatattttaaaaattcactgtaataaattattattattttattttatgtttttattttttgagacagagtcttgctctgtcgcccaggctggagtgcagtggagtgaactcggctcactgccagctcttcctcctgagttcacgccattctcctgcctcagcctcccaagtagctgggactacaggcgcccaccaccacgcatggctaatgttttgtatttttagtagagacagggtttcaccgtgttagccaggatgctctcgatctcctgacctcgtgatccgcccgcctcagcctcccaaagtgctgggattacaggcgtgagccaccgcgcccagccaaattattgtaatttttattgaatgcagtaggagaggtaattgtgtttaaatacatttagtcagaaaattcaaatggagatacttgagtgtaccgctgataaaatatttaaataaaagaaaaaaagtaacacaaataaagaactatcgtatcgactttgtctcttctgtgtcttctcattttacactaatgtttaaatctctgctatggtctctgctgttgtaccccccaaattcgtaagttgaaattttaaccccaaaggtgatggtattaagaggtgtggcatttggaaggtgataaggtggtgagggcagagccctcattaatggggtgaatgcccttatagaaaagggtctagagggctccttttccccgcctcccaccacgtgagaacaagtaagaaggtggaaccaccctctgtgaggaagtgggccctcactagaaaccaaatttacaagagtcgaatgtccagcctccacgactgtgagaaataaatgttccttgtttataagccatccagtttatggtgttttgttattgcagctcaaagaaacgtagacaattcccaaataattcgtaattctatataaaattaataaagttatatttattgcccactgaccgtccccaaaagcttcttaaaaaggacagaaataataaatttcattgtaatgttgtagaaactgtgaattgcaatattatttaactagaaatgtttttcaagtaaaattaatattcttatgtataaattttcttttttttctcccattaagtttaagaagttgataaaaatttctgtttctaacacattttcatacaaaatctctacatggtcatgctgcacataggaaaatactaaccatagattttctgttttttaaaaaatatatattttattatatgtgtattggaaggtttaatttaaaggaagatttcatcacaattgacttctggaaaatctcctccaacttttatgagaaaacatggatataatttaatagcatatacatttattaaaatgaattcaaattctatctttaatttttgttatgttttccccattgggagaaaagttgtatttttaaatcaattaaaatgaaaataaaatatttgatattaaactctggtgtgattttctagatagatagtgacagtactttgtaagtagctcagctagagatctctaactgttaaaacgtgaggaaagaaatttggtctccagaagacaatttttcacttccttctaatagtaatttaacattttcatctgttaaaaaggtaggtaacaaactacagtgatattggtagggattgctgacttttcaccaagaaatattacaatatattttccttcatattatttatattgaagatttgttgaaatattatttatgtcaattactaatgtgaaattatgctaattaataaacccatagggaggtaatgtcatataatgcattgattaaaaaacttatatttgatttttaatatattgatatctctatttagataatatgctagattttcttagtaatattacatagtttaccttatgcatttaacttttcatttggcagcagaatgtcaaattagcccatggcacaaaacgctttaagatcctgctcagcactaagaagaacagtactggaataatgtttggtcctgtctgggattatgtatccatctcacataaccaggcatgctgctaataccatcagtatggatgaggtctttctgcatccagcagttgtgattaatttgtgccgagcgatggatgttcttttaggagttacccctgtgacacacatcaggctttctggagacagctgaccagggcaagaggtagagtctacgcctggaaaacattgttttttcactgtttaaaactaattggtccatatgggcttccaacccaatgaccttgaaatgatttaagcaggaatcctctgcttcactcttacaggctcagagcagttcatacatgcaaggcattttgaacagatttttttctctctttcttgtatctctccatctttctttaatatctaattattcttttttttttttttttttttttttgagacaaagtctcgctctgtcgcccaggctggagtgcagtggcgggatctcggctcactgcaagctccgcctcccgggttcacgccattctcctgcctcagcctcccaagtagttgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaataaccagcatgtcatatccaggacataaaaatgctatgaaaagtcataaattctacaacttttcctctttccccgatgaacacacccaaacacacacaatatataggtggtgaggaggatgaaaaaagcaaaattgtataataatgaaataagcttacattttacattcagatcatatatcattagtttttaccagcagctgtgaagccagtaaaaatatgtattatttgcatgatgaaaacaaagtgattcaatgaaaagagaaataaaattcaaatcagatctatgaagataatctaattcttaacttcctcatatctataaaaattacatataaaggctctgcccatttttactctaatattaatttagagttaataatgattaatatttttggattgctactatgtattttgttctatttgaggtgtttcaatttgctgaccagatatctgtctccaaagcccactttctttatgccatttatctgtccagatgtgaaaatgtgtatttttgaactgatggaaaaaaagaaaggttagttttatattcaaggccacataggctgtaagttacatacagaacatgggcccagactcaggtctcctgatttttaagaggctacacaggaagattcatcatatgtttctcaaatttacagaatgcaaatgaatatcgaaaagcaagagagatgggacaaattaacagtaggaaaaaatattgagataaatacttctgttaagtaagagttaaaatgttgaatttaaacaacaacaacaacaataataataataataataataataatatactttgctcgttagtgggcccatgcatcaaaactctgatacaattatcttttcttccatacaatataaataagggttctcaaaaatctgaattattctgttcccctgaaatccgtggtggatgaaatgagaaatattttaaaaacacctcagttggaataaggtggtattttaaaaatcatttactttcataaggtaaccttatttatatttacagagtctatagttacgagttaaacattatatttaagtgctaggttttgtttgaaaagcgtctgggcatgagtctcactttcagtaacgagaccaaagtaaaactgaagccaaaaaaaatgaagtataaaaagcacaccattttgttactttggaaggcaaaacattgaaaaagacaaaccactccatcttcaatattgaaaaaaggaaatactgataatttctgagcaccttgtaacggaggactgagactacagaataactttgttcttcctaactggtggcaaacaatttaacaatttcataatctctaatatgaaacctttcaagtagattcaacaatttaaaaaagacaatggtaaagcttatcaaattatttatcatttaaataaattctaggatagaagaaagaaatcatgttttccaggaattatttattgtgcatctacagagcccactttttttttttttttttttttgtattttaaattctgggatacatgtgcagaatgtgcaggtttgttacgtacgcatacacgtcccatggtggtttgctgtgcccatcaaccagtcatctacattaggtatttctcctaatgctatccctccctaggcccccaccctcgacaggccccggtgtgtgatgttcccctccctgtgtccatatgttcttattgctcaactcccacttcttagatcgcaagtgctcaccttcatctgtattcaccctcccaagttttcttaaacccacttcaatcatacttttgcctcagccactcaaagccagctgcttttgtcaaaatcaccggtgccttttacattgctaaaagcaatatttattttcagtccttatcttacttgacctatcttcagcattattcactatcctttcacggcaacagcttctcggttctcttcctattttactacccattttttctcattctcgtttggtggtttccccttttctcccctacttaattttggagtggcccagaagtgaggagttattcatcttttctttatactcactcccttgctcaatctagtctaatctcacaccttaaaaatgtcagtactattatgactcctaatttcaatctccaacctggatttctcctttgaattccacagtccatatccaactgtgtacttcgtaacactgcgtaagtatctaacagacgtttcagatataaatacctgcaacaatgaaattctgattaccctgcacgaacctcctccactcatggtcttttccacttctttaatggcagctacatagttacaggtaccgaaaacaagaaacttggaggcacctcttgcttcagtggatagatatggaaaaagtgaaaaccacttttttgaaaattgaatttgaagttccatcttctcatttcacaatacagtattagcagattatatatgccaagaaatattctatgttagtaaacttgagatgaaaaaatactcttatgtcaatgtagtgaattatggtcttatcctactgaagcattaaaggtaaatattgcaattttcaaagttaaggtaataccacattttaatttggataatattataaatttatgaaatatttttctatatttataatatgtaaaaatagaaatataatcatattgcttgtatagtaaattccactgttctatgctattgtaaacctaaacctttcttgtaattagtctgaatctcatttttcattagatttttaaattccatgagcataaacactgtaaatgtatcagtttcattcactgctaaaatttcggacaatccctggtatatggaagaaggtcaaatatatatttatttttacttttctgtatctttaattttaataggctttaaatatttttttaaaaattaagtgattgtgacatcattctaattcccattcgatagatatttatggatgtttttccagtgtgtgtgtgtgaacgtacacgaagtggaaattaattaatgtgaatgtacaacatgaacaccttagattatagaatgtctttattcacacattttaaaggtttgtgatatctgcaagtttacctatgggtaattaatactgatgcacattcttgccagtcttatgaatgggcctcacccagccccctcaatcatcaattatgattctatatctatagggatggtgctgtgaacagaataacgtataatcttctagaaggtttatgcatttacatgtaatatttatgcaaaaaggcctatttatatgcatttttgaatggacagtggcttaaagaatgagatgttagttgtgactttgctcttaacacatggcttagatacattttattgtcagaatggtgcaaattgaggactttagcatgattttgactgtgtgtactcttccagtccactcaacacattttaatttattaatttaatttacttgctttacttactgaactatagcttttaatacctagttcttagaacctgcttggccaattttcgcaaacattagatatcttaggaagagaaaaaaaaaagagggagggaggaagaaaaagagggaataaaggatggatagagggagtgggtaaggaaaacaaatggcattctcctttcaccagaggtaagggacagataaatgttaaaaatcatggcaaccacacaaggcaatcattctcaaactctgatgtacctaagaatagaatggaaggcctaataaaaagcagattccctgggccaggcgcagtgtctcacgcctgtaatcctaacactttgggaggctgaggcaggtggatcaccagaggtcgggagttcgagaccagcctgaccaatgtagagaaaccctgtgtctactaaaaatacacaattagccgggcatggcgctgcatgcctgtaatgccagctactcgggaggctgaggcagaagaatcgcttgaacccgggaggcagaggttgcagtgagccaagattgcgccactacattccagcctgagcaacaagagcgaaaccccacctcaaaaaaaaaaaaaaaaaaagtagtttcccacaccctatccacaaagattctcgttcatatgttgatgttagaggcaaggaatctccatttttatcaaactgtctgtggtggttataatgtgagcagaatgtactttcacagacattattctgggtgtggctactcaaactccaatttttagagaatctttctttttagccctattggttagggctattggttagccctattggttagtggaccagtctttactaatggatagtccttataatctggagcaaaaactccagataatacagtgcatccaagagccaatgttgtcacgccagaagatttggagtctagtaactgaaactgcatgcaattatacaattatcaactgtgtaggttcaacaccactaaaattgtcatgtgactctagcattaccaaagattgctcgtgtgtcagtgggaatactctacaagtaataagctcagtcttagctagtattcataggtcatggtcaaatcctcttgacattccattattcataattaattagaatttaggtatgttggtgtatgtgtgcacgtatgcctgtgtatacacagtatcaatatagttttgggtgtaagccaccacttttactttatcatttttaaataaaggaacctcagattgagaaaaaaagcagagagaaggtaatttgacatacagaaagtttttggtttctagtcagagtcagagaaagacaaacgcatatagaatgtacccggaaggcagataatgacaacattctgagtaatagtatattcctgttgctagtgactaaacataggatataaggctactatgtaattcaaaattttcttcttcctgtgttcccttcctggacaccacacctcttgctaaacagctcttcagtaaagccttcaatatacaagggtgtaatttttccaagtttcttcacccagcaaggtgcaggctgcatattgatctttatatgaggatgattctgaaaaacgggcaaattgaccgaactaccaatgattcacgcatatccctttattcctttattttcaattttaaattcaactctcaagtagacaaagaagattgtttgctttggttaattttgctggagggctaaattatatatcctgtctttctttatggatagaaattgcatttgcttaacattttaaaaatcactttagacagttaaaatatgtttacttaagctttcaaccaatttattttttggcaataacaatattattagtgtataaccttcaaatagcctgacatttggacatgtttgtcttgggattcaaacgtgaattacttgtacttttattttgaaatcaaaatgttaataaaagtctcagatttttctttagcagacaattcattgccattgaattttttcacaggtggaaagtatatggttgtggaacatatacatcctgagttggttacagtacagaaaaatagaaggaatcataaaactcttaagaatctgattaaaaacatcaacatttaatccaattataaagtgttgcaaaaaaaaaaagagaaaagtaatctatgctgttagaatcctatagtggaagtttgtggttgtgtcaggtggaggtaaggtgattagtgactaggaggaggtgtaggaggcgtatgggatgtttgtagcatctttttttaacaaaaatctggttgttagttacatgattaacttcactctgtgaaaattcatcaagatatacactttcctgtatgtcagcagcatgtcagcatttcaataaaaatgttactaaaaaaataagctatgaacttgctccccaaaaaagtgtacatagactatcccttcctctcctatcacagtaaactaggatacgggcgctcaagtccaagtggtaatttaatagcagctgccctaggaagtgacatggaaaaccaacattatgaagatacgtgaaaattaaagatgctcccctcttcaaccatctgtgttcattaaagatggaccccaaaagtaaacttggccttttgcactttcccactaagtgtttcccaaatactgtggtttccaaagccctgcttcttatctgctgccttaaaataatctaaggtaattgttaaagcaaattcccaggggctcaaccaaaatatctgacatgtatctgctgtattgcttatttgttttctttattagtttaattttatcatatcttcctaagttttcaagtaattttaatatatgacttgctctcaaaatttagcatccgaaaatcacatgtaaatcttgattctgtagggagagccctgaagtctgcctttccaaaacagccacatcccctggtcctggatatgtagaatcagtagtcgtttgggatcagttggatcaggcattttagcttctctcacacaggcttataggtagctgttacactaaaaaagcctagggtgagcagctgaggccaactctgttctagccttttatgtaagtcattatcactcttcttcactttcagcaaagtctcttaatttggacttagttggaaactgaatggaaggaattcatttatgtaagggaattctctgtaggatcctgcagctcactgaagctctacaaaagctataggtccaaagcaacagtaattggtaacaggttatcaggttatatttcctttgtgtgtgtgtgtgtgtgtgtgtgtgtgtgtgtgtaaaatgtcttagggagggatgactgtgaataacctgtgctccatgaatcaatgaacatattatcaactgactaaaaattattaggtttttgccattaaaagtaatggcaaacaccacaattatgtttgcatcatcctaataaaaataagaatatcccattgattcttgaccctacttataaaattaactgccttaaaacctacaggagcctccttttattcaaaatttaatactctaaaaattaaaggatgcatatacagtttgactttaagccaatttattactattactaaacatactcaaaaacttataaataaattcaaaaacctataaaattcatgagataaaatacaaataactgttgtatgctgtaaagtttgtttgcaaggctatacagcaaaagagtatattcttggttggaaacaaatacctttttttgtatgacaaaaaggaaaagaaacttcactagatagaatataggcagcacatattttataaagccttgtaatataacgacgaaataatactgacacatttcacacctagggaatatttttaataaaacgaaatactttctatcttcacttcaagtaagaatatgcccattctgtttataacttgttacaacgaacacatgaatcctcaaagctcttgtatacctttcaatgataaaaatctttctttttgcttagagcatgagatacaaatcgacactggaatgactaaaaggattttgaatgatttaaagaaaaaataaccttgccactctggggaagaccacagattctgaaaactctcacttatcaccgacatgttgaactatttagctggtgtttggaacgtgagaatcatcttgggtataaacagcaaggtcagccagatataaaattctgatagtgataaaggggtaactttttttctgtgaatcttccaacttatgttttatttttattattttatcctgccttttgccttccaaccagcaaagccatcttatcctacactgaggtctgatcccattcccagttttttgtcaaccaagagaaaaccacactaaagtaccttctatgaattagccaaccagaataatgtattttgtaataagcaaattttaaaaaatcattaacataaaaattatatctaaatcgtttatttttcagagcctagaaggtattgagggtgagaggtcaatatttctcctccacctactggaccgttcttgagacaaaaaataacaaagagttttagcctacaagtttttcaatatgctctttcattgttatatttctatggaaccaagaaacctatgaagaacgattactcgggaacatatgtgatagagtgctaaggatgtttatgtgtgtggggattgcagagtggggagacgtgacaagggttcagaaagtgcctttcctttgaacattttacaatgtttggtcttgctcttgtactcttacaatgacctttgcagacaagaaggccttggcaaaaagcaaggtactctgatgagaatggataaattgcctttcttcttcccaagcagttacaggtcaccttgtgaggaagaaaaaaggccaaataaaatgtcacctctgtgtgtcttttgtcagtttgtgctttttgacagccactatattcaactgctacattctatttctgttctaacactgctgcatgaataacgatatgagacaagaggacatcatacttcctttccttttattagcttccataattggcataatagttaattaatttaggccagtacttagaattgttagagacaaaccagtggaaaataaaaacacacggtgttctttctgaagaaacacaaatactgttttgttttgtgtgtgtgtgtatgtgtgtgtgtgtgtgtgtgtgtgtgtgtgttttggtattatttattatttcctagtaatggtagtgttgctcttcggcaatatttttgctttgattaaacttaactcattaaaacaaaagttgtaaaaggtaaagtttttagactgacttctttttgagcttctacatcctctgtgatgtatctcagtatgttatctgagtcaaattgttgctgttctcatgatgtgttgttggatatggtatcaggcaccctgtggaggaactctctggtgggaggtggtgtacaacgtcacactgtagcagaaaacctgaaggatactcttagctgccttctctggcatttgatcccttagttctatccaagtgtatcactttatccttaggcagattaaatttcatattatacctctgagctcatttacttactctgttacacttaaggtaaaacagatatagtcatttgtcttaaccattccctcttatttagtgatatgttcaaatttcctaacataaaggcttttcttcatcattaattagaagcattagtgatcttatatagagagtctcgtggaatatagttttctcccaaattcttcttggccctccatttttaagccagttgataacatccccttttgttagttggatgctatgacatatcatgacaaaaattatgctttgtgtggcaatctgctaagtttaaaaaaaaggagaacacaaaattaaaatacgaacacttagtgtatcaaaggtcaattgatttcagaaattgtaatatttgttggaaattcatggaaagattgctatttcattactaataacaagtaatgcctgaaatttctgtggggtgattttctctaaaatgtgtaagagatatttactttgccttaccttagagacctggctattggggtagaaaagataaacttattatattatttagtaacctactgaactgaggtgtggtgtgcaatggacttaatatttgtatctctccaaattcatatgttgaaatcctaatccacaatgtaatgcaattaggagaggtaattaagtcatgagaatagaggtctcataaaagtagttagtgtccttacaaaaggtaccccagaaagctctctcaccctctcaccctctcatcctctcatcctctttccaccaagtgaagatacaaacagaatttggcaatctgcaacccagaaaaggaacctaactagaacccgaccatattgagtatgaaattccagcctccggaagagtgagaaatatatttctgttgtttataatccacccagtcttttgtactttgttagagtggcctgaactgactagtacgtgtctgtgtgtgtgtgcgtgtgcgtgtgcatgtgtgtttgtgtgtgtttcattcttgccataagaataagagtaggaatatattgctagaatatttccagatatagaagatatgtcatttgtagcatttgtcttccttcttgtagcttggcaatagcagccctgatgttttttctcttgtcctaactctgggtcactatggaccctgttcaacctcaccttaaaggagtgccaatcgtttccatctcttgtctttttttttcctctctctctctcttttgtttgaaaactgatgatatacacattagagtagaaagaatataacttatatttcacatctccataacagatttaattaattttattagctttttcattttcacggtaggttccatctttttcattttgagaagtgatgactgatgatctttgacttgctactctgcctgacttagacacctgtgatctttcaacttgacaacatctctgtgggaaattcaggtagggggcaaattgtaaattggcttgaaggcaacatgcagcagcatgatctattttttgttgttttagcgatactctgttggcagtgtgaaaagatggacaagatgcacagaaatgaagcatgattttagagactgcttgtgtaagatcatgggccaagagaatgcgaaataaagaattgcagtagatgagcagagttgagatattcaagaggatttcaaaggtatcaggaagggattctatgagtgactgagtgggaacatacgagagaagagacctttgaggaagtggaagtgtctagcttgagtgggtgaccaactaaaatatgattaactgaaaaagggaatagaaaatagaaggtttggaatttttaaaggatgtatatagtttgctatatttttaatttgtcacaattaaataatactaggagtagttatccaaccaataattgaaaagatgtccgtaggcatcagaagtaaaatatgtctcctcagaccaagaaaaatgccaggcacctgagaagcattcaacaaggattagggaaattgaaaactagcaaatgtcatatgctttaaaatcattgaatcagggtgttctcttaaatttctatgaagtaaaatatgatttttatcattactcaaatagtgactaaacattttctagagttatgacattagtgattcatgtagggacaggggttgtagtagctgtcctcctcttagccctcaatcatttctcaaatgctgttttcctgtaactctcaaattactgaaggatgacaccttgccagggcatcaggcacatcagcactaagaatcaagctcactagttttaattccctggctaattttctatggcaaatatgtaatttttctttagaagaaacacattttttgacgcagtcataagtagctttagttgtgccataacaaaggtgtgacattttttctaggcattgaatttatgtggaaatctatttgctacatttgcatcttttttttttctggacagagatgcaagatcaaattgtatcaaatgcacacacattcacatgtaagtatttagatagagtgaagacgtaggtacacagattcagcagtctgaaaagatttactgtgccagggagaaaataattacaacaaatgtttattaagcagcttctatgtgctgtatataggtaggtgtaggggcatgggatgcagtgtaaataaatgttttgcaatctgccctcctgtaaaagttgggagaaaataaacaggtacattcaatagagtaattggggccactttaggggccaaaaggctgcaaaaaagcagcttcctaacagtggctatgcctttcgagggcaaatgtcttcttagttaaaaactgaaacatcagtttgaattagactgttgacaagaagagggaggaatgattcaggaagagggagagtatctctaaatgcttagatgtcagaaagagcatggtcagttgagggcactggaagcggtttagtatgtttggaacagagggtgtgcaagttaactagtgagagctcagggttagtgagctcatgagttggaaggaaaagaagttaaaaggcagcatgctagatagaataagtaggtcagtgagtaacaacatgaaaatcagaggaaacatgaaacaattatgcttctaatttcattgtgatctttgctcttcgttgttaattaaagggatttagattaaaacatgcaattgttatttgaagaactgagagacagtaaattattcaaaatttatccatttaattggccttaataattaatgactagtagctttgtattagatgcctgaagtataaatatatcaactaataatacttgaaaatatttcacttacaatactgaaagtgattttatggactttgtaatagatggtccacacgtgaactaattcactcttaccagagttcttaaatgtgctttcatatttttacatcacaggtggtttttattttatgagtgtagtgatcaaataacttatccaaactgggacatttaaaagagcaacagaggtattatgaataattacacaaagacaatggacataaacatgtactgccctgggtaaaccaaatctatgattcttgttcacagtgtatatcacattttaaagtatgcttaaatgattacaattatataaaatttaggatagtgttttggaatggaacaaactttttcaactgcatgttttaatcttttcatagtctaaagtttgtgaactattccattttgtcttccaagttacacctttacatttttatttgtcagcatgctgaataaatcactgggagaaaaagagaaaaaaatgaacatgagaaatctctaatttgtggcactcaccagctgttaaatacacacatagctttttaaagcagaattcttcttcaaaatgtaggagaagagacttcattttattttttctccgcttttgaaacataaattgggatctagtccaacaaaaacttttagggccaatgaaaaaatgaagtattattaaagtaaaaagagagagagagagaagaaattgaaagatttactatagaggagaactgccagattgtagcatttcaatggtcccctgaacaatgccacaatactcagttattattcaagcaggtggcacattattattacagttagatacctttgcttattatgcccttgacttcacacaaaacatagtaatttgaatctaatattgtctgttaaaacttccattaataaaagaaagtgctattaaaacaaaaaaaaaatctgtggcctattgtaattgattttttttctgtaattgatggactgagttacactgtacccaggtacaccaggacagctgaattcgataataaaggaaaataattgatttttggtttcacatgtgacagtttggaaacagtgctttgtcaaatttcttaattcccatagaaagcagcaccacaagagtcaggtagatccacaatagaaaatcagtacacattgtggagttttatatactctcataataattaacataaaatagtcaatgtaagaaggtgaatctcatgcatggccatttaatacaactggttaaagtggtgttttttgttgaataactcccaaacccttaataaatgaaatcccaggaaactgtagtcatccttcaggctctctccgtggtctgacgctatacctcatttccctgttaactgcttgtagcctgtgcattatgtctccaagcgtttacttctgtgcctccttatgttcaaacatcatttcccacttttattcattgaccatactctttcaatccagcaacatttagcttggggtgatctccagaaaatcttccctgagtttccagattaatttaaatgtccctattctgtgtgtcgttaccgctttttacacgtcttcctcttagcatttgatgcattttatctgatttatttgattatatgactgtttccctttctagactataagttttttcaaggacaaagatcgctgaataaacacaggttctgtgctaaggacatatctattaattgttaaactagacaaccatttctaagtatctgcatatttgtgaagtgaaaagagcatggctttagcgtatataaaactaaatttgaatctcaactctgccccttattagtaatgtaactctaaggtaatcacttaccttatccgaactttagtttccccattttgtgcaaatgagaatattactaaaattgcggcaacagttcaatgaaaaatgcacacaaagcagcttaaacaatgttcattctcagtaagcttccctaccttacttccttttcctttagtatgtttacatttttcaaaaggtaagaaaaataccatcgggatgcatttctagaggttttttttgcatgcttaaatatgagagagttatgtactatatacaaaacttatgctgaatctttgcttttgtcttttcttgtacttacaatgcccttttcccagtcccatctctgcctggcaaattcctgtttttccttcactgcttagattaaatctcaccatctcaatgaagtccatcgaaattaattagaagaatatctgcattttttcagtatctatttaatgattatattaaaatatagatatactattaaaccaaaagtgaaatgccaaatagattagcttagctttgaattatttcaagtctaagatcatctttcaatataaagaaaataatgagacatatattgaaagcatctttggataggcaagacctcttatttttatgttggaaaaatcattaaaaatacattagaatacaattaagtaataaaaatgaaaacaaaattaaaacaacatataaatcaagcacattttagatgtcttaattggtcatgtttttgtggtaaaacgctaattccttttagtagaaaaataatgttagaagacataatgaattgtgtagaattgtatacgcttgaccaaggcatttgttacatataagaatatttagtattttaccccatagtactataaaacgttattttagagaaaagcaatgccatgtattaaaagtgggcttcgcttattttctttttaacaaaaaattgactgactgctgtccacattaattttaattttataacataaaactgcctacagtagcgtctacagatttatctgattagcagttcataaacacaaggaaataagatattagcttaatttaccttaataaccaaatcaaatttctggtgaaagtctctgtttactggctccaggagactaagttctgctgtcctaggatgcatatggaaaaatcgtgggtaatcctcaggagtccctggaagacattgagatttcagtacataattgagaacaataagtaatatgtgtatctgctttttctatttcccttcatcagctgaggaacaaagctacaatttcattagtaaattaagtttcacaattatgcagttcagggaaagcagacacaaatgtggtatatagttattaataattagcatatcagtaagaaaatggaaaatgtttggatgatttttgaaattttttttattaagagggctctaattaatttgaatcttcatcacatgaaaatagacattaagtggagggagagtaaattttttattatgaaattttattttaatggtgcataaatcttaattataactgtttggtctttcaacatatattgtaataaatgattagtaatttgtaccaaatagtgagatgcttggaaattaatgtgaacatattttgttgcatatattatttcttaagattaatatcaagctaataatgttaatcatagtaaattaaatataggttctgatgatactcttaatgtctacacagggtatttatttatgtatttatttttgagatagagccctgctgtgtcacccaggctggagtgcagtggcttgatctctgctgactgaatcctctgccttcccggttcaagtggttcccctgcctcagcccccaaatagctgggattataggcgtgtgccaccatgcctggctattttttgtatttttagtaaagaaagggatttgccatgttggccaggctggtcttgaactcccgacatctggtgatacacccacctcagcttcccaaagtgctagaattacaggtgtgagccaccacgcctagccaagatggtatttcttaatgtattttaataatcaatatacatttcttcatgaagaaatgtcttctaattgtataatcttcctttgtgtactgcaacattcttttcccaaaatgaagaagtcaaatcataaaattgtatagtatatacatttgtaaaattaataaccataagagaaaaataatatagcttcctattatggaaacctactctgtgctaaatgctttatataactaatcatcaataactaaatcatttacattttacagatcatgacttgggagactggggagattaaatgacttatttaagttaaagggacaatctgaaacagagcttttattaaaaatccaggctgccagatgttaaaacacatccaaaaaggggcttattgttactacttattttcctcaactctgagacaagaagggaaattctactgggcagtaaatgagggggaaaaaaaacagaaacatatttcacaccattaaaaccgactgtaaaatctacaaatagtcaaaattatagatgaaatgcaatatatgataaagaagttatccctcctaataggagagtcatacagaaaatcatagagtttcatacattcttcatggaatatacatgagcaaaccccaaatgaagaagatattcataataataaaaaaatgagcactagtcatagatgaaaatgtggataaattttactctaatgtgagagtgagcaaacctttcctaactatggctcaaagtcaagaagtcaggaagaaaaagagataagtttaactatattgcaaaattgcatggtgagacacaatgaacaaagtaaaaccacaagtgacaaactgagaaaacatttgaaatttatgtcgagacggccgggcgcggtggctcacgcctgtaatcccggcactttgggaggccgagacgggcggatcacgaggtcaggagatccagaccatcttgcctgacacagtgaaagcccgcctctactaaaaaaaatacaaaaaattagccagcctggtggcgggcgcctgtagtcccagctacttgggaggctgaggcaggaaaatggcgtgaacccgggaggcggagcttgcagtgagctgagatcgtaccactgcactacagcctgggctacagagtgagactccgtctcagaaaaaaaaaaaaaaaaaaaaaaaagagaaatttatgtccagacaaaatgttcatatcccgaatatatatatataggtttataaattagctaaaaatagggccagtgagggatttaaaaagtgtggggctggctcggcgcagtggctcacgtctgtaatcctagcactttgggaggctgaggtgggcagatcatctgaggttaggagttcgagaccagcctggccaacatggtgaaaacctgtccctactaaaaatacaaaaattagctgggcgtgatggcgcacgcctgtaatcccagctactcgggaggctgagaaaggagaatcacttgaacccgggagacatggaggttgcgtgagctgagattgtgccactgcactccagcctgtgcgacagagccaaactccgtcacaaaacaaaacaaaatgttcggggctagagaaaaaactgttcacagaaagagaaaggcaaatgactctagatcataagcaaagataagcaaagatgcttatctcgatacataagaagaaaactacaaattattcctacattaagatttcattagtcacttagattagcagttgtcccagttggagactgtactctgttggcgagcctgcaggaaaacagacactttggacactggtggtgttaatacaagtgttgtaaaatttatgaaggagagtatgacataagctaccaaaataatattaatgtttactttttgacccatacatcccacatctggacattttcccatttataataacggaagataaatgaccacctaaatatacatcaatagtggtctgggtaaataaatggtgatacatcctaaagcagatgataattcaaatgtaatgataaatgatagatatctttagctattactatggagttattttcagctatattaagtaaaaaaaagcaatttggaaacaagggcctataatatgctaacctttaagaagaatacacatgcatatttacaaaggaatacatacacacatttaaaaatcgaagatagactgtaacataaaaaattgttacttatgagaaagagagggaacacgtggagaggataaacactgaaactaaatttcattacccatatcaagttttttacattttagagctacatatgttatatattattataaaactaattaaattcaaggacttctctaaaaataaaataaaataattcaatctaaatgtatatttagttgttggcacaagcacaaacaaaaagaactaccccaggtgaattttaaaagtagtactgacatcacacccacagtgtaatataggtgaagtaccagagaaattacaaaactcaaaaagttaagctatctacagtaatcatattggtggtatgttgtgattccaagatagttataggagtattttacaataaataagcacattattatgtgtcattctgattctattcttttcagtattgaaagctggattcttggcaggggatgataaagagatagaaattaaaaattaaagaggtaaaatagaacacctatggttttgattttgaattggcagtggaagtttaaactcaggttgtagtttatcttaagaaacaaaatgcatacaacacagctctgaatgctgaaacacagaactatatataatggccaatatagaagcgatgaatatttctaatgttcagactatggttttgaaatactatttaccaataaaagcacttaagatttctgagagagagagctgatttcaggtccagggcagaaaatcaacaaatagctgtgaaacatctgctcacactaagtagcaagaaagaattccgagactactaaactgatttgaaaagttttcaagagccaaaaggcttttttttgtttttttgttttttaagctaaagataagacaatttgagcatcaataaggatcatatcagtaatgatttgaaacagatcaaatatgtttaaattcataagtttacgagtgttgcaaaataacgtattgatcacttttggagcatgctagagaaatattttgtaaattagaaaataagaaaacagagcatgctttttccatatgagcttaacatggggtaaacaaataattgattaaaaagtgtctcattaagaaactatttcagctaataatttaagaagagtaatagtatcagagtgccatcattttacaacccctcataaatgaatggatcatggcattgagcactaaatgctgctaatatcacaaaaaaagagataaagccacatacataccactcaatagaagaattaattcaacatcatctgctatggcctgagttgtccccctcaccattaacaattttatgttgaagcccttactcccaatgtgaccattatagagagatagacccttttaagaaggtaatcagattaaatgagtctatatgggtgggctcttaaatctgatgggactggtgttctctttgtctctctttctttctatctcttccctctctctctgtccaagggcacacagaggaaaggccatgtgaagacacaagaaagcagctggagaagcttcatcaaataccaaccatgaaagcaccttgatctcaggcctccagaactgtgagaaaacacctttctgttgcttaagctactcagtctagggtgtttcttaatggtagtgcaagcagactattataccacctatgaaacagttttgagaaaacccaacaaagaaacaaacaaaatatgttatttgattaagtgtcaaaatttataggaaacatgggacagagtaacatgtaaaattaaaccaaggaaagtacaatcaagatgacgagaaactctataatataaacaacttgacttctcaataaatgaatcacaagaaaacaatttaaaaataaatggaaagagaaccactgtagattaaaagagacttagggctgggcgcagtggctcacgcctgtaatcccagcactttgggaggccgaggcgggaggatcacaaggtcaggagatcgagaccatcctggctaacatggtgaaaccctgtctctactaaaaaaaaaaaaaaaaaacaaaaaaaaaacaaaaaattagccgggcgtggtggtgggcacctgtagtcccagctactggggaggttgaggcaggagaatggcgtgaaccaaggaggctgagcttgcagtgagctgagattgtgccactgcactccagcctgggtgacagagcgagactttgtctcaaaaaaaaaaaaaaaaaaaaggagacttaggagaggctgggcgtggtggctcatgcctgtaatctcagcactctgggaggccgagacgggcagatcaccaggtcaggagatcgagaccatcctggctaacacggtgacaccccatctctactaaaaatacaaaaaaaaattagccaggcttggtggcgggtgactgtagtcccagctactcgggaggctgaggcaggagaatggtgcgaacctgggaggtggagcttgcagtgagccaagatcccgccactgcactccagcttgggtaacagaacaagactccatctcaaaaaaaaaaaaaaaaaaaaaaaagagacttaggagaattatcaatcccaacgtgtgaacttacatgaattctggtccccttgcatctctccctttccgagaaaaacaaaaacaaaaaaacagaaaagaaactaaaaaacaaaaataatatttgtgagaaagtgaaaataaacactgactgatatttaatattaaataaggattgttatactttttatttgtgctatgatattgtcagaatgctctaaaaatagttattttataagcataaattcaaatatttgtggattaaaattatatattttttcaaaataatgaggaaaaaaattgatagacatatatattttaataagtttggccaagtcttcataattcttgaaactaagtgatgccaaatggtgattttatttactatctcttattttatatatttttaaataagagttttcaaaaatgcaatataatttatcatttgctttggtttgcttttaccctagctttcatcagcatagaatggagcagggctcctggaagaatgaacccaaaatggtgaagataattgaataatagccgctgagctgggaaagattttcatttcccagagagtaatacttactagctgttaactagttactacggtgaaaatgttataatctctttatttgtaaatgatctatctcatctaagtttcaaaacaatcttatgggaaagatatttattgcttgatctgtgaagaaaccaacactcacagaagttaagtaaaatattctgaactctcacggctagtaaatgactaggtcagaagtcaaggtatctaaattcagagtgtaaactctttcctgttatgctatatagcctgagttcagtgaattagacactttggcttcatcggccatctgtttctggaaggttggtttttagacatccttacagaatatcaactcaacaagagtataactagcaattaaaaaatacatctccttagcactttgggaggccgagacgggcggatcacgaggtcaggagatcgagaccatcctggctaacacggtgaaaccccgtctctactaaaaatacaaaaaattagccgggcgtggtggcgggcgcctgtagtcctagctactccggaggctgacgcaggagaatggagtgaacccaggaggcggagcttgcagtgagccgagatcgcgccactgcactccagcctgggcgacagagcgagactccgtctcaaaataaataaataaataaataaataaataaataaataaataaataagtaaaataaatacatctccttggacaaagagtaaaaccaagtgaaatttatttccctgcatttcttaaaagtgtaatgcttttccagcgaggactaagaacacttaatgtttgtgctttcattatacacaatgtttacagtcaacctaaagctgttctttagaaacaaaaaattagccgggcgaggttgtgggcacctgtagtcccacctactggggaggttctttagaaacagctttgattgcctaaatttagatgtaaaattgataactatgtttattatcacaattataaataatacggtgaatttcagcattataattattagagccaacataattagtggttgccaaaacatttattttaatttttatatatgctaagaaaattctacgtttttcactttttcagtattatagaggaaatggcaacctaaattaatcccttggtgaaaagtttacaattttgaagattacgggttttctgtaggataaagaaaaaatgctacacaattatcttcatatatttaaaatgtagaattttaattacacgtgttgatcaagatagtatcaccatgactaagatagtaagcctatccataattgccagaaatttccttatgacaatgtctcctttctctccccattcatatttctcaccctatgcaaacactgatcactttctgtctgtcagcataataggaatgggatcatttatatagtatgtattcttttttttttttttaattttgagaaagagttttgctcttttttctagtctggagtgcaatggtgctgtcttggctcactccaacttctgcctcctgagttgaagcaattctcccgcctcaacccccagagtagctgggattacaggtgcccaccaccacgcccagctaatttttgtatttgtagtagagacggggtttcaccatgttggccaggctggtttcgaactcctgccctcaggtgatccactggcctcggcctcccaatgtgctgggattacaggcatgagccaccctgcctggccttacagtatatattcttttcgtaggtgtgtctggcttctttcaattagcataatgattttgaagtccatgttgtttcatttatcaatagtttatttatttctattgcctaggtgttattctattgtatggatatgctacaactcatttatctattcatacattgatgaacacttgagttgcctccagccacaaataaagatgctatgaactttcctgtatacctctctgaatgaatctatgctttcatttatcttgagcaaatatctaggagtggaatggctaggccatatgatatgtctatgtctaaatgttttattaagaatttttgggcagggaacaagtctgttaattttcagttacgtataggtttgtgtagtcaataccacaatcgggatatagaatggttttatgatcaaataactactttgtgttttccttccccaaagttaaatctttagcaatgactgatttgttcatcaccaccgtactttcatctttttgagaatgacatttagatggaattgtgtagtataaagatttggagactggcttctttcaactcagtataaagcattagagattcctccaagttgctgtgtatcaataatattatattttcattgttgagtaatgtttaacttttaaagaaattgccaaattatttttccaatgtgtctgtaccattttacattcttaccagcaatgtatgagcatttcagatcttccacattttcaccaacacttgatattgtcagtcatttaaattttggccattctggtgtgtatgtagtgatattcattgaggtattaatttgcatttcccaattagctaatgacattgagcaacttttcatattcttattttgtttataaatctgtaataatttgttaaaactttctgccattttataattgtctcatttttattaaattgtgttttcatatattccccaaacaagtcacttgttggatacatttcgcaaatacattctccttttctgtcagttctttttcagtctattgtcagtgccttttgaaaagcaaatgcgtttttactttgatgaagtcaaattttaaattttttcttttatagatttgcatttgttacatttaagaaattgttgccagccgggcacagtggctcacgcctgttatcccagcactttcgaaggctgaggtggggggatcacctgaggtcgggagtttgaaaccagcctgaccaacatggagaaaccccgtctctactaaaaatagagaatcagccaggcatggtggcacttgcctgtaatctaggtactcgagaggctgagggaggagaattgcttgaatctgggaggtggaggttgtggtgagccgagattgtgccgttgcactccagcctgggcaacaaaactacgtctcaaaaaaaaaaaaaaaaaaaagagaaattgttgccaaccctaaggtcataaaaatctttaccaatattatcttttagatgctttatagttttagctcttacattatgtatagaaagtctttcaagttggtttctatagatagtgtgaggtacggattgaagtttatttgtttacatatggctgtccaattgttctgcaatgttggttgtaaagattaacttttccttcttttaattgtcttttgcttcatattatttttgaagtgtttataccttaacagttttttctcatagctgtatttgcctatcatttattagcataatacttctgattccctacatatagtaaattgaaggaaatgtggatgcctgacctaaactatataattaccacttaatctttcaataatttttatttagagcaaagaatcagaagatggatgtacaatctgtaccacaaaaataatgggcatctagaggaaaggccctctaatccctcatcttgaaattcctgtttctgcttcttaaaatgttattgtttttgacagttccttgaattctggaagaaaacaaagtcctttcaataaatttccttaaacgccaagatgaacttaagttcacctctgtattttttacccaaagaggcccattcaggaaaacatttgtttttaatgcttcatacatttgaaaatgcacatctaatatacttcaaaggagcactacctcaaaaaatacagtatcaaatttttcccttcaccactgaaaatgtttatctttacatataaaattagtaagctgattaacacagaaataaaagagaacactgtcttctgggtgccatgaagatgtgtggtaattcctcagattttgacattgtagatatatagaaattatagtcagtttcaataaaacactgctaatgaaaacacccacaatttcctttggtagaacaaaaacaattataacatgtaacttatctctccaggtaatttttttgtgaaaaccttttaatgaaccatgaatgctggataccctgcagaagccaaggtattgaaatgtaaaaacattgtacgagaatagaaacacatgtctaagttcaaggtccctacagaatcccttatttatcccacttagaaaatgtaatataaactctatttagcaaagcttaattcatctaaaaatatagctgcttctgaaccatctctgaagctctgggttttatttctttttagtcattcccttatttgatcttgggattaattatattaatattccattcctctgacattaaattcacctgctaccccttttacataactaaaattttgttgataattttaaccattattttcatctatgccctaacaacacatttgtttttgtatcaagttatccctaggttcaaacatatattagaaaaattacctctaatttctcattattttcttccattaattttaactttagcactttttcttttcagctaatatgttctcttagtgcattctttgataattctaaatgcaaaaagtaaactacctttgtcctgcttttacagcttccaaaaatcattagttctaaatctgtctcctttgcaaaacttctttttcagctacttgttataaataacgaacttcattttcttatcgaaaatgtttttaataactgtgtaatagccaccaaaataatttaaatccatttttacatattattagggaaaactaaaattcttatcttagtagccaatatctcaacttcaaaaaatctttaccaaagattttattgggttgcttttcctatgcatatttatgacaatgcttctgattgtatagttcaggtatacctacactagaaagaccgagttcttgtcccagatcttctgaatcagaagctctgaaaagggaggtcaagagaatgcactttgaacaatctcactgaattcttgtatcctttaaagtttgaaaaccacctcttcatggtacatgatacgttcatatctgttatttaaacataaaaataattacaaaattcagaaactatgttattactaatagaaccaacattttttctgactacgtagattcaaatccccaagttactttcactagccagttctctacacattttccaagtgattcttccttaccttagaacgtctctctgatgtgttcctttttcatagtcctaatctcttaccttacttagacccttgtcatttcatacttgtaccacggtgatagcctcctaatatcttctgacattccattcccttataatcactgaaggaaactttctaaaacgctacttttattgcccaattatctagacaaaattttatctattgtgtactggggtaacccctaaaatagaattgagaataaaaggtataaatttatttttctttatgattgattcaatttacatatagtgaaatgcacagatcttaagctttaacgttttaggggcatagacccatgctattaccactcctattcaaactttatatttatttttaaataaaataatacaaaagtaaacttagctaatgctttatatactgactgacactgtgtctctgtatgttttagggacaagcaaggaatcttgagggagatgtgacaagtgtacagtgtgaagggataagcagcagtgtattattcagagttctttagagaaacaaaacaaataggctataaggacatattagtactgacagtgagaaagaaagagagagagagagggattgattctgtcaatcaattggctgattgattatgcaaatttgttgttttagtccattttcacactggtgaaaagacatacccaagactgggcaatttacaaaggaaaaaggtttaattggacttacagttccacgtggctggagcctcacactcatggtggaaggcaaggaaaagcacgtcacttcttacatggatggcagcaggcaaagagagagagagcttctgcaggggaactctgctttttaaaaccatcatatctcgtgagattattcactgtcatgagaacagcaacggaaagacttgccaccattattcagttatctcccacatggtccctcccacaacatgtgggaatttaagatgagatctatggccaggcatggtggctcatgcctataatcccagcactttgggaggctgaggcaggcagatcacctgtgtcaggagttcgagaccagcatgcatagcatagtgagatcccatctctaggtgagatttgggtgagacacagccaaaccatatcattctgcacttgacctctcccaaatctcacatcctcacatttcaaaacaattcatgccttctcaatagtcctccaaagtgttaacccatttcagcattaactcaaaagtccacagtccaaagtctcaccagagacaaggcaagttccttccacctatgcatctgtaaaatcaaaagcaggctagttactttctagatagagtggggatacgggcattggataaatacagccattccaaatgggagaaattggccaaaacgaagggtctacaggcccccaagtccaaaatccagcaggaaagtcaaatcttaaagctctgaaatgatctcctttgactccatgtctcacatccaggtcacactgatgtaagtggtgggcttccacagccttggacaactccacccctgttgctttgcagagtgtagccccctcctggctgctttcatgggctggggtcgggtgtctgtagtttttccagaggtactgtgtaagctgttggtggatctaccattctggggtctgtaaaatggtggccctcttctcacagctccactaggtggtgccccagtagggactcagtgtgggggctctgaccccaagtttccctcctgcactgcactagtggaggttcttcatgagatccctgcccctgaagcaaacttctgccttaacatacaaggcatttccacacatcttctgaaatctaggtggagcttcccaaacctcaattcttgacttctgagcactcacaggctcaatactttgtggaagctgctgaagcttggggcttacaccctctgaagcagggcctgagctctatgttggcccctttcagccacagctggagcagctaggacacagggcaacaagtcccaaggctgcacaagcatggggatcctgggcccagcccacagaaccatcttttctccccaggcctccaggctggtggtgggaggggctgtcatgaagacctctgaaatgtcctggagacgtttttcccattatctacaggattaacatacagctcctcgttacttatgcaaatttctgcagccagcttgaatttctcctcaaaaaatgagattttcttttctatcaaattatcaggctgtaaatattctgaacttttatgctctgtttccctaataaaactgaatgcctttaacagcacccaagtcacctcttgaatgcttttgctacttagaaatttcttccaccagataacctcaatcatctctcaagttcaaagttccacaaatatctaaggcaggggcaaaatgctgccagtctttttgctaaaacataacaagagtcacctttgctccagttaccaacaagttcctcatctctatctgagaccacctcagcctggttttcatcattaatatcattatcagcattttggtcaaagccattcggtaagtctctagagagttccaaactttctcgcatcttcctatcttctacagagccctgcaaactgttccaatctctgcctgttacccagttccaaagtcgtttctgcatttttgggtctcttttcagcaacaccccactcctgttaccaatttactgtattagttcattttcacacagctgataaagacataccagagactgggcaattttcaaaagaaaaaggtttaattggacttacagttccacgtggctgaggaagctttacaatcatggtggaaggcaaggaggagcaacccacatcttacatggatggcagcaggcaaagagagaacacttgtgcaggggaactcctctttttaaaaaaaaatcatcagatcttgtgagacttattcactatcacaataacaacacaggaaagacttggccccattattcaattacctcccaccttgtccctcccacaacacataggaattcaaaatgagatttgggtggtgacacagccaagcgatatcatttgttatgaatgctaagagcatctactctctgcaaattagagaaccagaaaaactggtggtgcattttttatcaggtccagaggcctaagaaccaggggagtcattggtataagtctcagaatctgaaagcctgagaactaagcactgtaatgtttgatggcaggagaagatggacgttccagttcaagaagagagaactcatccttcctctgcctttttgttctattcaggccctcaatggactggatgatacctgcccatattggtaagagcagatcttcttcactcagtcttctgattcaaatattagtctctttttgaaacactctcttagacagacccagaaataatgttttaccagctctttctacatgccttaaatcagtcaagctgtcaaataaaattaagcatcacaagcagccttctctcttgtctgtttgctttcaacacattgcagtgacttttagtttacatttggccagttaaagggatctgtattttataatattaattttacaccaaactaatgctcaaaaaaatgaataaatagctgagaaatatctctgcaaataaacctgagattaaaggtaacactaatgatatgtgtagaagtgaacaccaacagagatggaaaaatcccttcccattcctctgctaaaacagcttaatcagtcatgttattaggtcaaaaccgtggagatccaggcagaccggaaataaagtcagactgacaattttgatgtaattaatacaattatttataatgttgacttatatataatacaattaatcattttctatgtgatatatgaacattgaaaatttaatgactgataaaatacatgtataattcttaaatattagagtgtgtactcaaaaatattttttaattcatgggatgaaggatcataaaagttatgtattcattataaaatgtagctatcattaactaaatgatatggttttggctgtgtccccacccaaatctcatcttgaattgtaactcccacagtttctgaatctcatgggaggaagcttgtgggaggtaattgaatcatgaaggcgggtctttcctgtactcttctcgtgaaagtgaataagtctcacaagatctgatggtattaaaagtgggagtttccttcacaagctctcttttcttatattttgccatgtgagacatgccgttcaccttccgccatgattgtgaggccttcctgaacatgtggaactgtaaatccattaaacctctttcttttgtaaattatgtagtctcaggtatgtctttatcagcagcatgaaaacggaataatatactaacatacacacacaatcttgcctaaagttatttatgtcttaaagttcagagctccactttatgaaccctctcatctccttgaattacttgaattagatcaaagatggaaaacattttttgtttcctaacaagtaaaataatctttttttcccctcaccttaaatctgggcaggaattgtccttgctttgaccagtatatgatagtagattatttctactgattcagttctgggatcaggccttcagaagtttgatagctttcacttttgccttcttaaaaggcaggcatacatgcaattaaatggactattttaaataaattctataaagaacattttctttaaaaaataatttccaaaatgtagaagtacattaaaattagaagaagcattctagagaatggtaaggcatgaggaaaaatacaccttgggggatatatttaaggttatataatgtttgaaaaaaccacatgtgctcagctataagtgttcagttataagaacccagttgtgtagcacaaggatcatgaaacaaaagaaaatataaacaaaaaataagaaaacaaaaaaggaaacagaaaaatatggactctctgataactgtgaaatatgaaatacaaaatgaaatatggtaactgtgaaatatgaaatacacaatagaagaaatgttgggcccatgaacattttcatcccttctcaatgtgatatatgcattgaggaagggacaaaaaatgtgtttttctcttcacatttccaatatgagtatactgtatacttggccatgaaagtgctaatacttgataatacctaccacagttaatgaaggttgataaaaaaatttaaaccaaggtttctggctctagtatctccattcttaatcaatgggtgacaccaacattttagttgccagaatattcataatattattataatcatactttgaaaaattagaaaaaatactgttagcaatattatatttatgttttagtatgtaacatatatctcatctatatgatatttaatacatattacttttcacacattagctgctcatataagagtacttaatactacaagctactgttacaagctaaagtcagcagactttcttatattattagaaataaatacacattgtatgatatcattattaatgacagtgctgcaacagagcttgatagctgttaacatttacattaaaaatggtcagacttgataacacaattagaagcagaaatttcagctacatatatgattaaggggtctacagattatgcttttctttcagagaccttcatggcaggtttctccaccataggccttgagacttaggaggaaagaatggttttgtgggccaggaccacggctccactgccctgtgcaacctcaggacactgcttcctgcatccagccattccagctctagccatggctacatggcccccagatatgcctcaggcctctgcttcagagcatgcaagccatagccttggcagcttccatgtgatgttaaacctgtggacacacagagggcaatggttgaggcttggaagcctccacttacatttcaaaggatgtatggaaatgtctggatgtccaggcagaaatctgctgcaggggtggagccctcatggaacacctctaccagggcagtgtggaagggaaatgtgaggtgggagcccccacacagagttcccactggggcactgcctattggagctgtgagaagaaggcaactattctccagaccccagaatggtagatccactgacagcttgcaatgtgcacctggaaaaggcacaagcaccaaacaccagcccatgaaatcagccaatggggctgtactgtgcaaagccacagaggcagaaatacccaaggccttgggagcccaccccctgcatcagtgtggcctggatatgagacatgaagtcaaaggagattattttggagatttaagatttaatgactgccctcctgggttttggacttccatggggactgtagaccctttgctttggctgatttctccttttttggaatgggtgtattcacccaaagcctgtacccccattgtatcttgtaagttttttcaggctcataggcggaagggacttgccttgtctcagatgagattttggactgtggacttctcagttaattctgaaatcagttaagacttggggaactgttgagaaaggatgattgtattttgcaatgtgagaatgacatgagatttcagaggaaccaggggtttcatgatatggtttggatttgtttccccacccaaatctcatgttaaattgtaatctccaatgtaggaggagggacctggtaggaggtcattgaataatggggggaaatttcccccttgctgttctggtgacagtggtgtcagtgagtgagttctcatgagatctggttgtttaaaagtgtgtagtaccaccccttctctctcctgctctggccacgtaagatgcgccaacttccccttcagccatgattgaaagtttcctgaggcttctccagccatgcttcttgtacagcctgtagaactgtgagccacttaaacctatttttatttataaatcacccagtaacaggtagttatttatagcagtgcaagaacagactaacacagaagaggtattaaatattctctaatggtagaatttaccagtaaagcatctgatccagaattcttctttgtgggaagatctttttgattactaagtcagtctattaacttgttaaaagtctaccccaattttttattttttctgaagtcagtttgaatagtttgattccaggaatttgtccattgcatccatttgtctagttggcataaattgtatataatattccctcataacatttttttatttctctaagctaaatagaaggtcctctctttcattccaagttagtaaattgcatcttatctcttttattcctggtcagtctagctagaggtttgttaattttgttgatgatttcaaagaattgattttggcttcatttattatctctactgatttcctaatccctcttttattactttccactgtagtctctattatttctattgtgttgtttagctttctttctttttttttttttttttttttaaagagagtcacctccaatctcctccatcactcaggctggagtaaaatgatgtgatcgtagctcactgcagccctgcagccttgacttcccagacccaggtgattctcccaccttagcctcctgagtagctgaggccacaggtgcacaccactatgcccagctaattcttgtattttttgtagagacagggtttcgccatattgcccaggctggtctcaaactccaggtctcaagcaatccaactgtctcggcctcccaaaatgttggaattacatgtgtgagtcaccacagatggcctcccttctgctctttttctttagtttgcttaacatttccagtgtctttgtgacaaatattacattattgattagagattaaaatacatgttacaaagtattgttatttttatttgtctcaaagtatttttctgattttatttcttccatgagtcattgattaaagaatgtttaacttccatacacttgtgaatttccaaaatttccttcattataatttctaattgcattccatttttgtcagagaatagagtttgtattatttcaatcatcttcaatttaacgatattggttttatggcctaacatgatctatactgaagaacattctaggtgcacttgagaagaatgtgtattctgctgttagggggtagagtgttttgtagatatcttttaggtctagctgctttatggagttgttccatcttgaccttaagttactgcatttgcagagtttcaaggttagtcagagatgagagcttagggccttcccaagtgcttcctgagtatatatacagcttgcttttatctttttagaatcccagaaatatgttaaactttttaaaactccctatgaacatcattatctagcttttcctttaaagacttttggctagtcaataattctgccattgatgttcatgacagtagaaccattgaagaggttgacaacagcccttggatgacctcgtcatagacatcagcatccgtatcctcacatatagtaaacagagactgtctataacaaatggaagcaggagaggagtcgtccatgtggtaatttactgttagcttggagaaacacatatattcagaagtatttgtatggatttagggaaaattaagagttttgacaaagtacgtgaagtcagagtcatggatatccccttctgtgtgtgtgtgtgtgtgtgtgtgtgtgtgtgtgtgtgtgtgtgctgtgtctggtttttgtttttgtgtttccatttgtaccagactgatgtgacttaggtaacatgccttattttccttcctaatgctaataacaatgtcaactaaaatgtattgagcattaactttttttccaggcagcattatgtacatttacaatgtattggatcaaattctcacaacccttttgtacaaagatctatttttgttaatcctatattaaagaagaataatctggtcaggtagtggctcacgcctgtaatcccagaacttagggaggctaaggtgggaggatcgcttgaacccaggaagtcgaagcttcaatgagctatgattgtgccgctgcactccagtgcgggtgacagagcaagacactgtctcaaaagaagaaaataagaaggactaatttcaggtaaaggggggctaaataacttaaataaaattatgtctagtgtgagttaaagtcaggatttttaacatggacagtacaatttccagaggctacactctcaacccctacaattctcttccttctaaaaatgtaaatagtgtaaaaggatattattcatttaccttagctgtgacagcaaataattgtaagagtttatatctattgtttgggacaatccactatcctacggttgtaggctgatgaaactttccatcactgtgtcacttttctgttaaaattttttaattggctcctcatttcactcagagaaaaatacaaagtagataaataacatacaaggctctctagtttctgctctgttcttatctgtcacctttctacttttacctcactcacttctttccagtacttccggcccccttgttgtttctgaaacccacctggcaagcttcagttttgatctctgcctagaactcttcccggagatatcaacgagaataacttcctcagcttctgtaagcctttgctaacagcttaccttttgatgacacaagtgctgatgatactgcttaacactgcaacttctactacaatcctcctctgcttttccaatcccattcatatgatcgatttttcccatagcattcacaactttctaactttgataataaacacttacttattatagtaaatgtttattgcctatctcttctgccagaaaactggctccacaaagtcagtgataggggttgcttcacagggtaggtgatcgtttgttgagaaaaagaatgcacataacttttaaaagtgaaataaacttgaacaccaatgcatccaactggctctgagtatcataattatccaagtctgttattaaatttcatcctttggcttttgcacatgctgcattatctatatagataattgtctctctttttccacctggaaactcctgtctttctgctaaaatgacacttcctaagcaattctcataaaatgcttaatgctctcctctcatgagcctacatgtggttcaaactttatttagagtgccttaaatattgtattttaatttatcttttacgttgttttaatgttttttagccacagactccacgactccctaacctagaacattcatctctcatatttgtgtttttagcatctaataagagtgattgacatacagtcaagccttcagttaatgaaataaatgatgctttattatctacaccaagatctctatagacttaaaatagtttctgtttatgaaagttttttacaaatataaaagtctgagctctgcttatgatatttgtgtctttataaagaccaaaggcttgaaacagaattgcttgaattttctttacagacagcatttctaagaaggatacagtatgatatttgcaaatctaatatctgttggttgttgtgtatttgtatatgcacataggcttcaagtaagaggacagaaaggggttgagggctaatgctgaactccattaaagttatttttcaagcacacttcaaaagaagccctttctcccttaaaagatatatagcctgtctcacatgcatctgtctgtctagaggctatgcaaatcagcaacatccatatttcagcaaaagcaatctaagaagagcagcataatcaatttctcatcatttttgcttttgacacaattagtagtatatgcatagggatggattaggatggtttctgtggaatttttcaagaaaaatatttaccaaaggttaatatttcgtgttcccttgggctaatcgtgctctctcaccttttttttttaaatggctccaaaatagctctttttaaattcagtcatatattatcacaattatgtatagtaaccaaccaaaggtaaaacacgtgtaaaatgtttttcattttatattaaagctgaaagttggtgctagaggaagttttatatgataagttgatatgtagaaaaatactaatatgtaggttaatttcctaatattttgaattgctttgcttcttccataaaagttattcatttatcattctacacatttcagtccaacaaattgaggaagcaaatatcttgaattattatttttaaaatgtgtttatacacaaaagtaacaatcatgtcaaataataaactttgttatttaaaatatttccttggaattgagagaatttgttactgtaagattctagaataactgatagtgtaaaatgttatcagatacaaaccaacaaggatggaatagaggattcctggcctatctgatggcggttgaatattccggtcctgatcaatggcttggattggtggcgtaacaataatggggttcagttcttcctgaaaaaaaaattaagagagtttcattcagccgcattactaatacttcatgaaggattgagacagatgctttagtttggaaatctatataacgtctgagacagtaaactcaagtttcaacatttatgatctaataccttttactagttaattttgaatgttaagggggagcaaagtattctcaaagtcaaaatggtaagacatagtgattatgcacatagacatttatatcagtaactactcctaaaaggaaatcaaggaagaatgataatgcacttttaatcttctctagaggatttcacaaaagaaatagcagcctatcaaatagtttatgaagtaatgttttctctttgctttagacaagatttgtaagaatacttgtattctttccttgctaaatcattttttagtttcatacacatcaattatattaaaatataaataaagtaaataatttcataaaaataaaagtcacattattgcaaatttcatataattaaaattgattttaaatattgcaggtatttacatgtattttacaatggtctataagaaataatgtttaaaattataatatacttctttaatttggtgtttcccaatttaatgtccagtactattttgttgtgctatcaggactggcaaacatttttctgtaaagaaccagataataactatctttaggctttgccaaccatatggtctatgttgcagctaccctcaactctgtcattacagcaccaaagcccaagtgggcatggctctgttgcaataaaacattacaaaaacaggtggtaagttatatgaggttactgactactgtgatcataatagatatgctaaaaatacaacaataggtatgttgaaaaataataaaaagcttatctacacagatatgcttgggaaatatgatattaaatacagttttgaaagccaattaactgtactgcaaatcttttcagacttaattatgctaatctgcatactgactttctaagaaaagggtactatttgctcactttcaagaaacacccattaacctgtttttgaaatgatgcctttagaacacagtttgggaaacactactctaagttatgtagccctcatcccaaatatgtaagtggtaattctaaatgaaatacttctaaagggtaattctaaagggaaattccattacatatttgggctgagggctgtgaaacttaaactactgtttcccaaacatttagtatgtctcaatatctacaaccttacattctaaaaaattactgcaatgttctcatattatttcttctcaaatgacagaacattgaaatatgtaatgtacttttatacaaaaccagtagtttcagttctcagcaaaaatgtatagtgatggcatgctaaaaaaagagcaatgatattaaaacattatgtataatacttgattttatattgaagttataataaggataattattgaccaataatttaaacaccatagacattgtatggggtttctctcgagttcattatcactaataggtcctaagtagtctaaatgttatcagtattttcctgaaaataaagagttgttggtagtagcaacttactaatactctattctctcctttaaacgtggaatcagaaccacgaaaataccaaataaatatcaaaattactccattaaatccagaagattattgttcttaaaacgcaactctcactgaacttttcctcccatgctgcctctctctctctctctctcacacacacacacacacacacacacacacacacacactttcccaataatcaatttgcttggtatgcaatacctgtatttctccctaaactgaaaaaaaaatctgaagttctttgaaatatgtatgtttgagcacaggacttaagagttgacaagctctttctagtaatttcactgaggaatctgattgccatcagccaaagtcagcttatacttaagctgtatcactcctggttcatataattaaatctgcagtaatttttccaaaaccgaggctctatttggatcctgtaaaggcatttcaaatctgaggattttctgcagttccattctgcatctcatagtcagaaaaatattttcctaaacaatttttgctattataaaataagtaatttcttatctagaaattaaaataaaattgaatcttagcttttcgtttggaatgtaaaatgtaagcaaatcacaatatttgaggatatgttggctgatcaccttcatctatttatttctatagatttgctaagttacctacacataagcagttttagctttaattagtaatgtagtataaaatattctttctataatatatagaattgttgaaatgagcaacataatttatttacattgaattgttgtataagcaatgtaaaaactaaaagtaacacatcaaacaaaaccaagaggaagggagaaatgaaaattaaattcctcatcttacacatttgcctgtgattaaatatatatatatatatatagagtaagaactgaagaactaaaaagaaacaagtgtagtatttagaattatattaataattagaagatgaaaaactgtgagtatctcaggatactgagcatggaagtgagggtagatgggatagaaaatattttacataaagccatttggtactgtgtgactatgtcattaccatagcccgtactatttgttttaacattattaataaataaattatagtattgagaataaaagaaaataaactctcttgataaaggctttcacaagtttctgcaaatttaaaagaaatggtgtggtttaaataacttatcagaattgacattttatcttgtcctatagagactagcaacttattttacaatatttatttttccttctgctaccataaatgaaattgtcagataatctaggattaaaggtgaaaagaatgatttcttaactattatgtgtatgattacctctcaagtaaactgtgctccatgaagcttgaaatgtttaaatattattaatacatgacattaaagaatactaaaaattatgatttttaggatgaccttgttaaatatttaacatattttataaagatatgtagcattgaagtcagaggcagacaatttatatacattaattagaagaaacaacataaataacatgcattatgtttgaacttctgtctgccaacacaacctccacagtagatgaaaccaggcctggaaagggtattcatataagcaagaacaacccagattgaaatggttccttagaataagtgagaattttacagagagaacagaagtaaaataataataataatatgtacgtattcagttcaagtatttttttttaacaacagggtaaatccaaagaaaactgagtaaaaataaaatgaaaaaggaaaaaaaaaagtagtatatagtagtaaagtatccaatgctgatgaacaaaggaaacagataaaagaaatagtctttgattaccaagtgccagcatattactgtccttgaatttattgaaaaatagtatccttataatgaacctctttttccctaagttagtttcaggtcagttctctgactttaaacctagagtaccaatctaataaagggctaaagataagagaataacagatggtgtgttggctctcttagagacatttacttaaacttctaaattctgttatttattttcttttgctttttttttttttttttttttttgagacagagtatcgctctgttgcccaggctggagtgcagtggcgcgatcccggctcactgcaagctccgcctcccgggttcacgccattctcctgcctcagcctcccgagtagctgggactacaggcgcccgccaccacgcccggctaatattttgtatttttaggagagacggggtttcaccgtgttggccaggatggtctggatctcttgacctcgtgattcacccgccttggcctcccaaagtgctgggattacaggagtgagccaccgcgcctggccaattctgttattttcattgaacacagttacagctctatgaagagaacagaattattcttgcccatgaattgaaataatgtaatcatttacaggatttagcaaatagcagatatttaacataattttgccaacttattctgttgagttatccaaagagatcactactctctggtcaactttgtaatatccactagcagaaaatagtccatctgtggctactgccaggtcttccacagttccaaaaaggagattgattcagtgacttgtttcttctgaagaacagagtctcttcacatagacaataattgctgttgcttattctctgtcgtcctcatttctcctagtttttgactttactgcctatattacagaggaagtacggtatgtgttgaagaaattagaagtccacccatagctcaaatatgcttgggtatcctttatggaaagtatcaaaatgttcctctattttattacaattgctatatttatctttttgccaaaagctttattggtctgtgggcagaaattatcttatttgtacttacaaccctcagcctagtgcctcacagatttcaacaaatttttgttatcaagtcaagaaacacagaaagagctccccaaaccctggatggttcttttatactttgcctctgaagcaaagctgctttctttgctgtctcatttgtcttcaagaagaggtcatgtctcctgaattctgttccagttgataagcatatattagaagcacacaggatagcagatttgcatttcattgctgtttgaactgtcagagctacattccctgtcttagtcatggggacacataagtaaagtgaattaggtccatataaagagattcataatgagaaggtaatcatagaaacgattaaacaataacaaaaaaagtcttctgtgaaaatactgtgtaattatatggtttaagaaccttaaaattattattttaattttaagaaccttaaaattattctattttgaatacatgcttcctattcattagcttttctggagacacaccttctcttttgagcaatgttaagacaatgttttcatgcagaactgttgtattattctgagaggataacagtagccaattaacatttgatgtgagtgagggttaattatgcctcatgaaacctcactaccagattgaaaatgaacttttggtctgaattctatttttatatatatatatatatatatatatatatatatatatatatatatatatatatatatacacacacacacatacatacatacacataatcattaataaaaatatattagcaagcaatcccaaaagattaagaagcctttttgtagatttaataaaatctcagctttctggtcatttaggtgttcatatggttatcttgaacaaaaggtatattcaagagaaacactcagatttcagagattggatacattcactgtttagcttatatcaggttaacagaagtcatgatccatagaacaataagatttaacctattatatcatccctaatgttaaatgcatacatgatgcctatgattttcactgtttcatgcatgggtaggttgtctttaaaataatatgaaaccagttcttacttttaaaatacttctcacttcaccaatgaaaaataatatctatcatttacacaagttgatgggtcagtaaacttaaaaaaatgacatttcgcagactgattattaaagcttccagccttggttgagatagacataatagaagcattgttaaaatactaaatattctcaacttggcatttgaatgatgtcttcatctgagtaacgtatacatagtagtatactgaatgtgcccaagtatttcaaattaactgaaggcattataattatcttcaagaaagaatatgttctgatacatccctggaaaggtaatctgagctcatataagtacacagtttgctgttataaaagccaaactttgatgtattatataatattccacttatcattgcttagatctttacactgtattttaatcaagtaataacatcatagtatttggagaaaggttatgctaaaatagtaaaaatatgctgtaagtattccaagaccaataattaagtgatttgaaatcttagtaactatataatttaatacctaagttattgaatttattatttagtacttaattactttcactaattttgtgtgttctttacatttaagtaggtgctttttcaatatctattaaagtcattaatatttaatttgtacacttcctttaacaacagaaaatttctactacatttaaggaaagtcagtgtcacgcctgtaatcccagcactttgggaggccaaggcgggcagatcacgaggtcagggatcgagatcatcctggctaacacggtgaaaccccttctgtactaaaaatacaaaaattagtggggcatggtggcgggcgcctgtagtcacagctactagggaggcataggcaggagaatggcgtgaacctgggaggcggagcttgcagtgagcagagtttgtgccactgcactccagtctgggcgacagagcaagactcagcgtcaaaaaaaaaagttagtgaacattattagtctcatttcatattacattgcaaatgtactattttcctcaaagctcttgattattttcagccagattcttgcttgtttccatgtgttactaacatagagaattagaacaaatcaaaaattttctcaaacacattcatatagacataaatacaattatatgttacctttagaggccaaacaaccatttctgttttcactttgcttagttttgcttttttcaagggtcagaaatatcagattgtttgaaaaagtatcagacatatcgaaatgtttttcctggtgagattattttaaaaaatagtaacgaattggggtgagtagtatgggccaagccaattactttgaactttttgtattgttatggaagaaacacaggttgaacattcacaaacctctttgaaactgattcactgcatatatcaaagttcctcaaatggttttgacaattattatccttagaacagaagagtgaagagcacatttgagataggtatataattatgattcatgaaaatcataacaattcatgcctgatcactggaatttcgtatcacatattaaaacaaaaactcacttagctaacagaaaatacccttgttttattatttccatgagcaaattttatgacccctccaatatcatactctttattctaccaagtatgtgtaaatttaccttgtataatgtgactgaatttgtttccaaaatgtgcatttcagtatcctctcaattgcatatttgaatacttttactgatacttcccttattttcaaaatacttccttgaatgtctttgtctttaaagtttgtttacctgggattatatgcctccttttctatggatcatcaaatgatttctagacaggcaataaaaaccttggctggtggtaacccggtaattattttccatgaataaataataaaagcctgtaacaaaatcttgttggtaacaaaaggttggtgacttgttccacgctgtccaagtgacaaagtctgaagcattactgcaatcaagttggctttgactatcaaaaatcgttttccacataactcaaacctgagaatatgcatttcacagatgttgtaaggaggatacatagatcacagaaatatttcttacaaccctttctcacattcttatccatttctataacaactattctggttcctacttctcacactgccacagggctaactcaaaatcttctggttattcacctccccttcattcccatcgtgcacatcaaaaatcctccaaacgattttgacaagcatgacccactctggaagtcagaggaaaggaagaaattgagcagacagagtttgctttaccatgaagataaggagacaatcttgggagaatttatttgttcataattttagtctcattaaatttggatgaatatttcaatgataataatgatatggttcccattgtgtgctctcatcaggtcaggagacgactgtttttgtgatgacttcaattcattgtcaaatcacaattctatctaggacctccttgttagcagggactgtgtgagcactccctaggtttttcaccctcaatctctccatataaggcctccacactcaataggaaggcaataaaacaaggacaacaaatatgaaacatatataacaaagtaggccttttttattgatttgattttggagaaataaaatctgattttgcattatcagatgcagtagtttggtaaaagaacatacatttttaatttagataaatgaagcaaagtaatgtacagttttcccaagtggttttatcattttatatttctaccgagtatatgtgtaataaatgtgaaagttcaaatcaatgggagaaaatggatttttaataaagaatgattaaatattggttatcaataaatagagaaaaaaattatgatagatattgactttaccaaataaagctttggaagattgccagataagtctttaccagatacatctttggtcgattgcttatgccaaataaatttttgtagaacaaaagtgaatgtatgagaaaaacacatgtattagaagtcaacatagtagaaaataaggtaaatgattacttaaaaatattgcaaatgcttgcttagcaatgatttaaaacaatcccaaaaattggaactgttgaaggcatgaggagatgtgggcttttatatctgtgatggaaataaaaagcaggttaagttcaaggaaaaaaaaaatgaaatctatcactaggtttgacaatatgtatagtatagattaaagcatttcaatttgagctttatcttacataaatattgagagatatgctcggagatgtgttgagaaggatattcattgtacaatatacaatttgctttttaaaagaataaatttcttattcaagtacaacctatgagataccttcataaatcaatagttcacagtctgatgaattatcacaatgttataattataaattccaggaaaaaaattgatattttcacaaggtctgacaatatatgtagcttaaacttcaggattgcactttgagcttcatcttacataaatattgagagggacatacgctcagagatgtgttgacaagaatattcactgcacaatatataatgtacttttaaaaataaatttcttattcaaatataagttatgagataccttcctaaatcattagatcacagtctgacaaattattacaaagttataattcattcatgtaatcacactgtgatcaagaaatagaatattgtcagtatctcagaaaaccacttattaaattatctactcataactacccctacttccatcctagagatggcctgatttgtaatatgaaagatttgttttacctgttttaaattttctataaattgaattacatagtataaaaccttttatatatggctttttaatcaattattatgtcttatatgatatgtatgagtgtaagattcttgcatataattaagtgcagtactagtatactcatattaatggttatactatcatccattagatgaatacatcatattttatatgttagttttttttcaactggcgatgaactttgtacttcttctagggtatgctgtgaggataatgctcttacgaacactcttgagtatgtcttcttactgatatgattgcatttgtgttaaatagaagaataaagttgcagagtatgtatacattctgataggctagattactgtcagttttctaacgtggttgtatggtttacattctatcacagagtaggagaattctaactctttcacatctttaccaatttcagtctcttaagattttagcaaagccagtgaatatgtattattatcttatagttgctttaacttgaattttgatgatgattaatggggttgaacaactgtttgatgatcttggacatttgtaaagtgctgttccatatctcttgcctattttagttgaattgtctgttttccttaatgattcacaagagttcttcatatattataattaagtcatttatcagcttaatgttttataaatattacaattcttatggcttatatttagaccctattagtgttatcttgtcaaagaaaagtttctaattttaatatagttttatttatccctttctctttccatatatacctggctatttcctctacctgtacacatatcctgaatgtatgaagtatagacaataattttccttatctatttccatagataaaatattgcactcatccacatcagaatttatgtaaactgagttggcttccctacaactttcttgagagcaaagtgaaggtctattttcttttatatctgtaggaccagacagtacatatggcacacggagactcaaaaactttgaataaagtgtttctttgttgtagattatttagagtatttttaggctcatacacacttgccttgctctctgaatttctgtaggacatctaaatacaaataatgatgttttttgagaatctatttataatttcaatatctttgagcttcctaaattgctgcatttaactacaggccaaaataatctggtcataagagtgaatcatatacacatataggggctcacagcgcttcattgagatggccttttggggtagtacaataaacaatgtcataaacattccaatagaatgaacggtgaactcctatgtcctacaacaaaatatgccaagcttgccaataagtagcaataaagcttttcgataaactagtctcttagagcttgaattatgattttcaaggtgagattaataatatctacattacttgcaccactgcactccagcctgggtgacagagcaagactctttctcaaaaaaaaaaagaaatatgtatatatatatatctacattgcatgattgatgtgaggatgcatgaaagaatatatatatatatatatatatatacacatacagtaaatgacattcttaatatgtggaaattattatagttagttttttaaattgataattttaatgcttttaaattgtgtaatctgggtgttaaaattgactccaagttataagctagggagaaaaaaattttcatttgaaactagaagcttaattgataccatgtcttacacatctgtctgaaaataggacagtgatatgaattttgaaagtttatttagaattccatagttgatcaaataattgaggaagtaaaaagggattatctatctctgctatttaacttgaagccaagcttcaaatgagaaacttatgaattaaattatttaaaaatcgtacttaaaaataagatagtctgccagagagttgaatattcacttaaaatagttatcttattttgatttatttaaaggtaacttcagtgaaattattttctatagactaagacatatcatacttttatatccaataataaattcattccctacatttttattgtaaagagttgaagtgaaatttcttaatttgttaacattcagatgaattatataaatgcattaagcagttggcaggtaccaagaactctactaactgctcaagcagtagaaaataaattagacacaaattctggagatatgaaaaagctcacagtatcagggatggggattcaaagtgcaggtaccacaagttaatttagaaaatgttttgttagggcatttctcaatacatggtaagagaaagctctgataaaaaaattcatgctgtcaagtattaaaggtgaattataaaaaataacaacaaacagacattcaagcatgtgtactttgatccaagtatcaaatgtgatactgctagtgaaaaatgatgttcttgtctctgataggagtgggaaaaaagagtaacaaaatatagtagaaaatcatctagagacattttgaggagagtttctaaatcgccttaaaaatggaggagtttaattttcataaactgagttgccaatgaaaaacttctataggtaaatagcaaaaatatttattgtcttggtgattaaaaaatgatcctagagtatctttaaaagtatagttcagagaagcaaaaatatttataaccctaccacccaatgattatcatttttaatatttaaggtattttgtatcagtatttgttatctatgtatatatattgcttgtctaattgtccgtatataaacacatgtaatattttaccatgttccatatttaattttgttgacattttcatctcatatcataacattggtcttcatcaataaatatgcatcaaaaacctatttttgcaatagctttccaaacccactaatgtcataatttataaaatgatatatttcctcttcagtagtgtgtaaaaaagtctaactgcagatgcttgtcaatagtgagggagatatacatctagagtgttgctagttaagcataaagtataattttaaatttctttggtcactagcataatttacttgatatatttgtgtcttgcctgttcatttactttgcctattttgctttgttttaatttgggcattttaaaattttatttccatggcatatgtgaatagcatagaaatcaacactttgtcaccagccttaaacatattttcagtttgttgtttgccttttagtgttgtttttgacatttaggaggttggtgtttttatttactcaaatatttccctttccttttggatttcaggctagatactttaaaccatctgaaaattatgtgaatatcaaattatctattttttttcaagtactatggcttttttatatgtaatgtttcaatccatcaagaaattgaatagtaaagacttaatactcaccaaattataggtggaattttaatctttatcatttataacagaaataaaactagattgaaaaactatattttcccattgtatcttaaatggatatcttatttatttatttatttgagacagagtctggctcagttacccaggcttgagtatgatggtgcagtctcacaacctccacctcatgggctcggaccatcctcccacttcagcaccagagtagtagctgggactacaggtgcatgccaccacatccggctttttttttttttgtattattggtttcaccattttgcccaggctggtctcgaacttctgagctcaagcaaaaggcccacctcagcctcccaaagtgctgggattacaggcatgagtgactgcacctggcctataaaatgtaatctcattgcaaaactcaatgatgccatgcttctataatatgctattacttttttttttttttttttttttttggagacagagtctcgctctgtcaaccagttgcccaggctagagggcagtggcgcaatctcggctcactgcaagctctgcctcccgggttcacgccattctcctgcttcagcctgtggagtagctgggactacaggcacccgccaccacgcccggctaattttttcgtatttttagtagagacagggtttcatcactttagccaggatggtctcgatctcctgacctcatgatccacttgcctcggcctctcaaagtgctgggattacaggcctgagccaccgcgcccggcttattacattttttaacacaggttttctctagtagaagagagccatgatatttaggattatggatatgtgtgaaagctagacatttaaaaagcacacaatgacttgaaatatggaattgggtatcaaataatctggatttacggaaaactagtcacaaaattcatggagataaacaagatggaatgccaaacaagaaaagaccatgtaattgcatttgttaaatgtctctaatgtgttccacatccacttcccaatctctctctcacacacacacaacccaacaaaactgctttccttgtaaataaaatttgagggttgaaaaccaacatgtatactttttgcattacacatgtactttaattatcattttaaattcctatattaagttaaaaatacatatttagattaattttattggtttaattctttttcttcaacagtcaattgacagacgtctttgagtacttttattctgaagataatatgaatccttgtatatatgagaatgatgtttcattcttaaataaaaatttgattgaattttaggttctctatttacaaactttttctttcaatgcactgcaagttctacctaatctttgctttctttatgctttcttctttaaccatctggtagaaatttgcttttatcctagaaataaatatagtttaccagggattttccaagtatttgtctgtgctttaactgtgattcataattaacacttttgatctgcaaacacaggttctttatataacccttgagtgtttttgtctttgtttttgtttttccttacagtatctttgttattgtacttgcttacttctcctggtttattaataaacacaaactaattacatttttatctggctctctgatcttcgttgctttattctcctagtcagttcgtctgtagtctggaagatttttcaaacatgtaagagcatactataaaatcgtagagagtgctttttttaaccaggctgatgcagacaaagtcttgcctctcaaattagtttctgtgaactccaccttttgctggtctataaaataaagagtaatcttaccttctttaccaagaggtttgtttattaactgtggaaatgcttgtaaaacacctactaccattgtcctatcaagttctaaaaaaatatttgttattattgtttagagtcgcagctttgctttctgcatcttaaatcctatctttctgtcttaaatctcttcagtttaattatttcatttttcttctgtatcaatatctttatttaactttcaatatcatcctatatattccattcttaattaaattttatttcttatccaaacttttaaaaataatttaatagtgtttcttttagtcaatcttattaaatatatgctcccccctgcctttttatcttcagtgtaaaatgctgctctaatgttgtggaatctttcaagggattcaagtgtgtttgaaactgtgtattaagcgatgatcactaccttgctgactgcaaagtttccatatttctgtggtggagaggtagaaatctctcctttatccctgtctacatctcttttccctctactgctgctttcttacactagtcttggcaaaaatcgtacttagaccccttgtttctagtgttgatgcaacttgtcatccctttttgctgtctccacaagtacatcaatagggccatgagtaaaactaatgcagatactagtagctgcctgacatttcaattcagacctactctatgtatttcaatccaaacctactttaggttaagagatggaaaatgacatcacagaagaggtgttagttaaaactatgttttcaaagattgatacttcgaggcaaagccttctcctctaacttttccagatagaataatattgattatcctcactattcccattaaaatatgctttcctctgcattagattattaatcagaactctcacattcttagttcatcatcatatattttatagcagtccagtccagaggaaagcatgctgccatcagagccagaacgaccaaggtcttcaaaactcttctccacaacttattcattatgtaaatatatctttctaaatatcaacgttgtaagtgtataatagtaacattaatttacaacgattcatatatcagattagaccaattaatcctatgtcattttaattatagaacttttctcaggatttttttttttaaagtaacattagacggccttgcagtgactgtcccagggaacattcaataaatattagttttataatttcttattattctatttatgtataaatttctttctgatctgtactatagttatattgaagagaatgtctatttctttcatgttagtgccttacttggtgcctgacacattgtagatactcgattgccacttattgaatcaaagaaccaaggtattgattgaattatgggagtaaaataattacaacatgttataaagctgggagataggaaaatccaaaagaagagatacattttggggaaaacaattacctagtaaattcgattgaggattgggtttactagagaaatatcattttaaattcacaattcagaactggagaaaatttaaaagagtaagaaacagaaaaaatgaataaaaataactttgttttgatattaattttcatatgttgattgaaccttcaatataggcgagaatattaaagttactgcattttcctacagtttttttgggtatattctatatggaatgaacacagtggtttttattgtcagaatattcaaatattactactaatagcactatctgtcactgatcacattcactagcacactgtagaccctacatgtacatcgagaatattgagaaatctgtgacaacagtgagttatatattttattgacttcctctagttctgtatcatccagcatagaggacacataatactttacaaaatatacccttgctgtatgaagtaccaacatttttagtttcatttacagaacaaattctgaactttgtctctgatataaattatgttatacagcagcatttaaaagagatattagtgattagtgatttctttttataaatgcaatgtgaactttagtaatattaaaataattttgtcaccttactatatttatattaaaatatgcatatggtaatgcttgctataaattaaatcatataaataactgttccttttacagctggtttgaaaacattcttttgctgtcttttaacgtagattttagatctcaaatactgtatttttaatttaatagaacacatggccatttaatactaggaagaaaaagagatgttaatgtcattttccaatagtatttaatctaatatgttaaaaattttaaacatatacagcatttgtgcattagctttaggaaaaatacactagcagtaattatattctttgcagaaacatttctgaaattaacaaaatgaggaatataagtaaaccatttttaggcattgaaaaggataaatttatcctaaaagatgttgatttcagactcaaaataccataaactctatctgtttcttggtatttaaaattgaataaagaataataacatcctcttattaccaagaggacctactgtctcaccccgtggttagtgtatgtgacttaagaagcaatgattagaatttgtagagatgatgcaagtctcacattgacaaaaagaaaatttagaaaacagcaatgctaaaaatagaaatgcacaccaggatatactagcaacataaagttttaatgctttacagagctcatataacctgaattttctgagaatacaagaggagcgaaaataaaggttcatttttttgatagatagtcttggtgggattatgtctgcctcactgaacagtataaaacatttggcagagcatgtataataaccaccaatagcatggttcccaattcactcttactcaactcccacagctagcatctgaatcacaaacagaatagaagcttcccagaactcaaccactggcaacatttaaatccctcagcatactgaaggaccttgggagattagggtctttttgtggaagggcaaactgaaacacttggttttaatgtttgaaattatcatgacctaaatttgttttcacacttctgttttgtccttgtagtagaggtgactactttaaccacagcagggtactgttgataactctggatgctgatgcctgtaaggcactgatagatgcttcataaatctttttcaaatgacattcttgatatttgcccaccgggtctctggaagcatctgctaaacttctcaatttgtcttcagaatttcaacgtaattttttttctttctcctttctgcattggcaacaatttatgtcttccacataggatgtacttctttcacactatgtggatatttttaaaagtgtaggtaccatcacactcgcatcagaagcatctgttaaagtaatcacactggtgggggtgaccccagaaagcacatattctcataacaccttacaagagctgtaggtaatttgtattttggacaaacatgtcagactttttttatgtacaaaaaagatgtatacaaactataaccttttaaccctttctgataagccttcctatatcctgacatcgatttccttcttttacttgtttctctctcagtactcttcaaaaagagaggtggtgaccagtgttggaagagatgaagcagatgcacatcacttcctttgggaacttgctgaaataattctttgcattgcattttcatttacattatgctgaccagttctcttcacttagaactttcttagttgttcttttgattcttactgttgaaaaccaagattatgctcttgtgatgaagtgttttcaaatatcaaaatctgaataattgggcagcccactttcagaatcttatcatgaagtttatgctgcaaaatgtcagtttaaattgaaatattcaaactagtagcaaggtaccaatgataagacatccacagacccaaaagttaactgaattcatatgctattttttgctgaacttatctaactggtagccatacacagcaataaataggctggcaattatgcatgggggaaaatggagtttcaagtgtgtagtatcatgtctataagaataatattaatgatagcctgaaagcccactcagatatctcacagagcctatactctgtaacttagctatcatatataatctgtcctggggatttacaaccctggcccaagaattaccaggcatctatgaaaatgcgacctagaacaccagttgccctagagaaaaagacgcctcagcataggtgcaaatttcatagatgttaaaacaaagctaacccttacaagaataacttaaactccttatatgaaataaacatctgataattgaccaggactgaatacagatgtaagaaaggggaagacctccccaaattccgagaatagtctccggaaggataccctcccagctatttggtggccatgccaccagcctgctcccactgtcttgtaagagcactgccacaataaaccacttgggaatcaggtgatgtctaagactcatctttgaagcgtatcctactgaagagaagaagttgcctctggagaagatggtcagctaggctcacctaagaccctggagtgcaatggcagaaaagataaaaaaaagcatttaatgatgatctgatgactaacaaagcaactaataaataagttaacttttaaaggtaaagatgaatcagatggtcagctttacttagaaatatttgagataggttgtcctaattaattaaccaacaaacacttattgagagaaagtgagtagattggaagtagactaacatttattgatactctacttgcatctggttctgtaggtttaattttcacaattctactgttatagaacctatcaaaagcttcaagtaataagtaatatagattgaatcagaatctgactttgaatactctgttttttggatcaatttgactttccaccattatatgtgtaaggctgctgtttcctcacattacctacctgtcctggctgattgtacctcctactattgtgtttcccattccttagtatctctggtttatttttcttattaaaataagccaaaactttccttttccaggtttttcattggttatttctttagccttccatttatatctcacatttcaactcaaattctccttccttagagaagcttcactgaccactctagttaccaaagaatgctgtcttcttaatagtatgtatcagtgcctgaaattttttgttgaaattttaatttcctgtcttcttacactgaaatgtaagctccctgaagcagtaaaataacaatgtctatatccctagtacataaaacattgtcctgcactaaaagtctttcttgttcatgccttcattcactttctcattctctctctctcgatagattagatagatagatagatagatagatagatagatagatagatactgagatagagatatagtgtgtatgtatctataactgatggactgatttttttaggtaatgttccttgtcaaggagttgaaaatataattgtaaagaaagtttaactaatatatgatacaactaacaattaaaacaatgtatagtatgtggaactcacctactgaattactgagaggacagagggttgcgttatgagggaatctgaggaatacagatatcacttcacatttcgtcagaatttcacagtttaacatatattttatttcatttgtgcctcataggagctgtgtgaaataaagagaattgtcttctttttttttttttttttgtcaaagaagtcaaatgacatctcaatccacaaatccagtggtaaggcaaggttccctaaagaagataaacttgctaaaaatactaccctcctttgtttatttttcagaaatttaaattgctactcttcattgagaaaattagagcaaatgatgagattttttaaatctgctactgtgagtacgtgtatgatatttgatgaagttagcttgctgaaggcatcatagatcaaatccctaaaacaagaaacattttgtggccttacatgtgtaggattggagggtgtatgcatacactttcagtatattctagaaatcagtgagctacagtgtgatgtcatacagatatatttggccactgaccaaaaataaaagcatgctatagaagcattcgtcttgaaacaatatacttgccaaactgtctttacattggaataagccaatatttttatattttatatgtgcaggcaatcaataaaaaattgctaaggaacagagtctctattcacagtcctctgcatggggcacggcccagtacacattaagttgacctactgcatgatgtccagtcagtattaaaagggcttaacgattaaaaaaaaatcagatgtttaacatgtaaaagataattaattggtacattcaaagtctctcattcttttttgggatcatcctctgtgcttgatttttacccaatatttcagagccatttctgccagtgatgaaaaactggagatgaggttgcttagacacagcaaatcctgtatagccaaagggaagctgaaggtcaaagagtgaattagattgatgtcttgttcttgttgaaaacagaatttatttgttttgctgacagagaaggaaaatataaacagtcaagaacgggaagacatattattttgctataaaatgaattcaagaggaaataacagatataaggaaaaacacagtgaatattattataggaataattcattagaatagagagacaatgaacttaaacacttgctaattctcctgctgaaatggatcaagtgattgcttcgactggagaaaaatcctaaactaacctaaatataaatgagtgctagaggacaggcagaatcacatcatgacacagacttaaaggcagagccagaagtacaataaagttaagacctgagctctccatataaaacaaaccttgtgtaacaagtgaaccacccaggtatgtctttaaatttatttttgaaacattagtttctgtccttaattattttctaataaaaataaaatcatttgataaaagaaatacaataataatatccaacgtgaataaagtctgaagactcagagggaaaatatttttttcaataactgtaatcatcgtatttctccaaaaatctcatttgcaaataatattgtgaaaaaaacaattttcgtgatataactcacaaggcagaagtctgatataaaacataaaatgtccttttgtttttcgttttgcatttatttcttatttcatcctgataaaaatgaatgcatgcagttttcaatatgagcaaataagtttttttccatatatcctttaaaactgtcttattcacttcgaatcttataaaatatattcatttaaattatatttatagaaaatcttcttgagaaattatgaaacttctaaatttgaggagatagtgacctaaattactttaaaggtaatcttgatcataatagaatgctgcagaagggctcaaagtttcacttttagaaagtaataaattgcatggcatttaacaggcctactctaaataagccacagccttgaaaagaaaattgctttagacactggtcctcttgccaatgtactgatttctattattagccaacatcttctaccggcccctgtctggggtcaccttaggtctagctgaagctgtatcctcagggccctgaatggattcagaatcagcatgcaacatgcttgtggtggcagtataaaacagtctacgtgagagaatggtccatgagagcaaaatcaatgtaaggataaatgaatgtagatgggatcaccaatcccaaatatgttacaagaagagagtgaacaaagtgacacggagactaagagaagataagaaaagaagtagaaagcaaacatagggtgagtattatggaatagttcttgagtaaaattcagtaactataaaattataattactatggctctatctgttaatgtagtgggctatttaataagccaaagcagcaaaaactagggcattactatggattagttctctgtgtgtttcctgaaacctagagaagattgtaggatataaactcaattgtgtcctagaaactcattttctatgttccagtcttgtaaattctacaaggttctagaaatctgtagtctaagaggcaataaacctaattatgaatatactaagacttagtcccttccaggaaaaagataaagaaaatactagtgaagattatttccttatgaaatgtaaacatggccttaatctagactaaaatacattttttcctaagaattttagggattaagatagattttctgtggtagtaacaggagcacagccgctaaatttatgccactagaagcaaggaagatcataggaaagatataacctgtcaactttgattcattttgagaaatcagtactcatgtaatgacggtaatggtatttatcgtatgtaaaataaaaccataataagcttttaaaatagtttaaggtacaaaagagtattttaaaaacaatgaatttgatctcttaaaatttattatagttttgtcacgagttttattagaagattttccatgtgttctttctgggagaaactatttaaaaagtccattaactttttctaaatgtttaattttttttttgagaaggaatctctctctgtcgcccccaatttttatttaacatgagttaccaaattagggtcactgcattcttattaactatgctagtttaaaaaaatttatagaaactttttaatgcttaaatatgccatcatatcactgccaacatttgtctctttttaatcaatatttaaagtaactatttccagtttttcattttaatgatttatatagtctttaaaaacattcataatggtttcagtggaagccatctctgtgttgatttttatgcttttatgtttctttctttttttgagacagagtcttgctctgtcacccaggcaagagtgcagtggcgcgatctcggctcactgcaacctccacctccccggttcaagcgattctccggcctcagcctcccaagtagctggaactactactactactacaggcatgcactagtagtagtactacgactactactactacaggcatgcaccatcacctctggctaatttttgtatttttagtagagacggggtttgggcattttggccaggctggtcttgaacacctgacctcaggtgatatgcccacgttggcctcccaaagtgtggggattacaggtgtgagccaccatgcccggcctgatttttatgcttttaaatggcttttggtctcattctttacagtaatgaccgctgttggtttgataatcaaccttcataatgttcaaacagtttatatttctgcacatattttctatttaaatactgacaagtattgtggtcttagtctcttagagacaaaataatcataaaatatttgttaggataaaaaactgttaggataaagacataaaaatgaagttttagaaggaaatgtagataactgtttgaaaatgtaaaatcagtgagaccttatttattgtaggataataaatagctattaaaaatatacagatttaacactacatgaaaatttaaacatttttataaaaaagctatcattaatatgatcaatggataaatgacagattttggaaaaatagcatttaccagaatgatttgtaatacctataataatactaatgaaaattaataataataatacttcaaatagataagaaaaagcatattgctaattgaaaaagacaaagttgttaataggcaaattacagatgagaaatacaaatgacctgtaagcatttggaaaaaaaaatgtttaggttcattagaatttttgggtgtagtggatgcaagtattaaaaataatgtattagatttgtacctgataacctgtaggaatttcctacaagtggtttttaaagtaaagcaagatacattaaaatgtgtatacaagtattctattcttaacacacatatgcatattacatctattttttataatataaagaattgaatgtcagagtacatatcagtgttggaggaagagaataaggaggaagcacagaaagtaaaaaggaaaaataggcaccaaaaaagatttggagaatggcagatggccaaggagatgcagctgggaagtgcctcttccatggagaggaacccaaatatccagtaaaccgtcacattttaaacagatcttttgagagaaaacactgaaagttgatacagaggtgacacagacaccatggttgaagagggaagaaatggggcagtctgctcagagtcactagacaccaggactggcccatataccttgaacaaacccaaggaaggggtgagtgaaggaaccctgggacactacatacccacaatgtacttctgagatcctagctacaggagtttctacgacccccatagatctttggactggtaggagagctgcctcgagcacatgcagaggcacagtttgaacccacaccgagcccagaaggctttgttgtgcggtgcagctgcagcaaaatgcaaccctaggtgcccatcccacaagtctccatttcatactgagtggctaagttcctgctatctgccaggctgggagtgaaccgtgcctggcctgctcacatgcccaagataggccccatcacccatgctgcgtgattaaggtacatctggtccacatgcccccttgcctgtcaacgccttcccagacctcatgcctgaccactcctgcaagagggtgtccacagcacaacatccactgcccagcttaagtgttttgttaacagcctgggagaagttcaccaccctgtccccaaatcatagccagtgcttaaagcttagaggccagaggacaaatcagtgagcccaggcccgtgagctcagtcccgtgagcccagtcccaactccccaagactccagtacaccacgcagggacattgagctgagatttgtgacctaatctcaagtgaaggaggaggatcctccacagtcagaatgcagagaagaatgtggtatgggttctcatggggcatgggagctggacacccctccctttgcaagaccagacaacgaaaggtatggcctgatggtcgtagctttttttccagggagtatcctggcacagaatgcctggagtagctcaacaatgtgggagcagatggcttggggaaagcctagttggttgggcttgccgccagggcgagtgtctgtgggagatctgctgggttaggggagtgtgagctaggcagacaccatggttgccagctgggctgaaaatcacgggctgcaagctccatactggtgttgcacccattgtggcactgccctgcctggagatcctctacccttgaaatactgcattttctttgtctctacacttgaaatactgtattttctttgtctcatgttgtgttttgagacagtacaactcatacctaagttgtgtatcacagcaactgcggacataccctaaaacctgctctgactttggtaagcacagtagactggtgggtctctggagagttgtgtccctagagatgtaatcctcagtgtggaccactcctgagggaaggggagtgcagcctgccaaagcacaccatgagataaagaaaatgtggccatggcatcagccactaaaagggtcaccaccaaggcccagaaccagacttggagaaggaatcatgtcttgcctccatctccacttcccagtgcactgttgcggatgcagcagtagctcttcccataaggtcctagaaagtgtgcactgaaagaagttgtttctcatgatgctccagtgaggacaagcatgcaccaagaccccacctgccagctcttactcttaaatctgtctaccagattgaagtttgaattatagcatcacataaaaatacattgctaaaacaagcaacatctatgaaagccactgcaggaacctatctctaaccaaggaacatatatagaaacttcacccctgcaactacccagaaatgaagccaatgaatcacatacaccacagtcatactttcaaggagaataaaaaatataaaagccctgtgatggttaatattgagtgtcaacttgattgtattaaaggatgcaaaatattgttcctgggtgtgttttgagagtgttgccaaaggagattaacatttgagtctggactaggagaggcagaaccactctcaatctgggtgggcaccatctaatcagctgccagcacagctaggataaagcaggcaggagaagacagaagagcagacttactgagtctcctggctttcatctttatcccatgctggatgcttccagttcttcagattttggacttttgtacttacaccagtggtttgccaggggctctcaggccttcagtcacagactgaaggctgcacatcagcttccctacttttgaggctttgggactcggactgccttccctgctcctcagcttgcagatggcctattgtgggactttaacttgtgattgtgtgagtcagtgatccttaataaactccccttcaaatgtacatctatcctactacttcagtacctatagagaactctgactaatacaaaccccatctaaatgaagcaaattcaaaaacaaagtatcaactcccgcagatggaaaggaataagcacaagaactctggcaatacaaaaagccagagtgttttgtggtctccaaagcctctcactagctccctagaaaaggatcctaaccagatgtaaatgtctgaaatgagagacatagaactcagaagatggatggcaaggaaagtcaatgagacataagataaaattgaaatccaatacaaagaagccagaaaaacagtccgaatttgaaagacaacatagctatattaagaaagagccaaactgaacttctggaactgaaaaattcactaaataaatttcgaaatacggttgggagtcttaaaaacagactaggccaagtagaaggaaaaaattcatagcttgaagactgattcttcaaattaacccagtcttgcaaaaataaagaaaaaatattttttaaaaagacaaagccttcaagaaatatgggattatgtaaagaaaccaattctacaacttattgatattcctgagagaaaagaaaaaataaccaacttggaaaacatacctgaggaaaaatttcaagaaaatattctcaattttgttagagatgttgacatgcatacatcagaaatccagagaaccccttttatatactataaagacagccatccccaagacacatagtcattagactatccaaggttaacacaaaagaaaaaacaaatctcagacacagctagagaaaagagcaacactacccacaaagggaaccccatcagactaactggtcttctcagaagaaaccttacaatccagcagagattagaggtctatttttagtactctaaaagaaaagacattccagaaaaaaacattcatattcttcaaaactaagcttcataaacgaaagagaaatggagtctttctgagtcaagcaatcggtaagggaatttatcaccaccagactagccctgcagaaatgcttaagggagttctaaatgtggatgtgaaagaacaatacacacaaaagcagagttaagtacatagtccacagactctataccacagactctataaagcaactacacaattgagactgcaaagaaactagctaacaaaactatggcaggaacaaaatctcacatataaaagttaaccttggacataaatggcctaaatccttcacttaaaagacatagagtggtgaattggaattaaaaaaaaaaaaaagaatcatccatctgctgtcttcaagagacccatctcataagtaatgacactcatgggttcaaagtaaagggatagagaaagattaatcatgcaaatggaaaacaaaaaagagcaggagtttctattctatcagaaaaaacagatcttaagcctaaaacagaaataaggacaaaaaatgttattgcttaatgacaaagggctcaattcaacaagaataattaactatcttaaataaatatgcacccaacattaattggagcaccaagattcataaagaaatcactactagacctaagaaaagatgtagacagcccctcagtaataactggggacttctacacccaactgacagtggtagatagatttatcgaggcagaaatctaaacaaataaattctggacttaaatttgacacttgaccaattaaacctaatacacatctacagaacactctacccaacaaaccacaaaatatatatttttctcatcttcacatggaacatactctaagagtgatcacatatgcagtcataaagcaagtgtcaagaaattaaaaaaaatattaaataataccaagcatcctcttggaccacagtagaataaaaataaaaatcaatagcaagaggaactctaaaacgcagacacaaacacacacacacacacatacacacacacacagaaactaaacaaattactcttgaatgactttcatttgggtaaacaagaaaattaaggcagaaatcaaagaactttttaaacaaatgaaaacagagacacaatgaacaaaaacctctgggatgcaacgatagcagtttaaagaggaaaaattatagtgctaaatacatcaaaaagacagaaatatatcaaattaacaacgtaacattgcacctaaagaaattaataaaacaagaaaaaaactatatccaaatatagcataagaaaataaataacaaaaataagaacaggactgaacaaaatcgagattcaaaaatccatacaaaggatcaacaaaatgaaaagttggttctttgaaagtttaaacaaaattgatagactgctagcaagattaacaaaaaagagaagatccaaataagcacaatcagcaataacaaaggcaacattagatccagtcccatagagattcaaaagattctcagagactactatgaacatttctatgtgcacaactagataacctaggagaaatggataccttcctggaaacacacaacctctcaagattgaaccaggaagaacttgaaacactgaacacaccaacaatgagttacagaattgaataagtaatagaagtccgggactagatgaattcatagctgaattctaccagacatacaaagaggagctcatgccaatcctactgaaactattccaaaaaatcgaggatgagagattcttctctaacttactgtacaaaacctatatcatcctgataccaaaatatggcaaatacacacacacaaaagaaaaccctaggccaatatatctgatgaacatagatgaaaaaatcctcaacaaagtacttgcaaaccacatccagcagcacatcaaaaagataatacaatatcaagtgaactttattcctgggatgcaagggttgttcaatatatgcaaatcaattaatgtgatttatcacataaagagaattaaaaatgaaaaaaataagattatctcaacagatacgttaaagtatttgataaaatccaacatgccttcataattaaaaccctcagtagactaggcatttaaagaacatactaaaataataagaaccatctattgacaaacccagtctacattatactaaataggcaaaagttggaggaattctcataagaacaagaacaaaacaagaatatccacttttaccactcttattcaacttaatacttgaagccctagccagaatgatcgaccaacagcaagaaataatagacatccaaataggaaaagaggaagttaaattttatttcttcactgatgataggattctatacctagaaaaccctaatgattctgaccaaagacgcctaaagttgattaaaaatttcagtaaagttttaagataggcaatcaacatacaaaaagcagtagtatttctatacaatgcaatgttcaaactgagaaccaaatcaagaacacaatcccatttatgagagccacaagagaaaaaaatgaaatacttaggaatacctctaaccaaggaggtgaaagatctctttaagtcgaactacaaaacactgctgaatgaaatcatagatgacacaaacaaatggaaaaatattacatgcttatagattggaagattcaacatcattaaaatgtctttactgcccgaagcaatctacaaattcaatgcagttcctatgaaactgccaaaatcattttttacacagaattagaaaattgattctaaaatttatatttaactaaaaaagagcctgaatagccaacacaatcttaagctaaaagaacacagacaggggcaacacattacctgacttcaacctatactacaaggctacaataaccaaaatagcatggtatgggtacaaaaatagacacatagaccaatggaacagaatagagaatccagaaatgaggcctcattcctacaaccaactgatctttaacataattgataaaaatgcaatagggaaaggataccctattcaattaatagtgctgggaaaactggctaaccatattcagaagaatgaaattaggctcctgtctctgaccatataaaaaaattaactcaagattgataaaagacttaaatgtaaaactttaaactataagaagcctagaattagacctaagaaactcttttggacattgacgtaggcaaagaatttatgactaagtactaaaacacaaaagcaacaaaaaacaaaaattgacaagtgagaccaaattaaactaaagagcttctgcacagcacttgcatgttctattgcaaatatgaaatagcaaaggcatggaatcaacattggtttccaacaatggtggattgtataaagaaactgtgatgcatatataccatggaatactatgcatccagaagaaagaatgaaatcctttcctttgcagtaacatggatgtgcctggatgccattatgctaagcagatgctgggacacaagaaaaatctttaagatatgtcactgcttcttatcaataataatgttctagtgagtaacaagagttaagaacaccactaattatagtactgtaaatataattacagttctaataagacatacacacacagagaacaattttgtctggtggttgaggaaatcttcattgatttaagatattttttgatgaacaggatttttcaataactatcagacgaagaatgtctatgacttatttttaaaaactattttcttctctgccttgcatatctgacattttcatctcctatcttccttgaatacaatatagaacctgacatttctttcctttcaaagatccttaaaacatttcctacatttaatctgaatgtctttctcagtaatttttcttatacaagcaattatggctacattttcttaatataatcatgaaaaagtgagcaactgaaaatttaatctggagaatatatatgaaacatattcaattaattcaagttgttgttaggctgcatatgttcagctttcagtgaaggtgattgataaatgagaaactgaaagaaaacaaaccaataggtgtttttcagaaacagtattattaaaatgcatgtgctttctactgaatgaaagcaatatagactttttcctcgcattggtagttagtaaggtgtataaaaacgactttgtaaagaacaattaatataggttaatgaatcactgtgaagaggggataacactttattctagcaatgatctgcaaggtgttaaaagttaaaaaagatgaaaaacaattgaatagttatttcatcatagtgtttattaaattgattttcctgtatctgtcaagctttacagaaatgtcttcaacagaataacagtgttggaagccaaatgaaatgcattatgaaatatgattcttcacttggtatgcaggtatactctcaggtgttaactcaggcaaagagacaaattcaattttaaagttccatttgttaaaatttgatgattgtgattaaagacccataacaattctatctttgacattttagttttttcttcacagaagcattctactgcaattttcttagttttctttcctcttaactgtggtattacccataaatgctggatttctctgttttaagtgtaacaaacctacaatcaactatttctggaacaccacttcatcttaacaacaaggacccataaatattctaaaaattcaaagtgttttatataaaatgttaaatgatacacataataaatttctaagtagtaattatgattatgcccataattatacccataatttaaaaatatgttacctgaagtaaattattacatattttatgttggaagtattcatttatctttgatctcttttaacacactgtactaggtggtaataaaataaactgccttattgggtagtcatttatcttttgtttcatattttttactggactaatattccaacgctatagatagtgaaatataacattcaaacaatttgatagtagtcaatgaatccagtttttaaaaatgggatccattttctaaaattgagtatatagatacttcatgaaatgtcttatcatacatcctaaaccaaaccaacctcttcccttgactgtcttacagtgcgttattattttatccactgcagcaactagcacatttttcagaacctagtagatattcagtcattgtctatggaatacatgaacacattctaaatttggacagtcatcattcttggtgttttaaaacaaacacttcctgaattgcacaaactattttctaaatagccctgggaattcattgaaggaaggtatgggtaagttgggggtcaaactataaagatgtaggttctcctctcaaaacttcttcagcgtatcctcattgttgtttgtttgcttgcttgcttgttttgaaagatctagatatagtctaatgagagttgtataaatgtgatgttccacaatgattctaacttacatggtgcaaaataataaaatattacattctagctgtttgtggaaaatcagggataatataaaggatctagattttctctctcctctcctcctaagatttattcactcagcaaagttacctggtgactacttactgctagacactgttttagatacttgggctataacgttgataagaacagggcttgaattagtgaaaagtttattttaattagctgtatggcaaaataggaaactaacaaaaataaacatataacatgtcagatggcaatggctgcactgagaaaaatgaaggagaataagaagttctaaattattatatatgaccaatattaccaacatattatagaaagaaatgagttcataatgtttatcagagaatttcatgaaaatcactaaatttttccagaaagccaggcactgataagggaataaacaaacagataaccgattttaatttgatcttctcttacaagtgcagctatgatctgccattgtatataatttaaattttaaaattgtttatatttctttcacataattatgttcttacattttgtttgtttgtttgttttgagacagagtgtcgctctgtcacctaggctgaagtacaatggtgcgatctcggctcactgcaacctccacctcccgggttcaagcgattctcctgctccagcctcctgagtagctgggactataagcaggagcccccacgcccggctaatttttgtactttattagagacagggtgtcaccaaattggcgaggctggtttcgaactcctgatctcagattatcagcctgtgcctcagcctccaatagatgctgggattacaggcgtgagccactgtgcctggccaatattcttacatttaaagatcagacatctatcagattcccttctccctgctacaaacattgtatacttttccataggcacaagattttgttttcattcaggttggactcaacaagtattatttagcagttcattgcatttatccatttacccaatagaggaagtataaaagatacagatgaataaagtgtaataattcttatactcactatttgcccttacatcatgtaagtgctcaactgtacaacatgtttgtgttcccaaaacctaactggaagggataactcagaaaaatagaataaaagtattgtatatctcatacatcttcattttagaatattgtaggggtacagatcagtataaataaaatactttggtaagtgcccaccacatcatctgtttgtcatccttagagccagattataccattctcattaagaaagaaaacttactactgtacctcctacccagtaacatatatatgatatatatatatcatatatatatattttatatataatatattatatatatatataaaacatttgctactggttaggagtaacactcagaaaatcatacttaataatgtagtacaattgggtataaattcacctagtatttttaaattttatgtatattcatatttatatgaatcatcatttaaaatcatgtctactgatcctgatggcattaaaggcataagaggtaccgaggatattaatttaattttgtttacagctatgcacagatatttttagttcactcagatttaatccagtagtctattatttgattaattgtacagctatcaaatcattcaggactcccactgtttcaacaagagtggaaaaatattttttcatttatgtttatatgcagctatttgtagtctaaattaatattctggcaattgatggtgaaattaaaattatttctgtcagatatggtaatttgatgacagtggataagcatgggagtaagagaaagttttgaggaagaggggtactttttgtttacttaatgattattcaaaagatgttaagtaaacattctatagaatgctacagatagtggaatacaacattgaaacaatttaataatgcagtcaatgaatccagtttttaaaaatgggatccgttttctaaaactgagcatacagacacttcatgagatgctttatcacgcatcctaaaccaaaccaactccttcccttgactgtcttacagtgcatagggtatctctacattctaggaaaggaattatctgtttatatgccacttataaaatcatacttaataatatagtacacttaggcataatttcacttagcatttttaaatgtaaaatgttaacgaaaagtgttcttgaaaaatatttctgagaatattttctaaaaaatgaacaaatcgtaacacctaagggatgatatctttctagtgaattgattatcagagtataatgtggtatgttctgattatgttacataatattctgattagcagaacattttaaataagtgaatttagcaaaatatttagaggttaaggaaactgttttacactgactatgttttctgacccaaatgtgagaaagaacccaataaaaagaggcagccagataatgctgttgtttgtgaacttaaacagaagcttgcatgtaatttattgttcaaagaaaaataaaaatagaagttatactttatttagaacttaatgacagtgaaaattacataaaaaggaagactactgaatacagcaaaagctgaaattatataggaaatataaatataaacacacaaaataagtgtaaattataatgaagtaaaaatatatcaaagagaaaaaaggaagtagtacagtaaaaaaaaaaaggtgatgctttaaaaactgtaattaaatagacaaatttccagccagattgatgaccaagtaaagagaaaaggaaggagacagatcaaaagacacaagatgatgaatgaaaagggggtcagcacttataaatgtagtagcaatgtaagccataatgagcacaagaaaacattatcaacttaattttgaatatataaaatagagacacttaaaaaaactgaacaaaaacaacttactagttttaaaagaaaaaaaagtcatcaaacatatatccttccaaaagtatagacttcaaaagtatagccccagatgggtgaacaacttcaaaagtacagtcccggatgggtgaacataaaccacactttaagcaagaactctcagttataactgcttgcaattttagaggataacagccacactcctgaaccagagcttggcaccggctattccctctggaacacccttttatttccttctctaagcaaagacatggaatcaatctaaatgcccaccagtggtctgcgggataaagaaaatatggtatataaacatcatggcatactatgcagctataaaaaagaacaagatcttgttctttgcagggatgtggatgtagttggaggccattatccttagcaaactaccacaggaaaagaagaccaaacactgcatgctctaactcataagtaggagctaaattatgagaacacatggacacatagagtgggggacagcacacactggggctttttggagggtggagagttggaggagggagaagacaaaaaaaataactaatggttactaggcttaataccggggtgatgaaataatctgtacaacaaaccaccatgatacgagtttacgtatgtaatgaacctgcacttgtacccctaaacttaaaagttaaaaatgaatgaagcctgtcagaaccacccactttgtagtcttacattttccctagtattcccaaacccctttgcctagtcaacattttacaaagcgcttttcatcttctactgtgttataatttatatatttttagtgtatattttacacactttattagaatatgagttccttcaaggtaaggactgttgtttgttttgtgctccctgatgtattttcagagcctagaacagggcctggaataaaataagcagccaacactatgcgatgaaaattttttggtgggtataaatgcctttgattcgaaacaaaactcagtttaattgtgtgtgtgtgtgtgtgtgtgtgtgtgtgtgtgtgtgtgtctaaagtcaccctaagcacactgttaataaccctagaatgactgacgtgttcgtattatgcaattttttatttttttcatcatattgacagataaaggattctaattcctataccttttcaataatgcagaagccttcataacatttaaattccattcatggtaaagattcttagcaaataaagaataaattgaaccttgatcaattactttaaagtagttataaaagacctatagtgaatatcatacttcagtattagaagctttctctttaaaataaggaacaagacaaataattggcaacatgacttcttttcaaattgcacagcattagggatccaagccataaaagaaaataaaagacatgtggatcataaagaaaatataaaacgttacttacagacaataaagttgtctgcataaagattataagagaaagctaaaaactattacagtcaaaaagagacatcagcaagcttggtggaaacaaaacaaacaagtacaagttgtcagtgacctttcaacaaccaattaggaaaaaaatatatatatacgttaaatcttaacactgaaaagcaacaaaaatatggaaacagtgcttcttatatgccagattctgattgaaatattttacaagtttaactcatttaattttcccagtgattcttgaggtagaggccatatttttcttaactttaatagatgcagaaactgaagcacagagagcacttgacttgcctaaggtaaaagttaaaaggcggcagatgtagaattcattcacaacaatctagatccagagtatttcttgtgcccctgatgatatgccaattctctggactctatcactaactctattaaatgatcaagaacttgaaagaaaaaaatatttaaattagtccatgaacaggaaatgtccaagtcataaacctagtaatatttcccaaagataatgcttaatagtggtgtcattacaaccaaaatactaaaaaaatgtgcaagccaatctcaaatatgtgggagagaaaacccaatactaatttgaagaggataaaagagcaaggcatctcccttgctgacagaaaggcttcttataactacaacattcatactgaaatgctattatactagatctagcactgaaacaatccaggccactacaaatgaatgaaaaatgagtccagaaaaacacagatccatatatgaaaatttgttttataacagaaattgcattaacaaatcagaggttaaattttaaaaaccataaaatatttcagacaattaattatttatgtggaaaaaagtaaagttgactcattatcctgcccagtacacaaaaatcaattccaggtggacttaaaaacataatgcaaaagcaaaactttaacataattaccaaaaatgtaagtcatcatctttatggtatttaaataaaaaaaagacttctttaaaaagacacaaagaaagcaaaacccataaagagaaaaactgatactcttgaagatgttcaagtttaaaactcatgcaaaatagcaccaaaaacaaggtgaaaaggaagcttcacagaggtactagataattctgctatgtttaactagcaaataattagtatccagaataaataagaaagcaatacatcactaagaaagtgacacacaaccctatagaaaaatgggaaaaaatatgaattggtaattcacaaaagagaaaatccaactgaatactaaatattataagagaatgttgaacaagtcaaactattaaagcaatacaaattaaattgccaataacattattttattcccatcctattgaaaacaattaaaaattctgaataccatgtggtggtgaaaatgtgatttcatgagtatatagcaatttggacagcaaactgacagcatgtgagatagttgatgatattcatatgacccagaaattccactattctagaaaataatcttgtacatatatataataaaatctatataagaatgtatactgcaacattttaaaattcaattaaagattagaaaagctctaaatgtatcaaaacaaagaacttgaaaaacagattataaataaatttatacagtggaagtcagtaaactgataaatcacaaaaacataagtttgagtaacaacatcaagttgcagtagacatgttcagtatatcatttccacaaattaacaaaataaatagtgctatatttttatggctataacacataaaggaaatatacatatgactttctagataggtattatttcttgtatctacaagtagaaaatggggttgcgcagagagggtgatagctacaattgcttctgtaattattctctttaaaatgatctgactcacaaacttaagagctggtggaaattcagcacgttttttttcctctttttctctccctgaaaagcatggaggtgttgtcactctcttcctgagtccctcagtgagcagacgtagagaaaaataccctaactgatctggaagtggaagatttaagttaaataaccttcaggaaaaaaggccttaaactgttttaaggcactaatattaaggtggtttcattgttacaggataacctagcatacgctgactgctattagaattcctgccatgaatcctaaaatatatgatatagtcttagtgatcattgggtgagtggcaaagcaactataactaaagctgaaagcatggtaatacatcttccgcagtgacaggatatttgataagactttcaccagcaaaaatatggaaggtacatgacattcctaataaaattgtagttccaagagaaggatggccagatttagcaaataaaattgcaaggcattcagttaaatttgatttccagatataaaacagatattattgtttagtaaaatttccatgtgatattatactaaatgattatacatatttgtactaaagaaaaacagtgttgtttacccgaaattcaaatttaactggttttctgtgttttacctggcaatcccatcaagagggagacgttgtgaaatagaaaagtagcaatatttcttggttactataaaagttatttaacaagactttataagggaacatgaagtcagagaagggggcaaaacactagtcattttaaaaactaggtggggaaatttggaagtagaggtgaccagatttcacagaagattgtagggtgagaggagtatagaggaagccaatataatacatcaaggtttatggtttgaaaaatggaaagatggaatatcaattacctgaaatgaagaaaatagcacacatttgtaatttgagttgcttattagcacccaactagagatatcaaatagatagttgaatatctacatctttgaattcaggagagagattcaaactgaagacataaatatggacattgacagcatatagatgacagtatactaagtttataaagataaaatagtaataaaagctaatattaacctcttttgtgtcagtccttgatgtaaatttttttatgtgttaactcactgagtccccacaataggtcgatgtaattggttctactataactacactctttaaaaatggatattttagtaaaaagaaggactcaatttatactcaccctcaatttgtagccattggtgtcatctctaagacaatttttagtaattgcctagtcagtgaaccttgccatagtccttagttatgtaaatttattgtattttttggaattccttttcattagccataacgctttaataacatatttttaaaattttgactttaacatctatattgtagtgaatatttaaagaacttcctccaagtttaggatacagaaatgggtaaattatgtctactccctcatatttcactattaagatgatggtaaattagcagtccaagagatcatggtcctgaaagtacagagaaaaaaatagaacccagtgacccaacataactaaggagcatatttgagacattgtcattcttggtatttctgaagaagcactgggatggaagggagttgagatcattttgtcagctacagcactaaattttggtcatgaatatcaaagtgattccatctttatgaggagcctgtggagaatggcaacatgctatatgtatacattttagaatggattaattgccatctgcgtaccttttatcaggttattctatttgttcagcatgccccaagatctcttttgtactttacaaatctgcacttcaattcttcttagttcgagactcacttcaacctaccgcatccttagttttctgcacttacttgttgtttctaaaaaagtatacatgatattatacaataaacatctagaattatacatttatgtactatattcacagaaattggacttgcctttaagccctcctttttacatatattcctgttattgtctcactgctaagtaatattactggatggcaaaataaaccaaaaaacacaaattgattttaatgaaaaatatcaatattaaatattagcttaaataacacaaataagtaaatattgaaatagatgggcatgttaggctgggcagctttttgtgggcacaatcatacaatttcaacttcaaattccatcatataacaggatgttctattggtacaatatctccttgttcacatgaggaaattaagtatattgatattcaccgaacaccaatttttaaatgtatttgaaattaattattttaagtgtctctcaactctcccaatagtgcacaaatatgtagttatgctatatactaataattaaataactttggaaactcacaacttcaaaaaaatgttcgctgttgtggaaagtttccgcagtagagaagggaatgtgaatggtatcagtcttagataacaagaaaactactttactttgtttcaactctactcatttgccatccaaatatgatagaagatgctgctcattcctaacaaatatttccagatatcatgcattccttaaaggagatgatactgattgccctctctattttcactcactttcccattacaattagcagcagattcttttaattatccctgcccttcttaaagcagtctcagatatataaaaattaattgcctggaactcacatctttataattttaaccttttcatgcttcacttatttacggtgacatttatctaaaacacttatcaggtgactgcgcatggtagacatctggtttatcagaaaaggcaggagaaaaaataaatgtaggacattaagcttgctatggtgctttgagactttcctagaaatcgttagctcatcaaaacttgttttggcatggcagaaagacatgtcccattaaaaggatattaatgcaagatcaccattgtcattaaaccatcataccatatattacacatttatgctgaaaatgggttcaaactttttattcccttatcctttaattattagaagaaactttgcagattatagccagataatttaaaataataaaatcaatgtcacttacaaggtcacaggatttagtaaaaccctgctacccatttccttttaagtaacttcgcattttagaaatgaagactgcctattcatgtggcttctgtgattttgttaaacattaattaacaaaatttctagtttttttttttttttcttctagagcagttcagtggaatgaaagaccttttttatcctatgcctctaaccacaaccgggtgtctctatcttaaaagatatttatcaagtctctgcttcatatttccttctctacaccattacagtcctcagcaagccctgctatctcatgatcgcaaatcttggccctttattgttggtcttctttctttcattgctacatgttagaataaatggtgtaagagaatgcttttatctattcaatttctttctctttggctcctgacccactgtctttgtttcagaataattatcagtgcctatatattaccttcacatatgaggcctttgttcgtttcattctttccatctcaattttctgtacattcgtattctctaaagtcttcatctctgtcaattgttcccttatctccctcaagtggacactgtcggcttttcgtagatgttcctactcaaaagagatcttgcaagccagtattttacattaagtaattgttctatttctcgacttttgctggcctataaatataacacatataaaggtagccattgcaggcacagtaaattatttgtctatgaaatcacaatgtttgccccagtatcttaatacaactctcaaatttatataattttttaatttaaaaatttaaaaataactttgcttaaacaaaggcagtttgttttctaacttatctatgtgtgtatgtatatatacacagaaatgtatatgtatacacacatatatattcataaattattgaaagtttcatgcaaattttttactttgccaatatgccccaaaacttgatatgaaattaattatacgaaggagtacagccttgtctttaattagctagaaaaattctcagcccacttaaataaactgttcccaacttggggagataaatttaaatatcttatcttggcaacgaacttataacccttaaaaacatttgctatggcatctatatattatatttcccttgatgtgaaaaataagaaacatttcagaaaaacccacaattaaagaatatcacctggcatcatgtctaaaaatgtataacagtaaaatagaaaagatttgtggatatgacaacaattctgcttgctttcaaaattattttttgctttgttttttgcaaagcctaattaaattaatatatgaatattgagtctattaatcttctctcttaaaaattcaaagcactattttaaagtaaattatcttaggaatattatctaagaatgaacttcatgtggtaaataccagcataagtcattactaaatgtgtttagggtatacaatggaagcagagtctgctgctaggaaaaattgaccttttgttttacaatttataatttatttagtgcagtatttgaaaatcatatttagatataacaggtgacaagagagctctatactaggaaagataattttagtactaccatctataaaagagactaataaatatgaaatgaagatgctataattaaactgtaactcttgcccatgccagcccaacataactattataaaattgtacataactatcaggctgttaatttgaggtaatattgcaggcactacaaaaaaaattcagtaactcatcaaaactattttcttatgaaggtaataaaagctacaatacctgcccatgtcaattatttaaaggtgttcgaagcaaatttcttaaataatttaatttctggagccagacataacagttgactttgtgctctttgacatttactactacagactgttgctaagtccaggcttcaagaactctcctgcatttattctttttaaatcaatggtacaaattatctaactagctatatgtgacgacagcagtggttctcagtttggttttaacaccacctggaaacctgcaaagtctcaggtttcaccccaggtctaccgaatcagaaacactagggataagccccaacaatcactgttttagtaggatcttcaagtgatttcaatgcaggttaagtctgaaaacactggaaaagaggagagaaaaagagagagagagaggagagatggagacaaattcccagaccatacactgcactagaaatagagtgttaggactttacaacaggttcaaaattttagagatgaattatagctgacatttgaacacaaaggaaaggagcccattagtccagggaacatctctgattataaacaacttcatttcctgcttaggtattattcaaatgtatatttaacagtataatgcttctctacaatcaagtaaagctcaaacaaatttaagatgtctttttttttaatgttgtatgttgatgagatttaaactaatagaggcttagctcaattggtgattaaggtgatgagtctgccctggaggtggaaataaatatttcattagacttgtgatgaattctagataattttgacactactagaatgattttgaaagtctggatgatttttgaccaaatatagacccaaatacaaatattgtgaataaaagtattgctaggatttagaaactttaacaagttacataatgtttaaattcatgatttctgtgggtaatttgtggtcagtgctttggggggcagaatgttaaagagatttctatatgagattatgagtaaaactttgtgacaaacaatttgaaaaaatagttgaaaagaagaattcagtaggtaaagttaaaaaagtagaccttactatgaaaaaaagagtagggatatatagaaaatttagatattacgagttgaatgtgtgcagacttcccaagatctatgaatgctataaggaccactacagttgatagcgtagagaaactaaggcaatatttatgcagtgttttagaaggccacagctccattccattactatctgatgatattttagcaaagctggactctgcagtatccttttttgtttgaagaggaatagtagaaggagcatttgtcactcttatttcaccttcaacttctcattatttcccatacacgctcctgttacaattcttgggaaataattaaaataaacttacagccttttatatgggtaatttaaccatatttactagtgtttaaatgattcaaccactgctaggctgtgtagaaaatacaagtactggtagttgtgtgaaagttagctgagtttagataagaggtggcctgaaaagtcaagtctcactagagcactgagattttaaaactattctctgggaactagctagctagctagctagatagatatagatgtttctcaataacaacaataaagaaaattatttcttcatgtatttattacaataagcaaaatattgactaataaaaacacaagaaaggaaaaatactaacaaaaaacatcctgaatactctatatactaaagtgtaataccaaaataaaaattagacacttagcattttctgtgagataaaatagaccaagcaatgagcctcgcttgatgcttcatacaccaggagagctggaaggatgcacaggttcagtaaaaacatgccaaaattaacatgagaagacatgattttatttacttatttatttattttttagagacagggtctcactctttcacctgggctgggatgcattggcacaatcagagttcactggagcctcaagttcttgggctcaagcctcctgagtaactaagactacaggtgcatgccactatgcccaaataattttaaaaaaatttttaacagaaacggagtctcactaagttgctcaggctggtcttgaactcctggcctcaacccatcctttcatctcggcctccctaagtgctggaattacagtcatgagccatggtgcccggcctaataaatgattttcaataaattatatttaacaaaatggattagaattaaccaaaaaataaaactagtaattcaaagctttaaggagtggatgtaggtatgtatctacgcatggatgtctgttaattttgtttctttttaaatcagagaaaacaaatttgaaaagatgctttgaaagtagctgccttcttattgtaattgttttaccaaatagcaaagtctagttcttcaaaattgtcagaacctgttatttatactccatttattcttatgattgggcaatgtgtggcacatttaaggattattttccagtatatcataaatatattaacaatgtgacactttaaggatctaaggaggactgaaaattttatctgaggaattcgttagtctatcacagaggtagctctttgatacctaagtcatcaccttttatagaacgtaacataaaggttgaagttttcacagaataagtaatactgtgaattttcagatagagtgtaaactcctctgggttggctggcttttctgtccttacagagctgcccattgtggtcaaattgaccacatgagaagttgatgatgcagttatgccatgcatagcaaccgcagcaggccttcctcattccaatgtaaatattcattatatgaagcattatctaagacccttttgccttgaaagagagagtaaaaaattaatcaggagtagagtctctaaaatattcatttccctggttcatggagtcatacaagcttctttatcatctcagcattttagtctagtccaaaagcccaaagactaaataaagtaattgatacatggcatccatgaaaataatacaagtaaaatatggctttatgttgactatgcaaatttcatatgaaagaaattgtttccaagaaacttaactcaataaaatttaaaccataaatatttttcaccaattttattcaataaatacttactgagaacctactgtttcctggccttgttatacttgtttggaattcatttgagaagtcaaccatataatacttcatgacattggtctaggcacaggtttttttggataaaaacttaaaagcacaaacagtgaaagaaaatttaaaggcatcttaacagaaaaaaaaaacaatcagcagagtaaagagacaacctaagaacaggaaaaaatatttccaaaccatgtatcagataagatattaatatccaaaatatataaggaactcaaacaactcaatagcaagaaaacaaataacctgattaaacaatgggcaaaaaaatctgaatagatatttctcaaaagaagacatcaaaatagccaacagatatatgaaaaatatatttaacattactaatcttctgggaaatgcacataaaaaccacaatatcatctcatcccaattcgaatattatcaaatagacaaaaaataacaaataatggcggggatgtaggaaaagggaaactctattacactgtttgtgggaatgtaaattagtacagtgtttatgaaaaacaatatggaggttcctctaaaaattaacaatagaactaccatatgatccagtcattctactactgggtacacatccaaaggaaatgaaatcagtatgtcttagagatatccacttccatgtttattgcagcactattcacaatagccaagatatgaaccaacctaattgttcatcaactgataaatgaataaagaaaatgtggtatatatacacaatggaataccattcagccataaaaaaataaatcctgttattcaaggcaacataaaagaacctgaaatgaaataagccaggcacagaaagacaaataccacttgatctcactcacatggaatttaaaagagctgatttcatagtagagagtaaaacagcagttgctagagactgagaagtagagtgagaaggaaagatggagagagactggtcaaaaaattcaaagttacatttgcacaggatgaataagttctggtgctttattgcacattagagtgattatggtaaaaagtattgtattgtatgtttcaaaatacttagaagaaagaattttgaatgtttttaccacaaacaaaatgataactgtgtgagatgatggatatgctgtataccctgaaaagattattacataatgtatagatgtaggaaacatcacactataccccataaatatgcataattattatgtgtcaaaaacaaaatttttaaaagttaatcactctctaatgaaagtatcttttggctcctagacacctgattttttttttccattttgccaaaagtcaaattctacatactaaaacaaagaatttattgtatcctttcaaaacaatatattttaatagcatctatagattcatcaagcaatgatgtaatgaacacaataaaagcttgagtaatctaactactttacaatagaaattgtaatgtttttgtttttgttttgtacgttcaatcctctgaaaaacatgactcttcctgatttttttttcttttttgaaaggagtcttgctctattgctcagtctggagtgcggtagcacgatctcagctcactgcaacctccgcctcctgagttcaagcaattcttcctgcctcagcctccagagtagcttggattacaagcaccaccaccttgccaggctaatttttgtatttttttagtagagacggggttttgccatgttggccaggctggtgttgaactcctgacctctggtgatccacccacctcccaaagtgctgggattataggcgtgagccactgtgactggccaatattttaaatgttaatgtctatcattatattttctcattctcttttgctgtacttattaaatggtctattatcctagaaaataggtaagaagatgaaaaacaaaccagtagcataagatctgaaactgattgataagttatacattaaatatatgatttgatttgcttaagacctctagtatttctattccttttttaatttttagagtttcaaaatttcattataattttggttaaatttactgacttctcaaaacttctaaagtttaatgaactatatacccatcagtgtattaagcagaaaaatagtttagaaaattgtcaccaaagtatgcactttgtatctgaaaacaataatgaggcttctctctgaccattaatcttgggcttttatgacacacaacaattttactattttgtttatttgcttggtttatagtacatgaagacagaaatattatagtttctgtttcatgtagcacatttctttaaaaatgtgttttaaaatgcctttttttctgcaaaactgaattccagtacctaatttctctgttactttggtgggccaggagtcctgccgagaagaatattgatgtctctctcatcagaggtttttgataatgtcaggtttccaatatatcctaggggtatatttttacctttttaaaacaaaatttatttttgcctatttttttcgttctaaggctctttatgacaggactatttaaagcactgaggacaagacaagatgtttatatatacttcctgctgtttaatattcatgcaattctgacaagattaatatactaatttctctgtcattagtttcattaacagatattaattatatctgaatctaaatgccaaatgaatagacagttgggattcaattctatttaagataatcgaagttctctttacaatcatgattggggtggcatacataccatctattctggttagagatggactctggacgctagataaaacacttgggattaaaacacttatcctagaacttatcattataggcacttcacataatgggggaaactgaatatttacaataaccttttggaatagttgatgatgatgatgatgggaaagagagagagaaaggccaggtgtggtggctcatgcctgtaatctcagcactttgggaggctgaggcaggtggatcatgaggtcaggagttcaacaccaacctggccaacatagtgaaaccccatctctaccaaaaacacaaaaattagccaggcatggtggagtgtctgtagtctcagctacttgggaggctgaggcaggagaatcatttgaacccaggagggagaggttgtggtaagccgagattgtgccactgcactccagcttgggcatcagagtgagactccatctctaaataaatacataaataagagagagagagaggagagagaaacatccttttttctggtaaaatttagagactagattgtccaatgaagatggctgaataggaacagctccggtctgcagctcccagtgtgactgacgcagaagatgggtgatttctgcatttccaactgaggtactggttcatctcactggttgaatagtgggtgcagcccacggagggcgagccacagcagggtggggtgtcacctcacccaggaagcacaaggggtcaagggatttccctttcctagccaagggaagatgtgacatactgtacctggaaaaatgggacactcccgcccaaatactgtgcttttcccaaggtcttcgcaactggcagacaaagagattctctcctgtgcctggctcgtcaggtcccacacccacagagccttgcacactgctagtgcagcagtctgagattgaactgcggggcagcagcctggctgggggaggtgcgtctgccattgctgaggcttgagtaggtaaacaaagcagccagggagctcgaactgggcagagcccaccacagctcagcaaggcctactgcctctatagactccacatatttgggcagggcatagctgaacaaaaagcagcaggcaacttctgcagacttaaaaatccctgtctgacgctctgaagagagcagttgttctcccagcatggcatttgggatctgagaactaatagactgcctcctcaagtgggtccctgacccccgtttagcctaactgggagacacctcccagtacgggctgacagacacctcatataggcaggtgcccctctgggatgaagcttccagaggaaggatcaggcagcaatatttgctgttctgcagcctccactggtgatacctaggcaaacagggtctggagtggaactccagcaaactccaacagacctgcagctgagggacctgaatgttagaaataaaactaacaaaggaatagcatcaacatcaacaaagcagaaaggaatagcatcaacatcaacaaaaaggacatttataccaaaaccccatctgtgggtcaccaacatcaaagaccaaaggtagataaaaccacgaagatggggagaaaacagagcagaaaagctgaaaattctaaaaaccagagtgcctcttctcctccaaaggaatgcagctcctcaccagcaacagagcaaagctggatggagaatgactttgatgagttgacagaagtaggcttcagaaggtcagtaataacaaacgtctccaagctaaaggagcaagtttgaacccattgcaaggaagctaaaatccttgaaaaatggttagacgaatgcctaaccagaataaacagtgaagggagaccttaaatgaactgatggagctgaaaaccatggcacaagaactttgtgatgcatacacaagcttcaatggccaattcgatcaagtgaaagaaagggtatcagtgattggagatcaaattaatgaaataaagtgagaagagaaggttagagaaaaaggagtaaaaagaaacaaacaaagcctccaagaaatataggactatgtgaaaagaccaaatctacatttgattggtgtacctgaaagtgatggggagaatggaaccaagttggaaaacactattcaggatattatccaggagaacctccccaaactagcaatgcaggccaacattcaaattcaggaaatacagagaacaccacagacactccttgagaagagcatccccaaggcacaaaattgtcagattcaccaaggttgtaatgaaggaaaaagtgttaagggcagccagagagaaaggtcgagttacccacaaagggaagccaatcagactaacagtgggtctctcagcagaaaccctgcaagccagaacagattgggggccaatattcaacgttcttaaagaaaagaattttcaacccagaatttcatatctagtcaaactaagcttcctaagtgaaggggaaataaaatcctttatggacaagcaaatgctgagatattttgtcaccaccaggcctgccttacaagagcttctgaaggaagcagtaaagatggaaagaaacaaccaataccagccacctcaaaaacatgccaaattgtaaagaccatggatgctatgaagaaactgcatcagttaactggcaaaataaccagcgaacatcataatgacaggatcaaattcacacataaaaatattaacctaaaatgtaaatgggctaaatgtcctaattaaaagatacagactggcaaatcggataaagggtcaagatcaatcagtgtgctgtattcaagagacacatctcacatacaaagacgaatataggctcaaaataaagggatggaggaagatctaccaaacaaatggaaagctaaaaaaagcaggggttgcaatcttagtctctgataaaacagattttaaaccaacaaagatcagaagagacaaagaaggccattacataatggttaaagggatcaattcaacaagaagagctaactatcctaaatatatatgcacctaatacaggaacacccagattcataaagcaagtccttagagacctacaaagagacttagactcccacacaataataatgggagactttaacgcctcactgtcaatattagacagatcaacaagacagaaggttaacaaggatatccaggacttgaactcattcatttgaactcgcacttataaaattgaccacataattggaagtaaagcactcctcagtaaatgtgaaagaacagaaatcacaacaaattgtctctcagaccacagtgcaatcaaactagaactcaggattaagaaactcactcaaaaatgcacaactacaaggaaactgaaaaacctgctcctgaatgactactgggtaaataacaaaatgaaagcagaaataaagatgttctttgaaaccagtgagagaaaagacacaacattccagaatctctgggacacatttaaagcaatgtgtagagggaaatttatagcactaaatgcccacaagagaaagcaggaaagatctaaaatcaataccctaatatcacagctgaaagaactagagaagcaagagcaaacaaattcaaaagctagcagaaggcaagaaataagtaatatcagagcagaactgaaggagatagggacacaaaaaaccctccaaaaatcagtgaatccaggagctggttttttgaaaggaccaacaaaattgatagacctttagaagactaataaagaggaaaagagagaagaatcaaacagacacaataaaaaatgacaaagtggatatcaccacagatcccacagaaacacaaactaccaccagagaatagtataaatacctctatgcaaataaaccggaaaatctagaagaaatgtataaattcctggacacatatgccctcccaagactaaaccaggaagaagttgaatctctgaatagaccaataacaggatctgaaattgaggcaataattaatagcctatcaaccaaaaaaggtccagggccagacggattcacagcctaattataccagaggtacgaagaggacttggaaccattccttctgaaactattccaattaatagaaaaagagggaatcctccctaactcattttacgaggccagcatcatcctgataccaaagcctggcagagacacaacaaaaacagagaattttaaaccaatatccctgatgaacattgatgcaaaaatcctcaataaaatactggcaaaccaaatccagcagcacaagaaaaagcttatccaccacaatcaagctggcttcattcctgggatgcaaggctggttcaacatacacaaataaataaatgtaatccatcacataaacagaaccaatgacaaaaaccacatgattatctcaatagatgcagaaaagaccttcaacaaaattcaatggcccttcatgctaaaaactctcaataaatcaggtattgatgggatgtatctcaaaataataagaggtatttatgacaaacccacagccaatatcatactggatgggcaaaaaatggaagcattccttttgaaaactggaacaagacagggatgtcctctctcaccactccttttcaacatagtgttggaagttctggtcaggcaaatcaggcaagagaaagaaataaaggacattcaattaggaaaagaagaagttaaattgtccctgtttgcagatgacatgattgcatatttagaaagccccattgtctcagcccaaaaattccttaatctgataggcaaattcagcaaagtctcagatacaaaatcaatgtgcaaaaatcacaagcattcctatatgtcaataacagacagagagccaaatcatgagtgaactcccattcacaattgctacaaggagaataaaatacctaggaatccaacatacaagggatgtgagggaccttttcaaggagaactacaaaccactgctcaatgatataaaagacacaaaaatatggaagaaaattccatgctcatagataggaagaatcaatattgtgaaaacggccatactgcccaaggtaatttatagattcaatgccatccccatcaagctaccaatgactttcttcacagaattggaaaaaaactactttaaagttcaagtggaaataaaaaagagcccgcattgccaagacaatcctaagcaaaaaagaacaaagctggaggcatcatgtaacctgacttcaaactataccacaaagctacagtaaccaaaactgcatggtactggtacaaaaacagatatatagaccaatggaacaggaaactgggctcagaaataacaccacacatctgcaaccatctgatctttgacaaacctgacaaaaacaagcaatggggaaacgattccctatttaataaatggtgctaggaaaactggctagccacatgtagaaggctgaaactggatcccttccttacaccttatacaaaaattaattcaagatggattaaagacttaaatgttagacctaaaatcataaaaacctgagaggaaaacctaggcaataccattcaggacataggcataggcaaacacttcatgactaagacaccaaaagcaatggcactaaaagccaaaatagacaaatgggattgaattaaactaaagagcttctgcacagcaaaagaaactaccatcagagtgaacaggcaacctacagaatgggagacaatttttgcaatctacccatctgacaaagggctaatatccagaatctacaaagaactcaaacaaatttacaagacaaaaacaaaaaaacccattaaaaagtggtcaaaggctatgaacagattcttctcaaaagaagacatttatgcagccaacagacacatgaaaaaatgctcatcatcactggtcaccagagaaatgcaaatcaaaaccacaatgagataccatctcacaccagttagaatgacaatcattaaaaagtcgggaaacaacagatgctggagaggatatgaagaaataggcacacttttacactgttggtgggagtttaaattatttcaaccagtgtggaagacattgtggcgatttcttaaggatctaggactagaaataccatttgacccagcaatcccattactggatatatacccaaaggattataaatcatgctactataaagacacatgcacacgtatgtttattgcagcactattcacagtagcaaagacttggaaccaacccaaatgtccaacaatgatagactggataaagaaaatatggcacatatacaccatggaatactgtgcagccataaaaaaggatgagttaatgttctttgcagggacatggatgaagctggaaaccattattctcagcaaattatcacaaggacagaaatccaaacaccacatgttctcatagttgggaatcgaacaatgagaacacttggacacatggcagggaacatcacacactggggcctgtcagagggtggggggctggggaagggatagcattgggagaattacctaatgtaaatgacgagttaatgggtgcagcaaacaaacatgccacgtgtatacctatgtattcaatctgcacgttgtacacatgtaccctagaacttaaagtataaaaacagaaattagagacattttctgcctcaaatagatataacgcatgttactaatttattaagcagaactcatcaagatgccaaaagataaaaatctactaaatcaatgatatagttaccaaaagtcaccctgtataattcatggatttaggacatgattaagtacatacttagcataattgaaaggtgtccacctgaaagcaacagtaatcacacacacacagacacacacatgagtcaatctgtcaaaattacacaccaagcttttaattaattcatcaattatacatcagtgtttctggattattagaattattttgacacattaaaaagtaaacactcctaatttaactcatattatttttgataaaggcattgtggtatgccatcatttcataatatacactgaaacatattcaaataaaatgaaactatatctgagacatgcttcaagtaatttgggaagaaaggatgggagaagatatagttggtgcaagtatgcctatgaattggtaattgttgaaactgggtgataaattcatagtgtggtcatgatggtcttctgtttttttgtatatatttgaaaattgctatataaacatttttgaaatacaaattcttaggccacattccagtcatattgaattagaataccctggagttgaagcttcaagtgagaggtgaagccagctgagcttctgggccggatggggatttggagaacttttgtgtctagctaaaggattgtaaatgcaccaatcagcactctgtaaaatcacaccaatcagcatgctgcaaaatggaccaataagtgctctgtaaaatggaccaatcaattctctgtaaaatggaccaatcagcactctgtaaaatgggccaatcagcaggatgtgggcggggccaaataagggaataaaagctggccaccagagccagcagcgtcaacctgctcggatccccttccatgctgtggaagttttgttctttggctctttgcaataaatcttgctggtgctcactcttagggtccacaccacctttaagagctgtaacactcactgagaaggttcatggcttcactcctgaagtcagtgagactacaaacccactggaaagaagaaactctggacgtatctgaacatccaaatgaagaaactccggacataccatctttaagacctgtaacattcactgtgaagctccgcgcttcattcttgaagtcagcaagaccaagaacccagtggaaggaacaaattccagacacatttggcaaccacgaagggataatcaccaagtagtgagtaccatcggacccctttcacttgcaattctgttctatttttccttagaattcaggatctaattatcgggcacctgtcggtcagttaaaagtggttggtggccgggcgcggtggctcacgcctgtaatcccagcactttgggaggccgaggcgggcggatcacgaggtcaggagatcgagaccatcccggctaaaatggtgaaaccccgtctctactaaaaaatacaaaaaattagccgggcgtagtggcgggcgcctgtggtcccagctacttgggaggctgaggcaggagaatggcgtgaacccgggaggcggagcttgcagggagccgagatcccgccactgcactccagcctgggcgacagagcgagactccgtctcaaaaaaaaaaaaaaaaaaaaaaaaagtggttggcacggccactggaataaaaacacgggtgtcaggcattctaggaaagggctctcttacaacccctgactcttcggggttggaagcattgatttgcctggaaccagcttccacttttcttgtacttctgggctgagccgagggtagacagagtggaaagccattcagctccagggtcccaacaacaagttggttgaccctgaggctgagcggaactctcaaagacatgtcgcctaagggagactcgcccatctctcctatctatcctgacccttgcctcctgggtcctcatgcctgtcagacaaacttcctcttgcctctcttctctgaggctagtctcgcttctaaaaaccactccctgtctctggtgcttttctagtttctcgtataagaatgatttctagcataaactttaggactctattcccttctttaggcacccaggctcaccaatcagaaagacataatttttgcccaaagccccatcggaggagccagactatcttatctggaattttaggacccctcctcaggctagcaggcctaacaaaggctattcctgaagctaggatatggggagcctcagaaattgtatccttgctattcatataagtgaggacaaaaggcatcactcttccaaccctggagatctcttccctctctcagggtatggccctccacttcatttttggggcataacatctttatagggcatggataaagtcccaatattaacaggagaatgcttaggactctaacaggttttctagaatgcattggtaagggccaataatccgaccttcctcattcctccttgtggtctaggaggaaaactagtgtttctgctgctgtgttggtgagcgcaactattcccatcagcagggtccagggactgttgtgggtgcttgggcaagaggggtttctgctgccacgtcagtgagtgtaactattctgatcagcagggtccaggggccactgtgggttcttgggcagggggagaaacaaacaaaacaaaaccgcaggtggttttgtctttcagatgggaaacactcaggcatcaatgggctcacccttgaaatgcatcctaagccattgggaccaatttgacccgcaaaccctgaaagaaaggcagctcatttttttctgcactatggctcggccacaatattatctctctgttggggaaaaatggccacccgagggaagtataagttacaatactatcctgcagcttgactttttctgtaagagggaaggcaaatggagtgaaataccttatgtccaagctttcttttcattgaaggagaatccacaactatgcaaagcttgcaatttacatcccacaggaggacctctcagcttacctccatatcctagcctccctatagctccccttcctgttagtgataaacctcctctaatctcccttgcccagagggaaataagaaaagaaatatccaaaggaccacaaaatcccccaggctattggttctgtcccctttaagtagggggaggggaatttggcccaacgtgggtacatgtccccttctccctctccgatttaaagcagatcaaggcagacctggggaacttttcagatgatcctgataggtatataggtgtcctacagggtctagggcaagcctttgatcttattggaaagatgtcatgctattgttagatcaaaccctggcctttaatgaaaagaatgtggctttagctgcagcctgagagtttggagatacctgatagcttaatcaagtaaatgatagaatgacagctgaagaaagggacaaattccctactggtcagcaagccgtgcccagtatggatccccactgggacttcaactcagatcctggggactggagttgtaaacatctgttgacctgtgttctagaaggactaaggagaattaggaaaaagcccatgaattattcaatgatgtccaccataactcatggaaaggaagaaaatcctgccttcctcgagcagctatgggaggccttaaggaaatacactccactgtcaactgactcactagagggtctattgatcctaaaagataagtttattacccgatcagccacagatatcaaaagaaagctccaaaagtgagccctaggccctgaataaaatctggaggcattattaaacctggcaaccttggtgttctataatagggaccaagaggaaccggcccaaaaggaaaagcgagatcagagaaagactgcagccttagtcatggccctcagacaaacctaccttgctggttcagagaggacagaaaatggagcaggccaatcacccagtggggcttgttaccagtgtggcttgcaaggacaccttaaaaaaggttgtccaatgagaaacaagctgccccctcatccatgtccactgtgcagaggcaatcactggaaggcacactgccccagagggcaaaggttctctgggccagaagcccccaaccagatgatccaacaacaggactgagggtgcctggggcaagtgccagctcatgtcatcaccctcactgaaccccaggtacgtttaactattgatgaccaggaaattgacttcctcctggacactggcatagccttctcagtgttaatctcctgtcccagatgactgtcctcaaggtccgttaccatccaaggaatcctgggagagcctgtaaccaggtatttctcccacctcctctgttgtaattggaagactttgctacagatagtaagtatgcttatctaatcctacatgcccatgctgcaatatggaaagaaagggagttcctaacctctgggggaacccccattaaataccacaaggaaatcatgcagttattgcatgcagtgcaaaaacccaaggaagtggcagtcttatactgccgaagccatcaaaaaggggaaggagaggggagaacagcagcataagctgctgacagaggcagggaaagaccagcagaaaggaaagagagaaagagacagaaagtcagagaaagaggaagaaacagagagacaaagaggaggagacagagagaggaagagacagagacaaagaagaagtcaaagagtgagagagaggaagagacagagagacagagagtcaaagaagtaaagagaggaagagacaaagagggagtcagaaagagaaagacagacaaagaagagagagacagacaagaagtcaaagagagagaaagagggagatagaagtagtaaagaaaaaacagtgtaccctattcctttaaaagccagggtaaatttaaaatgtataattgataattaagggtcttctctgtaaccctataacactccaataccaccttgttgtcagtgtaaacaagggtgtagcccaaaagcactgaggctactgacaacccatagccttcctatcaaaaatccttaacccagcaggtttccaaacagggatctaaatcttaatgaattaccatacaaaggtctgaccagatctaggaggaactcccttcaggacaggaggatagatggttcctcccaggcagttaagggaaaaagacacaatgggtgttcagcaagtgataaggaaactcttgtagaagcagagttaggaaaatttcccagtgattggtctgctcaaacgtgcgagttgtttgcactcagccaaatcttaaagtacttacagaatcaggaaggagctatctataccaattctaagttaatatggactgaacgaggttttcattaatagtaaagaaaaattataatcccaaacttacaaggctttcaactaaagtttgctaaaagttaacagtgtaatatgtattatcctgctaccacacactcttaaaggaattctcagacagtttgcaagaaataacgaaatctatccttactctacaatccgaagtagactctttggcagcagagactctcctaaactgctgaggcctagacctcctcactactgagaaaggaggactctgcaccttcttaggggaagagtgttgtttttaccctaaccagtcagggatagtaagagatgctgccaggcatttacaggaaaaggcttctgaaatcaaacaatgcctttcaaactcttataccaacctctggagttgggtgacatggcttctccactttctaggtccggtagcagccattttgcaattactcacctttgggccctgtatttttaacctccttgtcaaatttgtttcctctaggatcaaggccatcaagctatagatagtcttacaaatggaaccccaaatgaactcaactaacaacttctaccgaggatccctggactgacccactggccctttcactggccgaaagagttcccctctggaggacactacagctgcagggccccttcttcgcccctatccggcaggaagtagctagagtggtcatcgcccaattcctaacagaagttggggtgtcctgtttagaggagggattgagaggtgaagccagctgagcttctgggtcggatgggggcttggagaacttttgtgtctagctaaaggattgtaaattcaccaatcagcgctctgtgtctagctaaaggattgtaaacacaccaatcagcacttggtaaaatcgcaccaatcagcactctgtgtctagctaaaggattgtaaatgcactaatcagcgctctgtaaaatggaccaatcagcaggatgtggatggggccaaataagggaataaaagctggccacctgagctggcagcggcaacctgtttgggtccccttgcacactgtggaagctctgttttttcactcctcacaataaatcttgctgctgctcactctttgggtctgtaccacctttaagagctgtaacactcactgagaaggtatgtggcttcactcctgaagtcagcgagaccacgaacccaccggaaggaagaaactgcagacacatctgaacatccaaaggaagaaactccagacagaccatctttaagagctgtaacactcactgtgaaggtctgtggcttcattcttgaagtcagtgaaaccaagaacccactggaaggaacaaattctggacacacaagttcctaggcttcatccaaaacattaaatcagactctttgaggtagagtaagacacatatttacaagctagttatgcaagttatgatccaggtaaaacactaatcgattgtatccaaaatataagtcttctatcattctgttgtacaaaatgaatgaaatctctaaaatatttctttaggaaccaacacaaagatattccattgtactaagtttgttttctggaaaacaaactctcaggtaaatttgcatgtatgatgtttataagggaattaacttttaattaattatgagaggggagttgaaaagaagtacaatccaggcagagacaacaagcccacagaatatcttaaaaggaatggcttcctgagttctcatgcactgaggctagatgactgggccttgatataactctctccagccccactgaccagccatttgatactatgcttccaggtgatgaatttgtgtgaaatggttgtctttaaatgaagggcaattcctcaggagagactcaagtaattttcactagccagcaacattcctagcatgtggggatgaaggtaattgagaggggagaattcattgcctcaatggttacacatgtaacacttcatagcacccaccacatctataagagctaatatattttttctgggaatttctttactgtcttttctcatttatctttatatatcccttacaagtcaacaaagaaatactgcagtggtggttatagtgactacactgtggttgctggctgtttttttagtgtttaaattaaataatattacccttaggaataaaatgtaaaaccatttttttaaaattcccatcaaaatcaacataacatactgtttgtgttagtaacagaaatatatttaactgcatagataataatgaatagcagtctggattttcaaataaattatttcaagatgatatttactaggttagatacatgtaccctaactcccacccattcacttcctagaaatgtgttttaggtgatgttatttaggtggtaaaatcaggtcaataactcctactgaatccttagatattatgtgttgtacagggaaaaggtagtataggtaaaacttgtgtgagacacactttgttgttttagactagactgtaagttccagctgtgtctgaatgtttgtgtttccccaaaatacatatgctgaaatcctaaccctcaagatggcggtattagaaggttgggaggtgattaggtcatgaggggtgttaacaatagttcccttaataaatgaaaggcctaagagagacccgtcgcacattccactatttgaggacaccactaactgtgagccaaaagcaggacctcctcagacatcgaatctactggtgcctttatcttagaatgccaacctccagaactgtcagaaataaatttttagttttataaatgcctagtttgtggtattttttatggcagtcgatcagactaaaacaaatgtttactctgttgtgatcagatagtttatataacttacctaacacataataggtactctagtaggtcgctcctcctttgacctcagacctttccatttgagaaattttacaactttatttcaaaatgcattccatctactttacaaagtaaaaatacaaaggcctcttatcatgatgtgactattaggctttacaagcctatatcaaagtgtttcatgtaccccataaatatatacacccacacatattaaaaatttaaaaagtgaatgttatacacctccccacttcctttacaaaacttagctcaattccatctggataataagaaaaataggaaactttattgaataatgagtcacttctatgtgtaatttccactgctagtatgagccttcagaagggactggctttaagaattggtacagttcttgactgagaggaacttccaccacctagcagatggggcaatagattacaagggcaattatcactcagagaattgctgataaggtcaaattactgctgtcactttattcttaatctctgtatgcatttttttttctaaaagaaaactgcatatacaattctacagaccaaaaatattgcaaaaaatatgagtttatatgtcctaagagggttccccaattatcacaattgtttcaaatggaaacaatttcatatcccatatgtacatatatataaaaatatatttatgtatgtgtatatatatgcatatatatgcacacacatacacatttctctgcagatgttagtatgtggaaatgtattgctatataatagggacaataattagaactcaaaatctagagtaatgcaactgaaagtcatatcatgcatgtattacaagtaagatactctgcaatgtatacaagagaatgtaatttttaaggaccaaatgtgtgttattaatcaggtatacactctgtaaacactacgtggtataaaattgcttctcaacacaggaaatatttataacctaagtatacagtccaagaagtactttatttctgacacttcataccaaagcaaccagactgacaaataagcattctgagtaaaagcagtgttttaaataacttttgaacccaatgcatgcatgcaaggctgataaatgcaaacccttttacataatactcaaatcatattaaagagatgcttcttgacagagatacacttaaaccattctacatttctcctttttgttctcctgtgtgaaaatgtcaccttaaaagcaattttttaagaaacaagtgctgtttcatttcatgtcttcagatacattgtctgcccatgttttagcgattaggaatttagaggtttttggatgtttattacaactctttgacttatcagtataaatatttatcataccaatcatatttattctttgattatcttgacatggcaaggttttttcaattttatttaaaagagccagctgttttgtatcttatttactcacccatatcattgtttcccgttaaattaacactggcataagccagctgcaagttgcaaggaaatcgcactgaaaacagagctactataaattgtattcgcctctatataccaacaaaaacaaataaaacttttttattaatctctatgactttgttgttgtttaaagcaaatctacattaggaagagttgtcaggaaatttgggaagttatattgtttcctgaaacctgatattgattgatgagagtataccaatgattgcaagttctgagaaaagagttttacacaaaatgaacagcaaaagcttgggcatgagaacaaacttagaatgtccaagggataggaaaaaacgtcctggcagcagagcagcagataggcaggaattgaatcatgtgtactttggtaagccatacacgggcattgagaattttattcttaccacagttggaagtcactggaatattttaagcaagagagtaacttgaactgatttatgcttttaaaagattaccctgattggctgtgtgaaaaataagcgatagggagcaaaagtagaaacagggacaggagatgacagtggcttatgtataagatttcttctaaggatcttgaaagcatcatgaactaacatcacttgggaagtagataaattcattgctgtgtccatagtctgtttatttccctttttttttgtatgtatttgcagaatatgttagtaaacaaagtgaaattcaaggaaatcactattagggctgcctacaaatcaagtcggtttagagctattatagttgagtagtaatattctttcagaaaaaatcttaatcataaagcccaacacttatactatggcttcttaaaagtgaagctgcaaaactgcttgtgaacaatcttacagctatttttataactttttaaagtgttatgtacataatttcttttctgatgacctcattgaattctaaaccatcttttagccacacataagccccaacagttaaaactattaaaatgcattagcatgtccttcattatttgttttaatcaagaagaactgaaataaggaatatgtaacataaatttagttttgctaacgaatacatcagagagaaatatatctccttagagaggaatatattttatctaggtattttttttgaacagtgaagcactttttaaaaaagtaatactgtacacagaattccaaaatataaaacagacaaataaattaaggtacctttatacaaagtcattctatgcagctattataaaaagtaaaatatatatgcattgatagggaagttttaatttattccatataagtaaatattaattgagcattttatatttgagccatcatcctaacagtttgtgataagatagcaaatgatatagggaaagtctctgttttcagatgtttttatattttgaaggaagtagacaaatattaatcaattaagtgaatatgcaagaaatttccacatagtaaactaatctgcagaaaacaaagtcatgaattatctaattcttgagggaacctattacagactgtgttattagggaagccttttttaaggaggcatatatgagggaaaatctaaataactaaaggagccagccataggaaaatagcagaagagaatattctggaaaaaaaaaatggcacacaaagacatttcacctcagccaaagaatatgggatgataaaggacagaaaaaagaccaggaagcaggaggaagagaggtagtagaagcagatgggatgaggcaaatgagacaagatagtgtaggaccttacaggtcatggtagaggaagacacttagatatgattacttaataagaagctatcatagcactgaagcatggaagagatgtgatctaatgtctatttttcaatgccattctgaccagatttcgggcaaacctggtagacacccatagtaagactccaggaaaaaaaaaatttgatggtttgattatatatttgctttaaacatttggcttttcagctgccttgcatccatttccctttaacaatttatctgtttttaaattaatgaccttttctattagacacactttcatcaggggccctgtattgattggtatcttccagagaaacagaaccaataaaatgtgtgcgtatgtatgtatatgtgtatgtttctcagagagagagagcgagagaaagataatttaaggaactggctcatgtgattgtggagttgggcaagttcaaaatctgtaggacaggccagcaggctggagacatagggaggaattgtcatagtttgtgtccaaaaatagtttgccagaatcctcagttttttgagggaggtcagtctttttacttaaagccttcaactgactggatgcagccaaccgatatcatagatccaaagtccagtgatttaatgttaatatcatctgaaagcataccttcacatcaatatctagatatatttgacagatatctgggtaccatgtcttagccaagttaatgcataaaattaactatcccaggctccattccctctggtcaaagggcaagcatgtgattcaagctaggtcaatcagttgctctctccctcaaatttgcactgggttaaaaagacaaagaattacatcctgtctatacagtcatgccaaatcacatgatccatctccaacccctaaaacacataggtatggcttttgttctcaaccttcagctcctaattcctttaaaaagttaccagtatattctgtgaggccacagtgaatcttctaatagtttacttttatgtaggccagagtcatttggcttgtttgaaattaaatatatatatatatacatatatatatatatgtgtgtgtgtgtatatatatatatatatatatatatatatatatatatatacatatatatatatgtgtgtgtgtgtatatatatatatatatatatatatatatatatatatatatatataaaattgcttcagtcaggctccaggtacttggaaagacattcatcaaattaataatggttatcctggggactgggctttgaggattgaggatttctgatttttaatatgtgtctaatctttttaaatgtttcagtataatttataattagcagccaattattttataattaaagtaaatcctgaaaaactttctacattagtgtgtggaaaaacagcacaattgccaaatttatagggcgaagaagtcctatgtttacctagaggggaaactctgaaccaccacagcccaacaggaggctctgtgggacaatttggaaaacattaccataatctattgtttttatatttatttagaaaagaaacaaagggagcaagatacctccccgtctgacatttaaaatttgattcactgatatattttggctcacagtatcaccttgtggcatttggcatctgctgctccccctccccaaagtcataatatactgcataattaattcagcacaagtagtgacaatgccaactctgtttatttaaaaagatacctcgactgttcttttgaataaatagattgcattcctttaaaaatccaaaataatactgaattaattagaagtagtgcaatcagaataaattaggtcctatctacatacaactcagttttaaagctagaaattcaaattaataactaatttgaattagctacttcttcccatgtgtctctgagtaaacaccaagcagacgaaaaatttccattgccaataataatagtaacaatagcaaatattgttaaactcttactatttgctggtaactagttaagcatgcttcataaatcttcttttatagtagtcatgaaaaccacatatctgagctattaccttcattttgtggatgacaagttcaaactgagttttagagacagtaagcaacatacccaacatcacacaagatttaaattcagactctgagtgcttacaaactatcttacgctgtgatggtaaacatctttgcaaattttccctcataattgagtaagccatcagagtttcagaataaatgtgtaggaaaacttataaacatcagggacaagcttaaggacttgacatcttttacttttgtgtgtgtttcatagaaaaaaatagctcaaaggttaatttaaagtaatactttgaacaaactccttaacaagaagagttagacttcatacttgttattcagcagaatagtgactttgttcatacaactaaactaacgaactcaattcctcctttcgactgtttcttttttttgcctccttaatagttattttatacctgtttcttattatttatttattccactaaaaatttcaatgtcttcacattatctataattggtgctatggtatattacagttgaatatagttgaacctgttcaaatacattttgaccaatgataaggagaaccaaggattcctttgctttcatattacttcacacatgactttttaaaaaatttactttaatttctgggttacatgtgcagaacgtgcaggtttgtaacataggtatacacatgccatggtggtttgctgcacccatcaacccataatctacattaggtatttctcctaatgctatccctcccctattccccgacccccagacaggcccccatgtcacacaccacttttagaatcacaatacaatttcacattcaggacaatacttgctgaattttagtttgtgtttgtgtgcgattgttgatgggaagaacaaaatggcagtcacatcatatgttgactctagatgtgttatttatcatttgtttcttcaaaatattttgacaaacgatcttcgcattaaaaggctgtgggcagtttgggagctaccacctgtttccctcttcattgatcactttgctggccccaaaacatatccacagaaaaaattttgaaagtgattggccaagggactcagtgaggatatactttaatatttagaacactattaaaaacaaaaggagacattattaacaatatgctgggacaagaattataacctgggactttctatggcaaatgggatatatgattacttgatctagactgtataaaataaataatatatttggataatctacaattacaataagtatttatacacacaaacatatatatacgtacatacacacacacacacacacacacacacacacacacacttcacatatgtacctttacaaccaatatactttaattgagactgagaggacaagagccatgattattcatatttatattcaatgacttattacataataaacatattttgaaaatttgatgagttaattcaattcaaaatatgcaaaaaatatcaggctgggcacggtggctcatgcctataatcccagaactttgggaggccaaggcaggtagatcatctgaggtcaggagttcgagatcagcctgaccaacatggtgaaaccctgtctcaactgaaaaaatacaaaaattagccgggtgtggtggcacatgctggtagtctcagctacttgggaggctgagagaggagaatcacttgaacacaggaggcataggttgcagtgagccaagattgtgtcactgcactgccttggtgacaaagtaagactccatctcaaaaaaagaaaaaaaaaatactgtatatctgctatgtgaagccaatgggtttcaagttaggatataatgacaaagaagtttaaagaattcatagcgtagtgaaagaaaaacattcatagtaaatgaacacactgtaatgaagagtttaatatttatagtaggaataaatgggatcacaaagagaaactattagttttgaggatctatcattttaggttaactgatatgaaccttcaataacaaatatgtgcttaacatatgaaacagagagaaagtagggtaattctcagagttgttcagggtcatatgtgatgttctgtgtgcctagacaagttgtactatgtgtgttagaagagatgagactggaaagtggtcagatataagttactttgaatgataagataaaagccgtggaattcatttggtgtatgatggaaaacactgaacctttttaaacaccaaaaaatcagatcagcattgtattgaaaaacaaaaacaaaaacaactttggctttattgtgatggtggttagaggagtgagagactggaggccggatgccgagtttagagtatgtctttaaatagatgttctgacagtgtaaatagacaggtgtcaaacagatttgagtaagagtatataggtaatgcagaaaatggctttggagattgattgagtttggaacggaggtcattgaagtctaggttcaaatcaataatgaccacaggagtaacaatacatagtaagtatggatacattagaattggatagaaagaataatgaggcatctgccagaaacacagttaaaaatatccagaaaaagacgagaaattcaaacttggaactcaagacagatttcaagttagaagacttatctacaacaaatacataatccctatttgaggaaaaatagaactctatataggtttgctcaactcaatcttagtaaaacaataagggagaaaaaaagaattacaaaagagagaagccttggaactctttaaaatttaatcataattttaaaataaatttcaaaataaataaaagtgatcaaagatttaagaggcaaaatccaaggccaccaagggaatgagaaaaaacggtacttccataaaaaagcaagagaggagagatttcccagactgtaatatatttaatgtgaggctatgccaagaagaaatgataagtgttgtagatcactgaaaatcatcattacttttctgataactgagaaagcttccccggagggagagggtttcatagataaaccagagaagctgtttttgacatgaaagctagattttttaagacaaagattgaagttgagatgtttgtcactagaaattattgggatccaatccaatggttttaaacagggggagagaaaaagatgaccatgttcagtgagcaactgatgttgaaatactgaaaaccacatggtgcaataattaaaggaaggtatacacagtaaacgcatagaaaatacgttaatatatcattcatttttctgtccagggataaataacactgcaaaagaaaaaacagccaaccaatcaagcaaacacataaatgtatgctactgttcaattgaaaaaaatgcataaggatttatcatggttttatctgtgcttcattagaaaataaagccaaggattttatactccaaattctacagacttttttcataataccagaaaaccttaactttacagacataataactttaaaagagttggaaattaagaataaacatacataataatatatctgggcaataatttatttcatcctacttgcctagcatcctcaacgtagtttggcatacattaaggtcctatagaaatttatcaaattaatactaaattagcagagtactatgaattgctttctacctttgtaacaccagatgtatatatttatgtgttcaatataatattaatcttagtgtttgtgaaaacattaatttgccaaagagagttgtttatattagaaaaccgtgtaatctacatttataaaatcagtgtatttctaaacaagtgactttaaattttgatataaagcgatttttatttttattatatcatagttcatgagataaatttattaatagactatatttttaaaagtttttctgaactgacaaattctgcatgtattataatggggttaggaatggtttctcaagtcaagaataccaccaaagtaaggaaaatttcacatcaacataggtgaacaggtggcaagtcttccaaaatttgaagaattctttcaagaaaggatcagcaagtatgtaattagagtcaacatgttctgtttagctgacattaatggttagctttcactctggagagcaagatcttattgaaatttcatgaaattttagcagaatatataaaggaaaatagaaaaagagacaatcaaaaagaataaaagtacagacataaacacagtaatttgaatgtgaagctcaaaaactaactccagtttttatacctagtgttctagaatggattcaaaataacaatatacataacaatgtacataaaaacctgatgccagtactaaggatgattttattttctaaagattgccacaataacattttcttttccatatgctcttcttataatgtgacttggacacccctcatatagggaggtggagtatgtttctaccccttgaaactggcagagatttgactacaacagaactgacccttcaaattccatagctaatttatgaaaatttctgcctaattctcttgggaagcttgttgtgacaacccactgtcttgctgtgaggaagccccaacagcctataagaggcttcagtggggtgaaaatgaagcctcagtcttcaatcctggatgagcaccagccaacagccaaaatcaacttggtagccatctaagttaatcattatgaaagtggcacccagccctcagttaaagtgccacagctgatgctgcatggagcaaagataagatgttttctcaagtcttgctaaaattgcagcttagtgagcaaattaaatgattgtagtttgagcccactaagttttggtggcctgttatacggtgactgataatctgaccaagtgcctaggcttacaagtaaatatatctatatttttgtacatgaaataaaaaaataaatatttgccataattacttaaatgtataaatcttaaattctcattttttcaaagtatgttaaggaatggctcaatctgttaaaaatgataaaaggatcaagattgatcattccagaatttcttccataatatttaattcaaaaagcaaggttttaaaagaaaataaaagagtaattgttcaaaaaaatatttattgatcttcagttaaagacctcctttttttactggcaagaatccactatccttaggatctttcatgctctttgcccaaacactactttacaaaggattcagagcataaaaaatttcctgacttatttcttcaccattagttcattattctccttatgttaggatatgcaatatttaatattggactgggtttgtcatctgaagactgaataagttttatccttggactagttctactttgagtactgatactcaaaatatgaatattatagtacaacaagggagatagtgaggcattctgaccaaaaatttgcccatactctctgaaaatacttttggatataaatatttttcaacaactatgtccacctacagagtgaatctccaacttaacccaggctgccagagccagaaaaaacctgctatcaatttttgcatgtagagctaggactcaaatgtatcttaattttatttactcttcctaaattgtatctatatacttaaactgtctaccagaaacgtttttgtgtatattcaacacatgcaaccagttaatatttgtgcagagcttagcatagttcattacgaacagaacattctatacaacctctagacattatgatcacttacgttattaccccaaattgaaagtataatctggtctctagcattaaactgcataggaatgagagagatgctcagtctgtaatctggagaggaaaggaaggtcaatgattctttgtaaaattaagtttgtacactctgcttttcaagcagcagtctctatcttcctttactttcctcaatgaactaactactagtaaacagtcatcagactgactcattgaattggattattgcggtttcaatgtataccttctcttggggtcccactggtacactagctgaatctattaactcggaaacataaattaatactaaaaatatatttttctttttccttttttatatttaaaaggattttaattggaagtacacacacacacacacacacacacacacacacacgcaatacagagtgccaaatttgtatggggatgattgaaaaagattattatcaagtattaaatatttgtttcagcatatttgttttttcactgttgtctttccgaatagaaattttcgaatgaaacaaaaatgcacattttaataccagcccaatatacttgatccttacatgtttaaatttcatgtgcaaaaaatgattagtcatagagcaaacccaccctcttgtagaaattttaaaagattttaatgccagcgtaatatacttgaaccttacatgcttaaatttcatgcacaaacaatgattagtcatggagcaaacccaccctcttgtagatattttaaaagataaataaaaatgaaacttttttaaaaaaagagttatattttaggttcaggggtccatatgcaggtttgttacataggtgaagtcgtgtcatgggaggttgttgtatagattattgcgtcacccagttagtaagcccagtacccaatagtcatcttttctgctcctctgtctcctcctaccttccaacctcaaatagacttcagggtctgttgttctcttccttctgttcatgagttctcatcatttacctcccacttatatgtgagaatatgcggtatttggttttctgttcctgtgttagtttgctaaggaaattagcctcccactccatctatgttcccgcaaaagacaagacctcattattttttatagctgtatagtattccatgtggtatatgtacatcattttctttatccaatctgtcattcatgggcatttagattgactccatgtctttgctattgtgaatagtgctgccatgaacattcatgtgcatgtgtctttatggcagaatgatttatattcctctgggtatattcccagtaataggactgctggatcaaatgggagttcttcttttagctctttgagaaattgccacatggctttccacatggttgaactaatttatactcccaccaacagtgtataagtgttcccttttctctgcaaccttgccagcatctgttattttttgactttttaataatagtcattttgactgactgtgcaatggtttctcattgtggttttgatttgcatttctctaacgattagtgacatttaactgtttttcatttttttattggccacatgtatgtattcttttgaaaagtgttcatgtccaaaagaaaacactttttgatgtttttatttaattcttgtaattttaaattcctcatagatgctggatattagacctctgtcagatgcatagtttgcaaatattttctcccgttctgtaggtggtctgttcactctgttgatagtttattaagctgtgcagaagctcttaagtttaattagatcccatttgtcaatgtttgcttttgttgcaattgctgttggttctttgttacaaaatctttgcctgtgcctttgtcctgaatagtattgcctaggtggtcctccagggtttttctagtttggagttttacatttaagtctttaatccatcttgagttgatttttggttatggtataaggaggggggggtccagcttcaatcttcatatggctagccagttctcccagcaccatttactgaataggaagtctttttgccactacttttgtcagctttgtcgaagggcagatggcagtaggtgtgcagccttataaaaattatgtttgtcatcattacttttaccagtcctttcaagtaaaatttttatgttcaccatctttaatagtttgtgtgttttttttgtttgtttgtttgtttttgtttttgttttttgggttttgtttttttttttggctgggattcaacaaaataacataatggcatataactttaggtattctacatctattttgtccagtcaagttctgattagcttttttgcctgcaaaaatacttcatttggctgaaaacatatttttatccaatgcacataactatttatttttctctccagctgttttttttattcatgcaagttaactggaccagtgatcattgctgtgagtagactcaaaagtgattctcagctattttagatctgctgtgagaaaaaccaatagatgtattaatattataacattggataagcactctggctttacatttaggaggcattcctgttctattcctcaaaatctcaaatagaggaccctcagaacttcagttctcatgtattttgaggaaaaaaagtcaagtagcttccaacaaattctaacactttgagccattttgggaacccagagagctgattgctttccagggaaatagcaaaaatactggttaaatggttaaatcctagaccacggaatttttaaaaacagaatatgtgtatacacacacacacacacacacacacacacacacacacacacacacacaaatacaccttttaggggagaaattgatatttttgcctcagcaggatatccatttgccttaaaattcttattcttaggtatgtacatcaatcatctggggaggtccaagctgtgaaatccaaactgacagaaatttatagctccattagcatttatcaaaaatacaggattaagtgtagaaaatatgtattcatgcttcacctttctatatctttactttaagaggtaagtatttgtattcagtatttgttagctcctaccttcaaacggccaaacataatctccaataacatttcagaattctactgggccaaaaatgtatcctattgacctgtgtgtcctctgacttacgactgcatgtttaaatatgaatttaagaaaatgctgcactgattatttggagtttttcagaatggctagtgaattccttggtgatttattggtaaaaaaataaaataaaataaccatgttggactgttgtttcataacatactttctatttggaaattatataattactctttgtgttaaaaatgtattcatactccctgaaaatagtttcggacataaatatttttcaatgtgcatatactgagttttgctattataaattatatgtctacaaaatacttgaacatgatcccattgggttttaaaacatgcaaataaatggagaaagataagagtatatttaccggagttctcaactcaggtatggcagcttgataagtgagtggacggcaatcacgagtgtttggcacaaggacacaaggaagaaacattggacccaagtcatctccatccagaacatccactgtgagagtggtggtggtggttcgcctctcattcagattttgggcacggtcctgttagggagaaaaacaaacaacaggtagtttatagaaattaggcacaatagccaggagcagtggcccatacctgtaatcccagaactttgggaggccaaggtgggtggatcacttgaggtcaggggtttgataccagcctggcaaacatggtgaaaccccgtctccactaaaaatacaaaaatctgggtgtggtggcaggagcctgtagtcccagctacttgagaggctgaggcaggaggatcgcttgaacttgggaagcagaagttgcagtgagccaagatcacgccactgcactccagcctgggcgacagagtgagactcagtctcaaaaaacaacaacaaaaaagaaattaggcacaatgtagacttagttttcattgaaaaaaaaaagattggtaaattaacttgcttaaaccaacagttttaagtggttgagtcaggatgtaaactgagatccaattgtcttcaaagcaactttcttgaaagtatgttacagtagttaagcttttgtatgttaggcctttacctaacagttcacattactagacagcctaaccataaaggtcactctcatctcattagagcatttactttagaaaccttgtaattgtaaattccttctctgcgcctctgaggtgttaatcttttataagctgcttgtcagttctacaaaccaggcccatctttttcatgccctggggggccatctctttgaaatgtaatagtcaaggaagaagcccgtatttcccagtttctgtgggaggttaggagcctgacttcctttggaggcttgctccaatttctaaaactactttctgtcatgaaaattcaaggaaatttattttcctttgggaatgccaattagtaaacacatctggtctgtgattcccccacacccaagtccactggagtgtttaacagctctccagccattttttctattagagatcagttcagatctagtctgtattctggtctctcttctctattgcaatagctgtgaatacagtcttccttatcatttaactttgtctagtgcaattttgctgtaggaatacattgttactaactaaaatccaaagtttctttagatttccttagtttttacttaatgtcagttttctgtttcaggatcccaatcaggataccagtttgcatttagtcataatggttccttaggctcattttggctgtgacaagttctcagacttttgtttttgatgacattgacaattttgagcactggatattttgcagaatgtcccttaatgggtgtttatctggtgttttcctcaagattcaactgcggttatgtgatgtatgtaggaaaaccacaagtcaactgctattttgacatatttatcaaaagtatatgattaatatgacttatcactgttgttaacttcatcacctggctgaggctgtatctagtcagttttctcaactataaatttcctctttcttgtttccctttcatttctttggaaggaaatcatgatggacagcacacacttaaagaatgggtagtaattttattagaaatgtaaattgtttatatttatctgaagaatgtttgtcataggacagaagaaaataatattggacctaagtcatttccatgaagaacatccattgtcaagggtggtggtggtagcatcattcattatgacagaatctggaaatgtttttactttcacagcatttagttattattttgaagaactattatgcttttctgcctttttgaattctattttgtacaacattgacaagtatacttgcatgcatgttcatgtagcactattcacaacagacaaaacttggcaaaagcccacatatttatcaatgaataaatggataaacagattgtggtatgtacacacaatagcatatgattcaagcataaaaagaaatgaagtactgatatatacaacaacatgaatgagccttgaaaacatcatgttttcaaataaagaagccagacaaaaaataaggtcacatattatacgatccatttatatgcaatatctggcagcagtaaacatattggtggctacaaggagctggggaggggatatggaaagcaactgcatgagtggtgccagctctttttggagtgattaaaatgtttgggaactggatagaggcggtggttgcacaatactgtgagtgtaccaaatgccattgaattgttcactttaaaatggctaatcttattttgctaatttatgttaaataatttttaaaagtaattatactaacagacctgtatttttttttttttgttcataaaatgtcttcctttgtgacagttcccagacattaatatttgccttccaattaaaaaaaaagtccctcttgttaaacatggttaatagtacattttggttaagctcattcccagtctggttgctcataaaaacttgtaaagcaatgcttgagggtaaagttttaggaaacacgaatttctgttggtggaattttgtcagtacaaccttgtctagaatgtaataactctgtggttccaggattctttgatatttttatacagtataagacagactgcgataaaattatagcttaaaaaaacacaaaatgtttaaattttcaaagtttcggaactcactcagatccctagaggcactataaagattattcaaacctaaagacatttgagattcaacaaacagaaagaagtcttttctgaacttcttttatgtcactaaaagcagatacttatgagagtgaggctgccatgaattccctctgccaagaaagtttatgaaaatgaagaaaaaacaaggaaatctattcttacctacataaacatgatcacaagctattttaatctcccctttgactcctagaaacctagtttttcttcccttagaagcctcctccctctcattgtgttaaatatatacaccttcttctttagctgtttaaggagctgtgtatatgcactcccatatgtatatcaacctctaggccagttgaaaagtagagtaggagcaacatgtggcatgtgagataattttggtggttcacaaattaactttataaattattcttaagatgtatgaattttgaacatgtagaaaaatattaatttaaaataagcgtatgtgtatattttaaattttaaaaaaaaatagctcatcaaacttgccacttttttaatactgatcttttatttaattgggttatagctatgtctataatatatgaattaatagacaaatgatgtaatgatttgttcagtcagcatatcctgagtagcttccaaggggcagattccaatacactgcttctgacggtcttaaaaaaatgatgaggacatgtttcctcatcccattattaagagagtcatttagtactgaaaattactaatgttaagataatgtgacctcataaagattagtaggttatattttcacatatatttccctttgtgttgcatcatccagtgttttaaatcattaagtaatctcatcttccatatttctaaagttatattaaagtttaagaactaaaacaaatctttaaatttctaaatatatatatataaactggaagcttctttaataggggtggtaaacttttgttacatttattaatgattttacatttgacatttttctcaataacaaataagttaataaaatgacatatttaatatgtatttgtaaatttacttgtggcactggagttaatatttgaaaatttttttatttataaaatatttatttatttatttatttattttagaaatgagaatctcactacattgcctatactgacttcaaaatcctgggctcaagtaatcctcgcacctcagccttctgagtagctaggactataggtatgtgcctggctttaacccaccatttaaaataatgattgcttatgaagttttaaaagattgaattaatctaaatttaatttataaaaatagtaaatagataataaatattaaatatttataatattttatgtgatacatgaatgtagcatgcagatataaacacacatatatatgcatatatacacatacatgcatataaatgccagaggcaatatttctacccttccatgtcactcagccttctttatatgtaatcatcaaatcactataataaacaaatttgaattttttaatgttatgttttctttcagtctgtcagcatcaaatctctcactattatctgcttctttgggtcattgtcactactccatagaatagatactggtgtgttaaagatagtgtatttacaggaagtgtataccaaaatacataataggagttttttctcatattggggaaagatattgcttacaaagtgttgagctctaaaatttgtatttttaagtgggaaataaaaataatcctggcaaaatgattgtgagcagagatgtagcaacaaaatctactaacagtttccacacgtgggaattctcccacattttatcaccaacacatatcacataggaaaatatataaaaatatgtctcatgcacactcataacttgtgagcccataatggtaatgctaattcatgatgttctcccaatttggaatcagatttgatcttaaaatatccatttaaaaaataatccttcagcaattgagataaaaatcaaaacaaaaacaacaaaaacagaaaaaacaaaacaacctacacttttgatctttatagtaatatactactgctcaaggctcttctgagtaaatgaaataacattctaaattgtgagtggtaaaaaataaaaaataactatttctataaacattccatataatttaattatgttttcatttacgttatgtgataatctaatatatattaaaatccacaaagaagatctcctttcttccctttcccattttcatctgcatttctcttcttttttaaaaaataagaatatatatttaacttcaattatttaaaaataacaggatattacattaagttaggaaactgtgattctagttggcaagcaagaatatcttttaaaaagttaaacaagttcaaccagtactctgaacagaattgtgtctcctcaacctcaagctagaaaatctagagtaaagtgatatgtttctggaaacacataatgttccaagatcgaatcaggaaactattgaaaccctgaacagatgaatattaagctgtgatattaaattagtaataagaaacttaccaaccaaaaaaagcactggaccagatagacacacagctgaattctaccagacatacaaaaattgactcaagatgaattaaagatttaaatgtaatacctcaagctataaaaatcctagaggaaaacctattaaaactcttcttgacattggctttagcaaggatttcgtaatgatgatatcctgaaaagcaattgcaacaaaaacaaaaactgacaagtagcacctaaactaaagagcttcggcacactaaaataaactgtcaatacagtaaacagaaaatggaaagaatgggagaaaagctatgcaaactatgcatctgacaaaggtctaatattcagaatctataaggaacttaaacaatttaagaagcaaaagacaaacaatcccattaaaataggggcaagggacatgaacagacacttctcaaaataagacatacatgcagccaacaaatatatgaaaacatgctcatcagcatttatcatcagggaaatgcaaatcaaaaccataatgagatatcatctcataccagttagaatggctattattaaaaagtcaaaaaattacatatactggtgaggctgcagagaaaaggaaatggttatatgctgttggtgggtatgtaaattatttcagacactgtggaaagcagtttgaagatttctcaaagaatttaaaaccaagctaccattcaacctaccaaccccattactgggtatatacacaaagaaaaatagtgcattctaccaaaaagacacatgcatgtctacattaattgccatgctattcacaatagcaaaaaacatggaatcaacctaggtgcccatcaatagtggattgcataaagaaaatgtggtgcatatacaccacggaatactacaaagccatagaaaagaatgaaatcatgtcctttgaagcaacatggatgaagctggaggccataatcctaagtgaattaatgcagcaacagaaaactaaatactacataatatcagtttttcaatgggagctaaacaccaagtgcccagggaaataaacctgggaacagtagactgtgaactgctggggcaaggagagagaatggatcaaaaaactacccattgagtactatgctgaccacctgagtgcaatacacccatgcaacaaacctacatatgtactccctgtgcttaaaataaaagttgaggaaaaaaataatgcttctatgaacattaaccagaggaagttgggtattctattgtcttgtaaacattttttgtttgagatatttgcctaatatttcttattttttatgcaaaccagtagacagaattatattatcatttatagccccaaatgctcatgtatctttagtagccaaacactcagtaaatattaggtcccataaaccatcacctgctatcctcccatttcactctcactcctcagaaaatgcccaagaaacttgcagagttaaaacaatggggttacaattaacactaattccacacatcagtaggaagcagaagtgagggaaggtcagggtagaggttatttctgaaaagttgtttacaaggttgaaatataaaatatagaaaattaattttacctatacaaacacatatgtttgcaatgcttacacattttatttgaatatttctgtccataaagataaaaaattgagctaataaagaaatagtaatattataattttaggaattatatcttgttaggaaagatagctagcatcccttctctagattttgctatttgagaaatatacaacacccttgctattcataaaataatttagaaattataaattattcttgccatgattctaaattaaatttaggccgggcacagtggttcatgcctgtaatcccagaacattggaaggccaaggtgggctgatcacttgaagttgttaatggtttcagaccagcctgtccagcacagtgaaactccgtttctactaaaaatacaaaaaattagctgggagtggtggcacatgcctgtaataccaactactcgggaggctgagttaggagaatcatgaacacgagaggcgaaggctgcagtgaaccgagatcacccccctgcactacagcctgggtgacagagcaaaaccccatctcaaaataaataaataaattataaaataagtaaatataaacttttttctttctggtaattaagaaatcttgattacaaaagtgttcttatatatttcactcaggataacaataatataaaagagagtttgctttgaagaaaaatgatatgtaaagagattactttgattctatgtgaattagggtaacatatcaaagttgaggttataataatatgtagtaaatttcaacaaaaagaaaacccatttgatctttctagatctacccccaaaatttttgtctggaattaatcattccttcattatgtatttatatttgaagtcaatagcatgggtgacaatattgcaaatattctcaaaaaaatatgtgacagggttttctaatatgggtcagtcaaaactcaattaccttaattacggatcataacatgtaaacacggataaaaagaaacctccaaactacatgtaatttgaaggattctcttcgaaaatcaaatatttttaacataagcaaaaccaggtcaaagctgggtaatgttcaataatttgtcatgatacctgtaattattcttttagaggccatatactttaaagtcaaaattgattgctcatatcttaattctccttatgacttcaagataatatattggtgcttaatgtacatgacttacattgtgcataccaccaacacaatataaaaaaccactgccaggtgcagtggctcatgcgtgtaatcccaacactttgggaggctgaggtgagtgaattgcttgaggccatgagtttgagaccagcctgaccaacatgctgaaacctcgtttctactacacatccaaaaattagctgggtatggttgcacgcatctgtaatcccagctactcaggaggctgaggcacgagaatagcttgaacatgggaggctgaggttgcagtaagctgagatcatgccactgcactctagcctgggcaacatagcaatactctcctcccctcccaaaaagaaaatccaggtgtggtggtacgtttgtggtcccagctagttgggaggctgaggcatgagaatcacttaaaccccgtaggcggaggttgcagtgagctgagatcgcaccactgtacttcagcctgggtgacagagcaagactgtctcaaaataaataaataaataagcaaacaaacaaacaagataaatgtaaaaaaaatggaggtacattttagatatatggatatcattatcatatacaaacaaagatatgttagacttatgttactattggtatatacaaaacagttaatgattaacaaccagctatcagataagtagccctgatttgtagcactggcactttccatactgtaaatgctcccagcatggctgcaaatgtgagatcactgaactcagagtttgaaagagaaacccacaattggccctcaagcaagtctcagctgactttccacctccaacaacccacagttttaagttacagatttaaaatgttgtgaaaatgagcatccttctttatcatttgtggaagtgtgatatgtcacaacactttgaaaaataatatagcattatctactaagattaaaaagtatgtgaatatatatgtacaaatacacatacacatatacacatatatatgcatacatataattttctcaaagcaattccatttttaattactgatttttaaacagtaaagtaccagtattttagtgatttatataatactgtaataatgtctcaatatatttcaagcattagtctaagtacttttttgtttgctaactagctaattgtaaccagaacaatgtggtatgttttattaatatacccattttactggttaggaaattaacatacaaagcatgccccaaatcacacagccagtaaatggctgaactgagatttgaactcaggtgacataattcactacactcactgcctctcttgaacatcatgagggtagatatcaatttggtgccaaaaacaaatgatcaaataaacaaaaacggagtattgttgaatcaatggtgatccattattattatcttacattatgtagctattaaaattatttgttcttaaaacttttaaaaatgcttaaaatgttataactttctatatttaacatttcattgtgtactgtatgacttaagtttataacaaaaactgttattgcatttaaattcaaatgttcattcgacttcttcctaatgctattccttccttttgatgattcacatatgtacttctgttttataactttatccctgaaatgctaaaaacttgtcactacctcagtgatgagtagtccatcatgttggatagaagttgttccagatgtctttataaatattttaaaactagacaccaattcagaatcttttaccttgcatttctattaaaaaattatatctttttaattgcatgataaaaaaactagcttacaaataccttccacagcaatctgacttcataaaaaagacattctaccttttcttcacatcttcagttaaatagaaaaaagaattttctgtgtttttgaaaaactctgagtggccctccctaatacattttacttttccccatatctacagttttcactctgctctatgttacatgacattaaaatatatacacacatacagacacacacataatacatataacatcttataatatataattataatatataaaataataaatcatttttaaaatctgaagaaatataaataaaagcttccaaacttagcttcaaaaattagatctatatgtctatctacatatttctatctacatatccctaattatatatctatctaggtatctatctatacacatacacattctgtgtcaggtgatatatctctaagaaaggcaagaaaatgacaagtttgtggcacattttttcatgttaacttcttcagaacagctaattgaggttattttccttttagcatcccctgctatctatctgttctgctgtatgagcaagattacaacgcttaggagtcattaaaggcacaggatggcttcagagtatagctgctttaaaaaagaaaaggctattaatttagagcagttttaggtttatagaaaaattgagaggaaggtatatacaccatgtctccacacgtgcacatcctccccacttacaacatccctaatcaaagttgtacattggttacaattgatgaatctacattgaacaatgataatcaccaaagttcatcctttacattaaagatcaccgttggtgttgtacattctatgggaatggacaaatgtataatgatatctatccaacttcatggtatcatccagagtattttcactgacctaaaaatatttcatgatccttctattaatccctttctacctgcctttaccaccatatccctgacatccactgatctttatactatttccccagctttgcctttaccagaatgttatatattggaatcatccagtatgtagccttttcttaatggtttattttgcttataagtatgcattcaagatttctccatactttttatatctttatgcctcatttcttaacggttatttcaaaaacgtaagcttgtcacttaatatgggactttttatgtgacctccccttctagcttttttctcaaggggtactcccattcatcttgctaagaaaagaaaaatgttttcaggtcatcagtgtgcccagtctcaggatatgaactatacatagtataattcagaagtgaataccgcatatccctttgacacatatggacttcctcaaccttcgttcctattatgctgacacaggtgatacaagtctagaaggagatgttggatgggagaaaactctgaagagagtatcttcccagataaaagaaggaagaatcaataaacgtaaaagaaatcctagttttgctaccctttctgcctgttgcattcagacttgaaatgcagttgtgatgcttatggccatggtacacaaatacctcccagctgataaggcattgggaaaataaccacattccagagaagagggaagtataaggatggaaggaacctaagtccctggtgatataattgaactgtcaaaccaaacattgagctgcataattccagaaattttattaaacttccactaataataactataataaatgtctatgttttataagcatataagcatgtctatgttatataagcatgtaaggatatctatgttttataagtatataaaccatgtctgtgttttacaagcatatgtttggatgtcctgttattgttatctacatacattagcataaacttcagttatgggaatattagctgatatctagtgaacaattactcaataaatgatagccatgaggaagaacacgaccaattaggcaatgattctttgcctttagtgtaccttagaattccctgaagagctaattaaaaatgcagatattccacttccatcatctgagatttttattcagaacatctgaggtagggtccagaaatatgtatatttaatacacacccaaggtgattctgctgctgttaatttgcaggatcctactttgaaaaatatttcagtatagtctaaaaaggttggataatggataatacatatgaataatttagaggtcaaagaatacagtgaataaaaacaacctattctatccctttctccatctataagagtattatatataaacaccaagggcaggagtgccctgatgaagaagtgagtggcacagagctctccaagagtatctgatacattttggatgagttttttacttcataaattcacagaagaaatttaaaagaaattgaatactcacattagcttggattatgacaaagtagcgagtcttatcttcatagttgagcctcttccttaacactatatttccagtcaacattaggggaatttcaaaggtgtcattggatgtctgcaaatattaaagatacagacttcagattatttgaatgtaagatgaattaataactcaatattttggattaatcctcttggaagttagagatgacatgcttatcatctgaaaatagaatgactataagcttcagagtcaatattgttatcatacttccaaacatttaattttgatcaatgggtttccccagagtcctttggtaataataaccagaaaatttgtttcttgtcatagtttttaatatattactagtattattcatcaacagtcttggaatagttctaaatcaaagtccaggtatctgaaaaacttccctgttaccacattatcttttcactgtgttctttaacaccaaagcattcaaacactgaaatctgttatttctacatagtatcaattgtcaacattgatatccattctgtattttaagtatttttaagtattatctggcattaaatacaaaaaaaaaaatacagttacgagtcacttagtgatgaggtacattccgagaaatgtgttgttaggtgatttttgtcattgtgtgactattatagagtgtagattcacaaacctaaaatggtacagcctactacatactaggacaagtgatatagcctatggctcctaggctacaaacctgtacagcatgtcactgtactgaatgctataggcaattgtaacacaatggtcagtattttctctataaatgtaatctaaacatagaaaaggtatagtagaaatacaacattataattttatgagaccaccatttgctatgtgatatatcattgaccaaaatgtcattatgcagagcatgactgcgtgaacttgaatcagttcattattgtggaaaaaaaaatccaggttatatatcatttttttcttttaggttccacaacttctgctcattagttaagttctctgccctgtctaggactgagttttttcctggtaacatggaagtcataagggcaacactagtgctctggtataagcagccctcagtgtaactgtattcacaccttaagggagtataatttataagataaatctcttattcttaagaagaccttatgtcacttttgtattttagtgccattttaaagaatgataaaattgtttctagtaggctcaataactcagtgttattttgttcactgaaattgtcttgtggttgttcagttgccttgtgtatttgtgcttgtgatttttttgtgaaatatttagtttgaatctgcattagattgctgcaaaaggaaggaaagagagggaaagaaaaatgagaggaaaaggcaaggggaaggagaagagaaagggaaggggaagtgtggaagaagaaaaaaactgtgtatgtgagagagaaacagagagagagaggaagagagagagagtgttcacaccctcaacttagtgtaagtgtattcctaagagtcacataagaagttaaactcaatgaaaaaaaaaaagctgattcaaatctctcagctcaggctcaatcaatgaaatgtgtgtagtttagccttccatgtctagagctgtgatctgtctcctttctttctttctttgtctctctatctctctttctctcggggatgcataaagacacacacactgtacattttgcagaattaatatatatttttaaatgattcattctgtgctcctcatgtaatgggccttgcaaatcgttcttggatgcagtcatttaaaagtaacaatttaaaatataaatacagaaaatgaaaatgaacaacacaattaaaaacagacatttgacattttccctaattttttgcctattcaactttgcttatacctatgagtggggctggcattatgacacaggagtgtgaaaatgattgaatctaaacatgtaagttgaatatgggcaaaaccttagttaataattgctgtttacactgttaaacttatcctaatgtgttgttatgaggttattacattttagtgactcaataatatagaaatatatattggtttctagcataaatatggaagatactgtggtcttaccacaaaactaccacatctctggactcagaaccccaaattagctcacatatctggtgacattgtgcctcagaggaggctatgtctctaaatgagatgagtcttgaatagtctagcttaaaaacagtaattccattctcttttaccaggaagtattttgcaaatgtacatgtgattccattttgagtaatgaaaaaatttctcttaattgcaaagatagagagaagctaaaaatcccttttcaggttatagaagtttctgtcaggatataaaatttagaacttcagcagccatttggggactattgataaaattaattacggagaaatagctaacatgctagtgatagcagagtataaaataaaaagagcccggatctgtgttgtctttgagttgctgagcaaatcttgatattaccccatctctgaaaaacttattatgatagataataaattacctttttggttaaatcatctttaatttagttttttacatatatataatatatatataatctatattatatattattatatataatataatataatctatattacatattattatatataatataatataatctatattatatattattatatataatataatataatctatattatatatataatatatatatagtaaattttctgcagctgaaagcactttgatacatgattattcctgtctctatgtgtttacactgtaggcctctctcttctccaaacaggccatggctcttcacacctgatatttgctcttatttttctcttgcttaaatatcccatcacttatttctctgtgtactaatctttgcaaactttactcagtgaaacctcttaaatgtaatttagacttaagtctttgatgtgatctcacattattttttccaaaaaacacttatttgggatcttctgttttgcttgacagattcctcaagggtctcagtctgtgatgcagaaataacctatccttaaatgtctagctaagcaacttaatgaatctttgcaatactttttttgttgttgacagttttcattggacgtttgtagaattattaaaaataatagttattagtgactttattgatcttcagagcactttcaattgcactgaattcttatcatcttaaatctatcctttagagattttatagattcttagattttaattttactttttatatgtatgtatttatttatttatttattgagatggatgcagtcttgctctgtcatccaggcttgagtgcagtggtgcaatctcagctcactgcaacctctgcctcctgggttcaagcgattctcctgcctcagcctctgagtagataggactacaggcatgtgccaccacatctggctaatttttattttttacttttagtagagatggggttttaacatgttggccagtctggtctcgaactcctgacctcaagggtatgcccaccttgcctcccaaagttctgggattaaagatgtgagccaccatccctggcctagattttcattttgttagcacttgtattctataaaatataagaataggatatactttatcatcaatggtgcttctgaaatgttgcatattgaaagccactgtattaaatttaatttattaattaagcaattattgagtattcattctgtctctaaaatgtagaataataatcaagaaaattagaagcaaaatatagatatctttggtatctttatgatagtcttctttttcctctagtaaaaagaatactggattagatcaaccctaagtaaaagtcttgctttaatgatatttctgaagtgtttacctaaaaagtttaaaaaaaaaaaagctaaattaagcaagggaaaaaagtagattttttaataaataaatacatgataaagccatgaaaaaaacaaaacaatacttagaacattcttaaagtttagaatgcacaagaatcataggcatgtatcattaagactgtagattcctagcatctattacccaaaattcccgaaattcttgggaatcggcatttttaacaaacctaccaggtgatcctgatgcagatgattcaggttttacttttgagaaaccactgtactacgtaagtctaagagtgactgcactctctgtccttgctatttatttttctcttctttcattcttagagatttgttccaccaatgaggcagaaaagtttgggaacagagcaatgcccatttacttaagcaaccttacatttctaaagccaggacattgccccctttctgatagtcgtggatattctctttaaaatacaaactaacattggcttttttgggtgataagaatttaagtgctgactacctgcactgtattaatgagaaaaatccaattatggttaaatgatttaatacccacacgccccaaacacctggcctccattaagaaaggtccactcactactttctgacagttcagtgacaacaactgtcaaataagggacaattctccatttagtaaaataagggcataaggcagtttaagcaatttatcactatcacagatatgggaagcagggtaggagacagctgtaacatccacgccacacacattcacattcaataatggagagagaaggaatgttgaggctctagcaactctgtgtttcccaagatgattccatccccccagaatcccctttactaatatgggtttgcaccagtttagataaaacggcagctctctgaaaggaggtgttgaatcctacagttaaagatgctctagaaatggaatatggggttattagcactatttcttctcagctgatagatttggtcattcatcatttttaggaaagagggaaagactccagcctttcacacctatgttgtaagcattgtttgtaatattctcttttcagctgtgatgactagaaattcagttcaaaagaagataatttctaaagaacacacacacacacacacacacacacacacacgtgtatatatattttctggtgacctaaagacagagacttagtacaaaagtgcctcaatgggcctgtaattgagaagtggcggaaatgtagataattacgattttctctttatctctgtaaattctcttgttctttgacacttttttttgaagtatcttcccttatctttgtgtctttttctgtacctctctcttctctctttgggtttcccccatttgttcacattgaatataactgtgagtctgtgttttagttccaataagcagcatcaactttgcccttatcaatctttagacagccttaagcttgtctctgattaagctcaggctactgtgccatcagctgctgaaaattctatgttattgtcattgtttgtgtgtctcctctaatctaatttcctaaagtaaaaagtggaggactaagtaaggctatgcaatttttgtccacccaagagggactgggatttgagcaggcaacattaactttgctcctaagagaaagtcccaacactctaatcattttttctgtttcatactgttaaaacatgtccctggctgacagacaaaatggactccctatgactaactgaagtaagttaaaacaaaaccaacaaaaccaggtggccatgcctgagtgacaaagtggtcgcatactctgtgttctcagaaagatgtcaaagcatcacaggatcttcctttctacaattgatatggtttgggtgtgtcctcatgcaaatttcatcttgaattgtagcttccataattcccacgtgttgtgggagggagctggtgtgagataattgaatcatggcatttccccatactgtttttgtggtagtgaataagtctcatgagatctgatgcttttataaagggaaatcactttcacttgattaaattctctcttagtctgcttccatgtaagacatgccttttgcctcccaccaagattgtgaggcctcccaggcacatggaactgagtccattaaacctctttttctttatacattacccagtctcacgtatgtctttatcagaagtgtgaaaacagactaacacagtaaattggcactggtagagtggggtcctgctgtaaagatatcaaaaaatgtggaggcaactttggaactgggtggcaggcagaggttggaacagtttggagggctcagaaggacaggaaaaggtgggaatgtttggaacttcctagagactttttcattggctttgaccaaaatgctgataatgatacggacaatgaaatccagggtaaagtgatctcagatggagatgaggatactggagtaaaggtaacccttgctatgttttatcaaagagactggtggcattttgtccctgacgtagagatttgtggaaccttgaatttgagggagatgatttaggttatttggtgacataagtttctaagtagcaaaacattcaagatgtgacttcagtgccattaaaagcattcagttttaaaagtgagacagagcataaaaattcagaaaatttgcagcctgataatgcagtagaaaagaaacacccattttctgaggagaaattcaagccagttgcagaaatttgcataagtaatgaggaaccaaatgttaatcaccaaggcatggggaaaatgtctccagggtgtgtcagagacatttgtggcagcccctcccatcataggccaggagccctaggagaaaaaagcggtttcatgggccaggtcctggacccccctttccgtgtgcagcctaggaactcggtgccccgtgtcccagctgctccagccatggctataaggagtgaagacatagctcaggctgcggcttcagaaggtgcaagccccaagccttggtagctttcacatggtgtggagcctatgggtccgcagaagtcaagaactgaggtttgggaacctccacctagatttcagaggatgtatggaaatgcctggatgtccagacaaaagtttgctgaaggggcagggccctcatggagaacctctgctagggcagcatggaaaggaagtgtggggttgaagtccccacaaagagttgccactggcgcactgcctagtgaagctgtgagtagagggccactgtcctccagaacccagaaagtagatttactgatagtttgcactgcatgcctggaaagcagcagacactcaaggccaaactgtgaaagcagccaggagggaggctgtaccctgcaaagcaacaggggtggagctgcccaagaccatgggaacccacttcttgcatcagcatgacctggatgtgagacatggtgtcaaagaagatcattttggagctttaagatttgactgccccactggatttcagacttgtatagggcctttagaccctttgtttttgccaatttctctcatttggaatgtatatatatatatattcatacccaatgcctgtacccccattttatctaggaagtaactaacttacttttgattttacaggctcatgggtgtaaggaacttgctttgtctcagatgagactttggactgtgagcttttgagttaatgatgaaatgagttaaaactttgagggactgttggtaaggcatgattggttttaaaatgtgaggacatgagatttgggaggtgccaggtgtagagtaatatgatttggctgaatccccacccaaatctcaccttgaactgtagctcccataatccccaagtgttgagggagggacccggtgagagataattaaatcatgggggtggcctccccagccacgtggaactgtgggtccattaaacccctttttctttataaattacccagtctcaggtatgtctttatcaacagcgtgaaaacggactaacacaacaataaagcaaaaacagatcctgttcttggtgccaagataaactacagctggaactacttccttttgccccctatgccatccctacactggccctttagcactagccctttgaaagaaacatctgacagaaacttctggtttggggcttggaaatcaaccaatcagagctcacctgaatcaaccaatcagtgtatagaacagtcatgactcatctgttttgaccaatcagaattaagcaaggatctatccttcatttggatgaagacagcttattgggaacctgggtgggaactatagctataaaaccctaaccctctctttgttctctgaaatgtgtcttagcttgaaaccacaggctgtatatccatggtttgaaaactgttcactgaaataaagtctctttcgtccaaattcctttccagagaacatttgcttacaatataaatttaccactctccctcacacaaatacaaacagattcattcacatttaatgatgcattatgattacaatgcagttcaacttatcttattccatccaacttccaaggaaactgtatttgtgtttggttgggttttgaaacttaaaagtcacagccttggtgtgaaaagactgaggttcgaagttttacacaaagaaggcctttacaccagtcttaattatacatgagtttccagtaaaatgagaatattatgaatttatggaggcatggaaatctcatgatataatgtaccctgaaaagtattattaaactacagtaaattttttagtaacctacctaggaataagtaatcactgttttagcttaaccttaaatattttattgacatctgaaatttggactttgacatatatacacacacacagaactacttcaggatggtgatttttttaaaaatcgtttgtccttaaaatgtggttttaacttcctgactcaggaaattcaaatgcttacacattacaaatgaaaattatggcttacattttctgaattatctcaaagctacggggagtcaaacatattacaaaagaaggacaatttactcaggaggacttgataaaagatgttaccacccactgaaacaccactgtaatacctcaaagaaagaagctgcttatgcatattgcttaagtgtcttcattttttttttctgagtagtaacagtagtgaataacaatgttatgctgcttcctcagtaaactggagactgctacaagggacatgtcatcagtctcctccttatcactttaggtcaaacttaaaatgctgaataaacatgcctccagtctggcattaaaataaaaaaaaagatcaaaaagacatgataattattgtctaaatagtcttatcaatcttgctaacaatgagatttaatatatcagaatacctatatttagatttttccatataagacaaattctcaaaaatgaaagttactgcagatcatgtgatgacaaattcttatcaatttcagagttcttcttttattttttcaaaacaaactaattcaagcttgtctaacccatagcccacaggctacatggggcccaggttggctctgaatgtggcccaacacaaacatgtaaatgtccttaaaacattataagatttatttgtgattttttattatcagctcatcagctgtcattcacgttagtgtaatttgtgtgtggcccaagacaattctttttcttccagtgtggctcagggaagccaaaagattagacagacacctctgaattagttcagtgcattatgaacactcttactttgtattaccatgaaggcattaaacaaaaaaaaaaatcagcagtattttacaataactgtgatgagtacactagaaattgcatagaaattaaatgcccctaattaaaggcctgacaacatatattgtccagtacatatttttacatattgtctactaccaagttccaacagataattcaagtggtacttaataaacaaaaggtgaccaaatgagaaaatgaacttatacaaaagaaagaagaatgcttcttcttctgaacaatagtgcagactgacaaagattctttgcctggccaaacttgatcaggcttctgaatcttctcctaggctcatctgtatacttcctcataaaatcactttttaacaaagaaccatactatatcactttaccaagaactcctctacctttgatgaatgatctatcttgaaaactcatcaggtttctcatcctgcaccaccccttaggtgatgtctgatcaccctgacttgtcttcagcaacaatcgtattagcgtgttttagccagaattcccctaatctctgatgtttcctcctagtaattttccatccagtgaccctgaccctgctccttggttataaagtcccacttgcccatgctttatttttagttgagtccaatatctctctccaactgcaagacctcattgcaatgatttctatacctattgcagtggtcctgaataaggtctttcttaccatgttttaatgtatcattaaataatatttttatttaacaattgtctagaggacttttagaagaagatatttactaaattatttttttctaaatacatcagccatgaaaggatagggaatgctgcaggaacaaacccttaaactttcatttttttctttacttttcatatctacatatctaatatgcatcagcaagtggtctctttttattgttgtcattggctaatgaatgtttctcctcaacatgtttttctctgatcacaacagcaggggcagagaatatgattacttgtatattggttctttgagtttacatttcattagtcaaagcaaatacttttctccaggcaagaaaagtacacctctagtatgaatcaaaagagaggaagaaccaaacatttttggtaaacagctcaagtgcttttgttaacagcagtgaatccatatgggtctgcagcaactcggtcctaacctcagaggaaagaatgtgatttaggggaagaagtaagtttaaggcagagggagagattgaggtgagttttagagtaagagtgagagcttattaaaaagttttagagcaggaatgaaagcaagcaaaatactcttggaagacggctaagtgggtgacttgaaagatccaagtgccttgttcatcccttcacttgggggttttctacattggcatggtttgggggtttgccattctcctcccttgatttttcttttggggcaggctgtccacatgcacagtgcctgctggtgcacttgggagggtcttcatgtgcagtatgtttactgaagttgttgcatgcttacttgaggcatttttgccttaccagtttaacattcccagaaaaaggtcatatactagtgaaattctgccattttgcctcttaacgtgcatgcttcagccctcttgcccaacttctaagctcttattgggaagctgctgatcaccagcttcaagtgttttctatctattgggagactatatttccctggcactggctgtgatcaattattcttttacagaaaaagtttaaaagccacctaaccatcacctgacgatcagctgacattcctgggggtggtcctctcctgccctgctcatatctgcctaaccatctagttgatatggtttggctctgtgtccccacccaaaacaaattacaatgtcaaattgtaatccccatgtattgagggagggatctggtaggtggtgactggtttatgggggcagtttcccccatgctgttctcccgatagtgagttctcacgagatctgatggtttaaaagtggcacttccatttttgctctttctgcctcctgctgcatgtaagatacaccatgcttctccttcaccttctgccatgattgtaagtttcctgaggtgtccctagccattcagaactgtgagtcagttaaacctcctttctttgtaaattacacactctcaggtagtatctttatagcagtgtgataacaaactaatacaggaaattggtactgggatagtggagtactgttaagatgataacctgaaaatatagaagcaactttggaactgggtaatggtcagaggttggaacagtttggagggctcagaagaaaacaggaagatgtgggaaagtttggaccttcctagagactttgtgaatgctttcaaccaaaatgctgatagtgatacggacaatgaagtccaggctgaggtggtctcagatggaggtgaggaacttattgggaactggagcaaaagtcactcttgctatgctttagcaaagagactggtggcattttgcccctgccctagatctgtggaacttggaacttgagaaagatgatttagggtatctggcaggagaaatttctaagcagcaaagtattcaagatgtgacctgtctttttctgaaagcatacagtcataggcatatatgaagacattatgtgaaactggaacttatgtttaaaagggaagcagagaataaaactttaaagaatctgcagcctgaccatgtggtagaaaagaaaatcccattttctgggggaaaattcaagctgggtgcagaaatttgcataagtaacgaggaaccaactattaatagccaagacaatgggaaaaatgcctccagggcattttagggatcttcatggcagccgctcaaatcacaggcctggaggcctaggagggaaaaatggttttctgagctgggaccagggccccactgctctgtgcagccttaggacatggcatcctatgtccctgccactctagctccagccatggctaaaatgtacagttcaggccattgcttcagaggtgcaagccccatgccttggtggcttacatgtggtgttgggcctgcaggtacatagaagacaagagttgagctttgggaacctccaccttggtttcagaggatgtgtgaaaatgccagcatgtccaggcagatatctgctgcaggggtggagccctcatggaaaacatctactagcataatgcagagggaaaaagtggaattggagtccccacttgggactgcctagtggagctgtgaaaagagtcccactgtctcctccagatcctagaatgatagatccacagacagcttgcatcatgtgcttggaaaaaccacaagcactcaatgccagcctgagaaggcagctgcaggggcagtaccctgcagagccacagggacatagctgcccaaggccttggaagcttaccctttgcattaatgtgccctggatgtgagacatggagtcaaatgagattatttcgaagctttaagatttaataactgccctgctgtgttgtggacttgcatggggcctgtggtgcctttatttgggccaatttctcacatacagaatgggtgtatatacctaatgtctgtaccctcattgtatcttggaagtaacaacttgtttttgattttataggcttatgggttaaagggaattgacttgtctcagatgaaactttgaacttggacttttgagttaatgctgaaatgatttaagactttagggaactattgagaaggcatgattggttctgaaatgtcaaaaggacaagagatttggaagaggccatggttggaattatatggtttgtctctgtgtcccgactaaaatctcatgttgaattgtaatctccatgaatctagggagtgacctggtgggaggtgactggatcatggggcagttttccccctgctgtttttgtgagagtgagggcattctcatgaggtctgatggtttaatagtgataattcccccttcactctctctctcctgctgccatgtaagatgttccttcctccccctttcccttttgctgtgattgtaagtttcctgaggccttcccagccatttggaactgtgagtcatttaaaattattttattataaattacccagtcttagttattctttatagaagtgtgaaaatgcacactactgtaacactttcactttaaattggatcaatcagttcagcaactatttattcccaaacttgttgcttctttgttttagaacaccatttgaattgcaataaaaagagttgcttaagttctttgtagatttgcggggggaggtgggaggggagagggacagcattaggagatatacctaatgtaaatgacgagttaacaggtgcagcacaccaacatggcacatgtatacatatgtaacaaacccgcacgttgtgcacatgtaccctagaacttaaagtaaaataataaaaaataaaaaataaaaataaaaataagttgaaacataaaaaaaaagatttgcaacaaaacagaaaggctcaatttaattattccaattttattcatatattaaataaaatagttatggtgaagaatttacaatattttgctttattgaaatgttattattttgactagtaaaagtgccacactatggtgctattaatgtaagcagaattactagagatttagtagtagcagaacataaaatttatcatgtattttctcacaggtcttacaagagaagaaactggtactgaggtttacactaattttatatgaagtctaaaagtggattctctccctaagattgtaccttggttaatccttttttccttcaatacatcctaagttaagtgtcatgatgtcttactattttttccacagaattaagagcattttagcttgctaaaacatatattatttatttttcttttttcatttgtaattttgaaaatgcatgtggttgattggtttatccactctgtagggagtaagagttacatattatattgtacagcaaacctacacttccctggaatggggaggcattgagacagaattattgcacagttaaaaaagaatttaagccttattaactgtctacattttaagcagaaagatagtttaaagtaatatatttttgctctcaaactatatctaaacattgaatatttttatgcatgcaataaatatctccctaaaaaacatggactagtcatttgatacttgctgggaggttttatttttacaccttggggagtaaagattagaaagtaaccttcataaaatttgagctagaaacatggcgcacacgtacaattaattctttaaaaaaatacctaaagagcaaacaaaataaatggtttcaaaatcgaatgttcagtcagctgtttctacatttaagaaaaagcatttctgctgcccttttctttgctgtttctttgctacttcccacttcatttcttatgtaacccttcatactgtccttctctgtcacattctcatcatatccccaactcttggttttattgtctctgcctaaaaaaaagtcctcttttagagaaacaaagcaaaaaaaaaaaaaaaaaaaaaacaagactctaaaatctgaccttcaccctgctaataaaatgtatatatatatattatatatatatacttattttccaaatttattaaaattttaacacagccagtacaagttttttttgtgagaacacaatagaggaagagtatactgaaactggattttacagttcagaagtagttttctaatatgacccaaatcacttcacttacgagttttctttgctatgcaacagagataatactacttttaactgatttgtgaggataaaatgagaaaatgcatccacaatttacttaacataatgcaataaatttgtgatgtagatcttactgtgagttctcagactctactatcccaatagagttttttgtttgtttgtttttgcttgtctgtctaaagtttatctacaacatacaatggtaaaaataagggcaaaatgttaacttcaccattgtttatatttctaatatttattaaacataaaagagatgcattcaatttgaaagcttatttaagtagtgcatttataattgctttggggggcccgtgggattttgaggagctgcctcaaagaaagtggggagatgtgaggcaaggcttccagctctagcttcagttaaaaaaaatcttactttgtctgtttttttgaataatatgtcattagaggaaatgattcatggccttaaaaaacaacatagaaatcttcttgtctatttgggaggccgaggcaggcggatcacgaggtcaggagattgagaccatcctggctaacacagtgaaaccccatctctactaaatatacaaaaaaattgagcttccagtgagccaagatcacgccactgcactccagcctgggcaacagagcgagactccgtctcaaaaaaaaaaaaaaaaaaaaaaaaaaaaaaaaagaaatcatcttgtctaatggaaaaaaaggaagaaaaacaacaaaataaaacagactatagctagtggctttgtcttgtcttcttctctatctttggtttaactggtggacggctagaagtttaaaggcttatcaactccagcaatacttggtgtgtgttcttgaggtatagcaacaatattggtattaatttatgagttgcataaaattcatgtttgacacttgttatctcatctccagtgatttatttagaatgctttggagaccacaaacataacagaaatttagtaaatgaggcatattatacctatgaatatattttaaaccttatctaaaaataccatcaaaaattagcttctagcaataaagcataaatattacaaataattcaattttgagacatttttaaataatagtatcattactaatctggttctggaagttactgaataatacaataactatcagctgaaaaaatcattaattttattccttttaagaaaattacattgcaaataggtatttacataccggatcatctggattatactgaataacatactctatctgtccatttggtccatcatctatatctgtagctccattgtctcctgaaaatcctgtgaatattgtggtaccaactggagtgagctgaaaggaaaaaagattttaaatatcaattttcattttatcaactgcacaccagaaatgttacagcataaaaatcagctctttattacctaaaggaagataccagttggcagcccacaaccacaaactgaagtgtttcaaaagaacagttttgagccttacacaggagttcttaaaatgtctgaaatgtccaactttgtgattcttgctatgggcgaagaagcagaagacgctgattccgtgttaaacacatttggaccaatttatagccattagtatgttagctcctgtggagaaactgcatctgttgtttctcctcaaaacccttgatgcaatgttacccacaggctagaatttaaactgtaagaaaaagttagtttaaaataaacgatttacgagtgagcaatgaaatccaggctgatgattatatgcaagtggcaagtttgagaaagagaaattggagacaatgaatagtctgtatattagaggaaaatactgggagtttcttgagtccttctgatattggttgagtagaacatgatcaggtcacagcagctggagagatagcaacatcttttcattttggattaaaacatcagaacttaatatgtgtggcatacaaaaccatgatttgatgtgtgacctaaattgctagtcttaattcttacttatgcccacaagagaatcaccgttatttttttttacctgtaggtttttgcgcaatgtgctcttataaccagagtaatttttttaaattttcccctcccagtttttaggttttagctgaaatactactcattagttaaatttcaacttaattagatatcagcttctcccataccacccctcaaatagcattacacacgccacatcagaagatgattccccttttcttgtgcttgcattttgcactttgttcctataatcattgcattgttagaggaactaaatgcacttcatcaataaacataagctctgtgcctctacagactggacgcttttaatgtttgctcagggatttgttctcttaatttttgactaggattccttgatggtaaaaatagcttaagaggcaacaaaaaagttgccttattcagttttactttcagaaactgaaaattcacattttacaaggatccctcaggtaatgtaaatgagtgaagcaagcatgatgagacggtggaaaatagatagaacatgccctctctgatgctactcagagagggtagctgctactagtagctgctactcaatcccagcaaattcttgccatcttggaatatggagcccatgctaccaagtcttctaatattttaattgtatataaaatatcttgatgctaagattgacaacagatttttattatttatttatttatttttgagatggagtctcactctgtcacccaggctggagtgcagtggcacggtctcggcttactgcaagctctgcctcccgggttcacgccattctcctgcctcagcctcccaagtagctgggaccacaggcgcccaccaccacgcccggctaattttttgtatttttagtagagatggggtttcaccgcgttagcaaggatggtctcgatctcctgacctcatgatctgcccacctcagcctcccaaagtgctgggattacaggcttgagccaccgcgcccggctgacaacagatttttaaacattaaaatataaataggtaaaataaaatatgcccattgcctcaacaactacactagtttgcaatctctgatttaggaaaagaatataattatgacttaaaaataaaccataagtacaaggaagttcaggatttataaggcccagtttcctagcaggcagcattgaaggcaaactttggagagctgagaatgaagtgagacgagatcgtttaagtagtacctatgaggacatcgagggaccactggggatagatttagtagaaatgttagtcagctaaattgcttccaagctgacgttcaatatttttcttttttaatggaattcctgttgcaaaagacatccttatcttttataaatattcacccattcttatgtagctgtactttgatatttttattaccaacttatttttaaatcaacatatagaattttgtatatttgttgtgtacaacatgttgttttaaaatatgtataccttgtgtgatggctaaaccaagctaattaacatatctattatatacttttttgtggtgagagcacttaaaaaatctattttcaaaaatagatagttattaactatagttaccatgttgtacaatagatttattgaatttattagttcaagaaatttaaattttgtatcctttgaccaacatctctcaatccatatcccagcccctagtaaccactcttatactgtctgctgcaattacttcaactactttagattccacatacaagtgggatcatgtagtatctgaatatctgtgcttggcttgtttcacttaacataatgtcttccaggtttatccataattttcaaactgtgaaattttatgattggatgacattgatttgtttccatatatctaataaacttaaaaattttgttgccaaaaaatactatgtcatggaggtagatataaaagcaaaacaaaaaatcaaaataaaacaaacaaattttaaaaaattaaacagtatcgtctgtggaaattttgaggaaataaagggggtgcccatgcctttcaatctgcttactggggtaatgtatactattggaccagatttattttgaagagcaggatcccaaagccctacaacttagggagataaaattggtcttgcggggaagatataggacatccagggagaacttcacgtttgccactcttaatcaagattaaatttctggaataaatatttatatgacagaaatttgttggaatagatggtttgaaagattttagtccttacaatgtaatatttgtaaagttgaaggcatatttctaaattcaatatgcaaactattgaaaagatcaatgtttttctctagctctacaatgtttttttgaaatgatgaaaaggccacataaaagtagcatgatgtcttaatatattaccatcaagtaatatttttcttcatcactgacatggctttttccatgcagaaatcacatttgtaagtataatgtttaatatgtagtcctttaaaataaactctacattgttataatgtttaatatgtagtcctttaaaataaactctacattgtatttctttgattgactttcaaaaaatatacttgctgatgaagcctaccaaagattgataatagaccacaggaaaaaaattgaatatgcatttgcttatggtttcaattttaagcttaatccaaagagtaattcaatttcaaatgttctcatttcagaatatgagctcattttgtgtgccacaggtaaatttccctaatcatatttgtgtggccatatatacttttattatttctgaaaaattgcaagtagaaatatgattctataataaatttcattaatttatatctttgaatagaaaataaaagagaaacaattgtattagccgtaggaatagagaaaaccttttttctataatgatattatataaaggttatgaatcatccctaaatataattttaaggtcttttttagacaaaattttagattccttgaaaattaaatgaaaagcattagtgtaatagcaatagatttcagcatgttctttcattcatggctgtctttcttgacaatttcagtaaaaatttctccctaatttcacaaatatggtatttactggctgacaggggaggatgggcaggctcaggaattgtcccaaggtgaggtttgctctcctccatagttccacatttaaggcaaatgtcttagcacagatcactcctgtgtatttctactactagattgtgcaagcatgtacaaatagccattcatatgtaaaatgcaacacaaaatggatcagtcatacatttttctcatgatctgctcaaatttcatgatttgttcaaatggtagacctgttcacatatgagatagggttgaggctaatatgagagaaatagccgagaaaaaagaagataagttatatgggcaaacatgggaggtctgaaaagtctaaaaaggctctaatgaagaggcctatgccagatgcaaaaaagcagaagaaagtagaagcagaaaaaatgttttttaaaaaatagtagatcctggccagatgccatggctcacacctgtaatcccagcactttgggaggctgaggcaggaggattgctgcttcaagtctgagagtttaagagtttgagagtagagatagatagatagataataggcctggacacggtggctaacgcctgtaatcccaacaatttgggaggctgaactagatggattacttgaggtcaggagttggagtccagcctggccagcatggtgaaatcctgtctctactaaaaatacaaaaattaaccaggcatggtggtgcacacctgtagtcccagctactcaggaggctgaggcaggagaatcccttgaacccaggagactgaggttgcagtgagctgagatcgtggcactgcactccagcctggggcgagaacaagactctgtctcaatttaaaaaaaaaaaaagatagatagatagtaggtggttatatgtatattatattcagatcttttttgtgctattataaaactgtgaacaaagagacctaccttatgtttcatagataactctttaatgctatatctcaaaatcacaactaccttattatcattacaaaaaccaaacaaaagacatggcagaaagcccacacctaaatgggcaggtagcattgaaatgtatgcaaaaacagagtgttagtagtgaactgaaataaatttaaaaggtccctcttgacagcctatttgcatccaaaagctctttaaagacagaccataatttttttctttttaaaaaaatatttcatagcatcaattgtagaaactggttcatcagtagaaactcaattaattattcttatttatatatattatttatgcagatgagactgaaacttttcacaatttcttcatattttaatatactaaatcctctacaaggcctctatactggaatactgtatccacatcctcatcctctacctgcctgttcctggttcctcggacaacctcacttttagaggtgatttccacccattcattatgctgttcaattgcaacaggatggccagagcttctggcagctcactgtcaaaaaaccctgcccacctttttttgcttccatgaagaaaaatatgtagatttcactgtgaagtctagttcttcccatgctcttgccagttttcctacaagaaaattttctacagactgtccatgaataaactataaccataataggacccaatacagcaagcacatgcaagtagaataaccttatattcacgaaaccgatggtatgctgttcacttggaataaaatattgagaaggatatgtggtagaaagtcctccacaaatcataatattgtgttgtacatatatatttggtgattagaaaattccactggcatcaatatcattgtgttggtagataacaatgattttctgtttcatattttctggagtctcatgtgtcatatcaacacagaaacaaaaagtttagtaaaaaataaaatactaaaaaatgatttctgaatacctaaaatagtttacacatgtattccacaccaatgccttctgatagattctaatggctttaatgattaaacagaaaccatatgagagtcctaagaagagaaaacatatatttttatgtaatagacacaacttaaataatacctcttcaactggaagacaattggtacaaaaggatattattcaatttggaaacttgcccccaaaaagagccaccctagaggaaaaatttaaaatacgattgatgagattttactttttcccatgcttcctcaagaatccaagttttttgttttctcctacccaggaaaaatggagaatatctgaaggatactgaattttagataagctgaaacagaattaatcactacagttacttatcatataatgatgatttgatgaaagaaatgctaccggggtggcaggtgctctatttctactaatagacattaacaaaaaagaagcattacctttagtgatgcaagattacatatcagcctatgttaaaacactacacatttattttccaattgttaatatcattgatctgatttatagtattaggcagccacttcatgtcaattaatctcctagaaaacccaatcaagataaggcaacattctgtacaaattatcattactagtgaaactgaaggaatcttccacgtttaatcaacaatgagaactatgattcatcctttaactttctccccagataaaataatgttatagattcattcttgcaattaatccctgccttggaaatatgctttagaaatggtaaatttagaaattttaaaccaaagattctccacacatgaaatccagagttgattttgtaaacaggcagtcatcagtggaatattattgaaaaattcaacattttctgacaattatgaaattacaatgtctctgaatctacgattatttattgagaaaatatcgtttgccaaatcattgtttctgtgaccattatattggtcttactttaactagtaaatataacatttgttttattcaaccatttttccaaatcaaacatccgtttgaagtccatcttaaaactttccagaactgataaaaaaaatacatattcttgaattcaaatacagtgcaagttatcttgtaatgatttattaacattaaagaaaacataagaaaagaggtatagccctttttgtctagttaacattaacttatgaaggtacaatttatattaaacaaaatgcagagatcttaaatattcagtatgttgagttttgacaatttcatgaacccatgtaatgaacacctacacaaaaaatataatatttttatcacactgtaaaatttcctaatatccctgtacagactatcttgtcagatgcagctgcttttgacttcaatcaaaattgcttagttttgcctgttcttggacttcaatagagtgtgtaccctttcctatctggcttcttttgctcaacttaatgttttttttgtttgtccttggtccatctattttattctgtttcattaatgtttttcagattccctttaacataatatggttttcatacctgtgttaaaaatcttgatttcattaaaaatcttgattccattttttatcacaaagactagatgattaatattaagggttactttctctgaataaataatagacaaattcatgtagataagtgtatttaaaataaaaaaagaattattactgttacagagaatgataaataactctatctttactaaaaactgaggagcaattaagcttaagttgaatatacatatgagcttatttatttatttatctatttatttatttttgagatgacgagtttcgctcttgttggccaggctggagtgcaatggcacaatctcggctcaccgcaacctccacctcctgggttcaagcaattctcctgcctcagcctcccaagtagctgggattacaggcatgcgccaccacgcctggctaattttgtgtttttagtagagacgtggtttctccatgttggacaggctagtctcaaactcccgacctcaggtgatccgcctgcctcggccttccaaagtgctgggattacaagcaaaagccactgtgcccggcccatatgagcttagaagttgttgaatatttgaatacttgaatgttgtaaaacagctaaaaaattgattcccacgtacatgcttaaagtaaaaagaaatgtattaatatgtgcttctttcacttcctttaatctccttatctctttctcttttttaactgtttcctgattctcagagagaatgtgcccatcctatggaagagaaaaatggggacaagtaagaggaactagagattagtcttacttctttctttaactttagattaagtgccagtactgcatattcaaagaaattccataaatggggatgctcctgaaggcccagtgatttttattccttgaaaagttgaagatatcgagttttgaactccatgatccatgtttctaaaccataatttatttcatattaaaaaatcacttaattatacctagaaattgtaaacaaaacacacaaaatatgtaaaaaaggatattcaactctataaggaatgtcagtgttatgcttctcatgaatactgtctgtgcttttagatttaccagaataattctgataaaaacagatgttcaaaatatatgtattaaatggaaggagatgatataaccacaatgaaatgtaaaagaatagcataaaactatgagaaatggatttggaaagcaaaaactcaaattagatagattcagaggtaatgttaatttcaccacaaagctgaagtctcaataatgttccactaattactgcctgtttataagtgtatctctacactttcatgtgtggagaaactcttggttttcaaatctgtcactatttccaaagcgtatttccaaaacaggaggattgcaaaaaaaaaaaaaaaaaaaaaaaaaatggctaaaacctgcactaagtattttaaaagtatcacctcctttaatcctcaatacaagtttatatcattatttattttgttatcatacttattttatggttacaaaattataggcttagaaagcttctgcctgatgttattattctaatacttggtgaataatctgaaatgatataatttagattatgtatctcattaaagataatttattttgggcccctaagaaaaatgttttgggttattttacagaaggagaaataaattcaacttaattataaaatatctcaaataatatatggcacagtgtcttgtttaaaagtattcattcttaaacactgtgcaatatgttatttgagaaatgttagaattcactattaatgaacttctgaaaaaatgagaaataaacaggaaaacaaaatgtggcacataacagaacccaagattcacagacaatctgaaaccatataatttagattatgtattaaagataaattattttgggccctaagaaaaatattttgggttattttacaaaaggagacataaaatcaaattagccagtacctgcattttaggaaactcttcttcaaataattattactgtcagaaaaaaattggttctcagcaagcaaattatttaataaatttccaaattcaccatgatttcagtgtgcaaacctttacattagtaatcaaatctctattgctagaacatgcctaaaccattgaaaagcattcaataagcgctcaaggagcaaagagaagaagaaatatagccaaccacagtaatttacactttcctcaattatatttcaaaaaataatatttcaacaatcactaataaaaatggtgggtaaaagttcaatgagaaacaggatagttacagtcttaacctagttccccacaatatagctttaatacttattaagtattaagtacaaaattactggtaaatacagaagggaaagctggaagacactgttttgtcaaagtgataaaagccatcactaccaataatgaaacagatacattgtgtgtcttttgtgttacatgctatgataaaaacagtatcatttttgaaacattcatgcacaaagtctacgaatcatgagaaaatatcaggtgaattaaaatttagagacattttatacactcctctggtcctgaaaaatattaaggtcatgaaagtcaaggaagtattgtggaaatgctaaaattgagactaaaaaaattgaaaactaaacttggttttaggaaatacacaataaagtagtaagggctgaagaagtttcatattttcaacttaattttcattagtataaaatagttatgtatttatatatgacatatagtatacattatatataattacatggtatatatacacttaatgtatgacatacttatatatacatataatatatgctgtatatttatcatacacacaaaaatctacctctatgtgactatttatcaattagtaagaggaaagaaatattgtctgaccagtgagtctcaatactgtcaaggtcatcaaaaacaaaaaaaaagcaaaaactatcacagtttagaggagactgaagaaacatggtaaataaaagtaattgttattctgtatggggacctggaatcaaacaggacattaggtaaaaagcttatccaccatgatcaagtgggattcatccccgggatgcaaggctggttcaatatacacaaatcaataaatgtaatcccccatataaacagaaccaaagacaaacaccacatgattatctcaatagatgcagaaaaggcctttgacaaaattcaacaacccttcatgctaaaaaatctcaataaattaggtattgatgggacttatctcaaaataataagagctatcaatgacaaacccacagccaatatcatactgaatgggcaaaaactggaagcattccctttgaaaatgggcacaagacagggatgccctctctcaccactcctattcaacatagtgttggaagttctggccagggcagttaggcaggagaaggaaataaagggtattcaattaggaaaagaggaagtcaaattgtccctgtttgcagatgatgacatgactgtatatctgaaaaccccactgtctcagcccaaaatctccttaagctgataagcaaattcagcaaagtctcaggatacaaaatcaatgtacaaaaatcacaagcattcttatacaccaataacagacaaatagagagccaaatcatgagtgatctcccattcacaactgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctatgaatgactttcttcacagaattggaaaaaactactttaaagttcatatgacaccaaaaaagagcctgcatcgccaagtcaatcctaagccaaaaccacaaagctggaggcatcacgctacctgacttcaaagtatactacaaggctacagtaaccaaaacagcatggtactggtaccaaaacagagatatagatcaatggaacagaacagagccctcagaaataacaccacatatctacaactatctgatctttgacaaacctgacaaaaacaagaaatggggaaaggattccctatttaataaatggtgctgggaaaactggctagccatatggagaaagctgaaactggatcccttccttacaccttatacaaaaattaattcaagatggattaaagacttaaacattagaccttaaacgataaaaaaccctagaagaaaacctaggcattaccattcaggacataggcgtgggcaaggacttcatgtctaaaacaccaaaagcaatggcaacaaaagctaaaattgacaaatgggatctaattaaactaaagagcttctgcacagcaaaagaaactaccatcagagtgaacaggcaacctacaaaatgggagaaagttttcgcaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaatgctcaccatcactggctatcagagaaatgcaactcaaaaccacaatgagataccatctcacacaagttagaatggcaatcattaaaagtcagggaacaacaaatgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactagaaatcatgctgctgtaaagacacatgcacatgtatgtttactgcagcactattcacaatagcaaagacttggaaccaacccaaatgtccaacagtgatagactggattaagaaaatgtggcacatatacaccatggaatactatgcagccataaaaaatgatgagttcatgtcctttgtagggacatggatgaaactggaaatcatcattctcagtaaactattgcaagaacaaaaaaccaaacaccgcatattctcattcataggtgggaattgaacaatgagaacacatggacacaggaaggggaacatcacactctggggactgttgtggggtggggggagggggagggatagcattaggagatatacctaatgctaaatgacgagttaatgggtgcagcacaccagcatggcacatgtgtacatatgtaactaacctgcacattgtgcacatgtaccctaaaacttaaagtataataaaaacaaaaaacaaaacacagggaattaaaaatgaataaatttggttctctatatatgtacatagtgctctaactttttaaagcttaaataaacctttaaaaaactaaaaaaaaacaaaaactaaaaccatctgaataagctatgaatttgaattaataatgtaccaatgttggtttattagttgttacaaaaaatgtactatattaatttaagaagttaacaatcagggaactgtatatgggacatatgagaactgtacacttctattaaaatatcacttaggtctaaattgttctcatattatttaaataaataatgtaaaatatagttgtaaatagaccatttccattaccattttcattataacaaagctcaagacttgaatatatcatttaatataagaaaaataatgtttaaatgtaatatagctttacttctattacatttaatttttataaatataatgcacattgaaccaattatttgtcaacaaatttaataagatatacttatagaatgaaacagagtaaacagagaggaagagatagattttcatgtttttctgtgctttcatttggctgaagtttggttttttgtgtgtctgctaattgataaaatcattaaaaatgtttttagtcattcctttaaaatttcaaagaaaagctaaaatatttaaaaactcattgtttaaaattaagagctaattgatgcagtaggtattgatgaaagatatgattatgtcatgttaggagaaacaagcataataatatttaaaataaattaatatgcaattactaattaaatcagcatgtaataccaggtaagaagaaatactgaaactggtctaatcatcccacagaactgatgtttatgttttcgtctgaataaacctagaaactgatgctcccagttctgaaacttgcaaaagttacatttgccctgtctgagttcctttcccaggaaaccaaccattagacctcccaggtagtatcaaggaactggagtttgccagatcgccacatcaggaaaatgagatgccagaccgcttacctgtcttgattgtctaaccaaccacctgcttcctattgaccttcatttcccctccctaattcccattttcccacatatgattacttttcttccctgctatataaaccggcaattttagtcagccaaagaaatgaatttgaggctaatctcccatctttttggctgaagcacctgattaaatccttcttttctggcaatgtttgttgcctcagtgattggctttctgtgtggtgagcggcaggacctagaccaaagccctggcattttggtaaaaattacctctatggtgagctaactattatgcatgtagttgggcagggtgttcatcttcatgggtcccatttcattaccttttagagttttttcataaatttgtgggattctatagaaaagttattaaaggttatatattcagtcaattataactttttataaccatataatcacatctgctttttcagccattgaattttgatcctacatcatcatcatcatcctatcattctattcttcatcctatagctattattttgtaagtaaggtcttttacagtgtcccctcatgatcaattaaagggcattttctggttgctactcttacaaagtttgaatagaataaaaatcagaacttgtgttgatttgaattgacaaatttatcatagggaaagtgcccatctgtgaatagaatgaagtttaaaagtatgtttattagtcttgctgttatatgggatttagcattcttcattttgtttggttataccactatgttaaccatttatttttcttatttcaaaaatataactagaaatataattagaattgacatgacatacagttattccataaaagaaggtggtaaaaacaaaaatacagttgtcccttgccatagccagattattagttctaggattcatgtatataccaaaatctgcacatactcaggtccctaattgaccctgtaaaacccacagaggtttcacatccatgaatattgtatttccatctatgcttagttgaaaaactgcatgtacaagtggaccctcacagttaaaattcgtgttgtccaagggtcaactgtaaagtttaataaaatatttcctcaaaaagaaatgcttcatggtgaaaataggtgtattttacttttagaataatattttaggaatcatgattggatgaaagcagaaactgctggatataattagaaagctcattgtcatcatcgttcctaccattcaatgagtgttatctattcattgcatgcacccagcaccataggtctcatgttacattctctgtatcctttaacctttaataactaccctaaaagtattatagttttttttaattgagaaaactaagtccattagaaattaattaattttccattattatacaggtaggaagtggtcatcctaaaactgaaacctatgctgtgtgactcaatagattattcccttttctcataacactgaaccttgaacatgattattttactaaactgaatcaagtgcaacttttctgaaattagtattaatatttattcatattaatggtcttacactctacactttcagattttaagactcgggaaataaatatgaattttcaaaatcgcatggaattttctctatgtactcaagccctatcagtctcttgcctaatgtatgtatacaatatggtgagcaagtgctcagttttggagtgagaatgttttggttactgacttagattggctacttatcagcagtgagatcttgagcaaattcattaatgcttccctatttctacactttctcatctgtaaaatgaaaacaatgaacacacaaagtttgagtctgtgggcagctatctataagtactaagtaagttatttcatggaaaacacttagaatttgcttggcacacaatgcaattaataaatggtaactcaatggtaattattataattcacttattattgtaaaatacctttatttcattcaaagtcaggaggtatgatatcagaaatgtggtaaacatatctatgcagtattcttattatgaacaaatttggataagaacaaatttaaaattggtctagtatgaaattagttcctaatgagtatgcctaatgacaaaaggagtaagaaaaataaacattaaaattattataaatctaaagtttgaagacatttaacctggtaagcaggacataattttctatatacttgttatgtcaatatttaccaaaaaacttgattctttcagaaactcaaggttatttaaactgctaatactcaccttcctaaattgtgaatggcattttaaatgtaaatttatgaagcatcctttaaaatttcatgttattaatactgaaagaaacagaacttgattaaacacaaattcattaagctgactgtgaagcacttgggaccctttgcgttgatccttatagagccgtgcgtctagaaaaacctttcaacgaaaagaaaaggtacatttggtcaaaggggaatcatattaatgttgcttaatcaatgagtttagtatttccgggacatgaaaagtagggtaaaaaaatctcaagtggcatgacagtcatataatgaataaatacataatttctctctaatgttttataaatagaccgtaattcatatagttcatatttatcaagttttaaaaagtgttttttgttgttcttgtcattattcttgttttaatctatgtaatttattataataatctggaaaggttatactcgtttctttaaaaaatttactctatatgagcttcttcataaatttaactcaaagcaaactcttgctttctatctcaggaacatcagcgtagaaatatatatgttataggatatttttctgtatgataactgtgccattcctaatttaatgataaacctacttatagtacttctgtaatgtgccaggcactgttctactcaatgaaaaacaaagtgccagctttaatgcagattcaattttaaaggggtagatatcataacaaaaagcaaatacatatgcagtattgttgcagataagtggtataaagataaccagcttcagatagtctgttacaagagtcataaaatatgcaggtcatttatcatacatggaaaagttgtggggcttttttctttctattttaaaatttattatgtgtcttcattgaaccttgtgaggcaaaaattctaatactaccattttcgttttcaggtgagaaatctgaagtacagaacaaattaaatgaaatgtttttaagaaagacaaatgaaactaacaaatggtaatccagcaccagcatcactgtatatttgtattgtcagcagatttagctactatggaaaatctttgaagaatctttctcaacatgatttttgatatacacatgctctaatttattgtgggtatattcaacagagtagaattgctgagtcatagggtgtctgcctgttcagtttttgttgacactacaaaataactaatgtaattgtgccaatttacttatctaccaacaatgtatgaaagttgtgattatccatatctctaccaaaacatgagagtatattttctttcaattcaaagtgtaattgaacttaaaataaataaatataattaaaactccattttggtaggtattataatccatggatggattacttttaaaaatttcattttttatttgttgctgatgtataaaatttatttcttttaaaaaatattggacggtcacagtggctcatgcctgtaatctcagcactttgggaggctgaggcaggcggatcacctgaggtcaggagttcgagaccagcctgaccaacatggagaaaacccatctctactaaaaatacaaaattagctgggtgtggtggcgcatgcctgtaattccagctactcgggaggctgaggcaggagaatcgcttgaaccctggaggcagaggttgtgctgagccaagatcgtgccattgcactccagcctgggcaaaaaagagcaaaactctgaaaaaaaaaaaaaaaattgaccttgtctgcagtaaacttgctgaactcactttttaactgtaattttttttttctgtaaatactgttgggtagttctatatataataatgccatttgtaagtatttaatttaatgccattttccaactataaggagcatttctagtttgtatttattgattttaagctcaattgtttgatgattagaaaacacattctgtataattttagccatgtgggggacatgttgatacatccgtgaaaacccagcatttggtaaattattttatatgttccatccatgtgcctgaaaagaataaacttcatagttgttggatacatcattttaaaatacatcaggtcaatttcgctgatttcaatgttcaaatcttatgtttccttgcttttttttctttacttattttgacagttactgagataacttttgcattagttttctattgctgtcataaaaattatcataaattttgtggcttaaattaatataatttactctcacacagtttggtcagtcagaagtcagagatagctctcaccaagctaaaatcaaaatgtctgtagcactgcatttctgtagactctgaaaatgaattcacttccaagctcattcagattattggctgtatttatttatttttatgttggtagctgtcgactggggttccttcaagagtattcttgcattttcaggctatattatagctccactggtgttcaaaaccagcaatagtggctaagtccttctaagtcttagattgtctttgatctccccttatgcctcatcttatccagttcctcttcccttgcctctctctgactctagccagagaaaattctttccttttaagggctcacactgagattgggcctaccagagtaatccaggataatctccctattaacttccataaccttaatcgcatctgcaaagctatttttgccaggtaagtgtacagatatctttgggaggctttaattcaaattatatgacctcccaaacatcaattttctaatttctaaaacagggatattccttccttgtaaagctactgtgaggactaaataagataatgtgcataaaaagagcttaccacagtgctcataatatagatatagctccataaacaatacattttaatttattttaatatactataggtaacccatgctttagaggtttttatagttccttcctgtctgcctcaggatggtaaaaataaataaatattgactgaaaaattttctctcaatgaaaagatcattaaaaaccagacatatataagctctatattaacttgagataaattcttcacatgaccaagaaaacattatgtctgccttgacttgctcttgtttacttacatcaaaataaattttggggggtgagatgaacctcaaaaacctgccatcactgtcgagaaagatttgtctccaaaacttgcataagaatgatcagcaactgtgtaattttttcttgaaaccaggcaaactatttacttaatgatacaattgtttaaagctaattgagtcttcacttaaagagagaaaactacttcaatgtcttatgtcttgctcatgagaaagacatttgaaaccttgttataacccgtgttcaacatgtagatagaggaattaataatgttttggtgaattcttgacaaactaatagaagaacatgtttacgaagagcgtaagagggtagcatttaatgcatttataaaagtgctgattgtgattatgatataataccataaatgtaaatcatatttatttgtaaaataaggtacatgaaagtagttataatttagaatactagaatgtttattgataagtagtgaggggatgattgacctaaggacttgagttttattcccaacttcgtggtcaattttgtaaccatcaatttatactactgctccagttctcagttttctcatggtgaataaaaagagtgactaatcaggactttaattttggaagcttcttttataaatctgtgataatgactttattatacctgtcttttgtattttaatgaagtgtgaaatattttgacattaacaatctattaaactgtgaacgatttttttggaaaaacatttagatctttcttaattgcataaacttcatgtcttatactaaaaggacaaatagtatgaaaaataccttgcaatcttgcacagaataaaactcatttcatttaattttattacaaacacagcattgtagatgggcaagatagggatatctatttatacacatacacatatatagtatgtatgtatctaattttaatgtatcttcctaatacataattcataatagataaaattcatgtcaactaaaccaatagataattcataatttataattcattggactaaactaagtactagtactatggaagaactattcaaatgaaaaatgagaataatagctaaatttctattttttttttgatgctatttcaagctttaaatgcactgttttttttttcaagaaagtaaatataaagagtatgggcaaaatcaaaggtgaaaaatatgaccatcaagtacacacatttgatattatcaaaccatagaagatatgaccatagtgtcaatgggataggatgacctcagttatctaaaaggaaatgcattgtgagaaacttaccagttcaacaatgtattgacagctttgcacagtaatatagcttctcaaaataatgtttaagatcaaatctttacctttcctataaattttatcactctgatgtttaggagtttagggtttgaagaaattgaagatcaatacatgtaaatattgattatttcataaaaataaatcaagtaaaagagatgaacaaaattttgagacttgcatggtagggaggatcttattctaggcaaaatgaacagtgtgagcaaaggctaagaaagggagatatttatgagatgtgagagagttaatctgaacaggataaggcattatcagggagaatttgagaatgttcagaatacattgacaaatggtcagattatggaaaagcttgaaggtctgccagaagaagtgaccttttgacacccgacaataatgagaaattgcaaaacttttgaaaagtagagttgcatgattaaaatgatatttgagaagttactgtttaacaagacactgaaaagattagagagggaagtggaaacagtcaaatcacataggatgctttgaacttcaaattgaacattataaatttctgaaagaaggatgaactatgaagagggatccaggggcagttagtgacatggatgaggctggaaaccgtcattctcagcaaactaacaagaacagaaaaccaaacaccacatgtcctcactcataagtgggagttgaacaatgagaacacctggacacagggaggaaaacatcacacaccggggcctgttgggggagtgagggggtaggagagggatagcattaggagaaatacctaatgtagatgatgggttgatgggtgcagcaaaccaccatggcacgtgtatacctatgtaacaaacctgcacattctgcacatgtatcccagaactaacatatatatatatgtgtatatatgtgtgtatatatatacatatatatatatagattctgtaagtagatttgttgcctaagataattcacctatcactttataccaaaaataaagttagcactcaaccgaacaaagcaaatgtaactcaaagggtgtatttcaaaataagatcatttatatataattaaaactagttacttggaaattaattagtatctgtcattacagtagaaactcattaaacaaaagtgactcaaagaggtgaagcatttatcgaccagtaattcgtcttgttaaatttaaataggagtttgtattttgtttttaagttatataatttagaaagtctcagattacaaggaacataatttcttcaaactttcatgaacacaagaatgttgaaataactaaaaaatatttttagtaacttcaaaaagaatctagaggttaaaggcccaaatgatctgtttaattcacaaattacagttattctcctgtaaagcaggcatgcaaatttttaagattaaaaaaaaatcttgaaatgaaaagatggtctggtaaaatatgtactatcacattaatgtcattcattttttcatgtgtctaacatacacataataggtcacattagaggtactctagaaatattttgtagcttaattaactaaaaataattaatacagtaaccacggtttaaaaaaaaataaaagtggttcttcacttatgcactttagccaaaagagaaaataaaacaaagcaaaacaacaaacaagcatgtccttaaaaagttacaatactactttttaaatataatttttctaatttgatcagcatttttctataagaattcggttgtgatttgtagttaatttttggatatttcagaacttgattttaaaatccagaaaataactttacatttatagaaccgcagacattttcttccagtatttaattagtatgaccacctcagaaatacaaaggcaatgtatttgtattagataaatgccttaggataataataataactcgtgttatgcctaagtaagcatgtagatggatctaggcaataaattttcaaagatgatgaaaaataaaatatctattattataaatacattatttttcccatagttaaatgaattcctaaaataacatcggaagtcacatacttcttctgagtactatttttttaatgttttcttgatatttctaaacagttaagctcataattttaaaggaatcatttataaacatttattgtatatagttagatacatatatcaacagaaaggacagagagagagtaaatagaaactgacctcattcactgtggcatagtagctttcatgcttgaaagtgggtgagttgtcattcctgtctctcaccactattcgcacttcatggtagataatagtgcccacttttttgttgatgcactggacctgcaccacaatggagtgtatgttcatcggtggctgcaatgtagaaattgcatcttttaaaatactaattaaaaacaaagcttctcatcactgtcaaagcactcgttcattcagtacatttttctattcttgtttatttttaaattataataatctcaaagaaaatgatcattttaaggacaagagaagacaatcataattaatttattgtttaattttgtatctcagcgtgtggaattcaggtagcattatgctcacagttagtggatggctaatgagcgcacccacaaaattaatgcttagaattgatgggattaaacgaagtttgcccctccaaagattaaagaagcaataatataaacttttaatttgaagaaagtgttaattaataaattcctggagaagagagattgtttaacttttatgtttatttatatttttgctggaatattatatgttcattgctgatcaaattaaaaatactgattaccaaaagagaaaatccaaaagccagccaactaaacttactcattctacacatttaaatgcttattttgctaatctttttcactctctaaatatgtacatattatagacacacagacacacagtgaatatcagcccatgtttataaatatagatttactatagcattttttgtataatactatgaagttatgttatgtgacagcaatattatacttcattgtaagcctatagcataatgtatccaagtaataatttaaaatgaactactccaggctattatattttgtcattataaaaaatacttcaatacatagtatacataagcatatgcttacttatctaataatttttataataaattccttgaacgggaaaggtcaaagatatacttcctcaagtgccatggctaacagtttgcagagctggaatgcacacctacaaatatttgactctagagtcagagtattgaccactacaaagtatttctttgtgatttttaaccccttttgagcttatgcaactttatctctaaatatgtcatttttgcagtgtcctatcctgacccctccatcttaaaaaccttgtctccaacctgacatctcctttcaaatttcttccaatttatttttctttattgcatttctcaccgaaaatttggctcgttgtatattttatgtacttgttttggtttgtctgccttcactagactggaagctcaatacaacctgtgtgttattttagtcatgatagtatccctctttccagtaaccagccctatgcctaagacagatgatctggagtcaaactgcatggcttccagttccataacctactaactgtatgatccaggaaaaagtacaaagtatctctatgcttcgtttattcatctataaaattaaggctaatagttacaccaatgagaattgtaaatactgcatgtgattagactatactaggcatatgttaaacacctaagggattacatacatatcctattttatttattaaaaaataaatatccaaaatagtgaaaaaataaaatctataatgcacgacacatttgtaaatgagaaaaatgctacagaaactatatctaagctgaaggaaatcattatttagtttcaagatatttttatggccaacaaagaaaaagaaagttgacttgaatttgtagctgtctgaatgatgctacctagaaagaataaattgaggcatcattgacatacgaaaagaggtctctagtgaaatcacacatagctctgtgtttttatatctactctatttctcctttaatcactgatataaatgaaggcattaaaatcatgtgtataaaatctgtgaatgttacaaaccttggaaggatgtataaatacatttaatgacaaaagacatggttcaaagtcatcttaataagtcataataatgggttacaaaatggtaaatttttgcaataataaattttatcctccaatttgtaatagaaaaaaaatcacccaaatgtaatagacagctacaaacattaatgtaaaaatgtaattgtgaaattttgatagctaaaagctgattttacatgacagcactgtaaatgggctactggaacactaatgcatactgtacattaattaataatatcagataataatatataggtagattataacaggtaccattttacaggtgcatagaagagaaatttgaacacttttgagaatgtataaaatgggaggattttaaatttaacaacatatgatttgtcaaatatctaaatggttgtcatggaaacatccattagttgacttactgtagtttcagagagcagaaataagaaaaatagttgaaaaatatttcaaagcatgttttcaccataagtagagggcttctcttaatccaaatttgcaccaaataattatgtgcctctatcaaagtatctcatgtaactcatatgcacctactatatacccataaaagtttttaaaaaataacaaatagagcagagattcttatcagtagaagagtatagtttatgttagaaataaatttatgccttcgcacttccaaatacttttcctctgccattatgagctaaaatatttgtgatgcttcaatttctttttttcacatttgtctttgtataaaataaagaaaaatcaggaggaaaaagtgacatggaatagaacagactattctataaaacaagacccatcactgaaatatgccagtttgaggataaaagaccattgaaaaagactagctcttagaagtttcctggaaagaatttgaattagatgacctccatttttactaccagctttcaagtgtgtaatagaccttttaaggcatgtccagcatattttaattgtaaattaaaaacaaaataaatatgtgtactgtttgtccttggcacacctcttggaagacaatgaggtgaattatgcacttttaaagttatttatcttccaattattgcaagagagacctataaaaacattctatctcaacttctaattctacttggagtggtaccactgggaccaaaaggtcaaaatcttatcaaatagaggatcaaatgcactgtgtactgaggcctcacttagtcctgctaagtacccataaattagatctaaccaggtcacctggaacagttatcactctcaactttagctccctatgcaactgttagtggcatggctagaacttagagggcaataaattataaccataatggatcacaccgaaggcaaaaattccctgtggctaatatataacacacaatgtaattttgtattggcatagattcaattctgctgtataagaaggtcatacataaaagtacagttctaataagtccattagtgagagtttagggactctaagatgcttaagaatgcattagggaaattttgctttatctttcataactggtggcaaaaataagccatggtaatttgaccttttctaattttctttaattgctttattcatcaaacaaagaagaaaaaaaagctaggtagaaattgtgttcatataactatttaaaactattaccattcatatatacctaaacatgcaagctattctttcaatttaaaaatgagtgcttaacacaatactctgaacgtatacttgcacatttgtgtattagtgtacctgtgtataggttatgatatgtgtatcaggaatgatatatatcaacaattaaaggatactatcattaaaaagtgggtttgagagtatgaagagaaaaaattttcccacaaaaatgtaaaaattttgtaactctgaaaaagaaaaaaatataaaatagaaatttttgttatgaatttctcaatcatttaggattcaacatgaaaattaaagtttttataggggatttgttgatattagcagtttagattatagcacaaatcttcaatccaatatattttttttctagaaaccaaatgatttggaagtcaatgatttggggggcagggaatgcatttttggcaaatctgtaggaatttatttttcataaagtataggcaaagtttgtctaattctcaggagtgaattttttttgtcatgatatttctgtctatggacttaccacctttataacataatcattcctatttcacaagtaatgtggaagacagtgaaaggaaataagacactgtgtgttttagaaacgacttttacataaaaaagcaaacttaaaggaaatggctggccagagttgtcagtgtccttcacaaattaaattttcacaatgaatagtagcatatttactgaagatattacctaaaaagaaaatatcaatttgtaaatacaattatgcatatgtgacatgtagatacatctatagatttttcacagtgaattattaaggacattcagtctatttaatggtaggtatttgttatatgaaaagtttaatgtgggttaggattaatatgacttagtccttggatactaatagcaacttttataaaactgatatgaggtgatcataaataaagtcagtcaaaaatactattaaataatatggattttagaacaaggaattgcataccagtgttattagaaaataatttatacagaagcagcatttaagatatctcttagtagcacataaaattcaactgatagcactggataacagtgatttcaaagtttatgttcaaaagaacatcagggaaggtatggtaagaaaaaattggatatggtcatgggacaataattacattagttttcttagtttgtagttcatacatttctaaataaaaagaaaattatatagacagggtgcatcttgaatctagcaaaactcaagagacagatagaaaacagtttgcaatgaaaaggtatctgtgggcacagtctctgtttcagcactctggttgtagaataggttgaatcaagacaggtggtagacaacaattagtttatatgagtgatgactaagaggtcttatactaaagttatgttgactgatggagatgcaagatacaaggtggagataaaactactaaacttagcagttgaatggacactggcctgggcaggggagtcaagccccttttgcagctaccaagttagagtctgaaagaaaagaagctaagatatttgatgttgttatgaacataatttctctcgtttcaaaagcttttaaaattttgcccaggattttgagataagtattataggactgtaccagagtcatacttttctttctgttattattttaattattgatattgtcatgaccattattatcacatgcccaatagtgatgagagcattttggccatgtgagacaatcatttagcatttcaaaatttttatgtgatgtgcctttattactgagactcttcatgttcaccccaaatatcacattctggttgtttctcttttgtgacttttaattttgtaactcttcctttctttttttaatttttgggtgctgaaaatttatgtaactttagtgaacaaaaaaataaaaataagacataaaaataaatgatgaccataagggaaaatcttataaaccaagttttaaaattataaaacagttcatagtcatacaatctcatgtaaatgctttctaattaaatacaaatatctgagcgttgggtatttttattctttatattcttcctcggaaattttcatgaagatcatgtttatcagcttatttttaacacactgttaaaaatgtttctgtctatattgtttgcttttaattctattacagccataattattcaaacgtccccattaagagacagtttattgcctcaatgagaaaatgtagaaaacatgatttgcatcactttctctggaaaataaatttttctctaactgttgctaaaaagatggtataattggatatggatctaccatgtggccctactccttgctccctggctatagattcaaaccagtgagtatttaattgttatttctctcagaaattttaaaacaaaacaaaacacagtgactttaagccttctttaatggccactgcatcaaaagtttatgaagaactggcatggcatgaacacagaaaacacttaaagtcaaatgaaaaacaaggaagtggagtaaaattataagtgtataaaggaatctgctctgcagagagaaaaatagagaatatgcacagagaaaggcagaaactagagaccatatggtccaagaccaagtagttttcctctctccctggtaaacatacaatttccataaaagtaaattattttttatatctatgctattggtattgttaatattctctcccatcagctggaaatcatttgaaggcattgttgtgtcttccttataagccaaataactttgattaaaatcagaatattcttagaaaagcataatttcataacaaaaattcagtggaaaattttctataaaaataatttcaagagcaatttaccactaagaagggttaaagttaattataggctagtgattataatacaaagctttcgccattgttagtaggatcaaactcaaattgttggttctattttgatattcagagcatatatatatatatttgaaatggaatatatatatataatatataaataaaaatatatttttgaaatggaatatatatatataatatataaataaaaatatatttttgaaacggaatatatatatatatataattttttttctttttgagacggagtcacactctgtcacacaggctggagtgcagtggtgtgatcttggttcactgcaacctccgcctcctgggatcaagtgattcttctgcctcagcctctacagtagctgggattacagggtacctgccacaatgcctggataagttttggactttagtacagacgggttttcaccgtgttggccaggctggtcttgaactcctgacctcaagtgattaactggccttggcctcccaaagtgctgggattacaggcatgagccatcacacccagcccatattttttattttgattcattatattcataaaagaacaaccaaaaaactttgggcaacaatcaaaagaattacattttaggtaaatgccctatattttaaaagaaactacaaatattttggtatttatcataataatatagttatttaataataatgtatattttatctatatttagcttttgggaaaaaacattttacattaaataaaatttaaaacagtgtaaataaaggtatatatatttacatatatgaatatcatagtattaatatatatttcattaatactggagagcatattttcaaatacaatctatataaaaagtgtgcactcactttttttaaaatgaattctctactatatctttgtagaaaatattaactaggatcatagagaagcatacagaagaaaaaatatcttattctatatcaatgtaaataatgttaaaacaataaagtaaaaacatacaacacctctccaagtaaactaagattatttcaaatatttacataatattattattttatttcagacattacaattatttagcaatattggtatggaagcatatagggacaatatatcgagaggaccatttagtaaaatggataaaactccctagtccagtaatataatgatggtaaatgaatttatctctataaaacaactaaacaattgtagaaagatgcatgtacaaaaattttcactgcagcatttttgtaattcttaaaaactgcaaacaaacttgacttccaaaataggagattcattttttaaaaatctcttatttattcatgcaataaccaatcatgcagctaataaaaataattatataaatatacatttgtttgcattataattttacatgtattataaattttatgtaaaaagtaggccgacagcaaaatgaacagcataatccaatttaaattaataagtattataaatatacatatcaacacacataaatgcttgaaataaaatgtggcagaataaacattaaatgttattttccctaactgataaaattatcttcatatatatgcttcttattttctgatatgtttaccataagcatatattattttacaattaaatgagactgtaatttccagtagtgattagatttggactaaaagcccagatttacctcactatttgtctagcagtaatggtctataggacacataaaacagatgggcactaggttaaggatattcagaataaaagcccttatgctttgatgaatgaacccctaaaagcactgtggcagcaggaaaacataattcacaagaattcaaagaattcataagtaataaagcacatagtaaactgtagtaaaataagaggcaaattgagatttattaaagactccaaattttagacatgaaatagtataaagtatcaaccactccataacctattgtaaagtggatcataaaccctgagcaatgatgtgaaatgattcaggttcactaagctgagtatctgacatttggatttcataagctgggaacttgtgggtaagcatgtttagagttactctctgagttttcccagggcccagtgcaattactgattataatccactaccctctgcccctctgtactcaagaaagactgagatgcaaataagtgagtacaaagttactttagagagctacttatacctattaatttttttttaatttttccagaaatgaaacatccaactacgttggtaatttagcaatttttttttgaggtagtgtctcgctctgctgtcctggctggagtgcattggtgtgatcatagttcactgcagcctccactccccaaccccaagctcaagggatcctcccaccacagtctgcagattagtgggactacaggcacgtgttaccatgcctgcctagtttttcaaattttttgtcaagacagagtcttactctatttgccaggctggactcaaactcctgggctcaagcagttctccccactgggcctcccaaagtgctgggattacaggtatgagctactgctgtgccaagcccaatatagatattcttaataaaaaaaaatttatgctatctgagaactacttgactggcatattaccatgaaactttttctcattttttttttcttttttgcaactatgtaagacatttccacagttttgcccttcaaccaatgcttactagttgtaaaagcaggctcctgtgagtgcacccaccaaactacatcttcaagccggcagctgagtgacacacttacatgttgccattgttggacagaaatgagttatagccatgcttgtcctactttgccaagggtaccacctcttttttctaagcactatattttcttcttgttcagaaattgacaagcttccaggatattaaaggggaagtctaacggttctccaggacacagatgttcccttcctttctcattcttctttaaatgagttaaagaaactgttgttgctatactcaggaaataaactcaaattatgtaaataattcaatatcatataaacacacacatagacatttaaattataataaacttatattacaggggcaaagaaaaaaaatcactaacatctctatccagaactcttccggtgctgttcaggaaaagcatttgcttaacaggatccatcaacacccagtaatccacattatcctttaaagaaagttctatggtggggtctggtcctccagcagtccctttgatcagcatgttgtccaccagaattgtacctgcaaaccaaagaaaggtacttgaaaacatattctactcatatgaattctttagcaaagatcatgctcttaaaccgcggctggctcacaatcagttttaaagctgaaaatactcaactgtatatctagcataagacagaaaatattctttaccaaaaggccaaagtatctgcattatattatttataaataatatttttggtggaaggcagagatacagacatggtgagttccatcatccattttgtgtttccctctaacaacataaatctgtttccccccatctatcacttctcacaggagttatcactgaattttatcctgaacaaaaggaaatgcctgtaatagcagagtctgatgtctcaattaattctgttagacctctgatgtgaaaaaaagatattgtgaaactaagaaaggaagaggaaatagatttttaaaaagtagctgagcctcccatggtgagaactgcttctttttatcttagagcaaatacataaaacatacatcttgacatgaaagacaaaactagtgtgcagaaatggaatagaagccattcttctttaagacatgtctgggttactctactagaacaacgcactaggccagtgtaacatttcagtgattgctttcttattattttttttcagcaagctgaattgtagacagtttttgaataaaacttgaaaagattatgtctctaaccctttctactgtgttaaagatcccatgcattttacatgtcgaatgcaaacagcactgatgcaactcaaataccatttttccctcacgcagcaatgatctctttgccaaataataatgtaccatggcttagagcaatcattttcaaccgatccattttattaaacttatagatatagaagagatgtggctatgcaagtaaaatgtagcctccaaaaaaacactagaataaatggcaactatcgagagaacacatcgccttaggacagcactcaagaatatacagagaatccataaatacgaatctggcttgaaaaatataacgaaaaaagtatctgttgcattttcttaaggcatgaaattggcctaaatgttataccgttgcataattacaagaaaagtggaaggctctttaaaatattttctcagtaatttaataataactataattatctataatatttctttatcatactactactaccagtctttatccgcctaagaaatgctggaaagaaccatgaatcttttgtaacaagccagaataatgtttaaacacaaatgttgtctcacatacacatacttttgtaaatggcacattttttgcactttttcacatactaggacataattacatgaatattgagtggaatgagtatttttatttttgactgaaatggcaaatacacaacctacatacaatacactccaaagtatagatcagatattgatggcattttattgcctataaatatgttcaagaatgtatatatattcaaggccccagtacatactaatttacaaatacttcacacaactcaccatgaaaagatatttgatctgtatttcaatatataattgagaaattgaaagggaatttattttctcatcaagaaaacttatgtacaataggcaggtcaactaacattaacattaataccttgactcaatagtgtttaagagtagcaactgcaaatcttctgattgtgtgtatgcatgtatatatatatatatatatatatatatgctccatatatatatgctccatatatatatgctccatatatatatatatatatatatatatatatatatatatatatgctccaagctgcgagcagatacactaagggaaggagccattgaactatctttacaaagcaaatagtttataaccagataaagttttaatagtaactaatattaaagtagtgaaacaaaaacactgtatctggatttatattttatttaaagattctaactttcatggaaaagatctatagttttcttgctctcagctcactcctgagttcaatgattgaaactcaacaaaaaatctttctactgctggtgtgttgaaagagttttgtttgcttgcctgctttcccctttagaattgtccatttgtattgccaaaaagaaaaaaaaaagcctctcaaattttcatatacaagcttgctttaagccaaaatttaggggagagagagagaagagagcaaagcttaggcagacatgatacaaggagcaatatacatattttttaaaaattaacctaagtgttcactctgaattgcctgaacaactgtgcccatacccctctccttagaagaatacgtgacacccaagctatagttagcattaagccagaaactcctgtctctccctatcccagcagtggtgactgtatctttccacacatcctaagttttcaagatctgaaaagctagtgttctagacaatattggcaagcagctaaacaccagaatactctgggtgtattgggataatgtgctctctttcctccttcgttactttgcaagcttccctttttgccaataaaccttttgcttaatgtgtttcatttgatgtttaaatgtattctcttctttgacttcattttaaatattacagataagttaaaaataaaaagatgggaggcacgacacaacactaaataagaaaactggatggctctattaatgtcagctagaacaagcaatgtttaatagtggtaacgagacatatttaattataataaagggatcaacaggaataatcctgagtaggcctgtcttgcagaataggtaatacccaagatgggattcaccttacatgaaattttcctttcatcataataaaaatggtggcagttcagaaaatggaattaaatttagtttgatactcatataatagaagttaagagagctggccctggaatggataggcttagaatccaatccataatccaccacttaccaactatgtgaaagtggataaccgcatttaccctcgatttttctccctacaaaatcagtactataagagaaaaggcatttctactataatactatatgtatgttcctgaaaaagacttgttctcttgtatttagaataataaaaatcaaaacaatcacaatcgtgttaaaaatattagcacagttaaatatttattgacattttcaacacatttcttggctggtcaatcttttacagccttaaatactgggatttgtgcttcatcctttaagaagtaggtattgagggccatttacctctagggacgttttttataaaaatggaaaacttcctctttcatttagcctctttattagcctattaattcagaaaaataactttgcagcttctttttatgtacttcctgattctcaagagagattaacatattaaattacaggagttcatgtaactgctaatatagactctatttgtacagaataaatgttcttcaatagattttccattttttcttaagatcttctcacatagctagccctttctttttaattgtgacattagagcttgccacccatacaagaggatagtgggcattaagtatggtccaaaaaacctgtgacatgcttctaccccaaagaaaagtctatgtttctatttcccatgtatatgattatgtggttacataacatgagattctatgttgtatacatgtgtctatgtgtctgtataacatgagaacacaaactgtgttgtgttctgagtccataaggaatacataacaacctgattgaacttggaagcaaatgcttccctaaccatgtttcagatgaaatggtagccctgacaattccttgattatactcttgtgaaaccttaagcagagtacctggctatgctgtgtctggactcctgactcaaagaaactatcaaataataaatgtgtgttgttttaaattacctaattttaatgatattgttatacaataacaggtaatttacacaggatttaatgtcaaaagatctatgttcagaatcttggccgcacactattaactaactgtgagcttaagcaagttcccaagatttttacaatcagcaatatagagttctatgagaaaacaataaaaatgaatgtaagtggaggcacgcaactacccaatgaataacatttttcatcctacagctactagcaatttatatagatttgagcatataaaggagttatatattatttttcattaaattgggaacattatcaacaaaatgattttaaatgtaaaatgtactttctgtacaactgaaataagagaagcacagaacatacttaaataccagcaagaaaaaaaaaagactatgtatgcatatgtaaaatataaaacaaaaagaaggcaacagtttattcacagtaaccgttgataacttttcatgaaataaaaggccatttcttgctggcaaaagcaaaaatgaacaagataataagcaaaaaaagtcatactactaagatcaaaaatgcttattagtacttattagcatttgctgactgtattaactggactaagagataaaatagaaagacgttcagggaattaccatatttaattatcagactggtgtaaatgggaaaggtttataccctcagaatattgcaatattttattattttcaggccatcaaattgctgcagttaaaattaaaagtacaagcataccatgccgtgtatgtgtgtttttgtgtgtgtgtgtgtgtgtgtgtgtgtgtgtgtgtttcaacataatgattaaagtgggtaaaaaacaatcttcataccccactctcctcaaccaaaaaaaaaaagaagagtatagaatctaatcaggcagttctgttcattagaaaaatatgtcccaggggttgaaatcaaagaaacaaatattggttattttattttattttatttttgagagagtcttgctctgttgcccaggctggagtgcagtggcgcaatctcggctcactgcaacctctgtttcctgggctcaagcgattctcgtgactcagcctccataatagctgggattacaggcacctgccaccacaaacagttaattttttttttttttttttttttttttttagtggagatggggttccgccatgttggccaggctggtcttaaacttctgacttcaggtgatccatccgcctcggcctcccaacgtgctgggattacaggcgtgagctactgcatccagccaaaaatatggttttaaaatgtatgtgaaagattgatttgaaaagataaaagccaaaaaagccctgcttgatgaaaaagctcaacctcttaacctgtgtctccattagaatcaattataaacctcaaattttgggtttttcttccattccctaaccaaacaattaaatctctaccaagctgaagatccccccccttttttttttttaactaaaacttcatttcaacttgtgaaattcctttttttagtgaaaatgcaactgtagaaagttgttgttgttgttagatatgtgatttaaaatataaactttttgactgcgattttaaacactatttcaaagttttaaatgattcgattcagtaaatttgtaagtgtgatttattagattgaaagaattgattaagtgtcttaagaaaaaaatcctcttgggtatgcttgcctacccttctagatgtttgaagagtttgtattaaatttatcaacatcacagtagtttaattattaaagattgcatatatagtactttggataggggaagtaagtttgttaagcttatgagttaatagaactttaatcacagaacaaattaaagttttttcccttagtttttcagtcttcctacggttatagcaggaatgaaaatatttacgttatatttatggtcaaatacgattttgattttatctgtgtcatttacacatatttaatattagttaaaactcaagcaatattccatgaaaagacaacccacatattcaaaaaataaacaaaaacacctaattgactgtaggacaacaaacaattatataagacaatatgtttaagaaatggatgtggaattaactggtagtagtgaatcaatgaacatatttcaacaactccatttatttcattttttgagtttctggttgatccaaatccaagtgtatattccaggcagagagaaaggtcacatcataatcctcctccatttctcctctgatttcagatttaatttttaatataagatatttaaaaccttttattccatagataaatttgtacaatagaaaatgtggttttttagtacctctaggagaattctgagttgtcataaccctacagttaaatctgttttctcacctataaaatcattcagattaacaattctgtaaacaataaggcaaaattatttaatatgttattgaaaataataaaacagatggatgttatgacaatactaaatgtgaattagaactatgttacagaaaaatgttttgtttctataggtaatttgcttctggaaacaattaattggaggacatatttaataaccatacgtgctcaagcagtttgcttttttcatgtaaaagtgggcaagtattaagactaaattctgtcatttttttctatggcagtgcctatcgtagaaaaacaaataagcttaagtttgataattaaagcagcaaaaatgtaattaactaaagagtactcaaatattcaaagttttctgataggcttatcatttgagaggttaatccagccaaacaaatttaatttaaagtactctctaactgcaaatgaagtaaactttctaagtcatattccttttcaatagcacaagtacttgccctttttaaaaaatcaaataaactaactaaattaaataagattctttcaggtattttctaaaggtcattttattcatttggtctgtaagatgatgaaaatcattttacacattgaagaagctatttcaaagcctgacgaagtactttactttcaaaaatattttctaataatcattgcataaatgtttcacctccttggttaaattgattcctttgtgttttattctttttgatgctattgtaaactgaactattctcttaatgtcttttttagcttattacttgttaggtatacaagtacaactgatttttgtgcattggttttgtatcctactactttgctgaatttagttattagttgtgtgtgtgtgtgtgtgtgtgtgtgtgtgtgtgtgtgtgtgtagactctttagggcagggatgtccaatattttggcttccctaggccacagtgaaagaagaattgttttgggccacacaggtaatacactaacactagcgacagctgatagctgatgagttacaaaaaaaaaaaaatcccaaaaaataatcttatgctgttttcagaaagtttataaatttttgttgggccacattcaaagttgtcctaggctgcatgtggcctgcggatcataggttggacaagcttgctttagggttttctatatgcagtgtatttaagaaagaggaagattgtttaacttcatataataataatcagatacttgaatatgttttattatttatacataatattattcaaatattaatcagagaaccacctgaaagtgattatctactttctcaacataactttttcccactataaacattcattgttatgcagaatatataaagaacttctgaaatccaacgaaaaacaaatgatctgattgaaaagtgtgtaaagaacttgaatcaatagtttttcaaagaagatatacaaataatcaataaacacacagaaagatggtgaacatcactaatcattggggaaataaaaatgaaagctacaataataaaccacctcacattcattaggatggctactagacaaaaaacctaaaaaatagcaagtgttggcgaggatgtggagaaattgaaacactacaatgttggttggaaagtaaggtggtgcagcccaaaatttcagttacacaaaagaaacaagttcaagagattaattttacatcccagtaactatagttaataacaatatattgtacacttgaaaattgctaagagagtagattttaagtgttgtctgtacaagaagtgaggtaatacatatgttagttggcttgatttaaccattctacaatgcatacacatatcaaatatcatgttttacaaaagaaatatatacaatttttattaataaattgaaagtttaaaataaaatcatatggaaattgtggaaaacaaatgtttcctcaaaaattaaaaacagtattaccacgtgattcagccattttacttctgagtatatactcaaaagacttgaaagcagtctctggaagaggtacttacatacccatgttcctggcagcatcattcacaatagctaaaacttggaagcaaattaagcatccatccatggataaatcaataaacaaaatgtagtatatacacaaaaggaatattattcagccttgaaaaagaaggaaattctgacacatgctacaacatggatcaacagtgaggctggtatgctaagttaaataagccactcatgaaaaaacaaatatggcatgattatacttgaaactgacccaatacttccatatattttttaataaacatagatgtgtactcttctgatctgaaagtttgaaatttaccaaatgatcttcaggcctctcaaagtatcaaaaaactcaccatatcaccacatccagacaatgagatgcaggatccctcattcattatgcttgcttccttgcccctctgtaattcctgtttcttgcacattattgcatttcttccctgctatataaacccctagttttagtcagtgagggagataaatttgagacagctcccatctcctcggcagtatcacctgattaaagccttcttccttggcaatattcatcgtctcagtgattgagtttgtgtggcaaacagcaggacctagaccaaatccctggtgttttggtaacacacttatatggggtacttaaagtagtcaaaatcattgacaaagtaggttgttaccaaggacttggggagggagtaatggggagttattgattaatggtatagagttttagttttacaagatgaatacagttctggaaatggatagtggtaatggctgcacaactgtatgaatatacttaataccactgaactgtacactcagatatgtttacatctgttcctcttgcttcacttgtccttatcgtatttgctacaaggcattaggatcaattatcccccacaagtatggaaagtcttttctctgttcaaacgttcatcagcatgaagggtccaaaaatggccagaggacaatctgagcttccaattagtcagaacaatagttgagtttcgttgtcaaagcgttcaacttctggtcctagaacccaaatgtcacccagctgaaggtcacagacaagaaagccaaaattattcacgaagatcattaagtaagataggaagagagatcactttcatcttcacttcaagttgcccaggctctgttatgtcatgccatctcctgcatagctattcaggagagggcatgccttcgtgacctctaatttaaagcatacgccacatactgtaagagaatgaccaaacctcatagaagttcatcttctactagccgttatctgagaattaagaattctatcccaccatcttcttctgctagctgcttctgaatggtaggcattgtagtaacattattggattaagctgtggtgtgagctctttgctatgatccttcaccttaaaataaaataaatcaccttgttggaaatgaggttgtatgtccaccagataatgatcaaaagcattggaaagacgttctctgagcacatgaatgttgtttcaggtagaaggtctacagacaacacaaatccatactgaatcatatttatccatataaggaccctcctccatgataaaagtgggtttaatgccactggtcagtgagctggttccctgaggaatgataccataatagggattcagatttgggttctattactggcacattgagtatcagcaacagaagtaaccagattagccttagtaatgctatcttcttgagcccacatattaatcccatttaggtcactatgagcactttacacacagggtcatttatttatccctattgagaccaggaagcccattctgttacagcgtccctcactgacatccctaatctacagaggaaaaaaaaacaaaacaaaacaaaaaaaaactgtagggctcttcaaggaagccagatgcccttttaccaatatacttgttaaatcttgctgaagtgcatgtcctctggttatcttagaagtgtatagataaaggctggtttatcagattacacatgaagataaattcattgcacatttccatcactctgaacttttaaactcctctaaaatagggcttctcaattttaatgtgcccatgaatcacctagagatcttgttagaattataacttatgatttagtagatatagagtaggagggtagagccgtctagttgatgctgcttgtctgtgtgtctcactttatgaaagcaggctttatcacaatgtttctaaagtgtggtcccctgacataagtatcatcttcacacgagaacttgttcgaaatccgtatttgcggctccatcccaaactattgcattagaaactcagagatcccatttcagcaatctgtgtttaaatagccatccatgaggctgggaatggtggctcacgcctgtaatcccagcactttgggaggccgaggcgggtggatcacttgaagtcaggagttcaaaaccagcctggcaaacatggtgaaacaccatctctaataaaaatacaaaaaaaaaaaaaaaaaattaaccaggcatggtggtgggcgcctgtaatcccagctacttgggaggctaagggaagaaaatctctggagcccaggaggcagaggttgcagatcgtgccattgcactccagcctgggcgacagagtgagactccgtcttaaaataaaataaaataaaatagccatccatatcattctgatgcttgttgaaatttgagaaccttgttttataatgtgctgtaaaagttcagacattttgacttcattaactataagctattattgagacttggtttcagttagccaatctagcagactattaacgccacttttcattgtggtagccaaaacatcacaccctgaattcagggtgaatgcattcatgcaaaagaattcagcttcagcaagttttgtattttgttgtccattgtctaacgtctttagaattcactcccatgcatgatttctagctccctgccaatagtgacaatgacctataccttttgttttgttttgttttgttttgttttgagacagtctcgttctgtcgcccaggctggagtgcagtggtgcgatctcggctccctgcaacctctgcctctggggttcacgccattcttctgcctcagcctcctgaggagctgggactacagctgcccaccaccacgcccggctaatttttttgtatgtttttagtagagacagggtttcaccatgttagccaggatgatctctatctcctgacctcgtggtccacccacctcggactcccaaagtgctgggattacaggcgtgagccaccgtgcccagccaacctatacctgttttgtagtataggctatcttgttttaaaaaagatcttatattcctgtcttgactaaaagctaacatttcttatggccctagaatcaatgagagatggtataagtgggtcatgaaaagaattgacattagctcttgaggaaactgtccaaatatagttactgtaaggctattaggcagaagaggactagagaaagtgagagggtctatgttcactagccagaaagttcatgaaattgagatattcaatgttttcaccattatcattttcccatctcatgtctcaatgtcccttttcttccccagtgccaattttcagtgccttttctataggttaagaggatcaaaagggttgagagttccaagtatgttgcatctctgcaacacttataatcataaaaagatgggctccttcaaagctgccctgatgaccttctgtttccccatgtgctcttattgcattttatacctgttagtttacattttccctatatacattctcaagtatatagagaatatacacttggttgtcatgagaaaccaaatgtaataataattacaactattgctacagtgagtaattgctgcagccacttgatcatccaatactctatacctgcactcatcccatgccaccacaggtgtcatttgagtaattgtgatgccacacctggcaaaaattagccacatgctatgtgaatctcccacctccacgaaaggagtttatgcatggatccttaatatgcacactccaatccaagaatctcattttgagttattttttttttcttagagacaagtcaagcaccaattactataatacttggtgtaccagcaagaaaatgtcaccctcaaatttagataaaccaatgtgtttttagtaaaggaaagcttaagagaggtgtgagtagggtataggggaactataagaggtaatgtcatacactgacaaacaaggaatacagaagaaaaatttcatcaggaaaaaaaaaaaacaacataatctaatggggaaatgtcatataacatgagccatgtttagaaaagaaggcagccagcttggagagaacctatgcaacacatacctggctattatttacctctttcccttcatattctcctttctttgcccatttgtggaagccaactgaatgtcagatggctcaggagccttctgatgcaatccatgcatctctgagaaggtgaagagtggatgtaaaaggcaaacagatgtatctgcacattacctcctcaaggcattgtcttctgaattggtcttgtcaagagaatctcaatcaacaatgggatatagattcgggagaaattgagaggaaatttatgagttaaagcttaagtgattggcttaggaaagcaagtgccatatagtgtgaggcataataacactgtggtactggacattgtttagttgtagtttcctttatgtgtctgtataaaatcaacttttagttatataatttgctctatagtacaggtactttgtttcaatctctctctttccactataagaattgcatacacatttgaaagctagtttaatttaaaaaaaagtactaatttggccgggcatggcggcttacacctgtaatcacaacactttgggaggctgaggcaggtggatctcctgaggccaggagttcaaggtcagtctggtcaacatggcgaaacccatctgtacttaaaatacaaaaaaatttggtaggcatggtggtgggcgcctgtgatcccagctacttgggaggctgaggcagaaaaatcacttgaacccaggaggactatgttgcagtcaggctagattgtgccactgcactccagcctggcttgggtgacagagtgaggctgtctcaaaaaaaaaaaaaaaaaaaaaaaaagaaatgtattaatttattagcttttattgtgagtaatgaaagattatacttctgtccttagatcatattgatagtatttataacgttacataattctatattttgctccaaaaaaaaatctgtggccaggcacgctggctcatgcttgtaatcccagcactttgggaggctgaggtgggaggatcacttaaggtcaggagtttgagaccagcctggccaacatagtgaaaccctgtctctactaaaaatacaaaaattagctgggcatggtggtgcgttcctgtagtctcagatactcgagagtctgaggcagaaaaatcgcttgaaccctggaagtggaggttgtagtgagccgtgattatgccactgaactccagtctgggcgacagagcaagactcaggctcaaaaaaaaaaaaaaaaaaaattgcattgctgcaacatgagaaagctgctcctctagtcagagtatggctaagggaagtacatcataacttttaatcactgatatgtgattaaaattttaaagttttgataacattttaattaatgatttaagatgtttggctaatttccatctgaatttagattcaagcactttgcaagcctgttttaatctctatgcttaaaaaatctacatattaataaaatcagccttactacatacaagctgtcaacaaactctgttctaaacacagtggtggtatgaagtcaagtacctttctagctaatggtagtcagcttacacagttgttcaatggggcaacacaatcatatctccaactgttacagagattgaaatgattatcatctgaactactgcacttgtggcaaagttttctttctcaagaaggtttttggtaaaatacagatctatcaacaggagataccattacatttttagcacttaccatatcatttgcagagggatagactcagaatatgatagttgccatgaaaaatagtgaacagtaaaaactgaactaaatggaatatagaacacaagtattggaatgggaggcaaacgttaagaggaagagatatgggaaaatatatcaactcattattcaagcttatttaagcttcatttacatcacaaaaagtttccattcacaaccttttcaaataaaactgaaaggtttccatgatattttaaaaatataatctgtattttatcttaacaagaacttggaacaatattctatccaccattcctgatccaaacaagtgcccaatcttcatctatcttgcctcatattttcagtataaagagcccattcactttttagggaaaaaagacacaaataacacaatggcacaattgttaagtttctcattatatacaaccctatagctaataatgcacatgtcatttccatttctaggttgactaattttgatgggcagaagtgctctaaagtatgcttttataaacctcatatcacgtggtactccatggctgaaacatggcttaatgcatgttttaggatggtgaaggaaggagagaagggaaaaagaaaagacgaagaaaagaagaaagaaaaaggaaggtgaaggaaagaaagagagatgaagaaagaaaatgaaaatatgaccatgttataaagaaaattgaaaacatataattattttttcttaattttagcctgtgtagaaactcttaaggctgatgatgagatagatattttttgccataaattacatgaatctattcatttttacattcttattatatagcattagaatatgttgcattatatgtagactccttagaagatacacgtaaataaaattatcggggaacctgccccgatattcatgtaggttcttttctgtttttcctaagcatctgccagcttgagaagtaaagggacagagtacaaaagagaaaaattttaaacctgggcgtccaggggagacatcacatgtcggtacgttccgtgatgccccacaagccacaaaaaccagcaagtttttattagggagtttcaaaaggggagggagtgtgcgaataggtgtgggtcacagacatcaagtactttacaaggtaatagaatatcacaaggcaagtggaggcagggcaagatcacaggaccgcaggaccgaggtgaaattaaaattgctaatgaagtttcgggcaccattgtcattgataacatcttatcaggagacagggttttgagatcaactggtctgaccaaaatttattaggcaggaatttcctcttcctaataagcctgggagcgctatggaagactggggtctatttcatccctgcagcctcaaccctaagaggcaggcgcacctgggggcgctgtttataagcctatacctccaggtgggtattctctttcccaggaatgtttcatgctgagaaaaagaattcagtgatatttctcccatttgcttttgaaagaagagaaatatggctctgttctgcccagctcaccggtggtcagagtttaaggttatctctcttattccccgaacaattgctgttatcctgttcttttttcgaggtgcccacatttcatattgctcaaacacacatgctgtacaatttgtgcagttaatgcaattattacagggtcctgaggctgtaattacatcctcctcagctgacaggattaagagattaaagtaaagacaggcataggaaatcacaagggtattcattggggaagtgataagtgtccatgaaatctttacaatttatgtttagagactgcagtaaagacaggcataagaaattataaaagtattaatttggggaactaataaatgtccatgaaatcttcacaatctacgttcttctgccatggcttcagcaggtccctccgtttggggtccctgacttcccgcaacataaaataaaaaaaaaaaaagatgctttcaacttagtgactattattcctgtctatctctatgtgcatgtattacacacacacacacacacacccacattaagaacccactaaatattgttaagttcttggaaaatatgaccttaagtgaaatgacatacaataggtccttgaataacatagtcatttagatataattataatacgcaaaaaatggattttgttatgcatcgttttgattaaagtcacagtttccaagaacctactgatgacattaagtttatacacacacaaacatgcacacacacaaacacacacacacacctacacacacaaaggtagttatacacaatatactgactgccttataagaatgttttttctatcttgtaataatacatgagtaccacatttttcaatgcatttaatcatgctgtatctgagaatgtgacttattaagtcccataaatatatctaatacattttagagtataaatgttcaatgtattattgtagatataatatgaaactgtgcatgggagtggagtgaggaataattgaagaaaaggctcttgctgaaccaatttacctatgggagatcagaatatgccaccccaatttaggatggtttggcataaggtttgttgagctgaaggcaattaagaagcagatgaagaaaagctctctgcctctatttacctaaaaggacgatatacatttacaaagacaaaaaatatcccccttcccctctaaaccggggaggacaaatgttatccactgaagagaactttagactgttatgggcctggagatggcaccagaggaatctacattaacaagctttacttagcctttatctgccttttctttgccttgcctcaagttgctgtctttagaaattcaaaatccttttcctttgtcatgtcgcttccctaaaactttactgttctttgttgaacaatgcgttatataagctgaaattcaaactcacctccttggcggctactcattcccttgctgtcttccatgtatatatgaaatacacgtcaataaacttctctggcttttctcttgttaatctctcttttggtccatgggtccattccaactaatactttatcagaattgaggaaaaaaatattattcctcttccaaatagctatttagtattttctggctgacagagcaagtgtcttgacagagaactcacatttcattctctttccaacactcttcttttgatacactttaattataatccttaaaaatcagtctctgtgttagaagttgacatgatatatgaaggaaaagggccactttttaattctggaagttaatgcaataacataaagtagaaaaatagcatattttgaaatatatttcatgtcaaacacagacatatccttctaaaatgcagcatcaggaaatacttaggcataataacaaaagttcaaactatgatttcaaaacagagaatttgacaattcaagtatggatatgataagcctttattctgatttttttccaaatattccgacagtggaaaatgttcaaacaaaatttgaaggaggaggactgtgtactatcttattttccctcaatatttttcttatatactttaaagtaattttattctgcaatattgtgtcgaactatgaatttctcaaccattgtttctgaattgcaataaagtcaaaccgagcaagatggctttaatattgccctcatcttgacgaaactttaaacacttttcttcctgactgcatgtcctgacctttattttcttagagtgtttacttcagaaaattttccattgtaaattcttcctatgactctttgagatgtaaatagtctcccagccacttgtgagttttataacccagggatgtcttaaaaaacttggagacatccctttgaaatattgttatccagaaagatattttcccagtctcccagtttgtatggataataggagcctaaattccataagcaacaattaaacaattaaatgtggtccaaactcagggaacaaccttcccttcacttcctccaatgcttttccactaaaattttcttgcattgtgtttcaaaagaactgagttcaatttctatccactattgcaatagccttgaataaagtcttgcctgtttaactctatctggtataatttttcttcaagagaaccttaattagtcaagttctattttggcaatgggattcatattggaacttaattttatattataaaaatggataaataatcacaaacataaaatatgaatatatgtttccaacaacattgtgtgcatcaaaccaggcactaaatggcaaaggtataaataatcataataacaacttttgtggtgatagagttttttctagatgcactagatatgctgatattcttaaaataaaaattcttacatattagccaaaagatacttctgccagacaaatgttttattcattattacaaggattctagaccttttaaaattaagatattctgtttcaaagtcaatgtacaaattcccctaagttcttaaaaaataggggcaggtttcatggtgacctgttcaaagatctattgctgagatagattttagtaaatcaatttggttcactatcccagttggtcacaaatatgagtttttgttattacttcaattatcttattcattgcttactcaaaataccttttaagtcttatcccatgcagagatcagatggtaaggtttttaaagtaactatatgactatcagacttatttccatgtaacttgctttatttttgcctgtctttaagattttattacataaaaagtaataaaaattaattttaatgtattcctaaaatttcaaaatcttgcttgtttaaaaaaaaattagtcttaattaaaaaaacactatggaagaaaataagcctttaagtgatctatattatcctaatgatgttgttatgttacttaaatcaaaatttgtgaaaaaaataggttcacacttctgaatctcaaataaactttatagatcaaaaattaccaccaaaggtgctcagaaacaatgactaaaatttccatctctagcaattttttatataacaaaattgtcctaacaatactagctaataaattagagtttggttacaaaatgaaccatgataaaatctatcacagcaggaaaattttagaaaaggtcaagaccacttatgtgatcttaccttcaattttagaccaaggaaagtttgtaagtgaaatttaacccttcaaaaatgccccccaacatagtatcttattcttgtgcaacctggaaaaacaaaaaaaactgatattagaacctaggttattttatttgctgctggattatttgcttatttgttgttttaaatcagaaaaaaaaccccaaatattctggtagcctagaaataatcaatagccttgcagacaaccaagtatccgggttgccttatgaactaagcataggatagaattaaactagacactgctaaaatgaatggacaatttttagtggtatgtatacaaaccttaaagttcaaataatgtaaatggccgacatcaaacatattttctaaactatagaattttacaccaaacagtatgttctgccacagtaaactgtctctggctttcttaaaagtgatttattttatactgcaaattattctgtcatgtccacttggcatatatgtgttcctttctgattttctcaacaactctctcttagaaggaaagcattttctttttagaaaccattttgaatacataatcacatacatgtaacagaacatttaaaaagaaactgtttcagccaaaactatgctacctactctcagtgaagagagttgcagacaacttttgtaggacatggaaaagaagccactgaagttcagtgtgtaacatttatatgattaaatataatataaatataaataatataatgattaaagatgggaggctcaggtagcttggacactgaggatttgggaggaaagcaatattacagtgtgataattgcaagttatcaacaaagagtcatcagacttcttgcatttctccataagcttgatgacaagaacatcaggtgggtttctctgaaaagaactaaatttacagaagttagagaatttagagaaattagttgaagggtgtctgactttcacttgacaattttaaagggtgaaagtctaaatgaagaacttttgcagattaatggtctgcggttaggaaataactgtattccaactagagatgagtctcaagtgagtatttcccaccagcaaatgtgggccatgcaagagagtagacaagaaggagatgatctcaagcccagcccaagagaatcaccatgaggaatgaggagacctcagcagtaagacgctgggctgtgcagccacatccgcgggaacagcaaaagttagtgaccagaagacaaattctccagccatcccaggaattgccagaaacagctatccaaatttggaggtctccaaagaatctgcctacgtggttcacaatctcaggagttgccaaaatcagacctagagagtacagcaatgcaccctttcttttctttttacctctaatgctttttccagggtcaaacctggaggagatgaaaatcagtatttagtaagttgaagaaacagagatgaataaggcagagagagagcaaggttgttgacacccaggttctaaggcagctgggatgcctacaaaaggatatccaagcggaaaaaaattgaagtagatttctagccaaacttagaagtcctctgtgtctaatgtatttcagagtaggagataaagtatttgttggattagcacattagcaaaattatctagagaaaggaatacatgtgtaatgtccaataaaagccagtgattctccaattgaacataaaatggactaagttgataagaaatgtggggctctttcaacaaatagtttaaaatcaaaatcatgaaggtggataaaatatttctttacccccagaaaataaacggataaagctacttctactatctttgttatttttcactctactagccctaattatttcattactaacttatcatcaattgaaagttataaaatgcatgtttccatcatgatactatgtcatatatattttaaaagatggttataaaagtcatctgtcattattaaattaaattttgagtcaatatatatttgtattgggctatgaatatgcataagaaattaatattctgaataatatgtactctttcagtgccctggaaaagacaataggagcctgatacaatttgtcattcttgcacagtgacagttaatcgaaaattattaattcattatcaaagtatcatttccatgacaaagacgagaggaaaacatgcagactgtgtccagatttcttccagatatctaccagcaaaatatcaccaaaattaaacaatgaaagatagacgaaaagagaaaaaagccagagggagaggagagagaaagagagagaatgattatgttttacataaaaaacagtaaattgaattccttacttgatttttataggtattgttcatctagtttgtagtaaagggaacatagctatagacaggaaactgtcattgttgagaatttggagcttaaaagtattcagtaattttaaatgcaggacatgtattttcgaaaccattcataattaagaaattaaaaagattttagtaacatttgtgaaaaacagaaagaaaattatttaaaagtctttgctcttcagagatagtgcctggctcttgtagattcctttcacctctacactatgctaaaacctggctttgtctaaaaacaactttagctatagatggtcactttctgtaaaggcttttctttgttattgtcatagcattacagaatattgatgacttcaatatcacctacacagaaaaactgtatatgacttttggaaaaaaaatgagagatttagggcaagcaaagttatgctgttgtagattcaaaaaaaaaattgacattttaggttaagtatattttcaatgtttcaattataactgtaaatctataaatgctggtagaggtaacctcattagaaataactccttattctaagagcaaagagaaacctgaaatgctaaaatggatactcattcttaataggatcaagaaacaccaaatacccgtcaaatatccgaagattatattcaatgactctgaacaaggaaaaaagcaaaaaattaagtgaaacatgaatgaaagaaattacagaaatctaaacaaaggtataatctatattaatggattgtaaaactcagtagcttaaggatgctaaaatctcctcatgtaatgtcaataaaaatttcatcaattttgaataaattgaagaattaagtctaaaacatatacaattcaaattacaaagtatatgcccataatttatgactttactgcttaattctaccagcatataaagaagaacacatcttaaacaaactattacaaaaaataataggaaacacatactattttggtttttgatgctagcataaccctgataacaaacctgacaaaaatacatcaaagaataaaaagtacacatgaatatcctcattaacacagatacaaaaatacttaatgaatttatttagaaaataaatcaaatccagcaatctataaaataatgcattatgaccaagttggttttaccaagaatgcatggttggtttaatgtataaaatacataaaatcttattaacagagtgagggaaaaaaacataactcaaacaacacagaaaattcatgtatcaaaagtaaacgtgttcaagataaaaaatattaagcaaattaggaatagaaagtaacttcctcaatctgataagcaaaatatttacattaaagaaaacagaactaaattaaagctgacgggaagaagaaggcaagattatacaatcttataatttctattcatcatggtagttggaattcctagccactgaaataaagcaaggatcaatgacatatattaacaacaaagaagaactatgctcctatttagaaacagcatgatcgtttatgtataaaatattaaatacagataggccaccttttattgctttctttattagtttattgaactccataaatacggcatttttttaaaagtttgaagatttgtggcagtccttcaaataaatagcaaatttattagccattttttccatgtgctcacatcatgtctgtgtgtcacagtttggtaattcatgcaatatttcaaattttttcattgttatatctgttatgattatctgtaatcagtggtttttactattaattactattataattattttgggatgccgcaaaccattcccacattacattgaacttaattcatgaaatgttttgtgtgttctgattgctccacctactggccattctcccatctttctccatctcttcaggcctctgtattccttaagacacaacaatattaaaattagaccaattaataaccctacaatggcttctaagggttcaagtgaaagagttgcacatctctcaccttaaatcaaaaactagaaattattgagcttaatgaggaaggcatgttgtaaccaagataggctgaacgctagacatcgtgcatccaacagttagccaagctatgaattcaaagaaaaacttcttaagggaaactaaaagtgctattctagtgaatgcacaaatgataagaaagccaaaaaaccttattggtgataagtagaaagtttgagtgatctgaatagaagatcaaacaagacacaatattttcttaagccaaaacaaaatccagagcaaggacctagctctctacatagctatgaaggctgagagaggtgaggaagccacagaagaaaaattggaatcttgtagatgttggttcataaggcttaaggaaataagccatctccataacacaaaagtacaaggtaaagcagcaaccacatgattacatcaatagatgcaggaaaggctttcgataaaattcaacacacattcatgtcaaaaactctcaaaaaagttaggtattgaaggaatagaccttgaactaataagagccatatatgaaaaactcacagccaacattatactgaattggcaaaagctggagtatttcccttgaaaaccggcacaggacaaagataccccctatcaccactcctattcaacatagtattggaagttctggccagagcactcaggcaagggaaagaaaaaggggcatccaaataggaagagaggaagtcaaactacccctgctagcacaagacatgaacttatattcagaaaccctcaaaatctaggcccataagatccttaaattgataaacaacttcagcaagtctcaggatacaaaatcaacgtacaaaaatcactagcactcctggacaccaataacattcaaggatccaaatcaggaaatcaatcccattcataactgccacacactcacacacacacacacaaacacacacacaaacacacacacacctagaaatataattaaacaggaaggtgaaagatctctaccaaagaactacaaaacactacttaaagaaatcagagatgatacaaacaaatggaaaacattccatgctagtgaatagaaagtattatttttgctaaaatacctataatatccaaagtaattcatagattcaatgttatttctattaaactaccaatgacattcttcacagaactagaaaaggctattttaatattcatattataaatattcatatttattaatgataaaatattctattttaatattaatattcaggccccaaaaaaggacctgaatagccaaggcattcctaagcaaaaaatacagagctggaagcatctggctacccaacttcaaattatactacagggctacagtaaccaaaacagcatggtactggtacaaaaacatgcacatagaccaatggaatagaacagagaacccagaaacaaggtcacatgcctccaactatctgatctttgacaaagctgacaaaaacaatcaatggggaaaggactccctatttagtaaatgtgtagggagaactgacaagccatatgcagaagattaaaactagaccccttccttataccatatacaaaaatgaactcaagatgcattaaagacttaaatgtaaaaccaaaaactataaaaacccatttctctggacacaggaacaggcaaagatggcatgaccaagatgccaaaagcaactgcaacaaaagtagaatttgacaaacgggatctaattaagctaaacaggttctgtacaacaaaagaaaccatcaacagagtgaacagacaaacctacagaatgggagaaaattcttacaaactatgcatttgacaaaggtctaatattcagcaactaaaaggaatttaagcaaatttttaaggaaaaaaaccattaaaaagtgggcaaaggacatgaatagacacttttcaaaacaaaacatacatatgagcaacaagcgtatggaaaaaaatctcaacatccctaatcattagagaaatccaagtcaaaaccacaataagataccatctcgcaccagtcaaaatggctattattacaattaaaaaagtcaaaaaatagcagatgccagtgaggttgcagaaaaaaagcaatgcttatacactgctggtgggagtggaaattagtccaaccactgtggaagagagtgtggtgattcctcacggacctgagaacagaaataccatccgaccctgcaatcccattactgagtttatacctgagggaataaaaattgctctatcacaaagatacatgcatgtaaatgttcattgtgtcactattcacagtagcaaagacatggaatcaacttaaatgcccatcaatggttgaatggataaagaaaatgtggtacataaaccaaacttggaatgcggtacattccatgtgtaccacatggaatactatgcagccatataaaggatgagatcatgtcttttgcacgaacatggatagagctggaggtagttatccttggcaaacaaatgcaggaacagaaaaccaaatactgtatgttctcacttataagtgggatattaatgatgataacatgtggacacatagaggggaacaaaacacactgaggcctattgaagggtggagggtgggaggagggtgaggatcaggaagaataactagtaggtactaggcttaatgtctgagtgatgaaataatctgtacaaccaacccccatgacacaagtttacctacataacaaacatggacatgtactcctgaacataaaataaaagttaaattaaaaaaaaaaactaaaaattacatgcaatatttgtagtggtacaaatatatttatgtaactgtaaaaaagagagatgtataagaatatatacaaaatgtaataatggttacttccaaacaatacatgaaggctagaagttgaggtgttttttttttaatctgtaaggttttaattcttttaaaaaagaaaaagtattagtgtattgtttcacaatttttaaaaaatgtacaagaatgttcttatttctaccatattggtctgcttctttgtattttttctggcccaacccaaatcagtcttttcaaagtttatctacattggttagagatggagccttatagaacattgaattaaaggcagacatccaaacagttattgtatggaacagatctgcgtactaaatatgaatgtgtgtattgtgtgtgggcttatagtattaacaatacacattatgtctttttgttttttatgtgtattgtctgtgtacctgtgaatttcagtattcgtgagctatgcattaatgtataccacagttaaataaatgaattagttgcagaaaaaggaagatcaaagttggaaggctttatctatctgattttaagatgtactaaaaagccacagaaataaataaataaatgaataaataaataaataaatggactagaataggtaggaattagtcaactttatccttaagggccagatattaaatatttcaggccttgtgggacacatatgaggtgtctgtcactttttgcccctcttcctcctcctttctcctcttctgcctctttttctacctcttattttgacaatactttaaagatgccaaaattgttattagattgtgagccacataaaaacagcccaggagtcataatttggcaatttttggaacaaaggcaaaaaacagaaccgcagtagcctttccactaacacttcacaggaatttgatggatcaggaaaaacctttgtaacacatgatgctaggacaactgggtatccatatgaaaaacaaaagttaaccttaacccctacctcctaacaaacacgaaattaatcaaagaaggagcaaacgtaagagtaaaaggccaaactacaaagtatttagaagaaaacaggggattatcttcataacctgctatgaaacaacacagtaagaaacaaccataaaagacaactttaatatattagagtttcttaaaaatttaaaacttttattcttcaaaagatacctctacattaattataaactggaagaaaaatatttgcagaacttgtgtctaacaaacacttgtatgccaaatacacaaaactctatgacaactcaataacataaggacaaattttaaagtggacaaaacacttgaaagaaacttcctgaaggaatgtgcatgaataagtaataattacatgaagtgctcaatatccactgataaaaatttcttaaataggcaaaatgaatctatagtgatagaaaacaaatcagtggttgcttggggaaaaggatggagaaaattgattggaaaagagtacctgggaactctttagagtatttaaatgttttataccttgtcagagtggcagttacatgtgtgtatatacttttcaaagctgtatagttaacgttggtatatttcattgatttcaatgtaggtaaatctaacctcaaatatccataaatataataatcatatggaaggtcacttccaaattggtggaggaatagttgaaaaaatagtctaatattatcattttttaatctggataatggctccaggatagtttgttatggcattcaatttattctgtatatgactgaaattttaaaactcttaagctaaaaagcatttgtcacatgtttttgctgaaatattggttccttgtaatttctcacttaattcaagcagacatctaaaggtgatttattttccacccagaaaactaagagtacaaggattcacttgtgtccacaagggaatcaagtgatccaggagaacgtgcttcactattttttgcttttcctgacccttaaacagcttctaattcctcttgctaaaaaaggaaaagggatggctgggcgtggtggctcccacctataatcccagcactttgggaggataaggcgggtggatcacttgaggtcaggagttccagaccagcctggccaatatggcaatacctcgtctctactaaaaatatacaaattagtcggggtggtggctcactctcgtaatcccagctactagggtggctgaggcatgagaatcacttgaacccgggaggtggaggttgcagtgagtggagatcatgtccctgaactccagcctgggtgacagaatgagactctgtcaaaaaaaaaaaaaaaaaaggaaaaggaagcaaagaaaatagaaaagttacttcctctaaggtaaccctaggagttttcttcactatatttaggaacataattagctgtttttttaaaaaaaaaaaattgatgcatgcttgctttctctctatatagaactatattttgcagaagtgttaatgatgttttgaaggtgacaatgttatcccacaacatataatttcctctcttaaaagtactatctttgaaatgggctcacataatatgtaaatatatggggataaatgtatagtctcattacaaactataagaattattccatatatgtaaaatatgaactactataattgggtgtaaaaccaaggttgtaaatttaattttaataatttgcctataatatttatcagtccaaagtgatttgaaaagaaaatctattaacatgttttacaatattcttacattatttctatcattatgtatgagacaaatcatgatgtgacagcatgtgacaagtgtagcagatgctgtggatcagcttacacaaaacttattccaactacctcctttgcacatgtttctgaaccgcataactgagaagctaaaattatacttaaaggattcaattgcagctatgattctatgtatgattggggttactctgacaagattattttttatataagacattgttcagaatgtactatgaaggggacaggtgttacactttttgcagttacaaatcggggtggaagtgctgtggttctggtgttagctgtggttctgtagttggcaatgttggcatcagctttctggaaccaggcatctggatcatgggaaaggcagcatttcctaggtgatatggcttggctatgtccccactaaaatctcatctcaaattgtagctcccataattccctcatgttgtgagagggacccagtgggagataattgaatcatgggggcagtttctcccacagtattctcatggtagtgaataagtctcatgagctctgatggttttataaggggaaacccctttcacctggctctcattgccttgtctgccaccatgtgagacatgtattttgcgttttgccatgattgtaaggcctccccagccaggtggacctgtgagcccattaaacttctttcttttgtaaatcgtccagtctcaggtatgtctttgtcagcagtgtgaaaatggccaaatatactatagcagatcagttatgttgtggttttgcatctcattcctggcaggtcaaaacagaatctatttcttccaccctttcaatcatatgtgaactatttatgccacttaataagtcccttcagcttgaagaagctagggtatattgttttttgtaactaatatccctaactgatattgcagacttcacataaaaacatcctgttgaagatgaggaactagaagattctttccccagggacatatgatattaaaaaaaagctacaggtagctggtctttactgtgtacattatcaacctcttacccaaaatactatagtggtattcactgctataactatttacagtatattcagctgttttcttacagtcttagcaaaaccatcttctcatctgttatgacttgcatgtaccccccaaattttgtgtattggaaactaaatgcccaaactcatatgttgatgatatttggaggtggggcctttggaggaggtaatcaagattagataaggtctttagagttagtcccccatgttgagactggtggctttagaagaaaagaaagatgtgagctgacttgggtgctcttgccctctcactatgtgctgccctctcaccatgtatgatacagcaataaaaccctcaccagatgccgatgccatactcttggacttccaagcctccagaaccataagaaatattttttttctttattaattacccagtccacagtattctgttacagcaacagaaaagcaattaagacaccatctcacacctggttttgtctataccttgtgagaacctcacaactgtaattcttctgtataacacatcaattaaaatagaatctagacaaaatgtcagtattaaaacaatcaggaaaacagggctgggttgataataaggccacaatatttgctgcctctgagaatttgggaagggatggatttgaagaagaagttttctgcttgcatatctagttcttattcatatgcacacaagcctaaggggaaaaattcaggctcatcgtccttttgattgcttaaaagcatgtagcagcttccaatttacctttcctaaagaacaagtcaggctgcagaaagatcatggttttgaattcagccatggcttttaatttatttcttttagactttgcttgactggaaagctctggaagctggggttcaaaggcaattgtgtttaaagaaaatacttagttgggaatattctaacagcaactgatgggtttaataattcttgtagatactatataaaattttgaatagctagtatttaggtaaataattgcaaagaaacactcttcttttggaataaattacatggagtcctgttgctgtctacttgcaaataatctcattcacgttttgatgaaactcacaatgtacacattttctgaggaaaatggaaacaggaggcctcctgaagatacaataagatgattatatttattttcaaacctttaaggaaagctcctgcaagttaggctaaaatgtaaattttagtgaggattctattagaagttccaaggcaacagttactttcaaaaatgatagacccactgtgagcaaaagagagaagataaggactctgaccgagctggcattgttgaataaggggccctgatttgctgctcaatagctgactctgcaggtttcaattataggaatagctggaataatactgctctacaatattactggtagaatttgcaaagaattgatatatagagtttaagtatgtgtctctgtatgtgtgtttgtgtgtgtgcatgtgcagcacacagacatgcattatgaaaagggagttattcaagtaaaaagcacctgccgctaccataacaggtatgatctaggctgacccatgatgcttgggtgggtggtgggacattaagaatagaacatttaactacaggcatgcttatattccagttatatataggcccactgcacctctaaattgttgcactagagtctttattttggctggatttaaaggccacttcccaaaatttgtgcagaatctttgtagttacataattaaaaattgaaagaatttaaaaaatgacaactgtagtctcactgactttttaaaataaaattaaaagaccagtataactgtaagcccttgttcagaaaaatgttaattccttacgatctagactcagaatgtggggtttgaatcacaattctatcagtcactagcaatgtgatcctgagaagattacttagtctctctgtcccacagtgcctggtttataaactgggaataatatttattttaaaggattaaatgataagctacagatatgtctttttgcagtgtgactagaaaatagtaaacacgtaataagtgctggttgctgctaccataatgatcagtgtatttctatattgtttatttctggatatcagtacttttgatataagactagacagtgaattcctcaattacaggggctatgtctccagtaaacaagaaaatgcctgtcacacagcactcacattaaaagcttagttgaattgatacaacttgtcagagagactaatactgagggcacgatggccttatcatcagcatatcctcattactttgactagattatttaatttattctcttttactccttcttacttctacttcagttaaaggcaactggggagtatagaaatttgaatatttagctttttggggctatgtccgtagtttattcactacttagggtgacctgtgcacatgctaaatgattaaagaaggcaaattctaggatggtaagtagagaaatgtgcattatagattgaaggcatgtgatgggcaaaagagcctgaggaactgacaatagatggaggaactgacaatagatggaggtcagtaaacaaactgaaaaacaaatgtaagggaaaacatctgataaaattaaaaaataaatatcttatttaaaaatatacatcttcttaaatatatatttatattttaatatatatttaaaattatatatatgttaagtaaaacagaagttactaaaggaacttccacctttgtatgtttgcttgaatattacatctttaaaatagcttttgcaagagatgtttcacaaaagaagttgatcttacaggtattgtagttttctctaaaatgcctaaagattaatactccgcaaagtatttcagtcaatttcaagttggggaatttggatgaccaagacatctctgttctctcaattcctcagaggacatacaccgaagttagttgtgatagtagttattatgcctattaagggtgagatccttccaggttctaacttctattgtcctcaaacacagcactctgaaattctagcattaatgactgttactggctacttacaacaagcaacttcacttggatctaccatccagtttccaagctaccaacattaccttgttgcattgtttttgttgctgttgtttctttttttgcgacagagtctcgctctgtagccagggtggagggcagtggcgtgaccccggctcactgcaatctccgcttccctggttcaagggattctcctgcctcagcctcctgagtagctgggattaaaggcatgagccaccacgcctggccattacattgtttatgtacaagctagatgataaggaccaggcaacacttgtgctatcatattgcatgtgtgcaaggctacacagcctgttgatgcacacaggagagactaagaaaggcagacctggccatggcctacctacttgcttactgaactttgtattccacgaaagaagggagcatgaacatatgtttagcaggaaacttaaagtctagcaaatttcctggcccatagtattgtattctagttgtttgttaaataaatgaatggtctgtatacaatatagcatctctctctctctcaacgaatagcaaaattttttaatagacaagtaacgaagggccttccaatttaatgataataatacatggttggctatctattacagctctttgtgattgttggtttgtgaatctgaaggcactatttctcaaagtgaagtccaggaaccacttgatcaaaggtcatctgagttgctgtttaaaatttcagattcctggggtcacttcctgcatctccacctctgacaacaatattcaggaaactatataatcaacagtctaccaaggtgattttatgtacactactatttcaaaaccttagtgctagctcattctctaggtgaacaaatgaaacaagtataaatatgataaaaagtaagagatctattgatcatatttctacatgaagagattttctatttcagaaattgaagtaatcagctttttaaaaaagcctttttgggaatcaatgtaagtttcataattcagccagctgaccaataaatattaaaaaatgtttaactttcttatatttcatcatttaaaaaaatgagaaattattccatagtctatgtctgtctgtatacattattcagctcccacttataagtgagaacatgcggtattagactttctgtttctgagttatttcacatacgataatggcctacaattgcaataatagacattggagacttagaagaatgggagggtgggaggagggtactggatgagagactgcttaatgggtacaatgtacactatttgggtgatgattacactggacatttggtaatcatcacccaaatcattacccaaatagtgtacgttgtacccataaagcaatctctcagcctctcactactacacaatatatacatatgacaaaacaacacttgtaccccttaaatttacacaaataaaacactacaaaagaaaattgaagaatgatcctatttataatagtgacatgaactaatttgaaaccatgtactcataggagatataagaagaaacaataacatgtcctagaaggccaaaaactgaagacttgaatcaaatgaaagacatatcattatcttgaatgagaagattgaatattacaaacgtgttcatttactcgaatctacaaacttaacattaatctacaaaattaacataattccaatcaaacatttttggagggttttggacctggcatgtttacatgacggaataaatgtgaataatcaccaggtaactctataaaaagaaagttattaagacagagttctcctataatgaatgacaaacataatattgggctacagaacagaagtaggtatacaaatatggaagaatatattacatttattttgaaattaaatttttgataaagttagaattttcagtcagtgaatacttgatactttatttaaaacacagttgtcaactttttactatacgtcaggctatatgaaaatattaactgatttaagtctctttacaatcttacaaagacttacaagttaaaaattttaaatttataattttagatacatgccattatcagcattatataacacatgagaaaacgaagcccagagagtttatgtcacttgctgaaagcaacagcaatagtaagtagtagagccaggttgtctgaatgttctttaataccatgatataagatttaggctggcacttgaagaaaaagaattaaaatcatactagagttcttattttaaaagcagattaaaaatagaattttatttcatttaaatgaacaacataaaaccaggaacgtattagaaaaaaaattggtaagtatttgcatcaattgatgtggtaaaacgtgaaatgtgatatcaagttacataaaggaaaaatattcaaccagaaataccatttcacatagaaatgtttaaaatgtttcatatttcacatagaaatatttaaaatctatacctctaaagtatttatgaaaaaattcaaaatatgataagaaagtacattgtggtatatgtttaaattgtggtaatatgtttgtttttttcctattgtcacagcttaattattgataaggtctttatccacaaaaggggttcaaactgtgcaatacatttttgtcacactaattacaaaggttagtattactatgaaacaaaagtttcaagatcaattaaaaaatatggatgttccaagaaaaattgaagaaatttttaaaaatagtcaatagtttaaaaaaatcagacagagaaggaggtaataaaaagagagaagtactaaagtaagtaacaagagaagaaaaaaaggtagaaagaagaaaataaatattccatgttgtcaagaaggcaggagattctcaaattttagcaatgggattatttgaaagtaatttagaaaatagttaagtatttatgcaaaattattttaaataatattcacagatgtgatatatgtgaaaagaaaatagttgaacataatcaaaaaaattcaaagattataaaatgtattattacaatctatataccacatattatattggccactagggatgatataaaggtaaatttagtgtgacagacaaacaatgaaaatattagaaatggtagaaaggtgactttattgacataaacaaaaatgacaaaatgagaaataaaatgggaaatgttgtatgatctcgattgggtaaaagacaatttatctacatgtgattttcccatacaaatcatttgatccaaatggtatttccaatgacaactgaaaatataaagtgaatttaaggaggtgaataggtataatattttttaaaaaatcgacttttttattttttaaagacaggttctcacttggatgcccaggctggagtgcagtagtgtgatcacagctcactacagcattgacctccctggcgcaggtgattctcccacctcagcctccagagtagctgggactacaggcacatgccaccatgccaagctaaatatatatatacacataaaatttttaaaatttttactttaagttctgggatacatgtgcaaaacgtgcaggtttgttacagaagtatacgtgtgccatggtggtttgctgcacctattgacccgtcctttaagttgcctctcctagctccccaccccccaaaaggccctgatgtgtgttgttcccatccctgtgtccacgtgttctcattgttcaacccccacttatgagtgagaacatgcagtgtttggttttctgttcctgtgttagtttgttgggcatgatatcttcgagcttcatccatgtccctgcaaaggacatgatctcattcttttttatggctgtgtagtattccttggtgtatatgtaccacattttcattagccagtctatcactgatagacatttgggtttgttccatgactttgctattgtaaatagtgctgcaataaacatacatgtgcatttgtctttatagtagaatgatttatattcctttgggtatatacctagtaatgatattgttgggtcaaatggtatttctggttctagatccttgatgaatcaccatactgtcttccacaatggctgaactaatttacattcctagcagcagtgtaaaagtgtgcctatttctctacagtctcacaggcacctattgtttctgactttttaatagtcgctattctgactggcatgagatggtatctcactgtggtcttgatttgcacttctctaatgatccctgatgttgagcattttttcatgtttgttggccatgtagatgtcatcttttgagaagtgtctgttcatatcctttgcccactttttgatggggttgtttttttcttgtaaatttgtttaagctccttgtgacttctgcatgttaagcctttggcagatgggagactgcaaaaattttctcccattaatatgtttttgtagagatggggtttcaccatgtttcccaggctggtctggaattcctgggctcaagtgatccacgcaccttagtctcccaaggtgctgggattacagatgtgagctacctcatccagcaaccaaaattttttagtgttattcgccaatgctgctattaaagaattacatttcagtttacacttacgtcgatctactttaggaatttgtatactgatttgcatttatccaaattggaattttttttaaatactgggacttttctctcacagaagaggtctgagatcttagtctagcataaatgacgaaatggggagtgatagaatagaaaaccaagagaaaagaagttatttaagagattaaaagaaataattatctgaccctttcacatagtcttgggtgctgaattgcaaattctgctgtttctgctgtgacagaataataataattttcttttcaatgatatagagatatttaacaatgtttactatttcatagcactagcaaaacaggaaaaaatgcttgatgtaataaaattatttcacccgattattaatcaaatatagaatgggagaatgtatattaacattatttgtcttttgaaataatattatcacaaatattaacaaactttggatagctttttgatatcttaattcctgataattgctactaattcatttctaagtaacaagtacaatataaattccagatttaaattaaaaatatttgatcattcacaatgctatgactgtattacatttcaatattttacctcgtgttattttctccataaatagagtggttatggttcacaggtacacatgctatttgtttatttatttcattttgtagagagggtcttattattttgcccaggctaaaatgcagtagctattcaaaggtgcaataaagtgcgttacagcttcaaactactggcccgaaaagatctggtttagcattctgagtagctggaattgcaggtgcccagccactgtgcccagccacaattgccactgtgcccagccacagtcagctttttcaagaactgtttaagataacaggttagggaaaatcaggataatattttgaggggaaagaaggtaaaatcaattaagacagggtgcacagagtacttgaatggtacagctgatgtttcatcctttgtactaaatggtgtgtatatgggaattggttatattattttgactgtttgtagtcatattatgtacatatgtgtatacataatttaaaaataaaagacaaaagtaatataagctaaaattatagatattaatattaattttatttaaatataacaaagatttgccagtattcaaatgtctgcaattatccttaaaatgcacagaacctatgtttaggtatagtatcactgttcatccagccttcattcactctaatctactcttatctaaaatttgtagtgtaagtaaaattacattcggtatgacagaagacaaattacagtattagaacattatggaaaattggcataacattgtacaatcacccataactttattatttatcattttgtaacttttttattatattagtcaaaaaatctaactgtacttaatagctaatacatatattatttgattttttaaagactattattaaaataataataatttgggggtgagaaggcctattgaaaaatgaccaacatataaatcataaataagtttgatgcaacaaatatttgtaagtcttataggtaaaaatataaaaatttattctaaacaaagctaaaagacaataatatgcattgggaaatatttgcaacattcacttcaagggttgatgtccgtagagaatttttacaaattaataaacatttaaaaagttgaggagtggcaatagctatgagagataatttacaaacacataaaaaccaatattaaaactgtttaatctgtaagtacatcaataaaaattttattatagtagttattttatctattaaattagaaaaggtcaatacaactgataatctcccaagggaatatatgggagaagcgctttctcatacacttataatatattgttagaatgccattaaataaacatttggcaaaaatctatatcctctgtcaaaacaatttaagttctagatctctagaatccacatatacatatacatatatacatacacacacacacacacattcacacctatatatcaacaactcaaatccaactccaattctttcataagcagtattttgtccaacaaacaaatttatctaaaattcttcttggcttttctccattatagagccagcaattttgtgtagctctacctctaattccttcatttgcatttatttctgctttcaagcccttatatgaggcaaatgggattaatttatttcattatcttaactagattcattgctttaatttgtcaaactctgattgatttgctcaactcaatcttgtgtgttcaagaacttaatgtggatttctgttccacctcatgaaagtcttttccaaaaacttgctaaattcttgactcaagacattccagttagtaatgcatttctctgctcaaatacaatagaagtgtgctctaataaatactcttcaacaatgtgcagttatttctccccaactatcaattccccttaaagcagaattttactaaaaatggctttatccttctgggaataatcagtaaaatggcaattggagggtgaatttaaaatatactaaaagcagatggcagaacatgagtgcagatttttactacaaagcttaggaagaacaaaaggaacctgaatagagaaaatgcagaaaagctctccctgggctattaggatgtagagagcagaagtatgtttaggagcttcaaagagtctgtctctttgcaactgtttatcttaggactttaaggaaataaaaggtgcaagtgaaccactctggattataaaatagaatttcacacagaaaaatcaactcagttaatatgcatgttgcttacatggaaatgttgagaaatttttagcaaatagaaagtggtagatggtaggtatatataaaataattgcagaaaaaatgtgaaatgaagatgtatggtattacttttatatttaaattgttaatatgttgcccataatgctttatttcaaagaatgaaaaaccggaaaaatagttccttcctaacttcccctgcagccttgtcttgtggagcttgtattttacttcatgagaaatgccaaagatatgtcatttaagctgaaacctccagcagaattagccagaatatttgggaaaaagatgtttccagaaaaagagctagtataaatgtccttaagcaagacggagctcatgatgattgaggaacaacaacaacaaaaagattatttcacccaagaaaagtgaattgggagtacagatataaatgatgagatctgaatacgattcatggagcaggtcaaactaggatgtttgggtgtggtctaaatgaatgggtggcatgagttgttttaaggagaggagtgacatgatttgacaagttcttaagagatccctttgattactctggggagaatagaacataaagtagcagaaatgaaagcaaaggggagatagtgggaaataattgcacatttataagcaagagatgatgttggctgggactctgattatagcaacagatgaagaaaaaaggaaatactgagaatagttgattggatttgctgacattctcaacataaatggaaatcagtatttttttctaataaatatgatatgcataaatatttttaaatatttaattcttttaccaccagtggggcatgagtagacttcaggaaacatgccagtacagaaccatataaatgtgatcattggtagagataggctttaataggcatttgaatgtctccctcaacctggaataccacgaaaaaagcttttcgcttcgcatgttgcattattatcataccctatagctttctaccattttcagttacttaatattatgttttgcctcaataaataatagtactttctcttattgtattgtattgtatttgcagcaattattagtgaagttttacgtttcaatattacatctaaaacaaaacaaaattgtcccatactattttccattaaaacacgagatcactatgacaaaaaaagctaaaatgtcatgaaatgacttaaattggatgagagtatatgaaatacattaagaaataatctctgactctgtagtttttttatttgtaggttttactagaacatgaaatcaatatgtgaatcctggctggagtttgcatctaaatgtaataaaataaaatgaagtttaatattatcattgaaccattagtgtacattagtgagctggactatataaaataaactttattatatttagcatttgatttttatttatgtatattataaaatgaatatagtttatattataataaaaataaaagaagtagtatgttaactaattcgtataagatgcctacaaactacatacctgcctaaatttttgacctgtgaaacttcaatggtttgtgttagggcctacatttatatatgtacatgtgtagtgtatatatacatatatatatatatatatatatacacacacacacacacactatatatatttttgtgttatatatacacactatatacacactatatacacactatataggtttgtgttagggcctacatttatataggtacatgtgtagtgtgtgtatatatatatatatatatatacacacacactatatatatatatatacacacactatatatatatatacacacacacactatatatatatatacactatatatatatatacactatatatatatatataaaaatatatatatatatatttagggagggcattgttaatcctttaattttaaaaattttaactttgcagacaaagttgattatacctgtggcagaacaatgcatacagcaataaataaataaataacttttattttctgtggagctcccagaattatgaattattggatagattgagatttgccgaggtcattttcttagagttgcaagagcataggagaaagtcaagggaaataataagcagcacttgatttcctttaccacagaggatgggattctaaaaccaaattatctgactataaatcaagacctatcttttacaggctatgtgattgtggatgttacctcctctatgcttcaatttcctcatctgtaaaatggaattatagcctaccctattttgtagtatagtgaggataaattgagtgaatgtatgtagttcctagaatagagcatgacacatgataagtggtcaataaaatattgtttactactagttatgtgacagtcacttcacacatagtaatgatttaataaaggagcaagaagaatgtagagcacagcttctcaacatcggcactacgacattttgggtcagacaattatttaatgcagagggggccataggatgtttagcagtgtctctggccagtagtgtacctcctcctctccaagttttgacaattgcaaaggcttccagacattgacaaatattccctgaaaagtaaaattgtcccggcttgagaatcacaaatataaagtaaccactcaaagattacattactaattttgattgaatttgaccagcattatgaaatcaacataagcttaagtttctacacttgattttgtcattgtcagttagggcagcagagaactccagttctgaaaattctgagcatgtgctaatagcctataatataatcaaaactttcattttgaattgtatttcttaaaaaatagaaaacgtattaagcagcaacatggaataattaaccacaaaaatatggaacataaatctcatttgcctaatatctcttttgaagtcctgtttcactgtataagtattatgtgttttgtttcacagctagatacagccagttttttctctaagcctaaggttactcctcaaatttatggtggctttttgctcttctaagtttctataaaacttcagcaacctgcagcaggttgaaatttattgatatttagttattcaccaggccatatttacagtcagggattgacttacccaaaccagatgctccccctgccagcagatcactaggagatattgcaataatttccctggttactaaattagcaaaagattctcagggagagagaagggcaagatggcacagtttaatacttactattattcttttattctttaccatcattccttttgaatggattaagaatctgacatacacataacttactaacgaaagggagttaggtgagagggaagacatatttgtctaagaaaagtcttagagaaatattttgaaaagagatagaaagaagagttggattggagtgggtgggtagggaatcacagtaaggagatggatcattcacaatttctttagacatggtgaggcagccacaggaagtctgaacttgttgaaaccctaatccgaagccaaaaaaagtgctcaataaggtcatactttgatcacctctgcctaaagcagttattcacaccctacttttgggagaggaaacatctacaaacctttgttctctttgtttgttagcagagggatgacatgaatttgggaaaaaagtttgagagacagaatgagatttagctcaaacaaatgattgactcatgctgggttgaaaatgtgctctagccgtatgtagaaagctgaaactggatcccttccttacaccttatacaaaaattaattcaagatggattaaagacttaaatgttagacctaaaatcataaaaaccctagaagaaaacctaggcaataccattcaggacataggcatgggcaaggacttcatgtctaaagcaccaaaagcaatggcaacaaaagccaaaattgacaaatgggatctaattaaactacagagcttctgcacagcaaaagaaactaccatcagagtgaacaggcaacctacagaatgggagaaaagtttgcaatctacttatctgacaaagggctaatatccagaatctacgaagaactcaaacaaatttacaagaaaaaaacaaacccatcaaaaagtgggtgaaggatatgaacagacacttctcaaaagaagacatttatgcagtcaacagacacatgaaaaaatgctatcatcactggccatcagagaaatgcaactcaaaaccacaatgagataccttcgcataccagttagaatggcgatcattaaaaagtcaggaaacaacaggtgctggagaggatatggagaaataggaacacttttacactgttggtgggactgtaaactagttcaaccattgtggaagacagtgtggccattcctcagggatctagaactagaaataccatttgacccagctgtcccattactgggtatacacccaaaggattataaaacatgctgctataaagacacatgcacacatatgttcactgtggcattattcacaatagcaaagacttggaaccaacccacatgtccatcaatgatagaatggattaagaaactgtggcatatatacaccatggaatactatgcagccataaaaaatgatgagttcatgtcctttgtagggacatggatgaagctggtaaccatcattctgagcaaactatcacaaggactaaaaaccaaacaccacatgttctcactcataggtgggaattgaacaatgagaacacttggacacaggaaggggaacatcacacactggggcccgtcaagcggtggggggaggggggagggatagcattaggagatatacctaatgtaaatgatgagttaatgggtgaagcacaccaacatggcacatgtatatatatgtaacaaaccggcacgttgtgcacatgtaccctagaacttaaagtataataaaaaaaaaaaaaaaagaaaagaaaatgtgctttttcaacaggtaggttgaaaatgtgcttcagcatttaggataccagatgtaaacatccatgcatagaattagaaaggttcaactttcatggctgctatggtttgaatgctccctccaaaacttatgttgaaatttaatccaaaataggataatattgagaagtggactttttaaagaggggattggatcatgaaagttcctccctcatgagtggattaatccattcgtgagtggattaatgggttatcttgggaaggaaactggtggatatataagaaggggaagatagacctgagctagcatgttagcattctcagccctctcgccatatgataccctgtgctaccttgggactcttctgagagtccccacaagcaagaaggctctcaaaagatatgccccatcgaccttggatttccaagcctccttagctgtagaaaataaattcagttctgtataaattacttagctttggatatactgctataagtaacataaaatggactaagacaatggtcttatcctgaactttgtaaactagaattggctgtttagcttcagcatgtatttttttatagattcaaaataatttcattttgaattgcataatgaaggaatgtcataaggttttcagcatatagaggctctaaatatcagtctggcattgtgataaagcagagagtttaaaccaagtcctatttgtgacacatgacctttctttctggttacagctcagtaacataggaatggatacttaactcaaggataagcatataatacatgaggctttttttcaaaattttgatttagaaaatgaagtattctagtatgttaattatagacatttcaactgagaagtctaatagcattggaccagaatagtcacagcagtccaaagccatggataaacttaagttaaaggcaacaaataataagagccttccacattaatctctatcagagaagatgataaacaggtgaatggggactagaaaccatgcagctttagaactagacataaaacaaacagctatctaatgatttcctatttactatgagcccaagatattcttgtatcctctcagttaagctcctgttttactaaggaaatttaagtaagattctgtctcttgcaagaaaataacatctaagacatcttcgaatttaatgctgctttaattttgtttataccagtggtccccaacctctttggtaccagggattcattttgcggaatataatattttcatggacagggttggggggaaggtttcgggatgaaactgttccaccactcagatcatcaagcattacactctcataaggagcgtgcaacctagatcacttgcatgcacagttcacagtagagctggtgcttctatgataatcaaatgctgccagtgatctgacaggaggcagagcttaggagtaatgctcactcatccacctctcccatcctgctgtgtggcccagttcctaacaggccacggaacggtaccagtttgtggcctgggggttgggacccctgttttacactataacatttgcacacgtctctcatggcctgtctttcagatctgctgtttgtctcgactcaagtctagctacctgaaaattagattttttttttaaattgaatttgaatatcttaaagttgaatacacagtctccacttttacacggcccctactgtcttacatcatacctctctagccctggaagatagcaactttacattcacttttcctgttttagggctattattttatcttcagttatcaaaatctatctacttttaaatactttaacttgaaaatacatagtaagcaattatggattatttaaaatagttttcccatgagtataaaaaaaaaaagaatagcaaaagcaatatttgttgagtatttaaaagtgccaggcactgtgcaacatgctttgcttaagtaaatgtttgacaaaatagaaggtcttttaaaagttccatgttttaacgttaataaccatatcaagataaggttagatattctatcaaattaccatttttgtgaagataggccttttctgctatatagaatctcctcaaacctgagtgttcacattatggattatctagtatactccacagctatcaagtttgtttgtgtttctttctcaagtaagctatcttatttatcttatttctccttatttcttcagacttttcctctcatttctttctctttttctggttttttttttttttttttttttttttgagactgggtttcgctcttgttgcccaggctggagtacaatggcatgatctcggctcactgcaacctccgcctcctgggttcaattgattctcctgcctcagcttcttgcatagctgggattacaggcatgcaccatcacatccggctaactttgtatttttagtagagacggggtttctccttgttggtcacgcttgtattgaactcctgacctcaggtgatccgcccacctcagcctcccaaagtgctgggattacaggcgtgagccaccatgcctggcccctatcctctcatttctaaggaaatgacaaattaagtattttatgcaaatacagtgtagggtcatttaaaatattttttgtaatagatgtctctgtacataaatctatttaattttttcttttacaataaaaaggtattaatgtgttttagtttcaccaaaaatttcagtagaccaactgtgtaaaggtacacatttatatcaatttttttgacctagtaaaaactaaagagggaaagttattcaaatatttcagcataaattccctttccttgaaattgcaatcgtcatgtgtagctacaattgctcagtattactctgtagtatgagtagctacaattcctcagcataagaaacactgaagtagacaattgttaagaaaacaaagtcataacaaaacaacaaaaacaacaaaattaaaaactaggatatagaaacattaactaaatgttactcttgaagccgatataagagaaattattgtactagacactgtggttcatcatccagatcccatcttcatgggaacacatcaatcccacactcataggggatatcagcagctgaccattcacatctgtacctttcacgaaatattgccctaagacaaactaaaatgaactaacctgcccaaagcggtgtctcctttcggagagcatccattgactcatagctggctaatgtagtgatacaaagatgcaactgctttgcctcaatttgggacaactctgaaagatgcccagtaggactggctgaagactcagttcaaagttgtcaaataaagtaaaccatgcccagttgaatttacattgtttagtatgagtatgtcccatgaaatatttaggaattacataaactacacattattcatgatttatctgaaatttaaattcaaccaggcaacttgtaccttcacgtggtaaatctggcagcttttacttagttgcatctgcattgtaggtaagcatgtcggtatgcacagacctctcttccgtgcttccttacaagtgcgtcccagaaaacaagtattcatctcagagccaacgggcattgaggcattcgataatcatactcccaaaggtcaaggataaagaaaatatcccaaaagcagcaagagaacaaacaagcaaacacataacatacaatggagcttcagtatatctggcagcagattttcagtggaaaccttacagccaggagagggtggcatgacacatataaagtgctgaaggaaaaaataaaaaataaaaaacttttaccctacaatagtgtatccagtaaatatatcctttgagcatgaaagagaaataaagaccttcacagataaacaaaagctgaggaacttcatcaataccagacctatcaaagaaaaggttgttagtgagcaagaataaattatctgaggatacaaacctcactggtaatactaagcacacagaaaaacactgaacagtgtagcactgtaatggtgatttataaattactcttgacttaagtagaaagaataaatgataaatcaatccaaaataataactacaataacttttcaaaacatagacagtataataggacatcaagagaaagagcaataagttaaaaagcggggggagattttcaagtgtagaatttttattaggtttctttttggtgtttgtttgtttatgtaaccagtgtaaaattgtcatcagtctgaaataatggtttgtaagataatatttgcaagcattgtggtaacctcaaattgaaaaaattacagcagatacacaaaaaaaggaaaagaaagaaattaaatcctactgccaagaatatcacctccactattgtaagaaaggaagaaggaagtgaagaccacaaaatcatcagaaaacaaacagcaaaatggcaagagtaagtccacacttatcaatgataacttgtaatgtaaatggactaaatgcttcaatcataagacacagaatggctatggctgaatggatttaaaaaaaaagacaaattatctgttggctataagaaacatttctcctataaagacacacatcgactgaaagtaaaggcacggaaaaatatattctatgccaataaaaaccaacgaaagagcaggagtatctatactcatataagacaaaatggatttctcgacaaaaactgtaagaagagaaaaagaaggtaattatataatgataaaagaagccaattcagcaagaggataaaatgattgtaaatatatgtgtacccaatactggaacacccagatataccaagcaaatattattagcgataaagagagatatagaccccaatacaacaatagttggagacttcaacaccctactttctgcattggacagatctaagacagaaaatcaggaaagagacattagacataatctgcactatggacaacaaggatctaatagatatttacagaacatttcattcaatagctgcaaaatacactttttccttcttctcctttttttttttttttttttttttaaagacagagcctggctctctcacccaggctggagtgcaactgtgtgatctcggctcactgcagcctccaccttctgggttcaagtgattctcctgcctcaaccttctgcttagctgggattacaggcatgtgccaccatgcccaactaatttttgtatttttagtagagaccgggtttcaccatgttggtcaggtggtcttgaactcctgaccttaggtgatccgccagcctcagcctaccaaagtgtttggattacaggcgtgagccaccacacccggccaaaatacacatttttctcttcagcacatggaacattctcaaggatagaacatgtgttagatcacaaaacaagtcttaaaacattcaaaaaaattgaaatatcaagcatcttatctaaccacaatggaataaaactagaaatcaataaaaaattaattttggaaatttaaaatatatgctcttgaatgaccatccagtgtttcagtgaaaaagttaagaaggaagttcaaaaagatccaaaacctatgatataacaaaagcagtactgagagaaatttatagcaataagtgcctacatcaaaaaagaagaaaatttcaaaataaataatcaaaagatgcatcttataaacctggaaaagcaagagcaaaccaaacgcaaaattacttgtagaagaaaataaataataaagacaagagcagaaaaaaaaattccaatgaagaaaacaatacaaaagaataatgaaataaaaagtttgtttgttgaaaaaataaacaaaatggacaaacttttaaccagctcacttagcaaaaaggagaagacccaaataaataaaagtggagatgaaaagggagacattacaactcataccacagaaattcaaaggataactactggctactatgaacaactatataccaataaaatggaaaatctagaggaaatggataagttcctagacacatacaagctaccagaatagacgcaagaagaaataaaaaaactgaacaaccaataacaagtaacaagattaaagctgtaataaaaactatcccggtaaagaaaagcccaggacccaatagcttcactgctgaattctaccacacatttaaagaactaataccaattctactcaaactattctgaaaaataaaacaagacagaatacttcaaaactcattctatgaggccagtattatcctgatatcaaaatcagacaaagacataaaaaaaaactataggccaaaatttctgatgaaataaatatcattgcaaaaatcttcaacaaaatactagctaaccaaattcaacaatacattaaaaagattattgaatatgacaagtgagatttatcccaggtatgcaaggaaatctcaacatatgcacatcaatcagtgtgatacagcatatcaacagaatgaagggcaaaaactgtatgataaattccattgatgttgtaaaagtatttgataatgttcaacaacctttcatgataaaatgtctcaacaaactgtgtttagaaggaactaacctcaacacaataaaagctatatataacagacccacagctagtattatactgaatggggaaaacctgaaagcctttcctcttatatctggatcatggcaaggatggccactttcattactgttgtttaacacagtacagaatgtcctaggcagagcaatcagacaagagaaagaaacaaagagcaccccaactggaaagaaataagtcaaattatccttgattgtagatgttataaccttacatttggaaaaacctacagactctatcaaaaatctattagaactgataaacaaattcaggaaagttgcaggatacaaaatcaatataaaaataaaaaattttagaaataaaaaattcaacacatttacaatagccacaaataaaataatatacctaagaattagccaaagaagcaaaagatctctagaatgaaaactacaaaagactgatgaaagaatttaaagcatacaaagaataaaatggaaagatattccatgttcataggttggaagaataaatattattaaaatgtccatagtacccacagcaattcacagattcaatacaatctatatcaaaataccaatgacattactcacaaaaatagaaaaaaattctaaaatgtatgtggaatcataaaacacccagaagaaccaaagctatcaaaaaaagaaacaaacaaacaaaaaaaacctggagaaatcacattacctggcttcaaattacactgcagtgctacaataatcaaagcagcatggtctgggcatacaaacagacacatggactaatgaagcagaatagagaacccagaaacaaatccacacatctatagtgaagttattttcaatgaagatgccaaaaacatacattggggaaaagatagtctctttaaaatatggcgctgggaaaactggatatccatatgcagaagaatgaaacttgacccctatctactgccatataggaaaatcacatcaaagtggattaaagactgaaatctaagacttcaaactatgaaactactacaaaaaattgaagaaactctgcaggacattggtctgagcaaaagttccctgagtaataccctacaagcacagaaaaccaaagcaaaaatggaaacatgaaatcacatcaagttaaaaatcttctgcacagcaaaggaaaaaatcaacaaattgaactgacaatccacagaatgatagaaaatatttgcaaactaaccatctgacaaagtattaataaccagaatatataacaagctcaaacaactatataggaaaattgataacccagttaaaattggcaaatatcaaatagacatttctcaaaagaagacatacaaatagcaaacgggaacatgaggaggtgctaaacatcactgaccaccagagaaatgtaaatcaaaacaacaatgagatatcatcttacaccagttaaaatagttttatccaaaaaacaggcactaatgaatgctggagaggatgtggagaaaagggaatcctcttacactgtgggtgggaatgtaaattagtacaactactatggagagcagtttagaggttcctcagaaaactaaaaatagagccaccacatgacccagaaattcaaattttaggtataaacacaaaagaaagaaaatcagtatatcagatatatctgcactcccttgtttggccagcactgttcacaaaagccaagatttggaggcaaagtgtccatcaataggtaactacatttaaaaaatgtggttcttatatacaatggagtactattcagccataaaaaatgagattctgtcatttgcaacaacatggatggaactagagctcattatgctaagtgaaataagccaggcacagtaagacaagcataacatgttctcacttatttgtgggatctaaaacttaaaacaactgaactcacagagatagagagtagaagccttggaagggtagttgggggtggagggaggtggttaatggatataaaaattagtaagaaagaagcaacaaaacctagtatttggtagctcaacagagggactatagtcaacaataatttaattgtaaatttaaaaataactaaaaaagtgtattggactgtttgtaacacaaaggataaatgcttgaggggatggagactcaatttttcatgaggtgatttttacatattacatgcccgtatcaaagcatctcacataccccataaatatatacacctattatgtacccaaaaatattaaaatttaaaaatatttaaaaatttacttgtaaaacagcctcaggccaatctttcaggagatattgcacaagaaggcattgttattataggagacaacagctccatgtgtgctattgccccaaacacctttcattgggacgagacgtggacgtggaagacagcgatatagatccacatcttgtgtagccctaggctaaaatgtgtttaacaaaaaaatttaaatgttaaaaagtatacatttaacaaaataaaaaacttatagaacaaggatataaagaaagaaaatatttttgtgcaggtgtacaatgtgtgccttaagctaaatgttattacaaaagagtcaacaagttaaataaaagtttattaagtaaagatacagtaagctaagattaattactgaagaaaaaattaataaatttattgtgatgaagtgtacagtgtttataaagtctacagtaatgtacagtaatgtcctaggccttcacatttagtcacttctcattcactgactcacccagagtaacttccattcctgtaagctccattaattgtaagtgccttgcattggtgtaccactgcttactatttatacagtatttttatcataacttttccatgtttagataatcaaatattttccattgtgttatagttggctacaatttccagtacagtaacatgctgtgcagacttgtagcctaggagaaataagctataccatatagcagaggtgtgtagcaggctataacatctaggtttgtgtaagtaagtacagccaatcatgttcacacaatgacaaaatcacctaatgcatttcttagaaactatgcctatcatcaatcaaggcatgactgtatatcagaccactttacttatccaaaatgagccttgtgacaaattcactctctagaacaaaattggatgatgaattagtaaaaagaatcccttaacacaaaaattatgacattttcttacatcttttactttgttagaccaagaatagaagacttttcttctcactagtaactgcaatcaattggtatgacttggagtaccaggtatatcactcttggcaacacatctatttttagtaggacaaaactgatgtgaaaaactgaaaatctcttcaataagagcattgaaactaggaaaggggtttagtgagatttagtatatgtatttatttacttctctgtggtttttaaacttatcttacttcctctttttaaaactctgtcagatttatcactgatttcagaattacaatctttaccatagactacaaatccctgagtagttatgtgatttcctcccttctatcttcccagtccatctcataccatacatttattggtcttctatgtcctagacacaccagccttttaagaggactctttattaatcacaaagatgttgaacagatgattctgacagcctggaattttctctctccacttttctttttcttttacctaggttgaattcattgtttagatctcaactgaaatattccttctttgtggaagcttcaccacatgacccagattatgctaggtctcataacatgctggggccttctcaatattgtgattaaccatgagcatgatgtattttgcctggactatattgcagacaaagggcggactgcaaatgcagctgccgaacaaatatctgtggaaagaaaaaatgattccttattttagacctctactctgtctcattagcattaaatgtcacacaagtcttccaagcttatttatctgattttccaacctgagataaaatagaagcagctaatagatacacagcacagtggaaaggcaatattagaaataggttcagcaggacaggcgcggtggctcacgcctgtaatttcagcactttgggaggctgagaagggcggatcacgagatcaggaaatcgagaccatcctggctaacacggtgaaaccccatttctactaaagacacaaaaaattagccggtcgtggtggcgggcgcctgtagtcccagctactcgggaggctgaggcaggagaatggcgtgaacccgggaagcagagcttgcagggagccgagatcgtgccactgcactccagcctgggcaacagagcgagactccatcttaaaaaaatgaaagaaagaaaagaaaagaaaagaagaggagaggagaggagaggagaggagaggagagagagagagagagagaaaagaaagaaagaaagaaagaaggaaggaaggagggaaggagggaaggagggaaggaaggaaagaaggaaagaaagaaagaaaaagaaagaaagaaaggaaggaagaaaggaaggaaggaagaaggaaagaagttcagcaatggaaaagaaagtaagtcataaaagtgaattagaatgcaaagtcaaagaacacatccacatttaatgggtttttttttgtttgtgtttttgaaaatttaattgaagaaagtaaagttaccctggcttataataaagttagatattataacaaaagataagtcagtgaccttaatatgcaatgtgttttggtttactcatcagataaaatatgttattaatgaacaaaataaaaaaatctaaaaaaggaacatgtagagaaacctagagcttagcagtatagttctctgaaatattaataagttaagaaatatacaccaatgagaaatgacttcagaagtttcactccaagggccattatagctctggaaattcttaaaggattcattaaattttcaagcacagaaatttgttcatttaattgatttttatatatgctttttaccccttttgttagttctgatcatccttaacctacacaccaaatatgctacaattaaaaagagaaagctcataatattttaatccccaaacataaaaactgaatttattaagtacctactaaagtctagaaactttgttacacataccacataattttataactaaatatgtaacatcacaaaatcgagattcaaaatctaacattggtggaaaatgcaaagcatgagtttaataagatattaaccaaaatgcacacctctgtctctgctataactacctcacctctggtttgcactagacttgggttgccacttgatccatagagaaccgttattaaaaacaaaccagagagtaattatgtcaaaactcacaaagccctgatttaaatcatgagaaatctgaataaagcctcccttgtcacacctgtctaattagcacggactctaaattgaggaggggagccctaaaaaggaattttgttgtagctgtaaaaatgtatactctttaccagcagttacaaaaacaaataatcttcatttgaagcaagctctccaatttttcaccaggatagtgaatgagcaaagctacatatatcctgcagagttgctagacacacaaagcaaaggatataggtattacactaattaacaacaatgggacaaatcattaaacatcaagtagaacattcagccaagatgatgaacaaattatctgtaagctaagattaatttgttactgaagaaaaaaattaataaatttagtgtgatgaagtgtacagtgtttataaagtctatagcaatgtacagccatatcctaggctattaaatgttataagtattagtagtagcagtattggtagtattatcctcttttcaaattttaaccacagagcttacatatgtataatgataacatgataaataggaatcagtttttacattggttttgatggttcacactgtctcaactcatggtatcttgttagcaaaagtgcctctattgtccagttaggcctgattttagtctggcatacaattaaatctaatatgtggatgcacataaacagtttgattagatttttggggaagtaggtttctgcagacatgagccactgcttgaatatgcaatatactaatccaatcaatcaccttgatacatttagttgttttatttttataattctctataacaggtttatcagtcaaatttattggttatacttattggtgtaaatgaagaaatactttttttgttccctctcatcactacctttaaatatgctcgttggaatctctttttcccatcacttgagaataactccagccaatctccagctatctagcaatttccaaacacactttcaataaaattgaaagacaataaatctatttttggtaaatttgacttactttcaggttttaaaaaggtctagttgcatgtaaattaaaactacaattttgcaaccaaattaaaacattttccctacctgttcctcacctagctcagaattgatatgtaacaggaagacctgtggttgtttatccagatgtccttcttttgtctatggctccattaggattgtaatggggaaaacaagaatcatagcaggaagaattaaaagaaaagagaaaagctttttttttttttttttttttttaaataatctcatctttatttctattgagaggcaggcacccaaatgcttcttctgtcggggagtgaatttgtaagttctttgtaactctgtgctacctatttgttaacctgagtaatttgttctcctgctcacttcttgctaacacttgccagcggatacctgaagcctcttacatcttctgtggcatgcacttggcctatatatagcatattcattcacctaaagtgggaagaataatctggcatcttttctctttccccatcttgccatcaaaagctgcctcaacgagcatgtagccttcagaattttgaaagccagaagcaggtaacaacttgccatgtttagcttcatcttgaaactcttgaggacacctatcaaactttcccaaaactgtctcatcatgtatggttccattgcaggatgggtgcaatgctgagtgccagcaggggaggaatatcccattctttccttcttgaaattgcccccagtctttttgagctctcttcctatttggaaggagaactaaagcaagtttagttctcctcacaaaagagaaaataattgaaagcactctcacttaggcagctaattcactgtctatatgataattcttagaatgcctagtcctctctttacataagagcacaggtaattgaggtcaatgaaggttgtagagtcacagaacttgtctggctactttttattaaatcctgcaaagacttaactattcttctgtaatttagggataccggtcatttaatagggaataaacaaaaatctgagacataaggaaattctgtatccattctatatatgtataaattatatatagaaaaatagtttagaagagttaatatcaatttgaaaataggaattttaaagctgtgaataatacatagcataaatatgtataaggattcagcaaaatgttagttgacatgtggctaaataaacttaaagtttaagaaagataagaaaagaaaccaaatatgcataaatctggggacaaaatttgatattgctgctaataaaaaggggaggggcatcatattgggaagcttcattaataaaagtaacaaattatgagaacaaatagtcttattatagtttatctggtgaagcattttaatgaggcgtagttgtctgttccattacggaaagagttttcttatgtgtgctctggtagattttcatgtggccacactgaaagatactcccaaatgtctgactaataattctatttataggcaactgttctgaaggtttaaagtaaggaggatgaagttcatttggaagcagtggggaaaaaaatggtaatgctgggctttgaattttatggatgctgtagctgttctttatttttcaataaataaatgttttaaatgccatgttttttagctattgcagttaaactgccctcatctttttgcccagcaaaaaacccattaagttattcactgagattgactctagattttttataaaattaataactttgctaccagtttctcaaaaatgagtagaaacgacttttcaatgcaaatgccagtttttgctacagtgaaattattctgtctgtagtgactatttgaacatttatgggcaataggacattgagagatttagtatatgaactacgaatagatttatccttagattatctaatacatgttttccaccttgcaacataaaacctgatctctttttaaagtcctggttgttctgaaaaatgaaatgaaattatagtaaatggaattttgactggggggaaaaaaacttcacatgatttaagagaatggatgctggcaattgactatctactgtttattcaaagcttatagattagcaaccagatgtggcagaaagttggctgtttttcattcacaacaaaaacgatgctgtgcttaatgaacggaggtttgttatcccagtaataagtaaaaggaacatgaaagcccttgtgtttaatgcttatgcaaataagctatttgcaggtggcttttgggcagaaggtaaaatagtttcaaaactgggtcaagttttttaatcctcaaaaattgccagctagaggaaaacctcctaaaatctttattatgctatttgccaagtaaatgaaatgacatcatttatcatttaataaattacatatgaaaattcttttccttatgatttcatcaatcaacaaataaattctagaggattctagatacatttatttggcatattttttaatgcggtatcaaattttgtggatattcttttagagaatcaatttcttaaaatggcattgaacatttaatttaaaatgcccttcttgaaccatacatgtttattagaaaattattttatataggttgtccattaaaaaacaattttctatgtatgtaaacatttatgataactgctcaatattttggtccatatttatttatctacctatttattacacaatacaaatattacactttgtaaaattaaaggcctagtctaatattactctatgtcggaagtaaaataattcagagaagtctatattaaaagacaagataaaacacaaaatgatgagaatcacaaaaccattgccaaattttcagctatgacatttattctccatgtggccttaggtatcttactctcttattttaacctttgatgactataaaaataatttgttactaagaagccctctcgctttagtagctgtgactataaaattaagaacataattcacaaaaagtgtttgagtcttcctgaaaacattttaaaatatcaattaatcattgcacaatacacaatcgcctgatcatttgctaaaagagggttgcattctcatctctgttcactctgtcctttctgagactcatataggtgtgagagctagaaaaaatattaatgtgtagcaattcagattttctcattgatgaatcacttcagcagtgcacagaatactttgtaattttaaaaaggtgtttttattaatatacttctactattctaccccaatcaacagcaaatttacctaaatcatgagactgctggaactgctaagttttataaataaaagacttaagaactactattaaaccctgtgaatcctttatctacaatgagaatgtccatgagtcagctcttctgaccctctggccagtgttctggagttactgatctgcaactttctaattgaactctagcttggtatgtgagagcagctgtgggttaaccagcggggcgacatttaagtcttgacattgccattaatgattcaccacctgttgcaagttcaataagttattcacacaccaaattgtggccacagaattcattgagataaactaagttagaaggattgggtgtcaataaatgtttgctaaatcagaattgttaatgatagaaatccgtagcttaacaaagttgagaaatcttgtcttcttaacgtgtatttattgacttcccaggatatgtcttagtgaggaaacatagcttctggcatttattattagagggataaggaataataaaccacagtgattgagagacagggaaaggccgggggacctagagacacagtaacagaagaagtttaattggctaatgaaataaacttgagataagagagcagagaggaggttcaagagatgaaaccacatattcctctctatctgctcccaccatcaagggaattaataacatattttataatgaatccctgataaatattagtgtataattgaaaatctattaaaatgactatttctcagggtgcagaaaaatattaaaacaagtaaagttgccataagatggaatattatattttcctgcatgtctgcttcaaggctgaatcctaatggtcatgtatgtaggtaaattattcttcctacagcaacttctgggaggtggtatgtggtggggtataaaaggccaggggtgtagtgagggtaaagtgtaagtactttgatcttgagccttgactatattggacttgggatctcagaaatcttggggataaaccgtggattaaatccataaattcataaagtgttggttatacaacgggtagaaactacgtgccacttttggagggacagtctcctttttttttaaaaaaaaaaaaggccttaaaggctatatatatatatatatatatatatatatatatatatatatatatacagtcttttttattataataaatactattttgttttttttaaatgaaacaatctgcacatatacaactccactctgaaggcaattatttacataattatgcataaattcctatagttatgttagtagttgcctttcttcagagtggagtcatatatgtgcagattgtttcattttaagaaaagaaatatttatttatttgattaactgaaattatgcttaaaaatgattaaaatgcacagatctgtcttcatgaagtttaaatgtcttataagaaattaaagtaataaagactacaacatttattatttaactgtaactgtagtgggtagtaaaagagaaagcccagtgtgttggctttcagtagtaaaaaacccaacttgtggttaggaaacgccattgtttattgtatctaaattaatcaagttgtatcctgtaacaggtttcctgttatccactcgtcttccaacttctgaagtatgctttaaatgacaagggagaaacccagacactacattttctaggatctcagcacaacagagctccaggtgaaattatgctaaatagtggcatgagcgtgagatgtgggtggcataaagaagaggtttagagtgtttttctggtgacctcctgtttaagtttgacaagcatctgaaatcactgctagcaactttcccataattattgtgtttccagcctttatgaaaatagcagcaattttttttcctttctttgcctatgtacaccatctaatcatgagataagtctccttcttagtccctatattaaatatctttttacatgaaatacatagattgggatctttttctgacctgttcctgtctgacatattcttcaactctaagatgagttcatactcatcttcggaagcccctgggaaatgggaagttttttttcatattagatgttggtagatatagaggcccatcctttaataaacatctatgtgccagaaaatgtactaggcacttagatacattattcatgtaactctacacaaatgtatcaacaacacaaaaaaaaatctgtataaaataataattattatatcccttatatggaaacagatccagagaggaagatacactagcacctgtaaatagaggatccaagaattaaacatccatctgtcggactgactacaagctctttctttttcataaaatgctaatttctctcctgcttctaatatttgtatcaaaatttgtcatctattgttattgggtttataggtgggtagtgactccttggcttctattttgttctagtggattactgtcttctttattttcattctagtgtttattgagagtcctaattaatcaacctggctgctctgacttccatcagctcaccattgtctcttttcccagctcataatttctgtaacagagctctaagctatgctaaacttctgctatatgctgtcagcctctctaaatccaagtgctcttatctgccaagtttacatacacatgtttaaaatcttcttattgaatctacatacaaagtcttcatgtcttcctccttgaaataatagcattgtgagagaaaaaaaatcttcattctttttaaaactaattcagaatgtctaggtaacacaagaacactctgcaacaaacaagaggtaagggaatatttacctggtatttctgtgcctcattatcattctcactcattataaaattggtatctgaaaaaaatcttgctgtaaaaacaaaaagtaatgtatagagagtataaacaaagagtttgcttcacatcataaccattatgcatcccattgccaaagggaagatagtacactacatgattccggggaggagcatcattcacatagactatagtgtgcatggcacatgcaagagaccccacagtactacccgctttgttctctttgtagacacactcacggatgattcatactccctgacctggagtagccaaataaagagttgcatcagtttattatcattctttccagaccactttctaggtattcccattatacattccttcaaatagaaagattttattctgtaaattgcatcgcactgtacacatttttttctgaaatctgaataatttcatacagtttcaactgtgagagtacctgacagactgacctaactctaagctaaaacactcataaactagcacagaagcttgtcatatcattacacatttatccattgctctaaattacttatagtttttcctgaaacatctattaatattgcagttatttgagatgactgtgagcttactatttgccagtgatgacatgagcaccttggtttagtctagtgcctggcatttaataggaccattctatttattttcctaaactctggcagcaagattagctctaagcatatttttttatcacaacaatcgtccatctttaactacatgtgaggaaagcactttcttatattgcattacacatttttatatggccacagaaatccttacttaatctgacaaaattaagataaatttctttctcctaagttcaaggaaagaatcattctctactgtttccaaggagatgattctccttttctcaattgccaattgtctactgcttgtcctgggttccatcttttcatatgtcatgaggattctcaccccagtgttctgctcctctgagtcaaagcccttgacttttcacttctcaattgttttgtttgtaatttttttgcttttatttttttctccataaatgctatgaaagtgtatgtaaaaatttacccatcttttattttatatttgttatcacattttattcacataccaaactatacaggaaatgaatataagcacatctttcttagtaggaggtagaagtaaaattttgtttagaataaaaacagaaaaaaagagaatccaattccatatcaccagtttgctcctgaatgtgcaataagtttccacttatgagcttgctactgtacacaacgcaagagcttttaaaaaattgtctacatgatagtggttaagagcgtactttaggctaggttactttaaaaaaatatgtcatcattacttctgccatcaaaagctaattcaatgtatcataattgttaaagttgagtagggttaaggattcttctcattctatggtttccttataaacacagtttctaataaatgtctatttttttctgtgaaattaaaccactagatattgctgaatgtctgtatatttcttacatttctagaatctcattcttaatttttttcttatatttttccttcaccaaagtcttaaaacctatgcacctggtgtctattatttaaattctgtgatgtattttatttgactttatttgtgtttttagtcttttcacagaaattagtttattgtgatcttcttttccaaaaggacttaattcatatctcttttccatacctatcttcattagcaggttgcatttcagtttcttcagtgcttttttagataatatattttactacatctttcttcacaacactgtatatgctctgatgatcaggtctctcattttttttaagttcttgtcccctttgggacccatgacaaagtaaagggcagattttttctcacctggcttaaaagtaaaaagccttcatatgtttctcctctgattcttcttaggcccagcatttccaaaaacaaactagtacacaaaacattagagttgcaatgatacttcaaaaggttcaaatactaatttttgtctgctttctctctatagttttcttgtagagaaattttctgttatgaaggttgaactatttgctatatgttaatattttccaaataaagtttccaaactgatatttaaatacattctctcatattcaaacatattctgaactactttctgttgtgtctctagatcaatatttataaaactagacagttcatataatttttttcctttgctaactttcaagatcatatcaaaaagtactactgttgattcggttttttgtgtttcattatttgaaactgtattgacctttttcctcttatttctttatcatttcctgttatttcatctttgtgagtcttcccattaatgtctttttctttttgaattatttattttttaattgacaaataaactgtatatatttaagatgtaccacatgatgtcttaaagtatacatacattgtggaatggctaaatcaagctctttaatgtatgcatatttaatatatgcattaccttgtaattgggccccttgagattttagtatctcagcatttttagtgcctgagatttaaaaaagtcggattaggctcttgcttgcttgcacaaaagccaacatcccttgttctcacaatacaattgcaaactgctgatgtactgtttctttgtcaagcaggagaagataacttcaaggtaacaaaaaacattcgcagaaggaaagaatgcctataagattgttgcaactaactgttgagacccagaagtctggttgctcaggatgttatcagagattaaagaaacacaaacttccccattggttccctaaaactccccctctcttactctctggctgcaaacaaacctctctgctttctcttattgttaagacatatctgacagatcttgccccgttctcgctttggccaagtggaataaacttttatctatctctaagcgttggtgtgtcagtgtttggtttcgactgagcatctggtacatgagcctgaatttgggtctctacaacatcttcacctagttactatttttgtgtgtgtgtggtgagaatacttgaaatctactccattggcaattttcaaatataaatgtattgttattcactgtagtcaccatgatgtgcaatcaattttttgaacttattcctcctggctaactggaattttgtgtcttttgaccaacatctccgcaatttcccccatgccctagcttctgatgatgaccaattaactctctgtttctatgagttttacttatttaaactctacatataagtgagattatgtcatgtttgtttttaagtgcctggcttatttcacttgacataaagtctcccaggttcatacgtgttgttgcacatgacaggatttctttcctttttaaggcccattaaccttttgtagatctgttactgaggtaatcaaagcttactggacaattatgttatttgagtaaattgaaacataacagcttataaagggtcaaatggtagtaatagcctaagaaataggtttggaatattatttcttagcataaaagacaaagataatattggtcagagtcttctaggcttgaattcttggctacttagattttatcaagtaaattgtaaaaggataaccaatcaatatttcacatgtatttctgtatgaattttgatttgacaagaaagactgtgaaaacaaaaccactattatctgtgaactacctaatgtggaaataaatatccttaaataaaaccttgagaaagtatattactcaattttttttctacagatatcccatatgttataatatttaactgaaaacaaaatctttcttcttaagaaaagattttattcagttttagaacgttaaagtttctccactctaatatatacagaacttctctaacctttaaaaatactgctttgcttattactcatgataattgggccacatacataattaaaacacaccatttattattttgccatgtgaaagtggcatctggttccccaacttgacttcaaactgtaattttaaacaaataataaagtgttttgaaacattaatgtcattaattgtcttatctattgtctatgttcatcaggagctgtgacatgcccaaaggaaggtaatcagaggaaggaagagaagaagctaagttctagagaatccattaatcattccttagatgactgaccattttattattttcccaagtaagctgaggctgacaatatcatgaatcatttacatatatcagtattcaaatgttccatttttaaattgggagggggtatgttttagaatagaataatgaaattccctccatctcctcctaatgtacatcattaagaagaatctaatggaaacataaggttctaaggctcttgttggaaaccataatcagaactggaggaattctcttatggaaaacattaaaaaaaggaaattctagcaatagaattcattgttaaagctgtaagttacaacaatattgtctctgcatgctgactgtaatcctctataatcttcaaaggcaaacaggaacagtaataatcttttcatgtactcttaacttccttctctgaaaggctagaaaatgtcttacatgtagcactcatagtgtcatttaatcaaacccagtttctatttttcttcaacttctagatgaatggatgcttagtctttcgggcacaatgtgaatttcttaagggtctgtagactacatctcctatttttacttctcaaagtttctctcaaattgtgataaaaagtttcactctattggtactgttaactgccaaccactttgaaggcctcctcctccacttttttctttttccccatatctaggcaagcagtaagaaaactcagagtctctattccttggctacggcagggaagttcaaaccatttaaatcctgaactattggggctgagggtaagggactcacttgggcccaacccttaaccccattaaataccagaactccactgactcttccttaggtttcacttcccactgaacctgagccctttttgttgtggattattttgccctttagtaggtaataataccatgtaagtaataaatttgtttcatttcctttcagtcttgatatccataaattactaggggcaggggtggtgtagagttgcctagtattcaccaaataaagtaaaaacaacacacacactgagagaaaaatctagagaaacattcccacattgccacacacagttttcttgcttgcttctggtaaatataaccttctctatccatgagttcaattaacaactttggataggaaatattcataaggaaaaatggatggctgcatgaaaggagagtgttctacctgactttattcactaatcaggatatgcctaaaaactgggtggcaaaaactgaactgtaggttttgagaaagattctaataacaagaaaaatgtacaaacatttttattgttgtttatccctaagcaagacagcataacaactatttatacaacatttacattgcattaagtattacaagtaatctaaaatggatttaaaatatatgagagaatataagtaggttatatgcaaatactaggccattttattaaaggacttgagcatctggagattttggtatctgttgggggatgggaggtagggcggcaggtcctggaatccatcccccatggatactgagagacaaacatacatagaagctacaaaagcaaattacttatttcgcctcttgctgttgacttaaggaaaactatgcactgtatcatcagtatagagagttcttgaaaagcctagatcctcccaaagtttgaataggtgttgcaaatagcgagatgtggtgatagctcaaatagagaacctctcgggaaaaccatttccacatttagaagcaagtttgaagtggcagatgactattccttttttataaatatatatatatatatatatatatatattatactttaagttctagggtacatgtgcacaacatgcaggtttgttacatatgcatacatgtgccatgttggtgtgctgcacccattaactcgtcatttacattactttttctactgaaaatattttcttggcttcctgtcaagtaatgtgagttgcaaaaggcattgaagattggaccaactaatgaaatggaatcaggacatggtttcataaaataagagtgtttttttgtaattatttatagtttcttcctttttttatttttttaacttatttatattccaaatacggtttgtcatttagctcaactttttattttgccccacatatcttcttacggcttcttggtttaataggataataaaatttctaaagcaggctggtctatggcttccttaaattaaccctgcctcttctcttacaaaagttactaaaggcaaatataaataatcatgaccaacatataaagatatgaatgagatttacagagaataactttactcagttatatagcgttacccacaaagggaatttactagcttcaattgaaaaaaaaatcccatgacacctatgatatttacttctgtcatctccacattcaaaagaaaacaaacagattacccacatatttaatcactttttattttacaaatgctctgtaaacaaaatgcttctcagacctattcaatacaattaaaatataacatagctttgccaaaaggtgtattccaaagttatcagttagatttattaactgataaagattagcaatttaatgtgaatgttttctttagtgaatatacagaattctctcaaagttaaattattaaaaacatacctaaattcacctaactcaaaaatgtagtattcttatactcaatatctgcacattctcacatatacaaaaatataatctaaatgttatttttaacaatataaaatttgtttctctctttgttattgccaagattgcactgactgttgaaatataaaagaaaaacagcattaaatcaggtgtgataaaatcacctttttctgtttatcttcactactggcatttattggcacttggaaactatttataaactcatattcttattgctaacatcaattattatgcaaatacttgaaatttttactgacttcataaataatgcatgaaagtctatagacttcaactagtgagcattatcttttgtggtttataaatacagaatacagaataaggtatagtttggatgagtctgaacaacagatgtttctgctttatgaattctggtcaaatcatttggaaagagttttgtttatacaataagcatctgcgttttggaaagttaaactaaaaattattttgtcattttctctaatagcttgggacctacataaatctgttaagttgaccttaaatagaactgaaggtgatagtagaggtatttaaaacaagtttggatagtttttacacatgtaaatctataacatacatttaccaaaatctaatatttaagaattaatggaaattatacagttattccaactctaaagttttatgacacaaatatattacttagatagtatcttcacattaattttgtttaaaaatctccattatgctttagaggggatttcagtgagaatatatataccccatcatattttatcaagctgaaaactgattatgcaactttttgtaagtacagagcaagtttaatccatttaactcatgccagacttcaggcatttaagaataactatcaagtattcctttaagaatttttctttacaggctagtcatccttacttccttcaagtaattgttaatttgcttgatgccaggagctctaaattatgtagaattcattttactaatttccattataatatatatttcgtatatatcatttgcttcctcaaaacccacagttcagtttttgccacccagttctgaggcatattctgattagtgaagaaaagcaggtagaaaactcttttactaaaaataaccaaaacatagttgggaggaggtgcttagggcatacatttttgaccttgtttacctcttagccaatactaagtgctttcacatataatcctataaaatgcttctcctccatgctacacttgaataatcaaaattttgaggttatatatatataatttcacaattgcctttttctttctctattcaacaaattctaccccttagacactggctttctctgtttcttctgtggtagttgatagaattttacctatatttatgctaataaatcaattatccagctatattttgcacaggggtcctgctaatcttcttgaattcttccaattttagtatacgtgctgccaaagcaagtgccagctatttttgaagaactgatatgtactcctaagaacacaagataaagagaatcctaggactaaagttggtaagccagttttttttttccatttcctattctttctttttacttctcgtcttccattctagagctgattcacaggaatccttcaaacacttcttggataggtctttctggagtcccttcaaaagttcctgtttatagatgcacataagatatgagagggtctgaattcttcatgagtccatctcttttgttggaactcaagaaaagagactagactggagagtagaactagattttttgagtcatgtgtaaataatgactacaccgcatgtacacatttagatgctgtccccagttcaagagttctgtccactgtcaaaattcatgtccacctggaacctcagaatgtgagcttgtttgtaaatcagtttttgcagatgtaactagttaagatgaggtcgtactggagtagagtaggccctaaatccaatcactagtgtctctataaggaacacttttacactgttggtgcgactgtaaactagttcaagggttgtggaggtcagtgtggcgattcttcagggatctagaactagaaataccatttgacccagccatcccattactgggtatatacccaaaggattacaaaacatgctgctataaagacacatgcacatgtatgtttatcacggcactattcacaatagcaaagacttggaaccaacccaaatgtccaacaatgatagactggatgaagaaaatgtggcacatatacaccatggaatactatgcagccataaaaatgatgaattcatatcctttgtagggacatggatgaagctggaaaccatcatcctcagcaaactatcgcaaggacaaaaaaccaaacaccgcatgttctcactcataggtgggaattgaacaatgagaacacatggacacaggaaggggaacatcacacaccagggcctgttgtggggttaggggagggggtagggatagcattaggagatatacctaatgttaaatgacgagttaatgggtgcagcacaccaacatggcacatgtatacatatgtaacaaacctgtacgttgtgcacatgtaccctaaaacttaaagtataattttaaaaaaaagaaaaaaaaaagaaagtgaaattcagacacggagacagagaagcacacaaagaagaaggtcatgcaaagaaggaggcagagataggaagaaagcagctacaaaccaaccagaaccaaggatttctgagagccctcagaatactggaagaggcaagggaagttccttccctagagccctcagaggaagtacagccctcagaggaagcaccttctaacctccagaactatgaaagaatacatttctgttatttttaagccaccatgtttgaggtaatttgttacggcagctctagaaaacaaatatacacaggactcttctttccaataggtctgaaatataaatgtatatttatatacatctccttgaatatataaatataatagagattaaatataacagatttatagatttataaacatataacagatttatatatttataaatataaaacagatttatataattttgtaaacacaaaatagatttatatagttttataaatgtaaatatatgcatatatatttaatttttaattactaaaattttttctataggctctcaataaggcaaatacacaatgaccaaacagaataataattgcttttcatttatagattataaatgcttttaattgatagattataaagaatttcatttatagattataaagaattactgtgggcaattaaatcaaagccttttcaaaaatggtgcaaaactaaatctatagtattcaactgatgtttaataaatattaaacattattaatatttattgttaattttaattaatttttaattaataattaaaattattaatatttaataaatattaataagcatcttattcaactgatgtttaataaatatttctgtggattattcctctgaaataatattttaagaatacacatgcatagacataaatgtacatacatggttcaatgtggtgttttattccttgcctataattacacgggtaaaaagaatgcatatttatgctgaaatgaaaccattttgctttctaaaaagaaacccagacacacatttctaagtgcaatgacagcaaatactgatacattcacatacattcttttgtcttttgaccttttcaagcaaaatcgtgcaagtatatctaggttacatctgattagctttcacatgttttagcaggttttgagaaattttgttttataactttgataaggtttggctgtgtccccacccatatatcatcttgaattgtaattcccataatccccatgtgttgtgggagggatccagtgcgaggtaatttaatcatgggggcgattactctcatgctgttcttgtgatagtgaatttgttctcacaagatatcatggttttataaggggtttttccctttttgctcagcacttctccttcctgctgccatgtgaagaagaatgtgtttacttccccttccaatatgattgtatgtttcctgaggcctctccagccctgtggaactgtgacttaattatacctcttttctttataaattaccaagtctcgggtatttcttcatagcagcatgagaatgactaatacagaaaactggtagtgcagagagtggggcgctgctgtaaagatacccaaaaatgtgcaaacaacattggaactgggtaacaggcagaggctggaaaagtttggagggcttagaagaagacaggaagatttgggaaagtttagaacttcctagagatgtgttgaacggttttgaccaaaatgcttaaagtaatatggacaactaagtcaatgttgaggtcttgatggagataaggaatttgttaggagttggagtataggtcactcttgctatgcagggagactggcagcattttgccccgcagaactttgaacttgagagagatgatttagggtatctggcagaaaaaattctaagtgctaaagcaatcaagaggaagcagagaataaaaggtttgaaaatttgcaacctgatgatgtgagagaaaagaaaatctcattttctggggagaaattcaagccaatagggaaaatgtctcgaggacatgtcagagaacttcacaatagcccctcccatcacaggcctgaagccctaagagggaaaaatggttttgtgcccctcttccgacaacccatgcagcctcaggacatggtgctctgcatcccagctgcttcagctccagccatggctaaaacgggtcagtgtacagctcaggctgttcttcaatgggtacaagccccaagccttggcagcttacacatggtattgggcctgcaggtacacagaagtcaagaatagagctttgtgaacctctgtctagatttcagaggatgtatggaaatgcctggatacccaggcacaagtttgctgtgggagcagagccttcatggagagcctctcctggggaaatgtggaaaggaaatgtggggttggagccccacacagcactgtctagtggaatagtgagaagagggccaccatcatccagaccccacaatggtagatccatccacagcttgcactgtgcacctggaaaggccacagacactgaatgtcagcctgtgaaagcagctgaagggggggcataccctgcaaagccacaggagcagagctgcccaaggctgtgggagctcacctcttggaaaggcataacttggatgtgagacatggagtcaaaggatatcattttggaactttaaagtttaatgactgtcctattggattctgggcttgaatggggcctgaagcccctttgtgttggccaattacctctatgtggaatggatgtatttaaccaatgactgtatccccattgtatctatgatgtaactaactcacttttgatttcacacgtttgtaggcagaagaaacttgccttgtctcagatgagactttggacttgaactttcgagtacatgctggaatgagttaaaactttggggaactgttggaagagcatgattgtgttttgaaatgtgagtacgtgagatttgggagggactaggggtagaatgatatggtttggctgtgtccccacccaaatctcatcttgaattgcagttcccataatcttcacatgtcatgggagggacacagtgggaggttatttaatcgtggggttggttaccctcgtgttgttcttatgacagtgagttctcaccagatataatggtttataaggggtgtttctcccttagctcagcacttctgcttcctgctgccatgtgaaggacatgtttacttccccttctgacatgattgtaagcttcctgaggcctccccagccctatggaactgtgagtttattgaacctcttatctttataaactacccagtcacaggtgtttcttcatagtggtgtgagaatgaactaatacaatctttttcagcttttgtttcttagggatgcaattcaagttaaggtaagagagtagtgtagtataaatcagccttgctaagacttctataaatcatgaattcagcagctaattcaaagcacaattttgtatatggtacaaaagtatctattgtagatgactaatttcaactctaactatcaaagtgacaaaaaaacgagctatcaacatcagccctcctcaaaaatgtatgcactattttactaatagtaacaactaaacaatgagcaatattaggaagattaaaacccataatgtaatgtactgtttgacagccaaagactttaacaatgtcctattctttctagtacctctggacgctttattcttctgctaacgtcagccctcctaatctttcacattacattcctatattgcaccatttcagaattttctgcctcacagttggaatgttaccagatactcctcagtgtatggaccacctgctattgctctcagctcatgtttggagaaaactggtttatgtaaaattttattttttttcttctggtaaatgaaagctaatttgcaatatgtttccatgggaaaattctaggcataaaaattatataaccacatctaaaattgctaaacaatattttttaaaatacttaaaatttaatgataaatcatagtcataagcccataaaataaagtaatatcaaaatgaaaattaggaacacaaaactatgtgctacagggaaaaatataatccaaaagttctcaaacagtctacaatatctataaaatctgtgtattgagtttctactctgcattcagcactgttttatgcccaaacataatacaatattcctgtttcaagtggagaagtttgggctgtatatgggatgttgtttccatacatcagtggccactgaataacaataaaactcacattctattctcatgaaggcatgcttgtaatggctactgccaaatgagactctattttacaatagggtgtgtatttcttatgtatgttttatgtatctcccttatttaaaggatttctttccatatgcttttcttttattaaagttgaagattctgttctactttacttttagacaactaacttttgttgtttattccatagagtctctatttgtttctcaccaatcaatgttgggcatgaagccaggcccaacagaagcccttagtccatggagaattacttttattcacactaccgtaagaattagtatcttaaaaattttccaatatgtgaatgtagtgcttagaaaactttaatcattctacattgcctttggcattacaattaaatatctggcttaatatataaagcctttcacaatttaacttaatggcagttatcttctctccatacaattcactcaacctcaaaacttaaaactacataaccattcgtggttctttgctttttttttctgtttgccaggctgtatctaagttatatcagattactcaagtgtcatctcttttatacaccctttgtgatgcttgcagggtgaatctttcctatggctaatagtttatataaacatctatcatagcttatgtttttagttatatatttacttgcagaacttgttctttgattacaggcattcaccatacatgcctccctctgacttccttcaaaacatacttcagtgactgaactcaacagtcattgtagcttagtagtaaaaacaacgtattcaggggccaagattcttgcctttggatcccagggtcacgtactagctgtctgaccttgagcaagttacttacttaaactttcagtatcataagtttcattactagtgtgctcatactagtgtacagcaggttcttaaataatgttgtttcattcaacatccttccattgtaacattgatgagaaaaaacaaattcctggtgggatccactgcatgtatacagtttgcaccttctccccatgtctgcgtgggttttctctgggtactctggcttcctttcctatctcaaaaatatgtcgtgttcattggtgtatctacatggtgctaaaatgacagagagagagaaacagagaaagagagagagagagtgtgtctgtgtgagtgtgcccttgatagaacagtgtcatgtacaaagtttgttcccaccttgtaccctgagttgcccagaaaggctttggacacctgcgacaggaacaagaaggcgaataattatcttacttgtttttattaatctttcttaaaagtacatatagctcatgtttatttcaatatttaatattataaatatttttatctttatttagaagcttgatgttttcatgaaaagaattatgtcataggaacttgactcttgtttatatcaattaccctatgatcaagtttgttcctatataagttgttttgcatgaagtcgtagttgtcaagaacctatggaggatgttaagtgaggatttgcagtataaaattcttaggttatttggagaaaaatgacttaatataattagtcccataatgtaaagattttagagattgacgtgaagtcagtgttttatgaggatattagaaaaagacaggtgagagacaggatagaaataagaaaaataaatattgaaaacatcgtttccaagaaagaataatttctatatgtaatcataaaattgcagtaatggatggatttactaaaaaatctattccagtgctcagatgaaggaactgaaggcctgtgaagtcacacaagtttaaagcagatataggaataaactcctatttcactggtctcttccagagaggtttttgttttatccttgactaaagtctgcaacgtgttttccttatgtcaaatcttgctcttaatgtttttaggcattctgtgaccttttgttgactacttgacttagctctttctatttgccattactttaaatgtatattataagcctgcattgaagtttttcaaaataaaaacatacccaagctgttcttttccacagatgatttggggaataaaaaaggagaaataatacagtctaatttcactattgaaacagagatcagttgaactaaaacagaagaataaatggggtataaagcagtccactaagatattcataatttcatactgaactctttaggaattgtgatttcttaactagattcatttatttatttgataaagttttactgaataccggctatgtgcctgactcatctattgattagcaagattaacatggttcctacactcacaatgctcacattttgctgtagaattcataataataaaaatcatcataatcataaaacttgaaatagggacaactgatagccatggaagtacttttctgaaaggagtaatattaccatatttcaggttttaaaacgtcatttcagaaaaaatatttggagacagttggaaggaaggtagagtatatgcaaggagaaggagacaaacaagatgctaatgcaacagggcaccaaacaccaagaaataagcaagtaaaacatggagcgggaatcccagttttttgcagaagattaaaagagaagccttgagagacatgtatttggtataatacacaaaatatcatcatgcatttaatatagggagtgagggaatgaaaggcatcagaaataactttcatctctctggcttgagaaacattgagtagacaatggtggcatttaatgagataaggaaaatggagaataatatattttatcgaggtagcgagttgaaggatgatatgaattttgaaccactgagtttgaagtgcacttgaggaactccaacgtgggagagtgttaaatagccaatgctaattagaaacattcattgaaaaatgtatttttaggagaaatcatgacattaaaactagaaagaacatatttttgaataataccatttatattaatgtctgataaacagatacaaagtgcctaaaggattcttttttataaattattgatcattcatttaaatgatactagattagagaatatttacatcacctgctataagagtgacagcatattagccaatggtattcatgctcgactatgcaattcagaagcaacatcaaagaatattcttcattgtgttcataaactttctcttaagtgaataataaagaaaatgtaatgcctagcaacattttctagcaattattcttctgcaatgcatgaatacatatttgtgctattgtagcattaggttcaacctaattaactcagaaaatcatttatgcacaatagcctatctttcatgtacagcagatcatgtacattttctttactttttgcaagttgtatgtaacattagcacacaaaaaaatagtggttgtggttctcggttcttagcactgctgtttatcacatccatgtccatgctagtttttccatgtgtgatttaactaccaagttaaccatttgagattagaccatctcttggatttatgactctgtgcctataatattcgagctgcctataggtctttataagcatatatagcaacacatgttgtcaacaacaacaactgcttagatattaaatagctgaaacctctggaattaggcaaactgtgtgcaaatattaaatattgcttcagaccttgagaaactttttttcaactacctgtgcacatatttcctcacctgtaaaatgaaaccaatgataaaacagaacctccttctttggactatagtaagaatttaatatttaatttttaacaaattcttatggtaaggacttaatatttaattcttgacaaattcttatggtaatgtttaattcttaccaaattcttatgataaggatttaatatttaattcttaccaagttattagggtaagaacttaatatttaaaatattcatttttcagcatatatgaagttcttagaatacctactagcatatgataaaatcttagagaaatttaacaattttattataaattagattgcttaatatataatcatgttacatgagttgagatagtcaatgcaaataaaaaataatcttcactggttatccttttatgttactcagctttcaatttctcataccatctcaaagaaaatgtagctagtagttatttttcagaatctgagaagtgttctgcaaatgtgcgtaataatttttgtcaatgttgaaaatctttaggactttctgtaaagtcgatatttaatgagttgaactattgtctttagcatttatgtcctaatttttggaaggaaacacacacacacatatatatatatataaaatgaaatcctatcttacttgacctaaaactgcacaaaaatttatatttgctgcgtttattttgcattggtaatatcaattttcttccatctgaatacaagtcatttggaaaattccttacatccaagttcttcagctcctatttgttaatcctttctttctttcttttcttttcttttctttttctttttcttttcttttttttttttttttttttgagatggagtctctctctgttacccaggctggagtgcagtggcatgatcttggctcactgcaaactctgcctcccaggttcaaggaattctcctgcctcagccttccccagtctggaaatacaggcacgtgtcaccacacctgcttaatttttttttttttttttttttttttttttttaagtagagacagggttttgctatgtggcccggctggtctcaagttcctgactttgtgatctgcccacctcggcctcccaaagtgctgggattacaggtgtgagccacctcgcctggactatttgttaatcttgatcttgttatatatcaactgctgggttgctccatgattttcacattctcttcctttagtttgtattgtgttggtttttgtttctttcataaaacactaaaaatgtttacatcattttaaaacatttcaaacataaaacaatatcctaagtagcttaacagtagagtccacacatgttgggtattaacgtaaaaacttttaagctcgttataagatcaatcagtctgttcatatcagtactcaatgagaacattaacatgttcaactctgttcagtcattagagaagcatatataaaacatattccaaaaatctaataagctgagtgaatgccaataggccagtaaatattgatataggatgttgctttgatggtaccaatttcattttatatattgtaaggacttccacctactattagagtaaatttcaagctatataatctcacattaagtgtcatttgcaatctgaacccaacaattcaaaataattatgttttaccaactctaataataataagacaaaaaataatggctattacttatcagtaagcaatctgagacctagtaaggatagatgacttatccagggtcatagtgttagctggtgagagagccaggagttgaaatgaggtggtttggcctcagaaactttgcactaagcccctaaatgtattaacaacactacgccaaagccttgccaggaagcgtttcaccatcttccagtgggaagccaagtaaacataaacttttaataaaactgtctgagtactgtcagagaggtataaacacttctaccagacagtaatttttttcaccatcctggaagaccctcaaggtcagggattatattttatttgactttgtattcccagagcctcccatgacacctaccccatagaggacctcattaaatgtgtgctgttgttttatagcaaagtgattccaaagcggtagtagggctagagaaaaaaaaaggctttacagtatgtacgagcgacatttgaactccgtcttaaaaaaataaatataggtactcaaggaagaaacacagagaagaggacatttgagacagagaaaacaacatgtgtgaacaaggcctgaagtgggagaacaatggatatatctaaataataggcgtttggatgtagggaagccagagatagtgtcgggcaagattctggacaggggtttgtggcggtttaggaaggaaaacctttatgtcaggctttcaccttcatagcttcacctgcacagccagggctctgttgcactggaatcagtagagggaatgggtacagtttcaagaagctctccaagagctgggaacaccctatttgtgcctcagcgtggttgaaatttagtctctccatttatgagcattacaaattttaataaaatgcaacaagggcacagttggggagaggttataaatgactaaaacaaaaggagattttaatattgaagagtatagaattaagttttcaaaaagttcgaaacagagtgcttatatataaatataaaataaataaatgtgattgacattaatttattaataacaaaacttgcaagaagataaatctgcttacctggttttaagcattgagaggaactaggagtttatatgcattttgggggaaatatatttaaataatatttttgtgtttacacagaataattataatagcttacagatagtaaaactatcatatttggggttattgtctcccctagacaaaatctataactaacatctatatttacaatgtctaggctctcatcaaataataaatagtgaagtcaacataggtaccttatcccatgtaattcattaatctttacacaagcctcttaaacagtgctccagtatgatagtaaaataccatgtcttccctctccggttgaccttatttccaaggttgagtatctagctagctagctattttaaacaagagcaacctaattctattgatttaaaagacagaataatgatcactgcaggagacagagaaagtgaacagttaaaaaagatgtttcactaagctaagggaggaaggagggcctaaatttagtgttggagattgaggttatgatacaaggtttacagactaaaaagcaataacatgccatgaagtagtttaaccttttatgttttcttgcctctgtacttctgcaccctctcacaccactacatttgtctgcaatatatttcccttatcctttttaaaataaagtttcacttttaataattaaaggtacataataggtatatatatttctatcttattattgatacatagcatttgtatatatttacaggggacatgtgatttttttgttacacgcgtataacatgtaatgatcatgtcatagtatttattccctagaatacttttcatctcaatgcgttaaaaatatttcaaatactctcttgtgtctatttagaaatatacagtacattgttgtttagtaactaaagtttactctcaatcactggaaattattctttctgtttaaatgtatgtttagacccattaacctactctctttatccttcccacatacatttcctagcctctggcatctagcatactagtctataccttcatgatattaccttttttagccccacatatagtgagaacatgtgataattgtttctgtgcctgatttatttcatgtaacataatgacctccattttaccccatgttgctgcaactagtgttatttcatgcatttttatggctgaatagtttttcattgtgtgccaataccatatcttctttacccatttgttggttgatggacacttaagttgattccatatctctgttattgtgaatagtactgtaataaacatgggggtgcaggtatctttttgatatactgatttcttctcttttgaatagatatctgttaatggcattgctggaacatagagcagttctatatttacatttttgagaaatcctcatactgttttccacactgactgcactgattgacattgccaccaacagtgtataagagttcttttttctccacatcctccccagcatttatatatattttttgtcattttgataatagccattctaactggggcaagatggtatctcatgattttgatttacacttccatgatgattagtgatattgaacattttttcatatatatgtaggttctctgtatgtcttattttgagaatgtctagtgcccattttaacaatgtgttgagatccttgtataatctggatattagtcccttgatgaaagagtagtctgcatatattttctcccagttctacagattgtttctttactctgttgattgtttccttagctgtgcagaaatttttctgtttttgttgcttgtgtttttttaggtctcagccataaaatctttgcctagatcaatgtcctgaagtgtttccccaaagttttcttccagtagttttataattttgggtcctaacactatgtctttaattgatcttggctgatttttctatgtagtgagaaataagggtccttttcattctttccatgtggatatctgatcttgccaacaccatttattgaagagggtgtattttccctagtgtaggttcttggtgtctttgtcaaaaatcagctggctgtaaatacacagatttatttttggacaatctatttctgttttatttgtctgtatgtctgtttttgtatcaacattatgctgttttggttgctatagccttgtaatatcttttgaagtcatgtagtgtggtgactccagttttgttcttttcactcaggattgttttgaatatttggcctctttatgggttctacataaatatttttctatttttgtaaaattgccattggcgttttgatagagattgcaatgaatttgtagattgttttggtatggtcactttaatgatgttaattcttccaatccacgagcatggaatctttccatttgtttgtgtcctcttcaattgcttttatcagagttttgtaattttccttgtagaagtatttcagctctttggattactttatttctaggtattttattgtagctgttgtaaatgggattgccttcttgattcttctttcttagctaattcattactggtatatatgaacaccgatttgtgtatgattaatattgtatcctgtaactttatttaatttatatatcaaatctaagaaattttaggtaaaatgtttagattttcctagatagaagattatatcatctgcaaagaggaaaaatttaactttttcttttccagttcgaatgccttttattttttttaatccatctgatgatgctggctaggcctttgagtactatgatgaactgcagttgggaaagtgagcatctttatttttttccagttcttagaggaatggctttccactttttccctttcagtattatgttagctatgagtttttcacatatggcctttgttatgttgaggtatgttcatcctatgcctaatttgttgagtttttatcttaaaggatgttaaattttccctatttctctgtgtctattaagatgatgataagattttgtccttcaccctctttatgtgatgtatcacatttattgattagcatatgttgagcaatctttgcatctgtggaacaaatcccatttgattatggtgcattatcttttgttactgtttgtttcaatttgatagtattttgttgaattattttgcatctttgttcatcaaggatatcaagctgtagtttttttttttttttttttttttttggttattgtttttagactcttgtctggtattggtatgagggtgatgctggcctcacaaaataaattggctgaaattccctcctccccaaatatttaaaataatgtcaggagaaatggtgttagatcttcttcgtaaatttggtcaatttgtcagtgaagcaatccagtctcaaacttttctttgttgggagactttttattgttgatgtaatcttattactcattgttgataagttcaggttttctatttcttcctaattcaatattggcagattatatttttccaggaacttgttcattttttctaggctttcaaattagttagtgtagggttattcgtaatcgtctctggtgatctcttgtatttcagtgctatcagttgtaatgtctccatttttctgatttatttgggtcctctttctttttatcttcattagtctagtgagcagtttataaattttatctttttttggaaaacaactttttgttttgttgaccctttgtattattattttcagcctgtattttgtttagttccactttgattttttattatttctttccttttgctaattttggtttggtgtgttcttgcttttaaaatttattgaggtgtatcattagattgtttatttgaaatctttctactttttaatgtaggcgtttattgctaaaaactttcctcttagtattgttttttttctgaataccatagtttttggtatgttatgtttcaattttcatttgtttcaatacattttttgattcctctcttaattatattcttgacccaatggtcatttagaagcatgttgtttaatttccaaatattaatatagttttcaaagttcttgttattttttattccactgtgttctgagaagatacttggtatattttgattattaaaaaaattgagacttgttttatgtcctacaatatggtctattcttgagaaagttctatgtgctgatcagaagaatgtgtgttctactcctgttggatgaaatgttaggtaaaagtattttatgtttattgggtttaaagtgcaatttaaaggcaatgtttcttttttgatgtttttgtcaagatgatctgtccaatgctgacaatggggtactgaagtcccccaaatattacattattgcagtctatttgtccttattgatctaataatatttgttttatatgtctgggtgctccagtgtttgctgtgcatatatttacagttgttatattcttttgctgaatttattcctttataattgtataataaccttgtctctgctgtttttgattaaaattcaactttatttgatataactgtagctactcctgctcatttttttgcttccatttgcatggaatatctttttccatccctttacattcaatctatatgtttctttacaggtgagatgtgttccttgtaggcagcatatggttgagactttgtaatttttaaaattcatgtctttttgtttgtttgttttagattcttgctctgttgcccagtttggactgcagtggcacgatctctgctcactgcaaattccacctccaaggttcaagcttttctcccacctctgcctcctgagtagctgggactacaggcacgcaccaccacatccggctaatttttgtatttttgattgagaccagattttactatgttggccaggctggttttgaactcctgacctcaagtaatctgcccgcctcagcctcccaaagtgcagggattacaggcatgagccagcatgctgcccccatccctgcctttttttaactattaagccagtctatatcattgaactacaaaatttaatcaatttacattcaactttatttttatatgtgagggcttagtcacatataattcaccacacatacatgcaggtggtggtgaagtcttgctggggacagggccatcaggtgggccagtctttggcccccattggcggcagtgcaggtcaattatgtctttccctaattttcagggctgcatacactagcactggtgtcagcaggtctatgtaagcaggtctatgcaattctgttgtccctgtgtggcttgcttgggtgttggcagtgacagtgatgaactgggtgggtgagtgggtcctctggctccaaggcagtgggtttggtggtaatagtagtggagggtcaatcctctgactctcaagccatctgtactggtgttggtggtggctgtgacaggctgcaatggccagtctctaggcttgcagttggtgcatacatgcgggtactagctgtggtggtagcataggttgagtggactcattttcaagcccctggaaatagtgctcagctgctaatagtgtaggtggggcaggatgatacacaggcccttgaagggtgtgcttgtgcactcaggagggtagagctacatcacatgggccttccctcagccccccggtagtgtttacagtcactggctgtggtatacaggggtggagtgatccccaaacccccaacagaatgtttagatgaaggtggcagaagctgcacttgcagcactgctgtggggttggggtggggaagcagaggttactttcagttttagtacacacgagcagatagctgaggaatgcaagtttcagccctaggtgacagctataaaccgggcagcctttcttcggggtgcttttaagcgtgtggcgaccctgctgctaaaggttgctgggtcactgtcagtgcctcatgctttggtcctagcaacagtagccaccagtggtgcctggctgcaggtgggggaggtcagtggcgttctaggaatctggagaggcagaagttggactctagggcaggatgcaaactggtggggactgggctctcaaaatagcactctgctgtggctgcttaggcttcagtgtgggtatggcacccattcttaactcccttcccagagcaatgctcttgccatccccatgcagcttcctatgatagtttcagtgcccatatgggttgaaggactctaccatggctaagatttcaggaatctgctgtggaaatgtggaccactggggagcatttgcttactctttctccagactaaggagcctctgcatactccttgccaattgtagccaagcgggctgcctcgctttggtctcctttcttgccttaggtgttttctgtcacatctctgttgaattccagcattttttcttaggtgatctattcaaagtgtcattatctactccttattttgtgaaggaggtgagtaccggatgctttccatcagccattttgaaggcgccccttcatctctttattcactgatcaggtacaaagacccttgaaaaatgaatgggttaagggcatcaacaccccacacaattgaaaaaccatacgtgatttttggctactccaaaaattaactaatatccttcccttaactagaagtcttactgataatatattcaattaacatataatcattctgtatgttacatgtattgtacaatatagttttacaacaaagcaagctagaaaaaatgttattaagaaaatcacaaggaaaagaaaacatatttattgtgtattaagtggaagtggatcatcataaagaacttcatcctcatcctctttaagtatgccaaggaggaggaagaagaacaggggttggtcttgctgtctcagtggtggtagaagcagaagaaaatccacatataagtggatgcacaaagcccaaacttgtgttttttaacagtcagctgtattttttctaaaaacgcttctcaggctatccaaacctaaataaacatgtatttattttaactactgtagaaactattgccatgcaatcatttagcaattactcatacaatgtcttatattagtttctgttttatgtgagcagctatttagatctacttttgtttaattttctgaaattatttaatagaagattttatactattggcatatagtaggcatttaaaaaatagctgacttattgcagaatcttctattttaaattttatttatattttttgattttttttttactatagaatatagtttcctgcatattcattacaaaaacatgaggtatgataaaagagcaaagtgttatatttaaaattaatccttcaaacaatgaatcaagtgtaacaatatttccctaggtcagaaactttaaaatacttaattttataagttaaaaagaatgttttggtaaatactgcaaaatacttttaaaattagagctgtatatttttaaacatctttttttcaaaaaagtaattatacatattttgagtaatgctcagtcatagcacagaatataaaacataatttttatatgacactctgatttatgagagcacaaattactttttagcattaagccagtgcaatcatgtgggtcaccttccaaatataaagaaatagggggaaaggaaagtgggcaacttagtaggctatgaataaggtctaaaagagtgtgttcttatatttatgttacaaaaataaagtgtgtcctttttgaaaacaaatcttaaatatattttcaggcagattctacatattgttctgctgcaaaaaatgttgttttaacatgtttcccctaaactgcatgacttagaactaaacataaaaatggtatttggttgctgttccaaatgttatgcaaaaaaaaaaaaaaatcaatttgatgggaaaactagacaaattagtcagtgggaattaggtttattaagaaatttcacctaatttttgttgcttttaatagttgcagttttaactgagtgtgaagaaaagttgccaagatgacatatgtcacatgtttcttcaattcatacatcctcaggcactagccaaaagccactgtatgtgtgtttttttcaaaacccacgtatgaaacaacagaaattcctttaataaataatgattgttatctactatgtatcagccaatgtgctaagcattggaaccctcaagaacgtcatgatctgcaaggaacatataagagacacaaatccagaaaaattaaaattaaaataaaaacgcatggcagtgatagcaacaggcacagtggattgtcgtcaggaaggacgtggggtcaaaagaagatttcagaaggaaataataactgaccacagttttagaaaatgggagcgagcctggaaaggagtggacaggtgtttatgcagacagagttgcacataggtagaggcatgggaagagaggaatgaccagatggtaaaatatatcctatatacagaggagcatgtaaattatcttcacagttgaaaagagttattttttaaaataaactcttctataaccattcttcaccatttttagagtaaaaaattgttgatttaaaaatgtgaggaaacacagacttctacataattgtgtactttgtttcacctaaatgcaggtgacagatagacctcagtgaggtggctttctttttaatacagaatttttatagatcagttttagataatggccacaggagtcattaagagccggaaaatggtaagaagagacaacactagcttaaagtgaatgcaaacacatactctttgagattttgccagatacgagtcaaaaataccttttgaggaagaagttctaagaaagtaaaacataagcaagaatatcttttttaaggggatatttggaagcatattgagcaagttattgccaactaaaacatatccaaagatactggatattgtccttgataaatgttctagaaacttttaggactgagaaatactagggtaagcaatgaagaaagagttggagagaaaaaatttaatggtcattttgtttgagatgagaatgaattttctcgtctgtctctctgtttctgagcacgctatgactgtatgcaagattttcctacttaacttcacagttttccttctattttattgttaacacttccattctcactaatgtggttggtaaaataagtactttaattatttgcttgcacattcaatattaaaataccatgctgtcttcagtttattatgagttcaattttcaagacactataaaaataatataacaatccattaaaagggtattctaaaatattttgtcattaggttattattttattatcttcaagtaaacaagaaatacatgagtaaccctcagcatattataaaaatgtgccaataaatttaaagaaaatttataaacataggaattctaataatttttctatatacatgaaggtgattattccaaattccattagattttctaaagtattatatattttgttatttttaaattctctataaacataattgtgaagccactttaatcaaataattagaaacaataatttgcaagcttgcaaaagaacacattacatatacatcttttaaacaattaaaatctaaagagtgattcctgataaagtaaatttagtgtaaacagaaatgcaaataaataaaactttcatttctatattcgaattgcaaaaaaatttgcaataatgaatatgctatttttcttgcttgtaaattatggtcaaaagatgtctgctgaatccatcacaatagtatcctaatttctcaactagaagaaattttagcaataaaaattaagtttagaatgataccaaagcttagattcttcaatacaaagaaaaaaaaatagtctcaaatcaatccttgttttacagatgaggaaaaattggatccaaaaatattaagtgatttgttcagttatccaggtaggaatttcaggatcaaaacaggaattgggtttgttatgtcaaatcctatgctaaagcctgtaaataagcttcttccaggtcattaagtcacctctatgaaagtatttatctcagtagttcatatgatgacgatcctttttaaatgtaatcaactaaggtagtactccctaaggatagggttaaacacagcaggttctcaggacaggctgctgataaatagacagagatctaagtgtgtagtaaggaagaacagtctatgactgagttagttaatggacgaagtataatccataggaattttttatatgcctttgaattacataatttattaacaaaacactaaacaaaacataaacctctctgaagctacaaatgtcacatgactgaaatcctggcatattttgctaaatagaatacagtaaacaatcaacactgattttgataaaatgtttcgaggtttttcaatgaaacaaattctttgaacagagtgaaaattaatttttacagattatatcaatacaaatgttacataaaacaatttcttaaaaggaataaaaactaagttctacagattatataaatacgtccaacctcttttacatggaaaacagtatgaaatttagcctattctgatatgttttcacaattttatataatctacaacttattctcctaaacttttttttaatgttagacttttaattgggctacttacaacaaagaacaaaatgttttatcatacatttttccaagtattttatataagtgtaattaagtttcatcatgcaggttcaagtcgcattgccacgattaagtggctgtgaactattgatttgacttatttaacatttcagtaacgactaatgccagtgattattgcactgtatggaagttgcaaaaaataattataatattcaacgtttattttacttgaaacttaaaactttatttaagaacatgaccagccatcttaatttaccttctaactaaatcattgtttgagttgtatatgtttggaaaatttatgtaacatttttaagccttaatatcactatttataaaattccgattacaattcttacttgcaagatccctatacatattacagattatgcatgtaaagcaactaataaagtgtttggcacccaaatcttaattcacttgcatttaatcatgctggacctatacagacctttaaacagtacagcaattataatcatattatatttttttctgaaatatatcttatttatacatatttattcagataagcaaaacataattagcagaaataaaaatcagtgtcatttattatcatttttgcattgcctctgagggcaagagatttctattagaaaactggtatctgtgatatttatggacatagctgcaggtaaagatgatgatgatgattgtgcaggaatgccatatgaattatttcaaaagtggtaataaacttatattgatccatttttacataaactgtcaacaaattcccccaaggccaggccttaacccattatatatatataatgaaagtgttaaagcttgtagcataggtcctggaagtgccctataaatgtaatcactatgcatattggatgtaatcactatgcatatgatatatatacatatatgcatatatatatgcatagtgattacatatatatatatatatgcatagtgattacatttatagggcacttccaggacctatgctacaagctttaacactttcattcataataagttacatggtctttttataacactatgataaggctattttctctacttaataaatgaaatacttaagtgcctgactgaagattacacacatagcataaccagattgcaaatatagggagtctgaatccacaaggcatacactcaaggcccctcatgctgcctgatgttgctgctgtagaaaggacacagataaatagaaagtaccatgactgactgttgtctagagttctttatctctgtattttgaaatcaacagattatctaatggattaagataacataatcattttctttcagatgaacagctgtgatcaatttagcaggtggtaactttttttccccagtgaaatgggaaaatgttagggtacattacaggtaataaggtaaattatttgataaaattttcatttcagttgcatatatgcatgtatgtatactggatcattatataaaaggtgtttcttttaggttataatccaaagaagttttgaaagctgagtttttttaaaagggtgatcagaaatttggaggaaagacagaattgtttgttcataacatgtactttcaattttgtggttatgtttcaactctttacactatttaccttcagacttctagaaaccttttctacactccaggttctttttgtggtcatctgttattctgtggtcatctatgaatgaacaagcatacaggcccatcatggggtcaaacctgtaatcctgattccatcatcactcttctctcctatcttcaatttgtcatcaatttctaaagatatattagatttgcattcttctttccagtatcaaattttcattaatttatttcagacaccatttctctttccttaatttctgttccaacttccttctttgcctccagcctatcttgtttaatccattctccttagtgctactgagggagcctcctaatccataaataggatcatgttacctccctgataatttatttacatctttctcattaagctgacaataaggtgaggctcttcatggttcagctgtaacttactccagccttatctctcagaactcatgacttaaatactacaaaatagttcatgcaaaaatctgaaattttctcagagtactttctgctccatttttctgaaaatgttctcccttttcctttcctcacacatactcctctttggccaattcctacatatcctttagtcctcatatgataagccattgctcaggaagccctcctggatcctttatttcttggttgggcatccctattagtgttctttttatttttattactgttcctataacaacactcatcatgatgtgctagaattgcatctctacgcatctgcgtccatcaccaaacagtaaattctttgagatcagtgagtatgtgttttgcacacagagtatggcatagggcctgttgtgtactacattcttataaagcatgtgtgttgaatgaatgaacgaatatattttttaacttttattttttcttcttgagacagagtctcactctatcacccaggctgatgtgcagggatgcaatcttggctcactgcagccttcgacttctgggttcaacaattctcacgcctgagcctccccagtagctgggattacaggcgtgtgccaacacgttcaactaatttatgtattaatatattttagtagagacaggctgttctcaaactcctgagctcaagagatctgcccaccttgtcctcccaaagtgctgggattacaggcatgagctactgcactcagccaaataaacaaataatttttctttttaaaatgaaatacttacttggcagagaccacctactgttacgcaatcattctatagtctttaaaatctaacactaatttcaggtatcaaaatttatatttttaaatgtttatatatttattgtcatgtgagattttatggtggtcaagttcaaagggcccaaatatctagtcgccctaataatattttcagtgtttttcaaaagcttacagattttgatcatttactaatgacactccactgctcactcaaagctacactgactagcacaaatatcctgcttctttgcttagagtgaggctgctagttggcgcattttgatgagaaattccaatcggcaggcatatgcagatttggatattttttaaaaaatgaaataagacattttaaaagtaacaggtttacagagaaaaagtttactaaaacaggtcctaaggaaaaagactttgaaaccagttacctagcaaactataaaagctaaatgccccaaattgtaatgatagccagttgcaccaaaattcaatgttattcatattttatttttcaagataaaaaagttactatgtattgccaagtttgaaactgaatgctctatctcattcctttaagccaaatctttacaagaaaaggatttctacttcaaaagaaagtgacacaatactcataattaacataaaaataagcatttgcctaatttcaggagagtacattaagtcattagtataagtggtgttttgctttgcactctctttacattattccatctctttccatctgggagcaaacttaacaagcaatttaaaaataattggtgaattaaattgtcattggtggcctcattttcctttttcgcgtatgtcttcaacagacttactctagcagtaccattaatacagctgcggtaaaaaaaatctgtgcaaatggcatgttataaaattaaatggtaacatattgtgttgcttgggatcacagtcaagtctagaggcaaaatagaaataacagatgcaatacaaatgtagagttattatgtgtgtcatactggaatctagcctcacaaaattagcacaatatgctctacctgaggataagctagggaaaagaaaaaaaaaaaaaagaaagaaagaaggaagattgtgccagcaacataaatggagacatagaaacattttaatcttaatatggtaatacgttttgaaaagaaattgtacatagattttttatttaaaatttcagaccaagagaaatgccttctatattaatatagttctccaaaatgttttttggatcatgaaatttctgacattccttttgaatttagtgaatttactagtttgaatggtcctaattaaattcttccctaaagctatttacagaggtacctcctgattttattagtcctttagtgatgctgcatgtctggtttggagagtaacttccagcaaatgaatagtatttatgcttaaaacttaaatgtgtgtgtgtaacatattgaatacgtaatttaatataatatctttaatactatgctttactaattatctaatttatgtgtgatacatcatatcatcatatagctgcctgggtttgttttgaattgtaatccaaaattaattatctcaattataataacttttatctttacattaaaaagtaaaagatcccttttcctcatcctcatagaaaaaaataagaatgttaaaaagaatcaaaactatgttttttggtgaaattactggctccatttatttgccctcccgctacttatgcttttttccatataactttgcagttccttctctaaaaattccctctacttacccgtttctgaacaaaaatatctcacttctcacagaaaaaaatgagggatttgaaaaaataatactgttaaattatataaacatatagtaagcattttcttacaactgtgagtgtaaatgatgtcacattgcatttactatccaccattcactacctcacttcaccgcctcagctaccacaactctcagaataagtacccatctccagaaaaaactcttgagtctgtttttagtgatttgatttagatgagtgttaaattatttgcctcgaaatataattatgactcactagagttgaaaataaaaattactattataatgagttctatgagctagatgaacaagtctacacaccatttgtaaagtacagtggttttgctagctagttggtagaatcacgatcaagtgatgccatcttggccagccatcagcaaactgtaatagctgatactgataattatgaataacagcaaacttgaaaataattacataattaaatacttatttgtgtaatgagctgcttttagaatctatgccagtgggtcaagtaagaagaagtaattggatcagtaggagacatttagtagttaagagacttgcttgtgcacacctaaaaactcaatggaggttaagtagcatatcactgccaaagagattctctagcactggtgggcctcagcaaaaccgtaagtggccttgtgagactgtgggactttagcacattactgcaatagactcataatcttatctaaatcaaagactctgaaaaaaagtgttatttgctacttaaaatgcaaaccattctacttcaaaatatatagaggagaaagaggacttgtcccaagataaaatgtgtcacatttgacaactatcaaccttatcagagtctaaaacttatatgaatacatgctgaaagtggatgctcttagttgtatttatccccattattaaacctaaatagagaagatcaaagccaaggactggaattttgaattattagtagctacaaatttctttcttaaagctttctggggcaagtgattgtcaacttcatagagtagaaaatcaaattaaaatggaataaatattattattctgaagacaagtgttccttttttcatagaaacattaaaagtatttgctaagtatgataaaacacgtatttctagaaaacagcagatataagacagtgattttcatttttttctatcgacagtataaacattagtatagaagtatgagagcccgtattgctgatgtttggagactaacattccttgcaaagagatgtctatgtcctttccaactctaataatctgtgattctataatttgatattaagcgaagattttagtaacacctaatttctgaattgaaaagaatttttaaaattctcacccacttactcaatacttgattttcttctatatgaatagcacagtcatatagttcatgcttgagccaaatttatattagcctaaatacatttttgatgaaatatttttgtttcacaaaaattcttatattacaaaattttctctaatatatatatgcttactgcattttaaatcggtctggcgctactggaaattgcttcatattaaattataagaaatttaataatcaataataagtatttggctgggttaaccatatttcttacataacaaatgctgataaatatatgtgtgtgtgtgtgtttgtgtacatactcttgtcaaattctaattaacaaaaatgtttaaaatatgttgataaatgcaaataaacattcacaatattattatgatttcatacatgttttgcatcaaaaatggcaacttgctattatattaatagctacattttaattggggtctcactaatctagaggctactctaatagcttccatgtattgaatgcttcctttgtctggaaagatagacttttatatgttaacattggtaatttctgggtgatgggactgcacatcattttatcttgtaattcttgattttgatatttctacaatgaacaaacattaaaaacacgattttaagatgttataaaatatatattatcctatttctcttttatttttatttttcaatagtttttaatttttatacaagctttggtcagtgagtaatggtacttccacagagtacataagatttcaatgtccaaagcaagtcagtctgtattgcatatattcagagctccatcaagtaaaattcaatgttaatacagaggtaagtgttaacagagaggaacaatgaaaaatcctatttaggacctgacttcaaatctcataagggatcagaaataccactgtactgctgaaagtgttttcctaggaaaaacagttttcatagcatagctcgctgagaactaactgatttttggcaattagatcacccatttttgagttaaaaaaagataacaattgaatatcatttgaacttctaatacctattaagaaaaaagttatttaaaaatgtttggaatttttggttggaaatctatgcagttttgaaattaaaatatcgattgtgagaatagtctcattcaaagttgaaatacactcttcagtaacaaaataatactgaaaagggtgagtgcaatgacaagaacatcatatgaacagatattatattctggaaaaagtataaaagcagattcaagtgatagagattgatatcccaattaaattaaaagaatgcccagaaaatcagcataattttcaataaaaatgatactttattatgagtaggtaagtagagagtgtatttatttagatgctccccactggtgtccttgtgaaaatggatgtcaattgtgtcaataataagcaatgctacttgcacctcaatttctcagaaggtgttcaggaaaagaaggtaccaggtaccttagcaggcaatgggaatgaggttgggatatttgaaaaataaaaaagggaaagattaactgaaacacttgtaaggagatttagatctccaaaattcttctttaactcacaatcaattgacttcagatttgcctatgcccatatatcacccctcacacatcaagattagaagcaagcacatatagcagtggcgaggtagtgaatagaacaaagtagccatttgtagcccagaatcagaaatgtaggaagtgatccagagaatagagcttgcatactgactgcagggggactatgcaaggagtaaaatattaatttctaggcaggtaccagaatctaaacaatgataagcaggtatatatctaccagctatcagaaacaaacatggcagagattcaaagtagagagtcaggcagactaataaaagataacagtagtcaaacagtatagaaacaatgtaatgatcacaaatgattctgtttctgccatccttcttctaaaattctatatgtgacagaaagtctaaaatgaaacaaaataatatggaaattataattaaaaattattcttgactgagttacagtcaacatgaacatagggatatggacaacagcaacattagaggggtcatatttgcagggtctttctggagtcaagtgaatttggaattacaacatggtatgtgtttaatgctcagcaattatgttatgagcaaacaacaagttatattggtgtgggattttgagcaaaattgctttatttattttatttattttatgaagggagaggaccaaattttaaatttcagttgaggctttccatttgcagaaatggtagattttcattttaggaatcttccattagataatgtcagctcctaatacttctcattctcttgtaatttctttttttattaaattgagattctcagtgaggtcatagtgtaatggagaaaaaataggtctgcgagaaaattgtgatgtctttaccaacagaaggtgataggatcgcaggtgataaaaacaaatgaaataaaagaaacagaaaacctaaagaaatcaatcctatactttgtccactccattttttttctcctttatttcttccactttttcttttgaaaggtacccttttagttccaaaaatgtagagaagagtatattcattattttagtttttgttttctttcaattgctttaaaatatttttctatttgatcctaacattcaccctatcaaaaagatattttgaatgttttgacaaataagggtgatgatgttcagatttcagtgatgcacttagtaattagcagagcctgtatccaaacttgagtttgacacatttttaatacctatgctattccttacaagctatgttaggttatagatgatttttcccactgtccaaaactaattttttatgtccttcataatcttcagaaatgtgttttgccactttaaggaggaaaaattgtctgtaaaatccaaaacagcaattttgctgttgcaatggaacccaacgagtgatgccagcccactgaattgaacagaaagacagtgatgattctttgtgaagagaaaaaatatacatacacctctataatgtgaacagagcataataagtggcatttttgcaatttggctgcttgacatcctgtgtgaagttctgaatatcctttttttgagcataaagcaaggacatggctttttttccccttcatgcactcaagggactcactcaaacacctaataatgctgttcaacctttaatacattcataatggaattccccagttagcgtgttttcacttgcctgggtagaggcaccagctacaacctcttcaaatacttaaaagaaaatactgttcacattaattgtaagaatcttcaaaagaatgctagaatacctcaaatggaaaattcacaagtagtagcagacaagaagacatagagcataggagtgaatagtagctataaatcagatacaagccacattaatgaattgagataagaagtgtgaaataaaatcgatccccgctcatcagagaaggaggagagggttatttttaatcttgggatgaatttaaaatcaataaaaaagtataatagtctcataaacagaaatcgaacgacaatgcaaggagttggaaaaaaattaaaaacaaagggaaaaaagtacaccaatttacttcaacagttacaagaagccttgtttgatagtgttaactgtattcataatgaacatgtgtatagagccttttaaaacatcccatcaagcactgcacagctgaatgtgaccactcaaataatatttggtgaacataaagaagaatgcccataaataataatcttccaagtcaaacatcttagatctaaaagttaaggctacaggaagagtgagaactctttgtgtgaagacactcataattaacaatatataagcaactacataaggctgaaataggcagggattgtgaaattccacaatatgagaacacttattttcttcttttcctctcataaattttgttcagaataccaatttggggaatcaagcagaagtaatccctgctaatagtgctgacactatgtcaaaagttttgagcaataaaaaaaaatctccgactttctatataccagaaactttcattttaccctagaaaatcaaaggacccctttaactaaaaatgtgtttctagaaaagtgttccaaaatacgtcatatggggatctagctcctcagccaagcaattgagcctcttttccttttgtaagcagcatatcaaagtaaggccaaagttggatactaagaaaagaatggagttacttatatttaatatttaggatacaaaataagagcaaagtataattgcataatgcttgctacatttcaaatttgtctccttctggaaggaccttcatctctgctccctgaaagccaaaaacaacaggctactatttttgtttttcatgaagctagatattagccagttgctagacttcaactgtgatatattcatgagaagacacaagctggagaatttcagcctagtctaagcaggacagatggagttgctttttacctttatacagatcacgagtttttagccatttatttttcaaaagtctagccttcagcagggagcatccatatgcgtgtgtgcaattcacattgagttctgaaacaagacttctggtttatccataaatctggcaaaataaattctcgaggcatagcctggcaacaaagaacttgaataaattctttaaagctcttttgtagtgaaataatattagaagttggggcaaagacaaagccatgagaggtgttgatctctaacagttttatgaaaagatgtttaagtaacttttcagtggcatcaatttaaaaatctagtcaatgatgtaacgttgaggatggagtttgctgacttttatcttccatgagcagtcagactaaccaggtgttagtaatttgaatctaagcaataaagactgtgaagccacattgatatagttaccataaatgggaatcagtgagtcccaccagcgtcacagagaacaattcagtcagtagcttgggcagggccctgctagtcattaacaactccattaagctaagacagaaactggaagcattgcccagagaggtaatcagaagcactatgctcccaagactttccttaacaggtgctcattttcatcctggtaagatttagaactaagcatatacatatttaagagaatcatattagagtatggatatttgaaatctatcaatatttactattttatattcttaaaatatttcagataatttgcctttttgaatcacatttgtacttatgatgtataattaagtaatttacatacagttatattaaacttagatctattaatttcacatagtagaggctactagttattcccaaatatgttcattcttcctttctttcttcctttcccttccttccttcctttcttttctttctttctttttaaaatactgctccttcctgtacactgattttttttcctttcttgttagcagtaaaaatcttgattttttttgtaagtctaaaagactgtaaaaccttccattctctgctcagttatttgtgatgttaggactgagttctaactacttaaatgtatttatagtgctatataaaacttccagaaagcatctttgggggaacaggggcttgcccttttcttcttctctccattctctttcttgggactctactttaatgattccagtttaagcagccattatagaccatgagattaaggattagaccgtggccatggaataatgttgatctgggaggaaggtgagttaatgaggtcttcagagagctgcagtactagctgctggtttcatatatctagacttctttcataaaacgcaaactgccattcatacttgtcattattatatatttgggaggttctatatttcaagaagctaagccatataataaatagtttgtatttaaaaagtcagagtattttaaaaggatatatgcataatggaatactattcagccataaaaaggaaggaaatgatttctttgcagcaacatggaaggaactacaggccataatcttaagtgaaacaactaaaacacagaaagacaaatatcacatgttttcacttaaaaatgggagctaaataatgtgtacacatggacgtaaagtgtggaatgattgaaaatggagactcagaagggtgaagaatgggattggggttcaccatgggaaattaattaatgtatacaagtgtgtgttattctggtgacggatacactaaaagccctgacttcaccactacccaatgtgttcatgtagcaaaattacactgttgtcacataaatttatacaaataaaaataaatcactaaaattacaacttttcccttattagctttatgaggtttatttaagtactcatgagtggtgtctttcagtcaaaataactacaaaggaaattttctatctagatttatataactgatataaaatatctctatagatctatccgtacatcaatatctatcaattacttctaaaggttattaactatacagttttctaaaaggatccacacattaatcaagtccccttctcctcttaaagtcatagtcaaaagttgttagaagttgctataaatataagtaaataatatggttttgtaggctaaacccagatagtaaaggaactaaactaatattgtaatgtcctagcctttcattttaaacaaacaataaaaatgcatatatacacaaaactgttttcttatgcaaaatgctgataagcattttttctaaaataaatcaaggtcacgtgatcaaagtgaagcttttgacaaattagactagtttgataacctgggttttaaagaaactgtatcctttttccttgattttagaagagaacagcaaaagataattataaattttattttaaaatataatgtgtatttttctcactaaaagacgagttaatatgaaattcctaaacttttcatactgttttactattgagctaacattactttcacatataagtaaaataaatttaaaactatgttttcaatcaaattagattataattttaagaaacatttttatagtaatggaatatagttttgaacttatattaaacccaaattaattggatacttggattatttttaactaaagtagaatattaaaatattggttaccagcgtaattttgacatacattcctttgattcttatttttacatgttatagagtagcaataacttagggccgtgtttgaaaatgtcttaatgtttgcctttttaaggtatggtaaaaaaaaaaatgtgtatggccgtcagatatcatactatatgtattcattagcatagctgtagtgttagacaaatctaaaccccatttcactccatgatgtagaagttaaatactaaaaattatgttaatatgggtaatttaaaatatactagaatcagtactggcagataagaagaattgtgtatgaaaagaaagataatgcacttttgtttattaagggaaaatgagagcagttttatcctaaagtgaagtatcagttattttcagatgtgaaatagaatagtaaatgataaaacctaagcaaatacaggaagtcatagtttttggaaacgagaatttaattatcttagattataatatcaaaaaataaggaatctcaaaaaatgtagtagaatatgttaaaattttcccaagagtaggttagttttcatggttggtcagttaatactgaaagcataaagaagcttgtgaatcttttactgccaaatattaacagcgcaaaattagactatttctattgaaataataaattaatcttgaattacttagtctgattttaacaatatataataattattttccttccatgtaaccttctgacatgaatggctcaccagagttgtttcctgtgtgttgtgctgaatttattatgccctggatcaatcaattctgaaggagctaagataccattaaattgggttaatactttctgtttatttaaaatattgtattttcccttgattaacttgtattcaagccatgaccttttattgttctcaaatactgatattaatattctaatcaagtgaatagatccctctgataactcttgacattttcttctcaaaattaattcctaaatttagaaaaatacaatttagtgtgccttttatacctaatactatcttcgtgatatctcagatgatcacagaaaaatcacaaatgtttgtcttttactctataaaaaagagtaatgctgaaaataattatagttgttggatatgctcctcatttcttacatagctcaacactatgatgagagctacaagaggagttgttaaacaaaagccttctctaagatagttttgttcaggaaaaacatatattgataattctctggagtgtagagtctctgaaatacatacatcatacacacatacaggcatacattagagagaagagagagatgtacatatacatattctggagactacattctggagatttataaatatccttatacttatttttaacctcagaacataattactaaatacccttatgactaaatatatattataccttaatagatcttactattctttatccttatgtgttggtcctctaataaatttgccatagccatttaattctgtctttgccaggttaagatttgcttgcttgcttgcttgcttgcttgatttcaactgtcctgtcttcaatttcaaatgaggaaaataatatccacaagtgcacctaggtaaaatgtttagttcaataactggcatgtgatcagaattaaattataaatctgatcctaaaatgaaaactcaaaatgagaaagcattaggattatatttctgcttctctgacatgaacactttataattaattgaagagaaatgttgagtggctaacagccagaggaacaagcatggctgtcaatgcatcttgactttctaattcctcatacaggaactttaaaagttagcatatggctgagcatggtggctcatgcctataatcccagcactttgggaggctgaggcgggcgaatcacgaggtcaggagatcgagaccatcctggctaacacggtgaaactctgtctctattaaaaacacaaaaaattagatgggcgtggtggcgggtgcctgtagtcccaactactcgggaggctgaggcaggagaatggcatgaacccgggaggcagagcttgcagtgagctgagatcacgccactgcactccagcctgggtgacagagcaagactatgtctcaaaaataaataaataaataataaataactaataaataaataaataatgtctcaaaaataaataattttttaataaaaaaatttttaaaaaagttatcatatgatatgtcctcaagtttatgttgaaaatgtaaatcacaggtttttaaactttgccacgtaacagaatcagctgtataactttaaaaacacacatatgccatcccacccgatccgctgaatcagaatgtctgaagtagagtattttacaaatcttcatcaaaaatatcaatgactagtaaaagtcaaaatactgatcatattaactgaatatttcatatgtagggctttttgtcaatttactattttttacctgaaataaatgattttgtgaagatataaaattaggagagaccattttacataggtgtattccaaaaatatcacctttccttaagtcagatactgaagtaatgctccaaaacccaacaattacatgttactccagatgcattagctttaatggcattgggtggtggtttaatttttagcccaccctggccagggatatttccttagtgacagcagtatggtctgcagcaaatgtgaactttaggaaatgcactaacgtataagggaaaggcagctatcagcattcagtcttctctgaaggtaagtatagcaaattaagagagatgtagtagaaatgcagtagcagttaagggatcaattcaaagttatcagaaaagggtatcttgtaggacaagttcaaagctgaagattgaattttaaatgttattgtgtgttacatgcaagtctcttctcatattttaaatttcttaacaaaatccactaacaaagtattatccctatgatgtctcaaaaaaaaaaagaaagaaaagttaaaaaaaaaaaagaaatgaaactccaagaaatatgatcaaattcacacagttaacaactggaaaattctgaatgtaaagatagctttttcaagtatctaagttctttcttcaacagtccacatagttttaagaaaccaaaactacattaccttgtaacttcccaggttaggtttatagagtagatgattagaaagtaataagttcttaagaggttaagaagagaaatttaacttattcctttgatattgctagggaagaaataaagaaagcagtggggacaatttcttgtagttggaaccccttatatcattttttatttttcatttttaagagcaatacagagaagattcatcaatctatgttcaggtagtaattgctttttactactttaagctcatctgtaaaaatcaaagtgaaactgactaggttttacgatattttctgaaaagtcaaaattctggtctttgctatcccttttaggaatatatggtaaaagtttccctatttgctcattactgattcatctgcataatgaagagttaaaatcttattgagaaatgccttgcaatcagttgagaatctaattgtacctgtttggaaaggttagttacaaaagcacccacggtgatccaaacttatattacacatcctctgattatcacatttaaagtaatatgtcatttgttattcatatttagtgttacaactctttaataaccactcaatctatttccctttaaaaggacagctgcaataacagcaaaattgtaaaccttaagtgtagcgtaagaattcaaggtgaaacacattccaagtagtagcttaaaatgtcagtatcatacatggctccctgaataaaagaggcaagacgtgtcaacctgaacagacattcatctctttgcactaaagtgagagatacaaagacctgtaccactcccagtagagagatgtgctgagacattcaagagtcaaagacgctcagctgtctgaggcaaatactgtgagtcttcaggtctctgtaaattgttctacagctgtgaaggattcaaagtaaaatttcagaatgatcataaatgaataaaatgtggtggattatagtagttactgtctttggctgtccgtaatttattatgttgctacttcttgtaactgtacagtagttctcctttattcaagtgcttgctttccatggtttcagttgcctacactcaactgtgttccaaaattattaaatggataattctagaaataaacaagtcataagtttcaaattgtgtgccattctgagtagcatgataaaatctgttacacctctccattccttttttatcacaagaataaggatgagtacagtactataaggtattttaagagacagactacattcacataacttttattacagtgtattgttataactgttcaatcttattattagggttgttaatctcttactgcctttaatttataaattaaactttatcccagtgtactagtctgttttcatgctgctgataaagacatacctgagactgggcgattcacaaaagacagaagtttaatggacttacagttccacatggctggagaggcctcacaataatggtggaaggcaaggaggagcaagacatgtcttacatagatggcagcaggcaaagagagagaatttgtgcagagaactcctctttataaaaccatcaaattttgtgagacttattcactgtcactagaacagcaccagaaagacttgccctcatgattcaattacctcccactgggtccctccctcaatacatgggaattcaagatgagatttaggtgggaacacagtcaaccatatcacacagttatataagtataggaaaaatgtagtataaatagggttcagtattatccatggtcttaggcatccactgggggtcttgggatatattgtctgtggataagaggggactaatgtattttcatttctctgggggtgggggcaaacaaaactcatagaatggatagattatggtgcctcctacacctacccaaccaagtgaaaccagcattttacatcagagtaccttattttcactgaacacagatattggcatattgtatcctgtcacccctgcatagaattttctaaattagaagagatggatacatctattttgctctttgattgtgaactttaaagtgtatgtttggagagaaccactctaaagagaaaacatctagagtgggagatgacaatcttaaacttcacccaaatccagtgaccctgaaaaaaaaaatgaaggttaagaaactcccccacccgactgtaaactagttcagccattgtggaagtcagtgtggcgattcctcagggatctagaactagaaataccatttgacccagccatcccattactgggtatatagcaaaggactagaaatcatgctgctacaaagacacatgcacacgtatttttattgcggcactattcacaatagcaaagatttggaaccaatccaaatatccaacaatgatagactggattaagaaaatgtggcacatatacaccatggaatactatacagccataaaaaatgatgagttcatgtcctttgtagggacatggatgaaatcggaaatcatcattctcagtaaactatcgcaaggacaaaaaaccaaacactgcatgttctcactcataggtgggaattgaacaatgagaacacatggacacaggaaggggaacatcacactctggggattgttgtggggtagggggaggggggagggatagcattaggagatatacctaatgctaaatgacgagttaatgggtgcagcacaccagcatggcacatgtatacatatgtaactaacctgcacattgtgcacatgtaccctaaaagtataataataaaataataataataaaaagaaactcccccacccttttgtattccagagaatggcttactgcaaagaatcaccctttcccatacaacttagataagacccacagatggatcccttttttatctatgaaaagatcagacacagatcctccaaattcacattgttgcctcataaatgattggctaaactgttttttctccactgattaactggaacaaaatagattttaaccaatttcggttaagtttctctctttctgccacatctctaaactttgacccatcttcagcctgaatcagtgtagcaattctccggagattaggtaggccgcagagtaaaactttctctgctctatgatgcagccaatcatgccaccctttcatgccacatataaccttacctacttctccctagaaaagacataccctttttgcctaacccttgtgaggctggcagatattatggtcatagtttttttctctattttaatagtccctttcttcacctcacaataattcttttgaatagggtctctctttgctaaatccagattcctctttttgactttgaaaatgaaggccacagccaaggaaagtcagaggcaaggaaggacaagaagtaaaagaggatgtcttggtggggttgaatccattgctcaattctggaggccctactttatgcagccctacagttgtctaacccacaacctttgactttagcatggagttcatgctctgatagctttcaactaaagcagccattctctcctctccccagctcttttctttctctgttgatacagataatattttgtatttgagggtctgaaacttttcaaaattcaaatgtcatggattgaaactactgtccttgcacagagtgtgagaatcaggtggtgtggggggaagtgctaataatggtctatgatccccagaaagcaacctatgttctaatgtaatttctacattcatattaaaatttagagatgattttatgttaataactcatctgcaaaagtgcaaatatatgtggctatatataatgtatatgaagcagtatgataaagtaaggagatatgtctcatgtagcaatgcaaatttgagtttaaatccctgttgtgtaatttttttctaaatagcttctgcatctataaaagaaaatatatctcctttattaagagattgttgtgataactacatgagataatactgacacgttttacatagaactcgatccataataagtactgaataaacaatatttgctactaccatttacattctaagtttaagagtagcattcagaaataagagaggatataatttccttgagaagaatgcccttgataatctctggtccttccatagagataataaaagttagagaaaggacaaatggggagcttttcttttttattcatctcatatttaaactttgtaatcacctttggattctctcttattaaccacctctaacttatcttcccccatccatgcaatatttactggatctatttcaggtctgtgtccaaaactttagttttctactctttgagttcaatgtcacattacttgtctctcaaatggatttcacaatagtctcctatttggtccttttcaagtcagattttgctttcacacactccactgaatgtgctctcttcttaataaaaaatctacaagcattcctctattactttaaaatcatttcagaaatcttaagaataggactctgtttcagataagggtaaaattctggacttcaagtaaaacatgaaaactagattaaatttcaggttattgtttctcacaggggaaatatgatgggaggattgtgctttacatatccttggaaagatgtttgccttgggatgttttttacccaaaacggtgactatagttatgttacctgcgactcaatatgcattcttcttttcttcttcactagtattacttcagtttggtcaggggctggcaattttttcaatttaaaatttcatttcctagatttacatttccatgaaactaagtttccaagtggaaacttccagtttcctggagaggaagtcctttggagagagttttgttttctttatgtagacaccaccactctttccttcttgctgcttccaccttcctcataatgtctgaaattaaggtctggggttttgagatacaggaactattttgcaaccatgaaacaagtcacacattgaagatggcacagttgaaagagagaagctgatactaggacatttgtgatagcatcaagccactgcatcacccagagctgcccactccagagttcattcaactatacaaaacaaacctttatttgataaagctaccatctctgaaggttttcttttcatgcattttatctgaataccaattgtgataggatgcccaaatagttttcaccttttctccaacatttatactaagctcaactctgaacactgcgatgatagaaatttaaaacttgagagagcttatctcagcctctcaatacttcccttattttaaaagttttaatggaaaaatttcaaacatatatttaaaaatagtaaatactatgaaatgcagtcacttatccattgcccaaactcaagattatcagcttacgaccacccttgttgtatccataactttacccgttctgtattattgtacatagagagggtaatgtatgcctaaacacattatcacattaccaaggaacacttattaacccacgcctcactgcagtgcactctcctgcagtcccctggcactggaccatagtgcttttgttggcagcacttgtgggagtgttactgccagtggacttggaatatcttggcctttccagcacatcaagcaattgacctcaaggggccagagaacaaagccacatcctggtccaagccatccagggttagagcaggaagcccaggagtgctgagcttagctttagtcccctgaaagcataaagaaagaaagccaattgactaaacccaatttgtaccacaggaaaaaaaaaaaaaccctcaagggcaccaaacaatataaaagcacaaatccccatccaaaggaaagaaacttcaaagattaaaagaacattagcccccacagctgagaaagaaccagcacaagaattctggtgactataaaacccagagtgtctttttacttctaaatgactgcactaactccccagcaatggttctcatgcagattgaaatggctaaaatgacagacatagaatttggaatctcgatgacatgtaacctcaggaagatacaggagaaggttgaaaccaaatccaaagaaagcagcaaaacaatccaatatttgaaagatggtacagctattttaagacagaaccaaactgaacctctggaaataaaaagttcactacagcaatttcagaatatgattggaaacaataataaagcattaataatagaatggaccaagctgaggaaagaacctccagggcttgaagactgtaccttctaattaatgcaggccgaaaaaaataaagaaaaaataattaagaaaatgaacaaaacttttgataaatatgagattatgtaaagagaccaagtctatgactcattggcattcctgaaagagttggagggagagcaaaaaatttggaaaatatatttgagaatattgtctatgaaaatttctccaacttgctagagggggtgacatgacaatttaggaaactcagagaaccccagacagagaatatataagatgactatcgccaagatatatagtcatcagattcttctaggttaacatgaaagaaaaaaaatattaaaggaagctatacagaggggaaggcaacataaaaagggaacccaattaggctaacagtggacatttcagcagaaactttacaggccagaacaaactgaggtcctatatacagcatacttaaagaaaagaaattccatctaaaaatttcatatccagccaaactaagcttcataagtgaaggatgaataaaatctttttcaaataaacaaatgttaagggaaattgtaaccaccagacctgccttacaaaaggtccatcagggagtggcaaacatgtaaagaaaagaatacctgctaatacaagaatgcacataagtacatactgcactgacactacaaaggaactatacaattcactctacattaataaacagctaacaacactgtgatgacataaaaccctcacatatcaatattgaccttggatgtaaatgggctaaacacagaatggcaagttggataaagaagcaagacctaatggtatgctatcttcaacagaaccatctaacatgcaatgaaacccataggctctaagtaaaggaatgaagaaatatctatcaaggaaatgaaaaacagaagaggcaaagggtcctattcttattacagacagaacagtctttaaacctacaattattaaaaaaaagatgaagaagtacattacataatgataaaagattcaattcagcaagaagacttaactatctgtaatagtctgttcttgcactgctataaagaaatacctgaaactgggtaatttataaagaaaagaggtttaattggctcatggttccacaggctatacaggaagcacggctgggagggcccaggaaactttcaatcatgatggaaggggaagtaggcacttcctcacatggccagaggaggagagagagtgaaggggtaagtactacacacttttaaacaaccagatctcatgagaacttactcactatcactagaacagcaagggagaaatccgctcccatgatccaatcaccttccaccaggcccctcctccaatattggggattacaattcaacatgaaatttgggtggggacaagaatccaaaccatatcactattctaagtatgtaagcagccaacaatggagcatctagattaataaaacaagtacttagaaacctctgaagagacttagataaacatacaatgataataggagacttcaataccccaatgacagtattagacagatcactgaggtagaaaactagcaaagatatttgggttctagagtcaacacttgaccaaatgcacctaacagacatctacagaacactccacacaataacaatggaaaatgcatccttctcatctgaacacagaatgtactctaagatcaaccacatgctcagctataaagcaattctcaacaaattcaaaaaaagcaaaattataccaactgccctctcagacaatagtgcaacaaaaatagaaatcaataccaagaacatctcttaaaaccataaaactatatggaaattaaacaacttgctcctgaatgacctttgaataaacaataaaatttaggcagaaataaaaaaaattatttgaaactaaggaaaacaaagatacaatatgccagaatctctgggacacagctaaagcattgttaagaggaaggttcataggactacatgcatcaatcaataagttagaaagatctcaaattaactatctagcattacaccaagaggaagtaggaaaaaaagatcaaaccaacctgaaagctagcagaagtaaagaaataaccaaattagagctgaccagaatgacattgagatgtgaaaattcacacaaaagaaaaactacggaaagcagtttggtgatttctcaaagaacttagaactaacatttgacccagaaatcccattactgggtatacacacaaagcaacataaatctttctaccaaaaagacacatgcgcacatatgttcattgcagcagtattcactacagcaaagaaatggaatcagcccagatgcccaacaccagtgcactggataaagaaaagatgatacatatacagcatggaatactatgcagccattaaagaaaaacaaaacaacattctttgcaacaacattaaagcagttggaggtcattatattaagcaaataaccacagaaacagaaaatcaaataccacatgttttcacttataagtgggagctaaacattgagttcacaaggacacaaagatgggaacaataaaaacaagggcctacttgaagggggagggaggagggcaaaggtcaaataactatctattgggtactgcactcactaccttggtgacaaggttatttgttcaccaaaccacagtgacatgcaatttacccatgtaataaacctgtacatgtatcccatgaacctaaaagttgagaatagaaaaaaacaaaaacatattaacccccaaatgatttactgtcacttaggagaggacaggggtctaggatatgatgattcaccaaaggttccatagtcaggcccggtggttcacaggtgtaaccccagcactttgggaggctgaggtgagcagatcacttgaggtcaggagttcaagaccagcctggccaatgtggtgaaaccctgtctctactgaaaatacaaaaattagctgggtatggtggtgcacgcctgtaattccagccattcaggaagatgaggcagaagaatcacttgaacccaggcaagagaggttgctgagatcatgccactgcactccagcctgggcaacagaagtgagactccatctcacttggaaccaactcaaatgcccatcaatgatagactggataaagaaaatgtggcacatatacaccatggaatactatgcggccataaaaaagaatgagttcatgtcctttgcagggacatagatgaagctggaaaccatcattctcaggaaactaacacaggaacagaaaaccaaacaccacatgttctcactcataagtgggagctgaacgatgagaatacatggacacagggaggggaacatcacacaatggggcctgtcagggggtgggaggcaagggaagggatagcattaggagaaatacctaatgtagatgagttgatggtacagcaaactaccatggcgcatgtatacctatgtaacaaatttgcatgttctgcacatgtatcccagaaattaaagtataataataaaaaaaaaaaaggttccacaaggtacaagcaagggtgatcataatggaacactttcacgttggatatccaaaggtataggaataaaaaagatttgagaatattgggaaataaaaaaaagatgatattcagaacagactaaattatctctctaatttggcataaacagtctgcaaaacaagggtgttttgttaattcacaacttgtaaaataaacaccacattattccatctaaagtgataattgatttccacagtgttaaaccaacaactttgaaaagaatttcatagtccagtctgatgccagaatccttatgcttctttctactttttgatcagtgtatattttgtaaacatacacaatgacaaatgacagcaaagatcactattttacattctcccttctactcttctacttctccatttttaatttgttctttaatatgaagttcttaaactcattatttaaagatatccaatgctatgaaaatttgatgtgtataattctccatgattatacatataaaagtatataattatatatgatttgttttatttgatttttaaataagtaatattctatacatattagtctatggcttggtttttaatgtgttatgataattcccccaagggtaagaaaatacttgtattttccaatttttgcatgcatgcatgcatatccatctgtaattataaatgaatcagtgtaaataacacatgctagattgctcttcttaatataatatgttagctgttcttttttccttcttttctcctgtttttccttttcctcctccttctcctcccctttcctctcttcctcctctgtctttatcttctttgatcagaccactcccttcttctggctaacaagtgtggaatgagaatgcttaaattcaaacatttggtcaagcagatatgttgcctagagcaagataacatttcctcacttgtaaaatgaggataagcataggccctacatttgaggttttggtattagaatatatattcatatacaaaaatgtttaatataatgcttggcacataaagagactataatcagtgtaagcagttattaactaccctgcttatctttccagccattctatttatatttttcacttgtttcgcagtgtttcagttataacagccttttctctcttccttaaataggccaaactttctcttgccttagggcttttgcactggttgtttcacccttaggtattttactatgaacttacttacgcatctttttctgcttctttttgccctctaaagtactatatataagttctataaaagttggaatctggtttgttgtgttctacactgtgtctctacagcctaatatcatgcatgacacagagtttatggtttaacatgtacttgttggatgactgtaaaattccatttgatatttagtatcagagtaacccataaagataggtattatttcctcaattttataaataataaaagtacaacaatgaggcttaatgctttattgatagttaagctgttgaattgggcttgaatgcagtttccttttctgtgtgttgtattctttccactgtttcctatgtgttatgcatttttaaaatacacagaaaattagctttatgagattgtaaatctcttcgaatcatgcattttactgtctctatgtaaaaattataagctcacaataagtacataatatgcattttttattactaatgattttcttcccttcatgggtttatgctttttctaaatgtaaaatatttgtctaatacatatatgtaaaatacatagtatgtgtaaaatatccttttctaagcttgctataaaatcttacttgtttatttaggtgttgatagttaaaattaatttggcaataggtatgcaggggatgtctctgaaacccttggaagacattgatggtttctgaacttcaactggtgtagcagattgaaggcaaatcccaggccaaatatacatatatatgtgtgtgtgtgtgtgtgtgtgtgtgtgtgtgtgtgtgtgattatatatatttatatataatatataaaatattatataatatatacatgttttatattatatatatataaggcataagacaacacagagagaatatgtttaatacgacagcaatttagaagtaggaaacagtcattgcttgtgaaataagggaggctatggtagttgctgtgctgagcaataatgaccaagtgaacataagtgggatattgcagccagaaataggaacaaaaacagaatagatagaatatttaaaaaaaaaacttgaaagctactgcttagaatgggcttgactcacatagctgtactgaggtgaaactaaaccaagagatctttggaaattttctcccgagacatacaagaatttacctagcaatatacagtatgcaccctttaaatcatcaggctggcaaaatcatggtttgtgtaatacttgacattgaaagttaaccccttcttttatttataattagagacaaatgaagaactatgtagaatgtgaggcaacaagaggtgtttagattgttctttcaacacttaaagacctggaatgtctggtcctttttctccacttttactgtaataaaggcagtccaaattctcatcatttaacccctgaatgaaaacaggatcccaacaacttgttcccctgatgcctgaggccaatgcacagtgtccggaattttcctcttaaatgtgaactgaccgtggtggtccaatcctaaaatctcacttcaggctcctagtgaagaactgttagttcttagctaacatcacgtttctcttggacagctcacatattcatagttgtcttctaatcttaaaatacacataaattcactcagcaagcttgtaaaaatgtacatatttggacctcaaattcaaagattctaattccatatttcttggatgtgacttggcaatttacttctaaacacatgctccagcaagtgaaataaatgactatataggcatgaagaactacttagatgccctaaacaccctgctattttacaactatttgccaagaacatcttccctgccaacttggtctttttgtcttggaaaattgctacaaattcctcacaaccctgttcaggtattgttcaggtactgatcacttctccaagctttccattattcctccttccctccactagatggttaatagattccttctctatatcaattctgtgccttgcagatacttattttactgcctattttatattttggctttattgtcatcttcacaaataaagcgtaacctcttgaagggttgaaaattacttttggtattagtggttagcaaactacttggcacatgttaatgaagaattaataattgctgaatttagcatttttacactgaccctaagagtaaggaccaagttctggttctatcacttttgttcagctaattatatgtagagatacagatatacatatacatatatacatatataaatttgaacacagggttctcctaacacacatcttaataggtacagaggagaaagatcttggatgtttgaaaaggtagagttgccattttctctctgtactctctctgtacatgatttttggattgagaatatatctagaatgtcaccaacaataaataaactatgctgggaaaatcatttataatagacagatttataatgtcaattattaacatactgcagactttttcaaataggggagttcacttggaaatttaaaaaatgccagctggtcggttctgagatcacagaaatgaagattcctttgcaataaaaagaatcactttgtttttttgtttttttcctaaatctccacttctgcttatagtgactgtacccaaatcaaggagttataaatattaatctggtaacttcaaattgagaattcatagccactaaaatgggttgccttaagaaaaatcttttttccatcatccaaggtcatatgcctcttatcaaaggaactacacatatattacaaagttattttcagtttttctcatgaatttctatgtatacacaggtctctgtatgtagctaataacatacttagggcaaaatgaaagaaaggaaggcaatatttcccatgctcctaagttaaaaaccctatttgtctgtgtgtaatatggaaatatttacatattatctgtacagatttgatcatatgccaaaacatgtcccccttcaagttctatctgctttggacatccaaatacaattcaaataactttcaacagttttacatgtaatgaattctcagcaaattaacacaagaaaataaaaccaaacaccgcatgttctcactcataagtgggagttgaacaatgagaacacatggaaacagggaggggaacatcacacactggggcctgtcggggggtcgggggctagggaagggataccgttaggagaaatacctaatgtagatgacgggtcgatgggagcagcaaaccaccatagcacgtgtatacctgtgcaacaaaactgcacgttctgcacgtgtaccccagaacttaaagtataataatgaaaaaaagaccaaagacgttttgtgtgtttaaattattcttaaagctgtataaaattagcttgtgaaagttgatctaactaagatacaacaaataaaatgatcagtgatatggtagatctctcttcctatagagtagcgatattatttaacatgatcattgtttagttataacaattacttaaaaagaaaattttgactcccatttggtataatttttctggaattcggtattaaagtgtaactcatattgttagatatttttcaccttgcattgtccatcacagtatctactgtatcaaatgcacagttcatgaatcagatcagctcttttatatatctgatatatcatagtttattaaacttgaaatttttgcgtggaaaatatcacatctgagccacttggaactttggagtatagtgaaactccaacacactgattttttttctcaatccaaataaagcatattggaaatatgtatacttgcttaaaaatcgtttctatatagtcagtatttaggtggataattcaaaagtactctacctaatataatgtgaatactaaggactaaaaaatatgattaaatttggaatctcaattttagagtttttgagatgagtttttttttgagaaattaacattaaatcattttcatgttttataaaaatggaacaaagtattctaaaatgtaaagaatgcttgtcctaatacctagtaagtaatccttaacatagagcttgaatcatgtaataaattgccattgttctgccctaaattttcaatgttaaaggttaacacttttgggtctaatagaataacaaagcagaaggactcctaagacattcttcagttgactaaactgtgagttggtactgaattgcctacaaaaactggactgaaaaaacagtgtttgcatttcagtaaggtgaatgtaagaaagccaattattaactcattagtattccgcagctttactttcaaagggtaggagacaaaaaaatgaaagaagaatgtatatataattttctgtgtttattctattgactgtgtgaaggtaccaggacagaataacatttggaaaaaaacaaatatgtattcataaattcaggagacagattctttttatgggcaaaacatgatttttttttgatcaactgattcaaaaaaataataatatgcaaagcaatggttatttccatataaccttaggctttttcttaataacaacacaattctaatttttgcctttaggattcctttaataattacatggctaataaactattgcttttcctcatgcatatataaatactgacttgttccttatgagaacattccagggtattattagaagcatttgtcttgcactttactctacgcaagcactttaatgatctcacattgtttggaaatcccaatgagcttttgaggtaagtctcctagccttatcattttacagattttcatttaaataataataatacttttattcctgcatagagtattatgtaatatatttaatacatatataatttatacaaaaatatacatgctatatatatatatgcacatctcatatgcatgctttttaatgcctttacattttttccttagtgttttattttataatcagtgctttataaaaggatgcattccttttgaaaactatgcttccttcagctactaggaacacagtatggtatatggaaagaaaaaatgaaaacctctgacaacacttgcagctaatatttattagattctttttgcttcataaagtgcataacaaatttgcatgcattttactcatatgatctctcacatcaagcggtaatggtggatatgtttgttattgctcctatttaacagatgagagtactgaaatataaaaaggtaagtaagtttcccaagcaactaagcaagtataagtcaagatctgaaacataacaatgtgtctgtggaatctgatttttaaatactgttaatcactttaacagcactaatttggcaataacttatttcaaaagctgcttcctttctctaagcctcaatttcttcatattaaaatttcagtatgaatattgcaacttttaggatactcatagcacaaatattatgtttaaattagtgattatcttagtactgagagtaatggtgccaataataatagtttccatttactaagtctctactgtataccagaagcactgtgaacattacttcctctaacctgcataacacatccccaagacgaacatttcacattttatagttagaaaaattaagaatcagagaaattaattttcccaagatcatgtaactaggacatagagtatctggagttaacatcctactgtatgtgactcaaagatatttattttcttatcaccaaacattgtaagtaatttttactgtattttacacatcaaaaaccttagccagcacactatcatacatttactgaaacagagtagatatccttatctttcacttagaggcattgcagcatggttaagggcaatgctcttgaagtcaatatagtaccatggaattaaaaacaagaaaaaaactgggcaagcctcagtcatactctactacagatgctctttgacttatgatgagattatattcaataaacccatcataagttaaaataccctaagcctaagatggatttcatctacccaacctactaaatgtcatagcataacatagcctaccttaaatgtgctcagaccacttatattggtctacatttgggcaaaatcaaatgcttatttcataattaagtgttgaatatctgatgtgattcattgaatatggcactgaagtgaaaaacagaatggttataggggtgttcatcatttatgtacataactgaaagcacagtggacataaagagtgtttgaagcattgaactaaaattaatcgccggatgatggagatgctacagcaacagagtcaccaatttctccttcttctgatgaggttcaaaaatagctggtacaggttgagtaacccttacctgaaatgcttgggaaaagaagtgtttcagatttcagatttttttgaatattggaatatttgtattacataatgagatatcatggaaaggggacccatgtcaaaatgcaaaagtcatttacatttcacgtatacacacatagcctaaaggtaattttaaatgatattttaaataattttgtgatatttttacatgaggtcgtatgttgaattttcttcctgtgacatcatgttggtgctcaaaaattttcagattttagagaatttcagatttcaaattttcagattagggatgttccacctgtagaagaaactggttattgacacttattgatggtctagagtttgatatggtttctctgtgtccccaccgaaacctcatcttgaattgtagctcccataatttccacgtgttgtgggagggacccagtgggagataattgaatcatgggggtggtttcccccatactgttctcgtggtagtgaataagtctcttgagatctgatggttttataagggtttcccctttcacttggctctcattttctctcttgtctgccaccatgaaagatgtgctttttgtcttccaccatgattgtgaggcctccccagctatgtggatctgtgagtccattaaacctctttttctgaattcacagtgttctttggaaagatagcaagtattgattgtacagcttatttcttattattacatatctttctgtaacaagcaagagcactgtgtctctgcctgtcagttctcatgagtctctcctaatcgacgtgccatttctttaacatctgtatgccactgctgaatgcagcaaaggcctccacaggtttctttgctgtacactttcttggttcctccggtttaacttcttcctctgcctcaacttctttacttctttcttcctacagtttgatcacttgaaaactcagtgccaacaaacccatgaatatcctcttcatcaatacccaattttagctgtttctcaagtgctaataacttgttacctactattcatcaacagcagagtctttgttaaagcttttgaatgtgttcacatatgtcttcgaaactttcttccacatgccgatcatgcactgctgtgtgacttcttcccatgctgttgcgatgttctggatggcacttaggatgtaaaaacttttccaaaactcttggagaagtcagccagactcagtcacttcactaatctacacaaatccttggcataaatatactttgaagggagctattgctccttgttccattggttgaatgaatgtggttttgttcagtttcaaatacacagtcaaaaaaattgcttttatttctgtttgtttattcacttttcctgattgtctttatgcagagccctaaagaagttagtggtaaagccaaacccttgacatcagcagaactttgagcagcatatttggttcttcatttctcctgaaaagagtgatagccaaagaacatatctaccctgatgccctgggaaaagttaatagtttggctgacagtacttgaacataattggagcatcggtgacagggaggactgaagaagatttatgtgattaattctctctacttgggtacagagcttaaacacatttgtgtcacatataggtgctaaccaaagagtaacttcagcagatggataagtgaaaccatttgtaggagatcaagtgggtccccttagtactcccttgtgttgtgatcaaagttattggaaaactacaatggactaacacaggaagaactactaatggccaaggctcttcaggaacaaaatttcaggtcattgtttcagacaaaaggacctgatgatctggttaaaataaaagtaataatgaaataggtagtacaagaaggaagctataaacaagctatgaccatgtgaccaattgcaaacataagaattgcgataattatgaaaagttctttcttattttggtgtgaatgtatttcaaaaagattaaccaaagtttcccttttttccacgtctcctgccatctaacataaaaatgtgataatagtaattaactttatgtcaccgtatttaactcatatgatactaaagagggagaagtgtatcagaagtggaatgaacatcgaccactggtgaacaaatgacttttgtgagtttgtatccactttcagagtgatggttagcgtgctttcagttggtagaagtatagatgcgtcaccttggaaagaagcatgattttaccgttacctttatttggaatgtaaacgtgatttaaaatggaatacattgatgtcaatttgagaggtaaactttagtgaaaccatatttttaagaataatttttttcctgttaaaattgctgcagcacccattgtacctcgtgtgggtaccctgttctgctcttgcatgctgttgctgatctgctgactttccttgtcagtatgaagtagttagtagcatacaggttaaaggtggtaacagatatgggttacaattattgtccccatggactctaatttggcttcatggatatcagtttgccctcactctcctctgattcacactaacttttccttcccagctgccagcctaggtgacctgcagattcttcacgcctaccaccagaaacagagagaatagcacttcacagattgctacaacagatcccagttttatagagtttattttttacagaaaatcttgattcatattgattattgtgttgtttgtttccatattaagtctcaactgatgtcttcagtttatgtgatatatcatacggtcactttatggataatgcatttgggtgatcacattaaatttggaaaatagtctttgaactcctggaattttaactcttagtctcaaaccaaacacatatctagtctaactttctaaaatatgactgaaatagatttatatagctactatatttttagtttcaaattttctctatacatttttaatagcattgtttaatacaagtccctggatatgttttctatgacctcaaaatgttttgaaattttgggtcaaataaggtatgtgagtgcttatttttttttctttgggggagtgttttcaaatgaactttgaagcccagttggacactaaccaaacatttaagaaaacataccataacccttgattttataaaagaactaatacctgctaatccagctcaataatgaaaacccagagatttcatctttcaaattccaagttgacatttggtgttgttatttataatgtcaaaagccagcaatttatttcttaagagaaaattcaaaacaccccttctagggttcttgacctccggatatctttctgtccaccaagatgtctaataaaacataaagtttccatgatataaatttaatatggattactgaaatttgagtaagagttcttattaaatttaaaagtacagagtattctttcttcactagtgtagatgcaggtatggtttcaggaaacctatcatagcttgaatattttaaaactctattgatttttgaacatggtatagacatttctggcattgtgtgtgtgtgtgtgtgtgtgtgtgtgtgtgtgtgtgtgtgtattattgggggatgatgcgtatatgtctaccaattaactgtacatacaataatatcttgctatcctacaaaaatggcattacatttcattttaattttttaatgaagaaagggttatcaaaatttagttactacttctgaaaatttaatcttaattttaaactagaaatgtcaaatggcaaatgggttttttcctcatttcatgaactgcaaactcacataacatattgatgtttgttaaatcatttgcagtttcttagaggttttaaataaaaatatttactcatgcagaatagttattttttaaaattactaacacgtagaatagacagcaaattattaatgaaagtataatttgactttccattattttctttaattcaaaatattatattctgtctaattatactctttaaaaatgtcatttcatgatgcacgtgtctactttatctaacttcccttaaagcctaaaagacctaagtgaagattttaccatcaaaagttaaaaactaaagcgagccattttccaagaattagacagtatttttacacagccattaaatcataccacatgacaaggctgataaacttcatctgtcatatgaaattatctaatacccctaaaataaaatataattttataaatttacctggttatctgaataatcagatttttcattttatgaaatattcttaaatgtacaaaacattttaaaaatatgaatacataaaatatgtatattttatactttaatttgtgatagtatgggttttaaaatattttagtgttagatttctttttctttgatttggccaaatattccatttcatttatttttgtttatttatttatttatttatttatttatttatttatgagacacagtctcactctgtcacctgggctggagtgcagtggtgcaatctcggctcactgcaaactctgcctcctgggtttaagtgattctcatgcctcggcctcccaagtagctgagattacaggtgcacgcccccatgcctggctaaaataatattcagtctaattttatatgtctacacacaaacacaccagtattccctcacattagaatattgttatattattttctattatttcaaaaacatcttattgaacacaaaacaaaatttttgtcatcattgtagacatgacaatgcaagcaaaaacatacttgaaattaaaaagaatcacactatgtatttttatacatgcaaggtgaattttgattaaagattaattatgttaaaaaatcttaatcatattaatactccaaactatcctaaataggcaggtaagtctcatttaagtctgatgcagctgttatttgtgaaactcatgttaatgttaatggttcactttctcaaaaaacagtatttgaaatgcctactatgtacctggagaaattcttggattacagcaatgaatcaaaaaagatagtctttgccctcacagaaattgcatgtaatataatgatccaaatattctctattctgagataaaaggtgctgacagttgtttgcagaaaaatattagccacaggcttgcatgtttaccttccatctgtcttctccctagagcatggcttcgtattcacaggcttacaaaattctgtctttttatatagggaattcttcttgttttctaaccactttgttaacatgaaaacaattatgtgctttactcatgtaataagatttacagaggatatttcttttacatattgttaaaatgttagtgctatctctgaacaactatatcacagaatgaagaaggcacatctttgtgtagtcttaattttaactaatagtcaataattgaaaaacccagaaataaattaatctctgattccttctaaagaaaacatatatataattataataatgttcacacagcttcctatcagtgttttacttgccaacaataataaagactttatacaaaatagtgatttttaatcagataaatatataaagttagcaatttaggattatgtgaaaggataataattatctgttaattttaaattgctggtattttagtcaactgaaaatctatcatgaatattagctgatttacctctcctgaaaaaaaaaatgaaagcaaggagtagcacacagttagtttttttaaaaaagtatgaacaagtatgaataaaaattatattttgtgagatttagctggaattttgaaattggctgaaataaaattgaaataattgcttttctcctgggattcaaaatagacttcaaaaaaaaaaaaaaaacagttttaactgaaacaaatctattcattgtgaaacattatttcaaatccatcagggtccaaggtgttaaaagaatattcaaataatacaaataaaacatttacttagcaaaactttcatacttgctatgcaatacagaatggaaattctaatagaggtatcaatggttcatcagtaacagaaaaacaaagaaaacatttgttataatagtgttccataaaacttactcatcgaaaagaaattttagactgattgtttctaagatttggtaaagtctcaagtgtagcatgaaaattaatcacttgggggatggagccaagatggccgagtaggaatagctctggtttacagttcccagcgtgagtgacgcagaagacaggtgatttctgcatttccatctgaggtaccgggttcatctcactagggagtgccagacagtgggtgcaggacagtgggtgcagcgcaccgtgcaccagccaaagcagggagaggcattgcttcactcaggaaactcaaggggtcagggaattccctttcctagtcaaagaaaggggtgacagatggcacctggaaaatcgggtcactcccaccttaatactgcacttttccaacgggcttaaaaaacggcacaccaggagattatatcccgcacatggctcggagggtcctatgcccatggagtctcgctgattgctagcacagcagtctgagatcaaactgtaaggcggcagacaggctgggggaggggcgctggccattgccgagttagttgtttgattaggtaaacaaagcagccaggaaactggaactcggtggagcccaccacagctcaaggaggcctgcggcctctgtaggctccacctctgggggcagggcacagacaaacaaaaagacagcagtaacctctgcagacttaaacgtccttgtctgacacctttgaagagagtagtggttctcccagcacgcagctggagatctgagaatgggcagactgcctccttaagtgggtccctgacctgcgagcagcctaactgggaggcatcccccagtaggggcagactgacacctcacacggtcgggtactcctctgagacaaaacttccagaggacccatcaggcagcagcatttgcagttcatgaaaatctgctgttctacagccaccgctgttctgcagccactgctgctgatacccaggcaaacagggtctggaggggacctctagcaaactccaacagacctgcagctgagggtcctaactgttagaaggaaaactaacaaacagaaaggacatccacaccaaaaatccatccgtacatcaccatcatcaaagaccaaaagcagacaaaaccacaaagatggggaaaaaacagagcagaaaaactggaaactctaaaaagcagagcgcctctcctcctccaaaggaatgcagttcctcaccagcaacggaacaaagctggatggagaatgctttgacgagctgagagaagaaggcttcagatgatcaaactactctgagctgacggagaatgactttgacgagttgagagaagaaggcttcagatgatcaactacgctgagctacaggaggaaattcaaaccaatggcaaacaagttaaaaactttgaaaaaaaaaattagatgaatgtataactagaataacaaatgcagagaagtgcttaaaggagctgatggagctgaaagccaaggctcgagaactacgtgaagaatgcagaagcctcaggagccgatgagatcaactggaagaaagggtatcagtgatggaagatgaaatgaatgaaatgaagcaagaagggaagtttagagaaaaaagaataaaaagaaacgaacaaagcctccaagaaatatgggactatgtgaaaagaccaaatctacgtctgactggtgtacctgaaagtgacggggagaatggaaccaagttggaaaacactctgcaggatattatccaggagaacttccccaacctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaagattgggttacccacaaagggaagctcatcagagtaacagcagatctctcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccccaaaagagctcctgaaggaagcactaaacatggaaaggaacaacaggtaccagccactgcaaaaacaggccaaattgtaaagacgatcaaggctaggaagaaactgcatgaactaacgagcaaaataaccagctaacatcataatgacatgatcaaattcacacataacaatattaactttaaatataaatgggctaaatgctccaattaaaagacacagactggcaaattggataaagagtcaagacccatcagtgtgctatattcaggaaacccatctcatgtgcagagacacacataggctcaaaataaagggatggaggaagatctaccaagcaaaaggaaaacaaaaaacggcaggagttgcaatcctagtctctgataaaacagactttaaaccaacaaacatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaattgaactcatctctgcaccaagaggacctaatagacatctacagaactcttcaccccaaatcaacagaatatacatttttttcagcaccacaccacacctattccaaaattgaccacatagttggaagtaaagcactccccagcagatgtaaaagaacagaaattataacaaattgtctctcagaccacagtgcaatcaaactagaactcaagattaagaaactcactcaaaaccactcgactacatggaaactgaacaacctgctcctgaatgactactgggtacataatgaaatgaaggcagaaataaagatgttctttcaaaacaacgagaacaaagacgcaatataccagaatctctgggacacattcaaagcagtgtgtagagggaaatttatagcaccaaatgcccaaaagagaaagcaggaaagatccaaaattgacaccctaacatcacaattaaaagaactagaaaagcaagagcaaacacattcaaaagctagcagaaggcaagaaataactaaaatcagtgcagaactgaaggaaatagagacacaaaaaacccttcaaaaaattgatgaatccaagagctggttttttgaaaagatcaacaaaattgatagaccgctagcaagactaataaagaaaaaaagagagaagaatcaaatagacgcaataaaaatgataaaggggatatcaccaccgatcccacagaaatacaaactaccatcagagaatactacaaacacctctacgcaaataaactggaaaatctagaagaaatggataaattcctcaacacatacacccccccaagactaaaccaggaagaagttgaatctctgaatagaccaataacaggagctgaaattgtggcaataatcaatagcttaccaaccaaaaagagtccaggacaagacggattcacagccgaattctaccagaggtacaaggaggagctggtaccattccttctgaaattattccaatcaatagaaaaagagggaatcctccctaactcattttatgaggccagcatcatcctgataccaaagcctggcagagacgcaaccaaaaaagagaattttagaccaatatccttgatgaacattgatgcagaaatcctcaataaaatactggcaaaccaaatccagcagcacatcaaaaagcttatgcaccatgatcaagtgggcttcatccctgggatgcaaggctggttcaatatatgcaaatcaataaatgtaatccagcatataaacagatccaaagacaaaaatcacatgattatctcaatagatgcagaaaaggcctttgacaaaattcaacaatccttcatgctaaaaactctcaataaattaggtattgatgggacttatctcaaaataataagcgctatctatgacaaacccacagccaacatcatactgaatgggcaaaaactggaagcattccctttgaaaactggcacaagacagggatgccctctctcaccactcctattcaacatagtgttggaagttctggccagggcaatgaggcaggagaagaaaacaaagggtattcaattaggaaaagaggaagtcaaattgtccctgtttgcagatgacatgattgtatatttagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctagaaatctgacttacaagggacgtgaaggacctcttcaaggagaactacaaaccactgctcaatgaaataaaagaggatacaaacaaatggaagaacattccatgctcatggataggaagaatcaatattgtgaaaatggccatactgcccaaggtaatttatagattcaatgccatccccatcaagctatcaaggactttcttcacagaattggaaaaacctcctttaaagttcatatggaaccaaaaaagagcccgcatcaccaagtcaatcctaagccaaaacaacaaagctggaggcatcacgctacctgacttcaaactatgctgcaaggctacagtaaccaaaacagcatagtactggtaccaaaacagagatatagatcaatggaacagaacagagccctcagaaataaggccgcatatctacaactatctgatctttgacaaacctgacaaaaacaagtaatggggaaaggattccctatttaataaatggtgctggtacaactggctagccatatgtagaaagctgaaactggatcccttccttacaccttatacaaaaattaattcaagatggattaaagacttatatgttacacttaaagccataaaaaccctagaagaaaacctaggcaataccattcaggacatagtcatgggcaaggactttatgtctaaaacaccaaaagcaatggcaacaaaagccaaaattgacaaataggatctaattaaactaaagagcttctgcaaagcaaaagaaactaccatcagagtgaccaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggatataaacagacacttctcaaaagaagacatttatgcagccaaaaaacacatgaaaaaatgctcatcatcactggccatcagagaaatgcaaatcaaaaccacaatgagataccatctcacaccagttagaatagcaatcattaaaaagtcaggaaacaacaggtgctggagaggatgtggagaaacaggaacacttttacactgttggtgggactgtcaactagttcaaccattgtggaagtcagtgtggcgattcctcagggatctagaactagatataccatttgacccagccatcccattactggatatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacacggatgaaacgaaaacatcattctcagcaaactatcgcaaggacaaaaaaacaaacaccgcatgttctcactcataggtgggaattgaacaatgagaacacatggacacaggaaggggaacatcacattctggggactgttgtggggtggggggaggggggagggatagtattaggagatatacctaatgctaaatgatgagttaatgggtgcagtacaccaacatggcacatgtatacatatgtaacaaacctgcacattgtgcacatgtaccctaaaacttaaagcataataataataaaacaaaatagaaaattaatcacttactgtttttaagtcatttataatatttactctgactgttgtcaataagatccctcatatctctaaataaacccttttaaagatactgaataaactccttagagaatactgatgggatgctatttgctattttctcacaaataatgctcactccttgcctgtcccgaagtattaagataaaaccaagcacattaatcaattttcaccaaaatatattcaataaagaagatcattttatcaagcaaagtaaatatatttgtaaggatttatctgaaatgtgaagctgctactattgaatcttccctctttattaatgattttttaaaagagaatgtaatataacaaaaatcacttattaattttgatggtaccacactatgaaattttctgacactaagtattactttccaatagaaatcatcacattcatattgacctttggtatgactgtaataatcctctactttgtgttaaatgaggcagtgataccactgagccaaattgaatgacttaatgcattttctgattttttctgagtaaaatatatttttaaataataaagttggccgggcgtggtggctcatgcctgtaatcccagcactttgggaggccgaggcgggtggatcacgaggtcaggagatcgagaccaccctggctaacacggtggaaccccatctctactaaagtacaaaaaattagccaggcatggtggtgggtgcatgtggtcctagctactcgggaggctgaggcaggagaatggcgtgaacctgggaggctgagcttgcagtgagccaagatcacgccgctgcattccagcctgagtgacagagtgagaatccatctcaaaaaaaaaaaaaaaaaaaaaaaggaataaaattatctgtgattgtgaacaaacatctacacacagttgtgaatttgaatttttaattatgcgctgctatgacattgagtgatgaaaaaagaattattctttgtaaattatatgttactagatgaggtcaccatcaactgatttgttggcaaatcaattaaaaagtcaaaaacatttttgactaatctacatacattcaatcaacatccatcttctctatttcaatcacatatgctctttctcatcttctccagctatcttcttgccatttcttaaacttatcagcatattcatcttcagagtctttgaatttattcctctgtctataatgtaaattccctggatgaatgcatggctcacatcttcagtcttaactttatgcagttttgctctaatgtaatttcctcaaagaaacaagtcgtctatctgaaacagcatcactgcctcctcagttgttaatcacaccttggtttcttgctctgtttcgtttttactccctgtctctatctccatgtggaaagtggttttgcctgttttcttctctgatgcatcgccagtaccagaacagattctcacacaatatagagtgtcaataatcataccttgaagaaataactaagcaaacaaatgattaatgaaatgactgattgaacaacaaaattatgtattgggcatgtgttcaagattgtttgtaacagggaaggagagaattgcaagcaggtggtctttacttacattctatttcagctgttttgttgtaaaaatgaagacaaatttgggagaataattttaatactaaactttgactaggaactattgtctttcttactcaaaaccaacttaagaagcaacactctcaaccacacccaggtctgacaactcaaagcactgctctgtaaaattgtaaattttcaaaagcaaacacacaaatgacagtaaaagcaatatcatagtttccaatgtgtcctgaggtacatgaaaagagcttagtgctaaccaggtcagcatttttggaatgagaaccaaggattactgtatgacaaaatggagaatctagaaagcaaaaacttggatcaataataaacaaaatcttgattcttgacatcaatggcaagttgctttggtggattttttaaaaaagcactcaatatattagtatatatctacattttgttgaataaacccatttgaatttaaccaaaagtagtgtactttaacagtgcgtagattataacaatttcataaaaattttatattgagtatacttaacagattcatttctattcatactgaaaagtaattatacattctttgcttaaactacactacctgatataaatataaaataaatgctcattttagtatatatgtcaaatttgtatgaagtagtcatagatgaagggatagcaagtactttcatgttctttaaatcacatgacatacttacatttagttgaattacataagtaattcaatttaggaatacttggcatttgaatatttgttttgaaaactgctgtaggaaatattttaagtccaaaatattttcaagatagtttttgaattactatttatatctagcaattgctaagaaactttatactgttgattactgcactctattcaaaagtgaaggtagtgatcagattttcagtgtcttaacagggaagaaactcacagtccaattgtctcagcaacacaaatccgaagtctaacagtcaatatttgatcataaggaatggaagaaatgaaataactgtttacggcaaaaggaaatttagagaagaaaggccttaaagacagggaatggtaaaatctaagacctcaagagagcccgtgtaaggaagagaggatggagaaatactgcttaggaaagttctgtacaaagaaaatcttcatgacctttatttcaaagccagtaattgaactttggtgcttcctcccctcttacatcgataaatttccacaagcaactcactccccaaataacttttaaaaaattatacaatctaaatgtaaacttcttcattgagtccatcatggcatccttggttgatgttgctttcaaattatggagacaactcagatttacctttcatttcccaaatttactgagagtgtacaatatattttaaactttaaattcatgaagctccttcagggtgggttttctaatctctcacgtagtgatatccttttgtctctgcatctgtccatttctgtacagtcacagtggtgtgttccaaccatgacttaaaatcattttctccttctctttacgtagcagtgcctgtacacttcggcagattctgagaattagtttgaatgagtggttccaaagtatgtttaatgtcaatctatagttgctgtaaagcagccaaggactctgatgtggctggcactcagtggcaggtctttaagtagtcccagagtaactgtccccacctctcttctttcagtaaggcttcaatgctataagcaacttagagtcaagagaaactagaaaatatctgttcagaaaggtattttagacattctcacttaattaaacatagataatgtgatctgtttctctaaatccattctcccctcaaaatgaaattacatactaaatacgctctacatgctagttcaagagctttctggtggtagtcaggaactaacatatctctttgtgtgtccactttgcccctttacaacgtaagcttagtattaccagcaattgtgatgaaaataatctcttgttcagcccaagatgatgtaatgaatctgtcattaaggtgctgttgaggacaaagatcaggaattgaaagcatctaacagagcccaggatgagaaagaagtttatggatctctgcctgttaaattcataattcttccaagcatgcacatatgtataaatgcacttgacatatatattcacaaagaatatttctgtcccacaaattataaaagtctttgagagatagagacatgtgtataaataagtgttctataaatgtagctcaatgacttacataaacaattagctataatttaaaaaatgagctatttagatgctttgctttagtagtgaatgtatttagatatagagattatttagcaatagacatcagttaagtgagccacaggcaatttgacttcaagtaaatttactaatttagctgattaaagatttgttaggcctttcttttcaaagaagcttcaaagcctttaaaaatgagtgctcatcattctggtaaaataggaaacccacatgttttattactaccaattaaaagatactggaaaggagaaattaagagagtatagagcaaggctaaaaataagtatttcttttctttctttttttcagacaggatctcactctgccacccatgcttcagtgcagtggaatgatctcagcttactacaacctcccctcctggcctcccaggttcaagtgattctcgtgcctcagcctcccaagtagctgggactgtgagtgtgtgccaccacacctggctaatttttgcatttttagtagaaacagggtcttgccatgttggccaggctggccttgaactcccgagctctagcaatccagctgcctcagcctcccaaaatgctgggactacaggcatgagccacccaacatggccaaaaataattgtgtcattgggaagttttgattgcctaaagaaaaatataaaaacatttgcatggattgtttcccttagatttttaagacaaaaatgattaaagcactacattataatatctggcagaggttcatttgatcaccatatttttagaaatttaatgcaaaagagaaatgcaaaacatttactctctagatcagtatttatacttcttgtgatgacttaaataactctggcagctttctgagtagttggcagtttctacaaaatatgccaagtaaggagcacaacattagtatactatatcatgtcattttcttctaaaacacaaatattgaacttttaccacctgctactgtacagcagtgctatggcaacatcttcgtagagttcctaagctcctttgaaaagtaggatctaatcagcacaaaaggaaataaactatcatcattgctgttgctataattacctagttggcaaaataagctctatctatacagaatcacacattaaaacaaatttgcttaggaaaactaaatgttttatttcagcccagcttacattttcaaatgaattggttaacaattagaaaagaaattgttgataaaccttgcattatgtttattgaatttttatttctggttaaaaaggttaactgttttcactgtggaatatttagaaaatatagatttctttctttaaaaatagttagccataaggaagccataattcatcactgtaacagagaatcttttttcatatatcttttactttatagtattttaatattttttctctactgtagacacatttgggatttatttccaacttacataaatgcatcataataactgtaactccatatgattttattatgaataaggatagattttaaaaacataatcaaaatgttcacatttttgtaattacttaatgtggcaaatattttattaatacttaaatttgtttaatcagaggccagcagtactgtagatatttctgagtgatttcacagaatgtgtgggaatatacatctgcgtcaattctttaaatgagtaaaaggagcatctgtaatgcagcaaaatcaatcatgaagaagtaactgatgcaggaattgcctatacaggtttccaaagtacatgtacgcgtgtagattgagttacaagaaaaaggtcactttctaataaggcaactgacaattattttgtaaaaaatatgaaagtgcaagcacatactttagaacaaatattaggtacaagcttaatggaagagtctatcatgtaattagcagacaaaatgagccacagaccacatttacatacttagtttaaaatagaaacagagtcccaagagataaccattttactgctgcccagttgaggagaaaacactttcaatatttctacattaacgttcagagagtcaaggtggccgatgcagaacaaaaacactaatgataaggaaaaaaagtttttccaaagaagaacttggtatgaattagatattaattgttaattacttcagaaggcccaagtgaaaattcagacttctttctctgctcttggccttatttcatgttcccgctttctaagcacattaggttttcctattaatcagtcacaatcaccatgtctaatcggctgtggatctagatccttaccagatcccagccaatagaagttagcaatgtaaggcttattttgtggaccacttctttggaggaatacgttgtgtttctgttagatgactatacacatgatagtcaacttccagcccatatctggatgcattcttgagatgactctgaatcaaataatttcttttaaaccaaaactaaatatttatattaattgaatgagacttttataaattattccaagtaaagcatgaatttccagagactggcataatttaaacccatactggaggggaattatccatggatttgggttgaaactttcattttagtacctctactcatagtagattgagaattaaaatctgaagaaaaccctcttagataagacatttgtaaaataaaaaactcacttaccattccgactttcttcatcaatagcaactatggtagctggtggtcctcccctagctagtttgcaatctaaagagagaaaataaccaaaagtaataattgactgcaggggcacacacaatgagaaaaaaattcattgagatgtatattaatatttaaaaaggaaaatcttgcaatctaattaatatgcatcactacaattaatattatttaaaaacattttataataaccacatagattccttaccacatcataatacagtcactttgtgcatcacaaaactactcaaatcttactgagaaaacaccagcagggaccactggagagcagaagtccttcaggacagagataatgggatggaaatttaacccaaagaaataacagaaagggatgattaacaaggataaattgtaattaaagcatcacaacagaaacaaacataattggactttaattgtgataaagggtctaattagagagagtgaatagaattttaataatgttctaaagagaataaaacaaagacagacaagcaatgctcatgaggttgtttggggtttttatttttgtcatcttaccctcatattgccagtctggagtcaaaagtatagagtcatcaatggaagcagatcagaaaaatggaagaaagaaaggaagagagaatatatgtatatatttagtgagagatttaaggatataaaaagcattatacaataacattatctaatgatttgtggaaatagaatatataaaatccctatcagatttcctacttctaatataatgttaacacattcactggataatacacatcattagcattttaaaagccgttacaaaaaagactagaaaataacataaagtaaattggtatttttcttacgaaaaggtaaatacgaattacttatgaacagtctgttatctgtatgctgaaaaaactttaagaatagtgcctgtcaatcagtagtgatgattaattcattatttcaaacactgctaatatccttccaggtatcacatgataatgaacataaaaaatagtatgagctataatatccatgacagttgaaatgtgaaaactttgcctgcaggatgtcaaatgtgcacctctgagacataaagtactctactaggaaatactttgtgaggcagagagggctatgtcatgcagttatacatacatggcacactcctgtacagcagtgcaaattaattttgcttgaagttttccaaatttgtgtgttatttgggaaataatttcaaggtttatttacttattaaaattctgccatttattatgtacatatacatgaataattaggccttcaggaagcactattctgtattgtaaggtatgtacgctctcatatgaagcaaagaagctgggagatctacacattttctctctttacacttgtcaatattgaaggagttccaagtcataacattttcagatctaaaatatctcacactcattacgcctcttcctctccttatgccctcctacagagcccagcactacactatttgtcatctctgctcttgatttagtttcctcgctgatctcccagaagtcttgttctcatcctgcattcatctattcctttcatgagaatgattttcatgtacccaaatcaaaagtgaaataatagcattcctctgaacaaaaaccttacatgtttcttttggagaaaatgaaaaaaaaatcagaagaacaaagtttcttcacatggccttaacatcctttattgagaattaagcaacctgtccttcaattacatgaatcctcttactgttgctggaatgtagcctgtatttttagcaaaattttgttatctaaattcattgttgcctttttttgcctagcaaatctctgcttctttttgtagaattagatatttcacatatttgcacctagtgcgaattaattttgattaaagccttccaaattttcatgttacttgaaaaatgatttcaacatttctttatttatttactgttttataaaattcctccaattattatgtacatagaaatgaataattaggctttggaaagcactgtattgtaaggtatgcactctctcatatgtacacacacacacatatacacacactcatgtcactgtgtgccaatgccataatacctactgaaaatagataaaaattatgtattttagtgtgaatgttggtagaggaataaatatttaatcaacaactttatgggcaagcagaatatagaataataaaagaaggggaaatttggatataaatatttttgaacctttttacagtttgttactattaagtttaaaagtaggctttatgaagctaagccaaataatatcttcatattccagcccttcctcactctccgcctttcccattctcaaagttaattctccattcataccaaaccaaatttatgttttttgcatcaactgttaaaatatactttccactcttcttcccctggttaattttattcctttttcaggaatctgcctacgcatcacctcttcttgaaaatccttctcgttgtcattctagattaagtccttattctctgtattcctgcagtacacactgtatcccattggactaattgccccattggcacaatactaatgtgtctttctctctcacaagagcttcttcagaccatgcctgcatcattttcaccttggtaacctcagaacatgatactggtcctgaaagaatgtttgttgactttttccacaatgtagtctgctaagctacaatcttccattaaaacctctccatgagagcagctcagaagtctctgttctcactaacccctcaatagcagaaacagcccagaagaagctgcttaactacattttctcctgctacagtacccttagataattcccactacgatttattattttagtagattcaaaattctccccaataaaacattctttatatactacatatacttctggataaatacaaaaataatttaaacttttttaagactcaaaacacaaaatgaaaagaggttaagcagacacataataaataatctattaataacattgttcataacaaagtgtttgtttttaaacgatgcattcacgacagcataattaattagttttgaagtgcacaaaagcatttttaataagaacaattatatttagaattgtcttggaaagaaagtaatttggatgtaatagccaactatatattatgtatgaaaatatccaaatgtaaatcaaagggaagactagaaagcaatttgggggatggggagattgtaccctatggtctgtggatcatctgtctgccacaggaaagtcaggtgagctgctgatacctgtaccctggaaatggacttccttaatctatttaatttcacccttgactgtcctggttaaatcacaaattcattgtttttcatgcctaaagtttctagcctgttaggcctatactcattttccatatccaatttgtggtaaagtacaggatatgaataccaataactgaatgctcagtgtggcttatttctgcaaacttgtcacaatgctaaaaataagccatatatttaaaaatattcatatgcaatagatgggatttaaaatccaaagaggagaattaaaaagacaaataatgactgatctcacagatactaagcctgtgatactctgttgtcattgtagcctgaattttaagagcatgttacagacaggtcagacaaaggcttttgaaaatctaggattttccgaatatgctcatttcgtagaaatgagagcaagcacccaggaattcaaattctattcccactttagcctattctcaaaatgttcttttaacgttgatcaatgtgttttcaataagacttcaaaactatttactttaaaaaatatattaacatagtaattgcccttatatgttaataacttgtgtattgaatttcctacccatatttatcttctgagcctgggtcccatttgcccagacaacttctgtacttgcaatttcaaagttgtcttaaatgtagccctccaaatcgcatcccagttgctatcatagccgaaaactggatattttcaatatatattatttcagtgaatggcataattctgcaccaagccacataagtcagaaaccaggaagtcacatttcattttacccatgtttctagctttccaaaatgtaccgatcgataagtcttgaatttaattcctaaagaaaaacttgtcatatccactcactgctttcaatctgcagtggtaccaggctaatcttgtctcttacctaatcaaataggttttcctaactgctttccttacaatcaatcttgcccttactctgagttaattttctgtctttaagcagagtgatctttataattaaaaccttgcttatttttaaaagaatttaccatttattttaggttataagctaaaatattttggccatctacaactcatcacaaatatgattctagaatgtaaactaacatattttatataacctacaaagtcctccacaatatgccttctccttccctctccagtctcatctatttccatgtccctcttttcccaaagcaaaatagtttttgatcccttgactaggtaaggtttcccaatatatactctcataactctgcctcataatatcaatttatgattacttgattcttcacagaaagaaaactcagtgataacattgaccttgtttctattcctcacggttgtgtccacagggcagattttcctggcacatttttgattccaagcaattatttactgaatgcaaaaacaaagggcctcaatcaaatttgtaacaataaaattaaaacaacactctgtacattaattcccttttttctttttaatttttcaaatgtctttctcaagtgcaagtacagcaggtccttgaatgacattgtttcattcaatgtcatttcattataacaatgaaaaaaaaaaacaactaattccaggcctgagccactatctgtgtggattttgcaagttctccccaaatctgtgaggactttccctgagtactccagtctcctcccacatctcaaagatgtacatgctaggttcattggcatggctacatggtaccagtgtgagtgagtgtgggtgtgtgtgtgagttgccctgagaaggaatggtatcctgtccaaggtgggttcctgccttatgccctgaggtactgggctagcaggctccctgatgggaggccctgaactggtaaataattatctcactttttttgattaatctttcttaaatgcatgtatagctcacatttacttcaatatttaatataagaaatttttggtctttatttagaagtgtggtgatgtttttgtaaccataactatgtcataggaacttgtttatattttgtttagcctaaaataaaattggtttcattttatgtcatttcattgaaagtctcaatttccaagaacctacggacaatattaactgaagacttactgtaatgaggaaaaaattgacagataatttgttgtctaaagataaggtcattggtgacaactcagcagatgtgaaaggctaccaataaagtaagaaaggtgtagataattctgcaagaatttgaggttatttggaacaagttatgaaagattagagagagctcacaataatagacaaagtaaagtgatgaaaaaaaaggagaaaatgttcacttgcttccaaatgtctataatttctattagaattccaagatgttttatgattttaccaaactgtatcttaaaggaataaaactaagaaatttcaaatactaaagtttaaattatatcaaagatcaacttaccttttttttgtcatcttagaatttttaagctatttccttacaagctgcctaaatcaccagtgaactctgtggcacctagtagagtatttgacttaacataatcatttaatttatttgctgaattaggaaatatcttcctctatggaaaattaacaaaatgaataatccatcaaatccttagctttaaccatttcaaatctttgggggagtgttttaagatgttaaagaaatgggtttctaatatattatagtggttgtgaacatgtgctttggagtcacaaaacctaacttcaaatcctaactttggtttttaatagttgtataatattggacaaattatttaacctcttgtatttcattaatggggataagagtaattacaactaactcatatatttttacaacaaggacaaaatgaggaaatctatggtaatttcttagaagagtgtctggcaaaatgtatagacagactaggcctacatttgcttttattagtatccttattttcattaggaatatattcgaataaaatgttttttctatttttttcctttcatgcaagggctgatagtaaatatagtaaataaaccctcagctctcccaaatattcagtgagggcagatcttagttatatatgggattgtgaaatatattgttattaagaataaaagtaattacatgaaatgtcactggtggtctgtagggacaaaaatttgcttgaattcctatcccagataccaagctagatatactctgatggattaaatttactagggaaaaatagactccttgaacttgaagcttaaaaaaagtaatggggttctcacagtcctctactggtcccagtatgcccctgatatgagttggtgagattccacagaaagatcaaggaagagttgcagattttgtgaaacctctattcctgccaacatttctctattatctgtttcgttattcagagtaatctagtctcttgctcatgtgtttgtatttacacagacacacacacacactgaatctattgctaagttcaaagcaatttggcacctcattcaaagaaggtactgtgttctctttaaatttcatgctacacaagcattctgttttcaatttgcatgtcacaagcagcaggagagggacttttctcatttttcctgttgatctttggtatattcattttcaggaaaatacacacaggagtgaaatcttaagacagatactacttattttacattttgactgcttcatccaaaagaaaaagtttgatcttgaatttataaaatcaatggaacaataatctaacttgtatgatctaaagttacagtcaacaaactaatggaaaaagacaatgatagaacaaaagcaaaataaactgagtaaatttaaggacagagcaagtaattcagttccaattcaagaacaggatatgctacttgtgttactctcttggcattactatttgcagatttcagatttcaccatgaagggagcaaatgatattttatgtaccttagtgtcattattaattgaattatataatttgatgaagactttaaaacaacattgtctagtaatatccaccaaattcattcatggtaattactcaacatcattgctttcatcaatacaatttactctagagaccatagctacctcaatctgtacttttaaaaaaaacaatttcttattattttattttattctaactggtctatcaacaacagcagacttgaacataaatggcatttggtcagagaccagaagcccatacttagtcttaagaagtttggccggatgcggtggctcacgcctgtaatcccagcactttgggaggccgagacaggcggatcacaaggtcaggagatcgagaccatcctggctaacatggtgaaaccccatctctactaaaaatacaaaaaattagctgggcgtggtggcgggcgcctgtagtcccagctattcgggaggctgaggcaggagaatggcatgaacccaggaggtggagcttgcagtgagctgagatggtgccactgcactccagcctggcagacagagcgagactccacctcaaaaaaaaaaaaaaaaaaaaaaaaagaagtttaaggttctaggggctttaggaaaaaggcagaatatgaaataaattgtcagtagaaggctgctccaaagatgaagtatataattttaagattgcttttgttgattgaaaatattattgtactttattttatagttttatgtaaatacattgtcaaaacatgttaatctttgtattcatacataattctcttacatataattcataccacatgagttagaaactgtttaggttttccttccattgtgggttacaactcttcttttcttgtctaagcttccagcaagcaaccatgattcaatttgaggaatttaagatgaacagaacaattcttggtccaaggtgtaatattaccactgacatcaaaagaggccatataatgttgtggttaagaacatagcctttgagacagactgcctaggttaaatactagtcacatttaacaccttgctcactcttaggacctttgaaagttaattaaattttctgtagctcagttgcattatttgtaaaatagatgttgttttagagtagtgtctggcatatggaaatgctttctatgttattgtgaggtaaatttttattctaaccaagtgagcaaatcacttaaaatatgtctgttttttaaaaagcaatgactgtcatttttttttttaatatttcagtagaagtttcttccatttttaacattcaaaggaaaaccacattttattagtagatcaaataaggaatggggcatatgttaactttttaaaaaataatttcaaattttcttttatatttaggaggtatacaatatgcaggttgttatctgggtatactgtaaggtttgggatatgattgattccatcatcaggtaatgagcacagcactcaatagttgttttttaaatacttgtccctcttccaccctctccccttttctagatgtccagtgtctattactgacatccttatgcccatggctatgcaatgtttagctgctacatataagtgagaacatgaattatttggtttttctgttcctgtgttaacttgcttaggataacagcctataactgcatccgtgtggctgcaaacaacatgatttcattctatttttatggctgcatagaattctatggtgcatgtgcagcacgtttcctttatccaattcactgttgacgggcacttacattgaatccatgtctttgttattgtgaatagtactgcaatgaacatacaagtgcatgtgactatttggtggaacaatttgtttcctttttttttttttttttttttgagacggcgtctctctctcgcccaggctggagtgcagtggtgcgatctcagctcactgcaagctccgcctcccaggttcacgccagtcttctgcctcagcctcccgagtagctgggactacaggcgcccgctaccatgcccagctaatttttttgtattttcagtagagacggggtttcaccgtgttagccaggatggtcgcgatctcctgaccttgtgatccgcccgcctcggcctcccaaaatgctgggattacaggcctgagccaacgcgaccggccgcaatttgttttcttttagatatataaccagtaataggattgtgagtctaatagaagagctggtatcaagtctgaaactactctaaaatatcaaggaggagagtctgctccctaactcattctacaataccagcatcaccctgataccaaaacctgtcgaagacacaaggaacaaagaaaactataggtcaatattcctgatgaacatagatgcaaaaatcttcaacaaaatacttccaaggcaaataaagctgcacataaaaaacttaatctaccattatcaagtaggcttcattcctaggatgcaagattggttcaatgtatgcaattcaataattgtgatttatcacatggacaaaattaaaaccaaaaaccataaggtttttgagaatctccaaatttccacattggctgaactaatttacattcccaccaagagtatacaagcattcccttctctgtgcagcattaccagcatcttttgttttttgacttcttaataatagcattttgactggtgtgaggtagtatctcattgtggttttgatttgcgtttctctgatgattagtgatgttgagcattttttcatgtttgttgtctgcttgtatgtctgtttttgagagaagtctgttcatgtcttttgccaatttttcaatgtggttatttggtttatgtttgttaaattatttaagtttcttatagattctggagattagacctttgcgggtgcatagtttgaaaatactttctaccattgtgtaggttgtatttttactctgttaatagtcttttctgtcgggcagaagctctttagtttatgtaggtcccacttgtcaatttttggttttgttgcaattgcttttgaggacttgccataaattctttgtaaatgcaaacatcaaggatagtgtttcctaggcttccttttaagattcttacagcttgaggtcttacacttaaacttttaatgcatgttgagttaatttttgtagatagtgaaagtaagggtccagtttaattctgtatgtggctagccagttaactcagcaccatttgttgaatagggggtactttccccattccttatttttgtcaattttgtcaaaaatcagatgattgtaggtatgtggctttctttttggattctcttttctgtttcattggtctatgtgtctattttgtaccaataacatgttttgttaccagtactatagccttagagtatagtttgaaaaaaagctatgttgtttttgcttaggattgtgctttggtttgaacttgtgtccccatccaaatctcatgtcaaattctaacctccaatgttggaggaggggctggtgggataaaactggatcatgggtgtaggatttgcccttgctgttcttgtgatagtgagtgaattcacacaagatctggttgttttgaagtatgtagtaccttccccttcattctcttcctcctactttggccatgtccccagccatgcttcctgtacagcctgtggaaccaagggccaattaaacctcttttctttataaattacccagtctcaggtagttctttataatgatgcaacaatgaactactacagattgctttgtctatttgggttctttttggttccatatgaatttcagaattttttctaattctgtgtaaaatggcattgaaagttcagtagcaatagcattgaatctcttgattgctttagagattatggcaattttaacaatattgattcttccagtcaatgagtatgaaatgctttttccatttgtttatgttatctatgatttctttcagcagtgtgcagttctccttacagaggtctttcagcttcttggttagacgtactatctaaaagccctacttaaaaggcacagagtgatgggttggataaagtaacacccattcatctggtatcttcaagagacgcttctcacatgtaatgatccccataggctcaaagtaaagggctggagaaagatctatcatgcaaacagaataccaaatggaacaagggtcactattgttatatcaaataaaacagcttttaaaccaacaacaataaaaaagaacaaagaagggcattacataatgataaagggttcaattcaaagacaagacttagttatgctaactatatacatatgcaatattagagcatccaaattcatgaaacaaggacttctaaacctacaaaaagactgacatagcacacaatgatagtgggggtcttcaacaccccactgacaacattagacaaatcattgagtcagaaaacttccgcagaaattctggaattaaatttgacacttgacaaattgagcataattgatgtttacaggacactccatatatcaaccacagaatatacattcctctcatctgcacacagaatatactctaagatcaaccacatggttagccataaagcaagttggaaaaaatccaaaagaaggtctttccataaaacaagtctcaaagaaatcaaagttataccaatcacataccaaccacagtggaattaaaatagaaacctataacaagaatatctctcaaaaacacacaaatatatagaaattaagcaactttgctcctgaatgagttttggattgtaaggcagaaattttaaaaaattcttttaaataaatgaagaaagacacgcaaaataccaacatctctgggatgtgggaagagatatgttaagaggaaagtgtatggtgctaaatgcctaccttaaaaagttagaaaaatctctgattaacgatctaacaccacatctagagtaactagaaaaacaagaacaaactaactcaaaagctacctgaagaaaataaataactaaaatcagggcaggactaaataaaattgaggcataaaaatccataaaagcatcagcaaaaccaaaagttggttgtttgaaaggacgaataagatctatagaccactgactatatgactatataaacaaagaacaaaacagagaagatccagataagcacaacataaatgacaaagatgacattacaactggtccaacagaaacacaaaaaaatcctcagagactattatcaacacctgtgttcacacaaactagaaaatatacaggaaatggatatattcctggaaacacacaatctcccaaaatttaatcaggaagaaattaaaaccctgaacagaccaacattgagttccatattgactcagtaataagaaacctaccaacgaacaaaagccccacaccagatgaactcacagccgaattctaccagatgtacaaagaagagctggtaccaaatctactaaaactattccaaaatatcaaggaggagagactcctccctaactcattctacaatgccagcattaccctgataccaaaacctgttaaagacacaaggaacaaagaaaactataggtcaatattcctgatgaacatagatgcaaaaatcttcaacaaaatactttcaaaccaaataaagctgcacataaaaaacttaatctaccattatcaagtaggcttcattcctaggatgcaagattggttcaatatatgcaattcaataaatgtgattcatcacataaacaaaattaaaaccaaaaactatacgataatcccagtagatgcagaaaaagctttcaataaaatccaacatctcttcatgataaaaatcctcaacaaactctgtatcaagggaacatatctcaaaataataggagccatatatgacacaatacagctaacattaaactaaatgtcgcaaaagctggaaccattccccttaagcactggaacaagacaaggataccattctccattctcaccacttctatttgacatagtactagaagtcctaactacagcattcaggcaagagaaagaaagaaaatgtacccaaacacgaaactaaagaagtcaaactatctcttctataaccaggaaacctcgatgacatcaccaaaaagctcctgaaactgataaatggcttcagtatagtttgaggatacaaattcaatctataaaaatatattaacatttttgatgtgcatttaacatactaaaatcatgacttaatatatttcagtatataaccaccgattgtttaaattacatagtgataatggaactatactttctttttaaaaattatctgaggaatgtttataaataaactaaaaataaacaactcttttttgatacatacagtagacagtatacagcttctaaaagctctttacatggtgaaataagatctgttattccaaaatctttccaaaagaacttttctgttattagcttgtttttcaacattatccaacttgtctctgtgttttgtaattgaaatataaaggagaaaggaaaaggataatatttgtgtccatgtggaaaacaaaattattcatcaaacactttatgaaaagcagcttttatttccatcttgtttctgaaagctaatttgttattttttctaattattcttaatgaggaggctcagaggaaattcttaatcatgattcttactaagacactcaacaaggtcaaaagataaaagctgcagaatcaatgtcactgtttaaaattacactcttccaacagagagattcttaataagtctttgtttgcagagtactttgactactaaataaaattctttgccacaagacagttatgtgtacttaagctgcattaaaaaaagcaaactgtatggattaatttttgaaacaaaaattataagcatttaattacttattaaagaacatatccatgtaaatatgtccttagctgtccagttgtgacagatgttagcatgaaatagatgtgccacatttacaaggtacgggatgttgaagcaattttcctacttaagtgaagtaatataggcttatatttctggaacttcagaagactgtgctaatatttacctttctgtttcatcatctaggatataactatttttcacttatgtgtgaagcaggaaagttgttagacatagcaggaaaaagtacttcgtatcactggctggcagagaaagtttatatatttgagtttatacaggtaactggaaatttagaagtatttttcattgccttattttcttattccttgtcatgaagagtgtttggactgaggttctactatgaaaggtgaatatccaagggtggaatgagtagggactgtggctgagagttatgaaagaagatgattctgaaaaaaataacagaaagcataaagcaaatatttcctactttttccatacatcacatcttgctttctcagaaatttctctgctacaaacccacctgataacaccttccttagagccatagagccaaagtcattacagaggaatgtttcatatagaacaggaagttccaaatgaacctatgttctttttgatacgggagtactgggaagggaagagcgtggtccctttaaatgacatggaagggggaaagggaagtgctgagtggagaagggcgtggtccctggctagggctccataggtgaagactggcgctcctgcttttgtgcccaaatgttgcattttccaagaccaccctggcctgccatgcccccatcctgggcctataaaaagccaagaccctagcaggcagatacaaatacaggtggatgtggtgaggaacacattggcagaagacataagcggctcctagactccaaaaggatgtcgagggagcacaccagcggaagagcacaccgacagacactggcacgcgtgcaggccacccactggtggaaggaggcggagtttggtccggggaagttggaggagagccgtggccccccaaaactccgaatggcccactccaagggaaaaccatctcccttctggctcccccattggctgagagctacttccactcaataaaactttgcagttgttctccaagcccacgtgtgatccgattcttccagtacaccaaggcaagaaaccccgggatacagaaatccctctgtccttgtgataaggaagggggtctaattaagctggttaacacaaatcgcctatagatggcaaactaaaacacatgccctgtaacacatgcctactgggccttcatccctagacactggggtcagagccccacatcctgcccatttgcatgctcccctagaggtttgagcagcggggcactgaagaagcgatccacacccccaacgcatgccctgcgaggaggacaagggaacctttcccatttcgttttcattgtttcacaataaagaagtgacaagggatggatgtctacctatgtcaactgtttttaaaaataatatttcatgtaatgaactggcctatgaaatttgatcatatgatttggatcattcttgtcacacccaattaaaagaaagttgactagccaggggaaaaaaaatcaggacatgtagcatcgctctagaaacgtaattttctgcaagtctggctgttgaaactgcctattctaacccgagacagttttatttataactgctgagacaacttgcaactccagggctaattttccccaccgctgttgctcaccaaacagagtttgccagctccccagaaacttactagtcccaatgcactttctctaagagcaatacataacatttctcatttttataaaatcaccaaccttctctttgttcttcagacataccgaagaacacctgacccgtgtgtatgctccaaattgtgattctttattctcaaagaaaacattgaatttagagatccatctccacatttctattttgacttcaacaatcccattctgcatcataaaccttgagagaataatatccaaaccaagtcagatcagtaatttgatctgacatttcttggggtgaaagaaaacttttgttggcaagtttagcaaaagggactttggccacatgctgaagtatgcatatgtacaaatgaattacttcaaggaaaatgagctaggataacagtttttatattggccataaggataaaaacacattattgattaactgcattttttggagcttggaagttttcttaagaattctctaaaactgaatataataaagtgctaagacaagtattttaccacccttgacatttagaaatgaagtttttgatagtttgttatccacatgtataacatatgatgtggaaagttttatgtcctgctgagcttagttctcataggctcaattttagacaatttctatacagacgcctgcaattttgaatatctgctgctatttatgaggccttcccaagggtggtactccatatttaatttaattgtgtttgcatatatcatacattttgccaacagtaagctctaagagcactttatagttgataacaacttccttcattgctttccaagctatatgatttcttactataaaaccagccttccaccttcagtattgttagttctaacggcatacacgcaatggttttctctactatgttcaaaaagagggtaaaactactaagagtggaaattaatctgttaaaaatttctgttacattaacagcattttattatatctctcctcaaattaatttacttgagtacagtgctagaattgttattctgttgttagactttatgccataaattttggtaatatgtctatcatcaggaggttgggattttcaaaatttttcaattatcataatcagagacaagacctaggaaatgagatcaatttagtccctctaatcacaaatgtctgtactctaaagttcatgaacttgacactaagggaaagccccagaatggattagaaaatgctaataaaagtggagaatgtgtgggaaaaaaagacacctggctaaaggaaggcatgtttccaattttagagcaaggacagagaaatttttacagtagatataagaattcacaaagcatagctgtctggagcaaataatgtctttctctactaaaatagcttcaatactactttgttgcagattgtactaattaacagttatgttaatgatggtaactcatcatcacaatttttattttatgcaaactctttaaataatagaaaagtatgcaatgtattttagaaagatttgtatccatggaacttataaccaaaacaaatgttaattaaaataaagtaatatttttcttctgtcaaattgtcaaaattttattaaaaataatagccactattggttcaagtaaggaattaaaattattttataattttggtgtagctataagttgtttctatataaagaaagaaaggagagaaagcaaggaaggagggaaggaaggaaggaagagaaagaagacaaaatggaaagccaatataccaagaacttttaaaaactgtcctttgaatgaaaaattttactttgggatctatagcaatatagagataattaaagaagtatatattgctgctaaaagtacttataatagtaaaacattatatatgtttattaaatcattatgatttaaacacactctgtaattgtgacagatactgtatattggaccacccactctaacacctcttcttgtatttttctttttgtgcactattgaggcagataaacttaaaactgcacttgccagactcatttgcggatagggtctaccttggaatctgcgaagcagaagacactctcatgacacaagaacataaaggaacaagtgagccaaagggaagtcagttaatcactgggcaggaagtgtatggttctttgggggcagctgtggtagagaaattagtgcaacaccaggttatgatagttgccatgatggggattgtacctatgaggtttccactagaaagttcagattcgtggttaggtatctatttggctctcatgatcttgccgctgtggcatccaagcttagttttctgatgcttctaagtcactagaccacattagtaaattcattacagatgaaagaggctacctggattctatgaaattggatgaatgaataagccattaaaatatatattcatgttgttaaataaattttgatgggatgagtaattctcatggaaagtcaaaaaattataaagcaggttttagaactgtctgtacattcttagttttgagtgtgaatatataaagtctttttaatattaaagactaaataaatgaaacattattattgttattagtgatttcttattgaattcctaaattgcttttaggaatttattataagaaaatagtgtcctttgcatttttataagaaataaatgcattgcatttattataagaaaacatgacaaacacaatttggaagcaaaaataaggaacttcatttgtttagaatacttatagtaaatatcacaaagattctaaatagaataataaccttatcacaatataacgtaagaaacactgtaatgtgaaatctgttttgttaaaacacatttagatttaaaatttcttaagccattggatatgccttgttatcagtgtcacacactgaaaacttctagaagttgtcatttcatctgatacatgaagagcaacagttattccttaacacctccttcaacaccgcatgattctcctcaattcatattttgaaatttgacatatggcactgatggtgatatgacagagagaatctcaatgtgtcaatgacttcatcatattcatttgggcaactgagctagagtcttctgctccatgaagtctgtaatgacattgtgggaaagctgtaggcaggagcttcatattcagatcaaaggcaaatacaaaccagggaagagctatcttccagtcaatatttgttggcatttgctatattataaaacttcaagcactctcccatttttctgctcaatttttcttccattcattgcacggtgagatatgttccaccatgaacaaaggaagttaataagagttttcaaagatacaataaaatagatgaagtttaatatgacatttaaccctattgcttctcaaacaaaatgctttatatacatagcaagctggcttgctatccatcttctgtcactattctctttgtttactattattttgttttaccttttctaaaatgtcaaatatatcagacacacaatagagtatctgatatatttgtagagcttaaaaatcaataatactacaataaaatgaatatttatgtcaccaccacctacaatcagaaataaaatcctgccactatcttataaatcttctgtgtgcactttgatagacttttgcaagttttagggctgtataaaatagatttacacagcacaaattctgcaacttggctatttctctgcattattatgtttttaggttaatccatactgatgtatatacctttagggaaataatgctgtaaagtattccattatataactggatcacactatttacctgttctttattggagagattactgttgcaataatttttatttgtattatgaacaaagaccagatgcatattctggcatatctctcttggtgcacaatttgaggaatattttaggacatacccttaggaacgaacaaaagtgctgtgtcatgggtatagtatatatttatatttacttagttaaaatcaaattattttccaaattggctatgccattttctcagttaccagcaatttcagaattcctctttctccccatcttctataagatttgatatgatattaaacttttgtcattttgattgttgagacttgatattttatgtttttaaatttacatttttttctgactacttggcaacttctcatgtgtttaatgaaaacatgcgccactgcactccagcctgggcgacagagcgagactctgtctcaaaaaaaaaaaaccaaaaaaaccaaaaaaaacccatatatatatatgttttatatatatatttatatatttacattttatatttatattttatatgtatatacttatatattttatacatatataaaatactcacatgttttttaatgtggcttatttaaggaaactttactgatcatagagacataaaaatatttttcttaagtttcctttaacagttttagatttttgtctttcatatatgtcatccatatatgtgaaattatctattgtaattatttattaagtgttgaagaaccattttaattttccacatgagaaataaattatttgaaaaactaaggaaagttaattatatccattttcacctctaaatatcacctatttatacttctattttccatggtatattatggatccatttctgtacctttatatatatatgtatatgtgccttatataaattattatataatatatattattgtatatatttatattatatatttaatatatagtatatattatatataaatatataatacttatataaatatatatacatatgtttgtttcacatatatatacaacattgcttggttcaatttgttaataatttcttaggaaaatttttatccctcctgactttctatggtttttggtgacaacattttcctgtgtctttgaaggctgaagaacattgtaattttgttgcctagatgtttcttggatttcttccataaaactttttgagcctggggtttattgtgtagggaaaacataattgctagtgctagaatttaggttttctatcatgtcagatgtcgctatgtatagttaatgtttttctagaaatgtgtctattttgtacttttttcaatttattaacatatatatttcatatcatctttatctaaaaatctcagtctcttctgcagctataatttcggcaataccagttttaatattatttatttggcttctttctttaatttctatttttcctgttcattttaattataaattaaataatccttggctttgttaagtctgcattattttgatactttatgttttttattatttatttttatcttctttgtccttattctcttttctttacacacacacacacacaatatttcagatagatgcttattttgttgattttcagcctttcttcttttcaaccatgagaagttaaggctataaattgccccctcaatgcttttagaatcacatttcaaaaatgttgaaaatttatattagtggtaatttagctacaattgtcttctaattatgatttcttttttacccataggttatttaaaagatagttttaataaatacaaatgtatttattttacatatttttattactgaattactaatttatgtagatgtcagagaatgtgggtatactaatagattcttttgtaaaatttatcgaaaccttctttaatgcctagtatatggcccatttttaaagtttcatttgttattaaaaataatgtatgttctacaacttaacagtagtagtagtatcaaacctatacctttggtataggtttttatatatgtccactggaaagtttaagtatattttgatatattcagtatcttattgagataggatattgtgtctgctaatctatcaattgttgacaataatgtgtttaaatcttctacagtgatgtttgttaaattatttttgtacgtctgcgattttttaatttatattttaaactatgtagctaggtacatgcatatttagaattgctacatcttcttagtaaattgaacctttataattactgtatagtggccttctttatagctagtgtatttttgccttaatgctttatgatctggtcaggcaccagattttatctcctaactcctatagactctttaaaactcttaaaatcttaaaatataggatccagaccacaagcaatttacagacgctccaaaacaaatgtggattttaaagctttcttacatcaatagactcatgctttcttatcttatctgattgttgaatgattctatttctttttccatgttatcaccacattttaaaaagagtttgttttgttttgttttgtttttgttatccgtgtttttagggagtagttttctgaaattccagtcagctaaaatcctgaaataggaaaccaactgttattcttacaacttccactatgcaacctctctctcgctagaaaaatagtatttgcaaatatcaaaatataatcccctttcctgttaggtgagctgcatgcaattaaactaaacataatttatattttaaaaattattttttgccattattttcttgagccagtgagttctcttatttttgcccctgtgccttagtgtatgtgtctgtgtgtgtgtgtgtgtgtgtcacatgtgcgtgcacacacatatacaatgtttgttgtatttttttctggttaactgagactaaacttgaaatttaaagctggccttccatgaaaattatttaatgatgcaatgcaaagacaaattgctttctacatcaattttctatgcaagtacctataaatgttagataactaaattatcccagagttttcttcaggaaatatcagccttttattcaagtatatgattttctataaagtattgctattataatcttttaatgctaggtgaatccacatcaagcattcaatatttgttggatgatacaattaaatttctctctgcttaggttgagtttacattgtctttaaaaatgtcttttaggcagggtgtagtggctcacacctgtaatcccaaaacttgatgaggctgaggtgggaggatcacttgaggccaggagttcatgaccaacctggcaaacatggcaaaaccccacctctactaaaaatacaaacattagccaggcatagtggcacacatctgtaatctcaggactagagtggacgaggcaggagaatctcctgtacctgggaggcagaggttgcagtgagctgagatcacaacactgcactacagcctgggctacaggctgagactctgtctcaaaaaaaaaaaaaaaaaaaaaaaattaatatcacaaacatggtaaacataaaaattatcacagtgtaaaggaaaaagtaatatatactcacaaatataaacagacagtgggagtggggacaaatttgcattcatattgaatcaagacatttatatcgcctctatacaaaaacaagatgaactaaactaaattaaagggatgttaatctagaaattaaatgtatcatgtcagctagttttaatatatggatgctttgggcattgtaagattaaactttctgaatcataacagaatgaagctcattaaaataaaataaacttacccaaatggaagatgacctaaaagaataatttttgggcaaaatattataaaaatagctacacagatattagaaaatataacaagcaaaatttgatttttactttggtgtacaatgtcccaacattctgaataatacatacccttttctcttgaaaaatatgtatatactgaatgactttaaaacaaatctagaaattaaatgtatcatattttccatactgtttttgtttcaatcagattttttaaaagaactttcatctctaaatttaggaatctctttttacaattttttcatttacagctacctcaaaaaatagtatgtattcctaaaataatatagtataaatttattttgaacatcaaaaagaatctgagctcacctatagcccacaaatggaaatgagaaactcatgtgttttcatatttataaacacatattacatcttatacaacacattatgaaaaagaaaataaataaaagcatgctaatataatttgaatgaacaagaaatgctggaaatatttgaattctacctttcaaccacattaattagagcttccactaaatcatttccagactcatataactgtaataatttcacacctataattatctctccatgttccctgctatgtttattttacttaaattagacatatttcagtatgttctgaagattttgccttatattcaacattacatatttgtttaaactcctcccttcatgaatgtactctcctctgattctataggaccacccctcatctatttttatgcactagctccattatgaaacctttcaaaatcataaaaagtagaaaattttattcatagttcacagttgaagaaaaggcagctcataaccttgaagcctatatcctactgtgatactctttgtaaatgatagtatgagaattaagcctttatttaaaactttttcatgtcaatgtcagttctgtctccaaaacttaaatggcattattaatgaatgtgttacaggcattacaatgcagtgattaagaatacagccgctaataccagcttccttgagtttgaaacctagctcatggctccctcctcctttgttttgggaaaattacttacactttatgtctcagcttccttattggtaaaaaatgtataatatgcaagtctaccttatagaattggtggaagcattaaataatgcagttgtgaaacatacaaaagagtatctagtggatggtaagtgtaaaagtagtattaactattagtatctactatatggggttgtgggttgaagtccactaataatttgtgtcaacattactctggtaagagttcatggcaatgacttgttgattctaggaaatttctgttcatcaatgtattgtaaaaaataaagaacttcactgttttttatttttccatgaaatgcctacagatcaatttactgaagacaatagtctgcttatttgtgcaaacagttcacttatgaaacaagtttatttcttcactatacctaccaattctaaattattatgtcatggattttttccattcctaatcagttccttctcttgaaagatctgcattacacaacttgagaccagactccaaagctccataaatatcccattctgacctcttttaaacacttctaagattctgtcagggtggtgtgctttttgattacaatgtattccaataaattcaggtgtactttacttacagattatctggtgatatattgaggagagcaatgaactgtaagcaccactgtgttctagctgagatcccctctctgatgtgtcttaagatccttgacttgcaaaatgaatgctctactggggaagccttgagagactctgcaactgtgatggtggggtctaggtattgatattgtgtctcaactttggtcactgtcaagttcccaaatgttagttttattttgtctaatgggaaatagaatctattttaggactttttctgtgatctgtttagattggaaaatgttaatgtttgatttaaatctgctttattgctaaattactcaattgtgtccttctgtcctcatttttgtgagtctctaagaggaggtttatacaaaaatggccagacatggatcctgataagttgattcctagagccagctctggaattaataacttcagaaggttcctcctcggactggtatccctcacataaattttccctggagtcaactcttcaaaaccttaggcaaatgtttcttattcttatcctgttcagtctttgagagtcaggttctgtataaaatctcccattaaaaaagtttatgttatccaagaacctcagattatcgaggctgggattaaaaaaaaaatcattaacttggaggcctgaaaacactatgcaaaagcaacactttctactgcttgttgctagattctcatggctttgaatcacactaagtgtatgccttctgtaggctgaacccttgcctcatatatgtatctacattataaatctaatttccatgactgtctttcaaaaaggcataatttctttacaaataatttacagttaagaggctacttggtgaaatttttatattaacagaagttgttaatttgagaggagtcttaaaatggaaaggaggtaaaattcctattacaatgtgaacttaatggccttttccctactttttattttcccctgtctttgtttactcaatacccttttgccttactccattttctcacctggccccttacctcctggattacacaacctgagtttcacaaatctcaattgcctcttaaagttaagtcctctttagacatcaacaagcttcttatagtttatttttagccttcattctcagtctgaactaagaatcaatgtaaaagtctggacaaagtacagaggaatttagaatcattctaacaacatatatcgtaggtttcccagatctacgtaagtgattcttatgttagtaagaaaattaatgtaaaaaaattggattaaaaaatgaagacttaggataatctaaggtgaatgaaagaccctgaatattagagaaaaccagaagtatttaggaaagctatacacagtggagaaaatattttggaggctaccccaagactttcctgaaaataggttggacttccatctcattataaaaagagaaagaatgaatcaatttgaaactttaggaacaggacctccaacacctttagaaaatattcaggagtagatcttgagacagacaggacctaaaccctctcatcatttttgcaaagagccctaaaccaaaattagggaatgtaaaatggaaaaagtacatcggaaaatgacttcattgacaaacagaactccaattcctaactgaacattttgaaaaagtcatggaataaaaacagaataagcctctgaataagttaacagccttacagatgaaacaactggctatttctcctcaatttatcaagtatcagaggaggaagcttcctgaatacaaacattgatagataactgtaagcagaaaggacattggaaaaagattcataaaggacattggaaaatagctattctgcactaactgtgaaactaaaagaaaatttttaaaaaggaaggatgtgataagggaagttgatgctgatctgtggggtcattaattccctgatgtcccatttctctaaacattaacagacagtatcaaggtttctgattgattcaggcacagtaatatagtttacagaccctgccacacatgcattcagtcactcccctagagtcaataaagtatttaggagatgagtatttgcaaaaatctacagattattgtgtatcactctatagcttttgccctcagatctttaacatcgtttgctcatttgagacagcacttcccctcatttaataggtagggatttcctatgtaaacagaattgctaatttaagtgctctcttgatgggctttctcttgagatctctaaagaatcacctattcagcagggcacggtggctcacgcctgtaatcccaacactgtgggaggccgaggcgggcagatcacgagctcaggagtttgagaccagcctgaccaacacggtgaaaccccctctctactaaaaatacaaaaaaaaaaaattggccgggtgtggtggcaggcacctgtaatcccagctactcaggaggctgaggcaggagaatagcttgaacccaggaggcagaggttgcattgaactgagatcatgccactgcactccagcctgggtgacagagcgagactctgtctcaaaaaaaaaaaaaaaaaagaaaagaaaagaaaaaagaaaaaggaaaaaaaagaatcacccattcataatcatatcacacctaatttggactatggagtacaaggagcctggtatcgacatcaaactcaaattgaagatctactgatattggctgaattattggggaagaacacctcacatttctcactgacccatttaagcctccatctacacttgccctctacaaccaaagggaaaggacaaaagccagcagttgtgtctaacagaaaaataattacgaatactatgcactagtccttggaacactcctattcttctgatcaagagatcccagtgggctggggtacccatttatttcagaccttgcaactataaataaaatatttagccctgttttcctgtggtgccaaaattctatattattttaatttccatgctacctgagattatgtattttagcattctaaatccatgttctgctgtttgtattgtcccttttagatcataatagaaaatactcattagtctttctctagaaaaatcaatgatgtacctggacagttttactgcagaagtgtactgaggcacccaggtaccttatacaagtcttctgctagacactgaaggaccttgaatctctctataattctactcttatccaacatgcagacaatttttgctatgttgtcaagatgagataatttttcaggttgattccaactactacttatagctcagaaagtatataatgtgttcaaagaaaaattagaattttgtaagaagaaaatgcactatttagaacatgatttataatccatcactctggagagattacaaaacactttttttttttctaaaactgttaagaaaatatacttattttaagagactttttttttttcggctgtagggggtgaattttttttttttttcagtgagagcaggttaattaggaaagtaaaggaataaagaatggccactccatagagatttcataggttattacatgcaatgggttcccaatattactgaaattactgtacctctaaattttaacttagttgttagtaactcaatctctttgttgtattataagcataattagctgtaggggtgtgtctctgtgtgccctgggagtggcagggttggggttgggggtgggaggagtaggaggctgtgtgatttaaaattaattatttggccttcctaattatcttagatctttttaccaatttgtgcatgatcaatttggacaagccattggtgttttgactttactttatcagaatctttaaagactattcatctttaaagttatccataaatttttcatagactcagtggcaaaaggctactcaccttgtctaagggcaacagccagactagtgggtaattacagtgggtaatcttctgatgtttctgcattatattctctactcttcacctaattacctctgaatgtcaccaaaactgtacagtaaattttaatcacacaaggaaggtattttggacaatgataagtctttgggtagattctaaagaccagtgttaggtttgcaaaacaaaagtctattgggtgtggccaacaaattataccaaaaaattgttatctttgtaaatttagacactatactttcagaatggtgcctaatattactcatggatgatttgggcacatttccccctcaaaccctagaaaaagagaactctagataatttcattcaagaaagagaaaaacagggcctcattttgagatatacaacattactcatgtctaattctgaatagttttctcctgtctttaaatcatactatctgtgcttcagatattatcaggaacactgaacaatttcagtgaggccatagaaatcatcacctggagatttcataatactgaggaggtggtacttcttcaaaacatagcagtacgagaaataatattggcctgtcaggatgaaacatgaggcattttacaggaggaaagtttactcatattcctatagttctttctgtttttattttattaagaaaatatgggaaattttttaaaaattacaagacaaggtgataaatctagtattcccacatctgaccattaaaactttttggtttggtcatgggttccattgtattgctttaatttaggcatttttggctcttggcttagaatgtaaaatacttctgttagtatctgtctgtgattcagcattcaaatatcaggttttcataatcaaaaatatttctatgtagccactctgatatgacaataaatgatcatgcagccaaaacaaaaacaaacaaacaaacaaacataaaaacctaatgtatatgatagttgaaatgatcccaccagaaatctgatatgcaatcaggaccctgaagacagtggtattgattttgattgattatttgtgcagatgattattatttatcctccagcttaggttgaaaaatgactacaagagagttctgagaaataagaaaccacctatgttaacaaaactttttattgtttgcttcaaaaatattttctatgaaaggataaaatcataagccaactaattttattattttcttcaggaaatttccacagatcaatttattagagacaacactctgctcatctgaataaataatttatcaaacaacagtttacttattgaggctgcttgtttccacatgcatctcgctctgcccaccagtcttaaattactatatcataaactctgtataatctcagttaattccataccttaaatgactcagtttaaatcactttaccacaatccccacacacgttaagtacctcagttttgacttccctcttctgaaacattgctatatcattgtcaaggtgatgtttactcttacctattgtagtaacttctataacatttaaattttattactacattatcattcttggactaaacagttaaattgtagttattgttctttcttctattactattaatactactattttggtatttctccatcatttactgttgtgggaaaatgtgagaaatatgactgtatatattttattttattcacccaaactagaatatttgtctcttttatacctctccaaagaccccacttctatttttaaaaattagttgatatactattttgtatacatgtttgtttctatctgcttatttagtttacatgtttccttttattctttaccatctaagtactcaattcaaataagatacagagataaggtcagtttctgatagccaaagaatagcaataggtttggcacaagaattgcgcaggttcctcatgaatttgactctaagaaattgtgaaatctcggggaagacacacgaaggcctctgcatcccagttttcccttatctcacttttctcttctcttttcttttatcatatgtatgctatgtgagaattacaataattaaaatatgtaacatatgagaattaaaatatataataaggatagagcttactacaacacctagcacatcctaagtgctcaataataatccttattactttgtaatgctcctgtgagtctgaaaaataatgtatttaaggctcctagtagatactcttttaacaggaactactaatcttgttattgatattaatatagcttggctatattaatccaggtggatcaacatcctctgtataaatgaaaccacctatttacaaggtattccacaataattcaatgttgcatcttcagcaagaacaagccataggtctgaaaatgtaagtgcaaggcattgagtatgcatttgtgtatgtggtctgattattgctctgaagataaacaactactgagaccatatattctgaatcctcttacaggaatacagtatatgattgaattttttttctatctacagcttgcaatgactaaaaaaatgttggtttgttcccacaataaattccctccaagaccacaaatgagaaataccactttacatgtgcataccttaatgatgacctcttcttgaaaacaaaacaagcatgctttagacagaattagcttctcactgtagagatgactggcttaaatgagaattctgtctttgctctaataagtttatttgacatcttggtttgtcttatagtaaaaaaaaaaaaaaaaaaaaaaaagaaaagaaaaggtggtttgctccctttccccatggtgttaaattaattccatgagcagttttgttactctacacaataatacagtgtgtccccttatttatgtcataatgtgtcataatgtctattgggaaaagagatcaatttatgtaactcaatttgttgtctttaaaggagtttaacattgtatttgagctggacattggttgccttgagctttgagaatttaggctgattcatcatgtgaacctgttgtagaaatgaccttctctaggcttctgctttagtttttacatgaatggtcctaatgtccgcctatagaagattttgtgcacatgatgaccttagggttaatctacatcgggaaacacttaaattaccataataatgttctctcgaaattcttaagtatgattaatgttggttatgtatcggcctagatagagatttctaaaagtgagtgttcctgagtgctttggatgatactttgtaagcatatagacatgaaactatttaaaatcattgcataatgttgcaatatatcaaattattttcctcttgacgtatatttagattgttttttgtcactcattaaaagaatgctacaaggagttttttttatgtacaacactttgtgaccatataaaggcagttgcctagatttggaatttgtatataaaaaatatagatacacacttttgttaaaagcttaaaatttgccctttcaaaagaatgtacatatttaatttttcaataatcatgtataaaggtgtcagctgtattttcataagtttaaatgaaaataactgcttgcgttatagatttttcttttttatgttataaaataaaacttgctctaatttatgggtagaaagaatatgccttacaaatttaattaaaagttttaaatgttaggatataatgaaaatcaccccattcttttttatttccgaaacaagaaagggatgttaagtttttcaaaattgattcacatgagctaacattaaaaccattggatgggttgtgtttgtgtccttgccagttagtaactttattataaaatctctaaatctattaccttctgtaaaatgattttgaataagcatctgtgtaaaaattgttttctttttcactggattagaaactctgttaatgtgaacacagtaaatgaacttaaagaaatagtcaagagtaagaaaatatgagaaaataacttttaaaaataagttggcaagtcaagttctatggaaaaattaaaagacgcttaaacatcttaagtaaaatttcaacatgcctgttacgacacatccccaggaagtttattttcataatatttgatgtgattttaaggtcatcatttaagagaaaataaaaaaggtcatgaaagggattttccacatgagggcttccaattgaaaatatttacatataaaatgttaattgtagaaatacaatccaataatgaacaaagttcaaaagtgagtaaaccctgaagcaagacaaggcaagatatgtaatatctatcaataaaactaaaacattttcaaacatttggtgggaaagactatcttagttaatcagggacttctggcttaaggaaagaaagcaacttgtcagatttaatcaaattcatgggaatcaatagaattgttttcttttgttggttttcccagatatatgtaccaatcagcagtggtgataacttagatgaaaggaattggtggaaggagaaaggtctcttcaaaataggatattatctcacttcctaggtttcataatctctaataaagcactcctaatttaaattgaaaaacatcactgtttatttcatgcaataaattaaatcaaaatatataactggtttgatatttgtttccaagtatttgtcagtctttagtcaacaattcattaaaatgaaaaaaaccttaattctgatttacaaaatgaaaactatcaatggtaattattattattattattatttctatttttagtagcgacagggtttcaccatgtcagccaggatggtttcgatctcctgacctcattatctgcccaccttggcctcccaaagtgctgggattacaggcatgagccaccgcacccagctttttttttttttttttttttttttcctgagattgtatctccctctattgcccaggctggaatgcagtggtgtgatcttggttcactgcaacctctgcctcccaagttcaagggattctcctgcctcaacctcccaagtagctgtgaatacaggcgcctaccaccacacccagctaatttttgtgtttttagtagaaatgaggtttcaccatgtttgccaggctggtctcaaactcttgacctcaagtgattcacctgccttggactcccaaagtgctgggattacaggcatgagccactgtgcctggcctatcaatggtaataccttattgtagtatgtaaggattgtataattctattggatcttgaaaggttggtaagaaatcactgaaatgagtaagaatggaattcagtaactcaatattgatatcaagaaattagaagagaaaacaatacattgtgcataatgaagccaaagataagttaattattccttttatgaaaggtctctcatggcatacaaagtcatgtgatacacagtagcacacctcatctcttacatatgaaattaactaggaaagtgtgtttttcaaaatgggcatgaagacattagtttcacaacatacttatatataatacctagatatacatacatgtaacatatacaagtatacatagcacatgcttcatatatatgtacatatatgaaatctcactctcagtctctctctcttgatatacagacagaaagacagagaggtagagtttcatgtatagagagctatatattataactctttatatatagcacggaatgattgaaaccaaatcatttcaggtccaaaaacatacaagtaagggccccttttgtcagtttagttaggtcaatattatacccacctctctatttgaacttgtctacatgaactgtctctatgaatttcagtaaagtggtaacatgaactctaatgtttgttggacttaaccttttaggagcaatacggaacactattaaatgtttatttactcatgtataggagataaaagatagtgaattcttagcaggcttcaaactaacttttgagcttgaaggtacttatcaaaacttataaatgataaaggaaataaaaaaagtgctatcaaggtggatttttaaaacaatttacattttgcttatcattttgatcttcctcttatgatctatacatttgaaaaataaatacgtctatattattgcccaggttttgaaataagcccagttactaataatgccacaagctaagactgagtctactgttaccataaagccagattagcaatccaagggcctggggaacttccgcttttttagcgcttttcctctggtgggtttgttcttgcatttgaacaaagctatgggtttacatgagtaattgcctaagtatctggacttgccgggtatcactgacaacaggcccaaattataattaactcaaagtaccgtgttaactttttcagccaaaaatacatagaccataagatattaggctttctggaagagtctaagttattggctctggcagcaaaagagtaacatattaactgaagagtaaagacaaagcttcagacaaaggttctctataaataattgtgtcaagatgtcattacatcagtggaatgtagctcaattaacaatatcttttaaaggacatcaccttgccctaccaagagaaggtagctgttaaattgtggctccagcttgaggtttgataatgtggcagctataggatccatttcctgttctagttgtgtatattgtggtaataagaaaagcaacagagccccaccataaccaaatacttttaaaaatacaaccttaccctaagaaattaagtaaaaacaaatcttattcctctggtcagtgttgaagaaaaaaacaaacattcgacttcgactggttgcctcacagggggagaaaaataatagtgcataaaagcaaagcaaaacaaacaaaaaaccttagtgagcctagctgacttgttctcaagaacacagaggaacatggaggagaggcaaggctgttgcctagttctaaattaattaattataaagaattacccccaattaaacactaactcactgcactttttttgtagattccttgtttttcccccccacatcatactgaatccaccaaaattatcatcaaaattttaaagcttgataaattattttgtctatccacttcaaatgattatacatcagacaagatccctaacgacatatcagaatgaattacatatctggatatgaaagaactaggatgtctaatttaaggcaaaggtggagtttgcaatattttagtgagaggattgagaagtatggctaaataggaattaaagtcagcataatccttacattaacggaattttattaaaattgtaccatgttatgagtagcagaaagtatttggaaagctgtttccatgtttacctttagtgtagtagataaaggctatctcaaataaaatgttcagtctaaaatgacggcacattttttcttacaatgattaattttagaaaaatctataatccaatttactgcttgaatttacatggttgcatataaatgatgtgactcctggtgtgaattaggtggcaaattagaaaagggctttttatttttattgttttttagtgagaaagcaggtatcaatataactcagagaaatattccctacatcttagagtgagattaataaatatgtctttgttatcaataaaatgggaatataattctatctctttgtattgttataaagattaagttgaaaaaattatgggaagtccatagtataaaactgagtaccctcaaaaaattactctacaaattattgtttatttctatattattttatcatgtatcaatacatattacattttcaaaaatataaaaatacctcattcttggaaaaaaatgaacatttaagagagacaatatgtcactttctcttcagcaatgtcaagagaaaggaaattttaaacagaaaactgcagatgtctattcctgtaacacaagtggatgcattgatctagcaaaatgagatgaacccaaaccattataagcaataaactcacttcattcacttggattctaatcacatctttagaattgaaatttggcttccaacttccatgttcctacaaggagaaaatgtaccacctaatattcaaacattccaacacctttcctttgtcaattatatttcttttattataaatcaacaaatttgcatgttgtcacatagttgtcttgcatgggtttggttactgtgatcccttctcctgactccaatcacatccagctatggagacaaatataaatttcttgatctgtgaatcaacctctggtccttgatttccccagacaagtatttctacccactgaggcctgaccttaacagccagccagtctctttagacagcaattatagccagtctgtttctaactattgcactgtatttataggttgaaactttttaagtagaaactagatatcaacagggctgcctagggtatttctgaatgatgaagacaatgaggatgatgatgatgtcaacaatgggagagaaaattgtctggaaagagcatgctgttactttctggaattatgaaaatattttattccttgtttggggtggtatttacctagctgtttgcaattgtgaaaactcatgaaattaaaaacttaatttctcgtgttttcttttatgcagattatatctcaatatgttcaggcagtagaaataactatgagatttcttcttcttaaataaaatggaaggccaggcgcggtggctcatgcctgtaatcccagcactttgggaggccaaggcaggtggatcacttgaggttgggagtttgagaccagcctgaccaacctggagaaaccccatctctactaaaagtacaaaattagccaggtgtggtgatgcatgcctgtaatcccagctacttgggaggctgaggcagtagaatcgtttgaaactgggaagcggagtttgcagcgagctgagatcgtgccatttcactccagcctgggcaacaagagtgaaatttcatctcaataaataaatacatacatacatacataaaatggattgtgaagatttgaatatggactattcaatttgtggtataattttttgtcatatttgaagaattttcttcacagagaagctttaggtttacaaaaaaaatgggaggaaggtatagatattttccatatactcctgtccccacccatgcataacttgtattatcagcatcccccaccaacgtggtacacttgttacagttgatgaaacttcatttacacatcattatcactcaaatactagtttatattagggtttattctttgtgttttacactctgtggctttgactaaatgtataatgagatgtttctatcattatagtatcatacagacttattttcactgaccaaaaaatcctctgttctctgccgattcatttttccctgaccacaaccccctgacaatcactggtgttttcactttctctatagttctgcctttcacagaatgtcaaataggtgaaatcatagcgtatacagccttgtcatattgcctttttccatttggtattttgaatttacagtttgttcatgtcttttcaaggcttgatagtacacttacttttagcactgaataatagtccattgtctgaaggtaccacagtttatttatccattcacttactgtagaccctcttggttgttccctcccaagttttgaaaattgtgaataaagatgctgtaaacatctatgtgcagatggatgttttcagcttctttgggtaaataccaaggagaatgaccgctggattttatagtaaaagcatctttagttttgtaagaaactttcagattgtcttccaaaggcactgtgtcattttgcagtccccagcaatggatgggacttcttcttgctccacatgttcaacagcatttggtgtcatcagggtttagaattttggtcattctaataggtgtgtagtgttatctcattattatttaaatttatatccccttgataacatctgatgtgggacatcttttcatgtgcttatttgctctctgtatatcttctttggttaggtgactgttacggtttttggcccatttttaaaatgagtggtttgttttcttattgttaacttttaacagatctttgtatattttgcatagcagtccttaatcagatgtgtcttttgtgagtattttctcccagtttgtagcttgtcttctcattcatttgacactgtctttctcagggaagaagtttttaatttcaatgaaggtcagattatcaatctttaaatgaatcctacttttgatgttgtatccaaaaagtcattgccatactcaaggtcacctaagtataattgtttttaatagaaatcatatttttgaaaaagaaatatagttaaattatatcatttcacattttttatcaatgcttttagctcttccaaaccattatgaaatagttgtatttttattgtgttataaaatcaaatcataattaagcttttcaaatgcaaagctaaaaaatgaaatagcataaccttttgaatcgaattgaatagttcaagatctctatgctctatgttcaagcattatgttaaaactgctgtcttactatctacagaattttctaattagcctaaagagatttttataatttacctataaatatattttgagagggagtgataataaaatcaaaataggtcaagatatccaagtaactttattgagatgtcaagtggcatccagcagaaggtgaagaagtcacagagttacatcatagaaggccttcctgctgtgctatttccttcaacagaaaaagaagctttcatcctctaaggcttccagcatctgctgaaactactttgagtaattcaatcttgtaaaaattatttctgctacgtatacttatctaacacataagtatacttataaaaaaataaaaccttgggcccacttgagaaactaaattatatttagtaaggagatcaattttgcacaccttggcttattgtgctctatttaaaaacatattttcaaaacgtagctcttttttttccctgtcatacacttggcttcagtcattttgctgtaattaaacatgataagtacttccccatgttagtaaggcctgtgaatttccttctgcttgaaatggctcatcttccagatgcctacatggcacaaggcctcctttagttcctgtctctactcatgcactgcatcactttctccaagaaatctacttcaccactgtctaaaatagcccaccacgcattccctcacatcttatcccctccctttttgtacataatacatatcactacctgatatattacatcttcatttgtttattcaaaaaatggactttgtagacttttaaaaaactgtaaaatatagtcttcaacaaatagtatgctttgtttctattttattgtggtataatttacattcagtgaattgcactgatcttaaatattactgttcaacagttttgatgaatggctacaccagtgaaacctgctatactgagaggacaaagagcacatatacttctcttccccaaccactatctaccccaccctttccataaaggaatacaggtagcctgatttatttcactattgtttacctgttacagaacttcatataaatgaaataatacagtatatcaagtttatgctacatgtatattatctaatggtacctttttctattttaaatatatagaatagcaaatatgagaatatttttaaactcatcatcatcattctaaattgtaaactcaatcatcaataaaaattaagatcttagtaaacctcacaaaccattttgtaaaaaatttttgattgccattttgtagtctgtaatatatgatttatttttgaaatgtgggaaacagattcaaaacctagtttcaaggaataatctataaaaattgctctaatataattttaaattatttattttggaacaatcataatgttttcagagaccatagaattttagcacaatatcctgatatttaaaaaataaaagaaaaaaagcaaaacccaagaaattaaaaaactacatatgctaatacagagtcaatatatacttggatagtttgttattactattgaactttttataaaattaaagtatatatatgaaaacagagaatttactaaaaactatactgtgaagaaaatatgtaaagcaatattcttgcacaataggccattcaattatcggtgggttttaatctcattttttatttgatcatgcttattgcttaatggtcatagaaatgttcctttatcaattttcatgggaaagttttgcagcagagaagttccctagaatcaacatgtcttagatgtttgtaaaataagtgatttctttttccaaaatgttaaaatcattagtacacaaaagtcattactacgttaatttattttaaagtgttccatttcagtaagcaggtattaaggaagttggtgttgggataagataattgtgccaaagtaaattcttaatggagttcataagagaggaaatacagtaactgttctactccaaggttggctttgggggatttttcaaaccaacttaaaagtcttggatgttatatctgactggaaattatttctactccctgagaatgaacaacatgctggcaacagtgaaataaggaagcttgaaaaagggaatgagttattctatgaaacagtctgtcctatacatcaagattcttttagtttctcactcaagactttaagatacacaaaaatcttgccgcaagatttctcgtaggtggtgtgacctcagtatacgttgaagtcagagattacattgggttctaacaactcagggtttttagataagatctaaagttaaaagctataaatcagacctctagaggagggctacattggtccaaattttcatgaggaatagactctctttgccaatacaattaggggtgtgtgtgtgtgtgtgtctgtgtgtgtgtgtgtttgtgtgaatgcgtttatctcactgtctcgggagtatgtaattgtgtgataggtggaaattcataaggagaatggatcaactacaagtggtcatgggtagtgccatgtggaaccatactggagcctaaggcaaaaggaaagtgtctggctatatacgtgacttcctgtgctttttaatggttatttttctcagaacacaaaaatagttttaaaaaataatgaaaacctggaaagtagagtattgaaacatacaatctagtttttaggtttaaatatctcatttatacctaaacctgaatatattataatattttcaaaatgtactcttttgcttactcatttttaattgagagaattgctatgtttgacaatttctcttgacaaatgtcttgattaacttttacttaatttcaacttactgatcctttcttttagattttgataaactatttcttgtgggattttcacattggatttctattttttaaatattgcattggaatatatttattctattattaagttgtgttggcattccttaaattctgcacccgaagaaagtgcttcacttgtgtccattttttttcctttcttttttgagatggagtctctctctgttgccaggctggagtgcagtggcgtgatctcctctcactgcaacctcggcctccaggattcaagcaattctcctgcctcagcctcctgagtagctgggatgcaggcatgtgccaccacgcctggctatttttttttttcttttttttttgtatttttagtagagacggagtttcaccctgttgctcaggctggtcttgagctcctggcctcacgattcacctgcctccgcctcccaaagtgctgggattacaggtgtgagccactgtgcccggcctcacttgcatcattctagttgcagccctgatgatgaattcttaggtttgaccttggattgtgtgtatccaaagtgaggcaaaagccaccagaaatgagatcaaagaactgagagcccaatgccctaaaacagactttccatgtagacagcaaatgcacaacgattataagaggaactgatgtagagtggagggcctcgagccagaaatttgaacgaggagaaactactggcaagacaggagatgcaagcaacaacaaagttttggggtacctggggcttaaaagagcagagatcttggcaaatgagaagataccagtcccaccctcttgctctgaggtgctgaagtacgagacaatagacaaaatttgaaaaaaaaaaaaaaaaaaaaaaaaagctgcaaagaaatggtttcctggaggaaagcatgaatgtcttaaatataatgggctttctgttcagtatttcagtatctggtaaatctcatcattagaagcaatgcagaaaattaatatattaccttcacaataccctcattagaacacaattataacaaccgaaaaggcaatgtactaacccatgaggactcacttaactcattacaatggtttagtgagctatattgagcttaaaacatatgctggaatggaaataaaaaaatgaaaaccctgaaaaataagctcttcagaggtttagaaatgaaatgggagtgatgaatagctaggagcaaggacatgggagtatacatggtgccaagagagaaggtatcattttactaaacacatacttcacctttttcacatttcatctaattttagcagcttaaaaaaagcttttgtttttagcttagacagaaactcttaggctttggacccatgttccaattctatacatcaaaaattgtgaaaatttctagagggaatgatggcaggacttctcagaaggttggaaaatggagggtgtgagttgaagaacagtggttaatgacaaaaattgtagatgaggtccacctgatcacaaatcatttctaaaaccatatttggggatttggataatttatttgcactcctaaacctctgtttcttcatcaataactgggcataatgatactactcaggtttcttatgagaattagatgacgaaataccgtgtttgtcatgtaggaaggtataataaattttacacctgcctacatgacatatatggtataattaatttataattaataacttgacttttataactaatttactgacaattacttattgagtacctgctatgtgttagggtaaagcaattcaagaacctaactgaactcctgatatttgtggcttttacattctagcaggtgtgccataatgagtgatattatttataacatcaaacgctaggagaatcacaaagagctgactccaccttgagtttgccttctagaaacagaaaaatagcatgaatcctaattttcacaaagtagatgaagatattcaatttgatactttaagaactttccaaatgaactaatttgaaaggaaaacgaaaagagaggattgaaagaattgtcattccctgttcaaatatttaatcttgtcaagttctctttaaatttgagtggaggcaaattcctgaagatcaagcacctggcctatgaaaatgtattaaatatgttttgatgataatttcagtgatcatagaaggcatttccaaatggaatccattacactgcttcaagtattattacaatgagttctagttctttcactaggttaatagattaataagttttattatcttgcttgtagaaagcattgaaaattcccaaggaagaaaaaataagttcaaacaagtaaccagaaaaataaaagagaaaaaggataattcacttctctattgtaatttatgtgtttcttgtatgtgggattagacccagcaaagctaaaagaggcaactaaaagctcagccccagtgctaattttgtatccttgaggaaatcacataccctttcaagttttaattattcatctgcaaatccaagattataaaatgacctcatattctagttgacaatgtttttatatcaatattttatttctttactttttcctcatactgtgccttgcttctcctttatatgtaaagtttacatatcaatttatacatgcgtatatataatttttctatcaatttcaggagtggataaaggatgtctttgacccaaattcttgccaaatctccttccaagagaagtattgcctattatactccaaatgtacaataccatagcattagtttagtaaaaaacaatatgtcttgtttctcctttatttttcttgatgttttcataattttaataaaaaacacttaaccaaagtgctgaggctgtgtttacaataaggtatttttaaattttatctctcctctaccaacacatacacataaatttaggaggaaaataagattaggtagcatcaatttggtgctaatgaaaatgaaaccagcattgatattttctaaatctaataatgcatgcattttgaatagttttctttgactcatttcccctgaaggtgaattcagattctttaggcattttcccaaaaataatttttaactctctgccttgtagtgaaattttccaaattgaaaagccatgtagaatacactgcgaacaattttacagccttcattaatatataagtcaatgtctaggtcacagcttctattaggtagccttatctttatcgatagttttccccaacttcagattctggtaattgcatgacttaccctaccctctctgtgtttaaatcctagattaaaggaggaaaacagcgtcctgtgaacactagcctcaggtgctgacagcatcatcctttgtagcagtccctgcaccttatccttacttagtaaataatcctttatttaaaaaaaatttgtttgagttcattgtagattctggatattagccctttgtcagatgagtaggttgtgaaaattttctcccattgtgtaggttgcctgttcactctgatggtagtttcttttgctttgcagaagctctttagtttaattagatctcatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcccttccccattgcttgtttttctcaggtttgtcaaagatcagatagttgtagatatgtggcgttatttctgagggctctgttctgttccattgatctatatctctgttttggtaccggtaccatgctgttttggttactgtagccttgtattatagtttgaagtcaggtagtgtgatgcctccagctttgttcttttggcttaggacatgaacagacacttctcaaaagaagacatttatgcagccaaaaaacacgtgaaaaaatgctcatcatcactggccatcagagaaatgcaaatcaaaaccacaatgagataccatctcacaccatttagaatggcaatcattaaaaagtcaggaaactacaggtgctggagaggatgtggagaaataggaacacttttacactgttggtgggactgtaaactagttcaaccattgtggaagtcagtgtggcgattcctcaggggtctagaactagaaataccatttgactcagccatcccattactgggtatatacccaaaggactataaatcatgctgctataaagacacatgcacacgtatgtttattgcggcattattcacaatagcaaagacttggaaccaacccaaatgtccaacaatgatagactggattaagaaactgtggcacatatacaccatggaatactatgcagccataaaaaatgatgagttcatgtcctttgtagggacatggatgatattggaaaacatcattctcagtaaactatcgcaagaacaaaaaaccaagcaccacatattctcactcataggtgggaattgaacaatgagatcacatgcacacaggaaagggaatatcacactctggggactgttgtggggtggggggaggggggagggatagcattgggagatatacctaatgctagatgacgagttagtgggtgcagtgcaccagcatggcacgtgtatacatatgtaactaacctgcacaatgtacacatgtaccctaaaacttaaagtataataaaaaaaaaaactgaaattggcctgttttattatttctcgtcagttctttgatttaataaaccagataaaatctcattataactaattcctaatattagccaagttattttattaaaaataactaagacagaaaaaaattggcttcaatatttggttataattttagaatatgagattacaaagaaattgtattgtactcatgatgttggtagcagggtttaacaatatatcttgggaaataaaatatttccatctatatcagaatgatatctagatgcttgtgtttctcttaatcttttaaagcttctttttaaatgtcttgttctactgggcttactctacagtgcaggtagatatattgaaaattcctaatttttcaatatatgaaagaaaaaagcaaagaaaagaaatatcagaacaaaacaggtatttagtaataaacaagtcaactgctttcttaaaactagagttgtaaattagttctcagacacttccacataagagtcacatgacacttactaattttaacagaaggctagccctgaagcagtgacacatgtttttgtgccatatttaattccacacaacattgattttaatgggaattgctagggagtaactacagttttgcccatggtcatcaaagtcactacaacatgtcttcaggaactatatagtcaattcatcgccctggccaatggccaatttgtaagttagatacatatcttttaccttgttattaaacaaacaaacaaacaaacaaacaagctctattcttctaagtgagttggttacatttaaattatcatttatctatgtatgtacgtatgtatccatctatctatctatctacctacctatctatctatatcttttgctgatgtagaactgctgcttttccagttgtatccaagtaaagttccatatcaatgcaatgatcccttttgtacagttattaagtataagttttctataaaaattagcattggatatgtagactactcatgtagttagcgatttaagttaagaccagacttggagaaataaatattaagtcagaatgaaaatcactgatcagctgacatcctcctttaaaagtgagaatatttcccacagaatactaatcatttaaagacaacttgctgtaaatgaaagacaaagatgaataaagccaaacactggtatgctgcagggcaagatctttgtatatattctatccggtatttgtttttgaaaattatctttattcatgtcatgaaattatcaaagaaaagagtgataaaggatctctgggttatgacagcacttctcctgcgatttttttaaatgtaaggaattcagtcagactcagtcagtctaaaaagatgcaaattcttgggaattgtatccagatcagataaaacgttggacactggttaacacagtatggtccacgtcactgactctcacagttacagtgtagtaatacatcagattatttgccaaaaatgtccagtgatgtttgttccattagtactcaaagtaaaagagtgcatctattctctcaagtaatattgaatgtacagtgtgtttcagacatttgtgaaaaaaatacattggtagttccgctcttgaggagtacgcaatctgttaaagaccaccaagttatttttttttactggaagtctttatgcaaagatagagaaaaatgtctacattgatggctgaacacctaggggattgaggtgtagtgaagataaaagaagagcacagaatgtatacctgaaagacctgaagaaaattttaatttcttttttttttttgagacagtctcactctgtccccaggctggagtgcagtgacgcgatctcggctcactgcaacctctgcctactgggttcaagtgattctcctgcctcagccccctgagtagcagggactataggcgtgcaccaccacgcccagctaatttttttttttttttgtaatttttagtagagacggggtttcaccatattggccaggatagtctcgatctcctgaccttacaatacacccgcctcggcctcccaaagtgctgggattacaggcgtgagccaccgctcccggctgaaaattttaatttcttgacccatattcttcagttccctctaaactatgctttcaagaataatgtaaatgcaagttaaaaatgtagtgtccaactgttctcacattaagaaatcagggttacatttggtgagaatacaaaaaaggaaaaaaaaataagtcaagattaattgatcatattaatttcatggtatcactccacgaaaatccagaataattaaattaaaaacaaaagttcaaggcaaagcattgctacaaaaatttcttataataattaatttactggttatgccccttacaggagtcaggaaacaggttagattccttacccagtgtgcccactaatagtccctttataaaaccatctcctggaggcactagtcctccctcagaagaacagtaggtgaaggagttctctggtttctggccttgaggccagttcctgtttaagcctaaataaatgaataaataaataaataaataaataaataaataaataaataaatattcctcttccaagaggcatctggcagttccccttatccctgatgagtccttcttaagaccatgtcgaattaagttaaatgaatcgaaagtaaattaggattaaattgtataacattgattcatacattgccttggatgatttatatacatttggaaagtttaatactttatcacaatggttaagttttaatgcaaaataaaattatctatgtagtgttttaaaatgttgattagcctactccttagcctttttgaagtactttttaaatttctggtgtaaattctggcatgtagttctttaaaaaaatcctgcaggaagtttttgtgcctttcaaagtttgagggcccctaatcttgggcatacaaatcagtctttcttctgattaatgtggcattgtccatcatttttataaatatgagtctcaaacccttgattgataaagaaaatgctcattataacattgtgacatttggaaaaatttaatattttgtatttttaatataaattaattctttcagaactattaaccttataggaaaacactagagagaatgattttagcagatttttgtaagaactcatctcctaaggtttaagaaatacctacatggtttaaaatagtaattataaacatagtaattttaaaataagatactattttgtttaggtcttccaagtcagttagctggtgtcagttttatggtcagaatgacaaaaatatataataaaaatgtgcagctcatttagctgttgaaggctaatgaacaattaaagcattccataagaacttaatctcacccattttttagtcctatttaaatctgctcctcctttccacaaagttcgaatggcataaattatttaagtcatatacaaagggaacccaatcaggctggcagaagacttctcagtagaaatcttgcaagccagaagggattaggggcttattttcaacactctaaaagaacttaaactaataatttcatattcctccaaacttagctttgtaaggaagggataaataaagtattttctagacaagcaactgacaagggaatttgtaatcactagaccagctttacaaggcaacctcagcggagtcctaaacatggaaaaaaaggacaatttctgccaccacgagaacacaattaaatacatagtctgcagaccctataaagcaaccatataatagaaactacaaagcaaccagctagcaatttcacaatgggatcaaaacctcacatataaatattaaccttgaatttacatggtccaaacaccccacttagaaggcacagacttgcaagttgtataaaacacaaagactcatccatctgctgtcttcaagagacagaactcccatgtaacaacacccatagttcaaggtaaagggttggagaaagatgtatcatgcaaatgaaaaacaaaaaagaacaacagtcacttgtgttagataagacagaatttaaaccaataataataaaaaaggataaagaatgtcattaaataatgacaaagggttcaactcaacaagtagacttaactatcttaaatatgcacacactcaatattggagcacccaattcataaaacaaatacttcaaaacctataaaaagacttaggcacaaaacaataatgggagacctcaacacatcaatgacagcattagagagatcatcaatgcaaaataacaaaataatcctggacttaaatttgacacttcaccagttggacctagtagacgttacagagcactctacccatcaaccacagaatatacattcctctcatctgcacacagaacatactctaagggtgaccacatgctcagccataaagcaagtctcaataaacacaaaaaattaaaatcatatcaaccatactcttgaaccacagtagattaaaaccagaaaccaatactaagaacatctcccaaaaccacacaatgacatgcaaattaaacaacttgctcctgaaggactttcagataaacaacgatattaaggaaatttataaaattatttaaaatgaagacacacaacatttcaaaatctctgagatgcagcctatacaatgttaagaggaacatttacagcactaagtgtctacatcaagaagttagaaagatctcaaattaatgatctaacattacacctatgggaaccggaggaaaaggaacaatctaaacctaaagctaatgagaggaaagaaataactaaaatcagagcagaactgaatgaagtagagacccaataatccatacaaaagatcaacaagaccaaaagttgggactttgaaagcataaacaagagagataaacctccagctagatgaacaaaacaaaaaagagaagatccaaataagcccattcagaaacaaggatgacattacagccaaacacatggaaaccgaaaagatcctgagaatattatgaacactggatgcacacgaactaaaaaatctagaggaaattgatacattcatgaaaacatacaacctccccaaattgaatcacaaagaaattgcaactctgaacaaatgaatcagtcataaaaaaccctatgaatcaactaatgtccctgaccaggtggacataattcacagccaaattatagcagaaatacaaagaagtcctactaccaattctactgacactattacaaaaaattaaggaggaactcctctgtaactcattctatgaagccagcatcaccctgataccaaaacctggcagataaacaatgaaaaaaagaaaaactacaggctaatatccatgatgaacataaacacaaaaatctccaaccaaacactagcaaacctgatccaacagcacatcaaatagctataccatgatcaagtagcctttatttctgggatgcaagagtagttcaacatgtgcaaatcaataatgtgattcaccacataaacaaaattaaaaacaaaaaccatgtaattatgatcatctccatagatgcagagaaagcttttgataaaatctaacatctcttcatgataaaaatacttaaaaaatgagtcaccaaaggaacatacctaaaaataataagagtcatctatgacaaacctatagccaacatcatactgaatgggcaaaagcgggatcaatcccttgagaactggaacaaagcaaggatgctcactttcactacttctattcaatgcagtactggaaatcttagagcaatcaaagaagagaaagtaataaaagacatccagatatgaaaagcagtcaaactatttctctttgctgactatatgtttctacactaaggaaacctcaaagactctgctgaaaggctcctgaaatggataaatgacttcagtaaagtttcagaataaaaattcaacatacaaaaatcagtagcatttctataatgttcaagtggagagtcaaatcaagaacacaatcacatttacaatacccacaataaaaattaaatgtctatgaatacatccaacaaagaggtgaaagatctctgtaataactacacaatattgctgaaagaaataatagatgacacacacaattataaattcattccacactcatggaaggtaagaatgagtattactcatggtcatactgcccaaagcaatttacagattcaatgctattcctgtaaaactaccaatgccatttttaacagaaatagaaaaataggattctaaaatatagaacaaaaaatagcctgaatagctaaaggaaggtaaacaaaaagaaaaaagccagaggcatcatattatccgacttcagctatacaataagtctacaatatccaaaataggacggtattaatacaaaaacagacacatagacgtatggaacagaaaagagaacccagaaggaaagctgcacacctataatcatacgatctgtgacaaagttgacaaaagtgaacgctgggtaatgttcaatatatggtactcaaaaactggctagccatatgcagaagaatgaaactggactcctacctttcaccatataataaattcactcaattcactcaagatggattaaagatttaaatgtaatacttcaaactataaaaaccctagaaaaaaacccaagcaacatcatttttgacattaggctaggaaaacaatttatggctaaatcctcaaaatcaattgcaacaaaagcaaaaattgacaattgggacctatttaaattaaagagtttgcacagcaatataaaaaaattttaaaaagatcaacagagtaaatagataacctgcagaatgggagaaaatatttgtgaattctgcatctgacagaggtctaatacccagaatctataaaaaacttaaacaaatttacaagaaaaaaataaccctattaaaaagtgggcaaaggacatgaagaggtacttctcaaaagaagacatacaaacagccaacaaacaaatgacaaaatattccataaagattgttaagttccattggatcgcatgataatttcattgaatctgtgactggtaaaatttacagcttcagtaacaccagatgtaaaatgaagaatctatatgttggtcaggttataatcaagacattatttttcttgtcataattacacatactcttttatcatgtattttcttgaggaaatacatatatgcaaacaaaacggtaggtgctcttattttctttttaaacaatacaatatgaaatataaatgtacactagatgccacccaatttaagaaatagaacattactggcaaggtgtggtgtctcactcccgtaatcacaacactttgggaggctaaggctggaggattgcttgaggccaagagttcaactagcatgggcaatgtagggaggccctgtctctacgaagaaaattaaaaaatatagctgggaatggtggtgcacacctctcggcaggaggatcacatgagcccagaagttcaaggttacagtaagctatgattttgccactgcactctaggcaatagagcaagaacctgtttccaaaaaaataaaaataatgaaaatatttgatctaaagaaaggaatataccatgttttcctttatttagcatattaataaaaacaataaagatacacatatttcagttactggtatcttagaatatcttgcatatatacaatctgagctttttgatcaggaaaaaaatttaaaagaatctcttgcataccttttcttacactatcctgaattttgcgttattacttgccatagttgatagacagactataatgtatgcacccctaaacagtatatagtttttccttttttaactttatgaaaataaaattatacccttgaatttatacccaaaaattctcatatgaaatattttatccatgcaattaacaaatttaatccaatggctataaaatatagactattataccaaacaattgaggaattagaatgattctataatgtcttttatttacttgtgctacttggataattgttattttcctccattttattttactaagtggagggctggtttatgttaccttttcatggagaggacaaaattaaaggtatctcaaggcaagactaggtgtgggcctgtagacaacactaaaatgaatataaggagagagatatgctagtaagggataccacaatgggcaaatgcttttatttttgacctatggatgggaagggatacacagacctgtagggttaatggtatccaaacacatagaaattctaacatacaagcattcagtagataagattatcaactcccaatttctactaaaaaaaagttcatatgctaatcaaccatatcagttgcttcaattataaacctcatttacaagtcttaatagaaaaggaattgatttttttctgctttcaaagagaaaatgagtgaaaatagacaccctctaaagcatattcaacacctacccaacaaactttcaaaggtagatctatttagctaccaccatttacttgaagttaaaatggtacacaaaaatctattgcctaaatggtagtcttcattttatcatttaaaattaagattcgactaaaagatcaatagaaaaatatttgatctaaagaaagaaatataccatgttttcttttatttagtatattaataaaaacaataaagatacacatgcttcagaatggaaagaaaggtgtttacttttaacggcagaacatatcaatcacctcattattacataatatattatttaaggtcaagtgtagatgctcaagcttgtaatcccaaagctttgggaagctgaggagaatgacttgagctcaggaatttgagaccactctgggcaacataacaagaccccatctctataaaaaggaaaacaatgaaaataaaattagtcatgtgtggtagtgcccacctgtagtcctagacccttgagagactgaggcagaaggatcacttggatgcagggttttgagtctgcaaggctgcagtgagctataatcatgccactgtactcaggcctaggtgacagagcaagaccctgactttttaaaggaactgtatttgcttctattaaacaggtcacaaacactctcaatagttttttttctcaaagttgagatatatggaacaagtttttaaaatttcaccatattgataaaattatcccctaaatctatccagggtaatatattatccacaataacatattttcatatcttctttcttttactccttactggttttctactgcttcaataatttgtttttctctttattctatcttgattcatgtctagttcttgtttcctatgatatcctccttgtaattttaacccagttcatccctctaatcttccattcagtatctctctgctgtgtaggaagcataactgtgctgagttcttggctggaccactgaaatcaagtaatgactgaatataaatcagaatcatggctgtaaataaaaagaatgtgaccaaatgtccattagcaatgatagtctagtcatataaaaatgtggctattttcaattaataaaacaaaacaaggaagaaaaagtaaagacaatgtcaggaacgatgataagaataagcatgtaacaagcaaatggtaggtttgcttcaaccaaatggtaggtttgctttcattacatgaaaattttaccaaattgtacatataaagtcttctaagaacaatatacaaataacattttagtatataaattggctcaagaaagtcatttttcagggactctagatttataggctctttaagtctctttaaaactgtaaatgacccacagaagttggctgccctaaaggtttagattaaataaaccatccagtgcacaattcaaatataagctgaacaaccttaattggaatatctatcctgtgcggttttccagtttctgatttggtactccccaagtagcaatttcctatgaattaccgtttcccaactaagaggtacagaaattcccagtttctttaggaggctgaatattttaaaacttcggctttattaaggttttcaacaaagttctaattaaactacacttcattaatggcttacccccctaccttagaataaggagagctttcttacaattattaaagctaaccttcagaactgttgttaataacaagactaagaacaatttttaattttttttaacttcatagctgtaggctaaccaatagttaacaaataattcattcatttcattggcatcatcagtcctcctagcaatatgtgttttttttttttttaatttaagacttggtgggggaggcggtgaggactgtgcaattactagtcactgttttcccactcattggtactattagcttaacagataaaaccacagataacagccgcaatcaacttcagcaggttcccagaggcaagctcttgctttttgctgattagcttcattcaattatgtcttcttaattgttcatgtgctacagctcattaaatgaaaaataatattcctttcctgtgggtagggcacttgagatttgaaaaatagccacttcatctctgcctcagaggcacaagtaagttgatctgatggtgtctgaaaaagctcaacagatttgtgcagatagccctgcccgagaagggacaataaaattaataaaattgattgttaaatcaagtcaaaaataaaattactcccagtattttcctttaagattaattttcaggaaaattagacccagttttgtagcatttgattatgttcacctctgtaatataattttctttgtaaaaagatcagttattgctgttccattacagatgggatttagggaaagtggagtaaatttttaaatttttctgaaaatagattttgacagattaaaaagtgtgtcacacaatttatttatgaaatattctagaaatggagaaggtaagtttcattcattaaaatagattcattgagtacctactatgttccaggccttttgctacacaatgaggatacaaaaggtcttaacttcaagaggtttattagtctggtggagtagaaataataattcaataataatccattagctaatatatactggctatttactaaggacctataaagtacttggtcgatatgtgtcaccttacttaatctttttaacgatcttataacatagaccatatcatattttttattatagatgaactaaggcttagaaaaattatattgcttcctgatatcacataactagcaaatgctaaagtttagtttgggacaagatatgtatgaccttgtagcattcctatttacaggtactcctcaatttacagttcctatatgcatacatttcagtcaccatgtttagttaagttagaccagttacccagctcaagcgattctcccacctcatccttctaaagtgctgggattacaggcatgagccaccacacctggacggatgtgccatagtttgtaaaagagttgagaatggctgctagctagtagaaaaaaatggtgatattagaaacatgggtatattttcaaatgaattccaaaagtttgagaaagtaatagaatttttgtctgttttgttctctgttatttcgcaaacacagatactcagtacatatttttgcttttttttaaggagatgaaaaagtctgacatgattttataaaaaataaaatttcaaatttcagctaccacagtgtattaactgtaagtaattacataagtacaaattttgctccttgctctttggtccaaaatcattatgtaaataacaggtgtgcttcatgatcagtgaccattggcatcatctttttaaatgtctgtcagtgattgatcactacacatctattattcatcacatgcagacagaaaagtgtgcagttatgttgtctctgtttcccattgataaacacaagtgccatttcttaaaaataaataattgaaagaattggccagaaaagataaaagtacaacataaagtaaaacgttgagtccagtgaaaatggagctacagcaaaatccctgtgggaatattgacactgctgccatctgaggaacttaagctttgcagccagaacaacttagtgcagaggagcttattgacataaatgaagaaagtggatgtgatgaaaaggatgaagatgtatcaggctaagtgacgccagcaaaaacccaaacacacaataaaaaaaaaaaagacttacattaaaggaacttacagagatacttaacaatattgaaagcatcaaagcataaagtgatgaaagctgatccaaatttaagattatgacaatttgccaaggcataaaacattgcccccttcattgtaagccatgtaagaagaaatcaatcactattcaaactattagtaaacattttttaacaaacaagtaaactttaagtctttaacatcaatgtaattaagagggaattggccagcatatgtgaaagtatagcaaacaaatgaaaataatgatgcaaaaaataataatgtaagatatgagttgaatataaacagagttatagaaagaaagaactgactttaattcttttattcccagtgtaaattccaggatgttaaatgaatatgttttataatttatttattttcctacacatttgtaagtgacagtaaaagagtttctaatattttgaaaagaaattaaaggttatggaataatatttattcttgattattaagataaacttgcatgatttcagctgagattatcatgtttatcatccttcactaccatgtaaagcgagaagtgtgggtattaacttattatctgtttgtttaaagtgaatgacacacagcttagtgttacatcaacagaaaaatatttaagaggaaatgacactaaatcaattttaagataatgcttctattatgtatgtttctgtatcgtctttctaaacataattatggaaaaggcatcccaactggtgacataattattgccaataatataatagtaatgacaatatatttgttggtcaattaaaagtaactacattagctttggtaaaactacatttttcacttacatgattaaagacacttatcagtgctcttgtgatcctactttaagatatacatcttcatattaatttgtaaatgaaatgtgggagtttttcataaccaacaggtttaaagctgtgtgaagatatgtgagggaaatatatagttatgtctgtaagaatcagtgatgtgccatactttgtgttttgttgttattgttttcttgagacaggatctcactctgttgcccagcctggagtgcagtggcatgatcacagctccatgcagcctctacttcccactcaagcgattttcccacttcagcctcccaagcagctgtgactacagttgcatgtgaccacacccagctaatttctattttttgtaaagacacggtctgactatgtggccggggctagtcttgaactcttgggctcaagcgattctcccacctcatccttcttaagtgctggtattataggcataagccaccacacctggactgatgtgccataatttgtaaaagagttgagaatggctgctagctagtggaaaaaaatggtgatattaaaaacatgggtatattttcaaatgaattccaaaagtttgagaaagtaatagaatttgtgtctgtcttgttctctgttatttcccaaacacagatactcagtacatatttttgcttttttttaaggagatgaaaaagtctgacatgattttataaaaaataattttgatgttagtaatcattactcaacatatttttgaagagtctaaaggaaatttccactgtttcaaaagatcccaccttccatttctctctatctcatctcctagcaatctacccttcatttattgtactctagttgtgcttatctttttggtctttatcaaacacaacaaatattctgagaccttaatatttctgttccctctccctggaacactattcctcaagaaataaaattaggtaattatttcaatcaagctggtatttaaacatcttctgctcaaggaggcctagctgataatctgtatttaatgttccagttttcctatactctctctgaacccccattggccattctattttgttttatccatagtgcctatcacctgttggcatattatatgaactctttgtttattaacttatttgttaattttattgtttatcatttatgtctatcaatggcatgtagactctaagagagcaggcatatttgtgtgtgttattcattgatatttcaagattaccaaacagtgtctgtcatatagcaaccattctttttttatttttttctgagacagagtcttgctcccgggttcacaccattctcccacctcagcctcccgagtagctgggactacaggtgcccaccacacccggctaatttttctatttttagtagagacgggctttcactatgttaaccagggtgatctcgatctcctgaccttgtgatctgcctgcctcagtctcccaaagtgctgggattacaggcatgagccactgtgcccggcccgttcattacgtaagaataaagaaatatccccttgacatgaaattctgtgtattggaataatatatataccatggcaatgagcatttgtcattatcttagtcagcagtatatattttcctagacaatgaaaagactcccaactggccttttgtatgacaaaaagaactgctaatcactttcccagtttggcttttatttatctccagattaaagtgttattaaggattaatttaatgttattttattccatttagtgaacttttaaacaataaaacacttttatctatgttgttttgcacccatatgacaataaagtgttatcatgcccatactataagtagaaaaacacaggtagaaagaacataactgatttgctcaaagtcatataactcagaagtgaccgaatacatttgcctgactccaaaacttggtctgattttatcatcccttgctggctgtcagatctgatatatcagtccaaaaattacctcttgcttaaaccgatgttttggatgacttttgtaattttctgcgttccatcatttattagcgccaatatataaatggttatttagaatacagaggtttacacatattcgggaccaacattccaaaaatggcttaaatatttctggcagcctaatattatctacggagaattattttcctcaagaacattagtgagatgtgctataataatggttgagcaaagtagcacaacactagatgctgtgtaactctgggaacaccttatttcctgctctgatagaaatctgttaaagaccctcatctgttacaggcagagagaagagcagagtaaaagtgctttgcctacctaaagggattgttgtaagaatctgatgagttaaactgtgtgaaagcattttgcaccctctaaatccatacatttacatgtgacttccctgtatgacacaagctaacaaacaaactagaaacaagcaaacaaaaaaaaaccgagacacaaaaataaaatatctttctgttacctcatttgggaaggggtctaaaaacccagaaataatagtatttacatgtacatgtagttggtaaacattcaatggagtaaaaagtaaattaaaaataataccattagcagaggggaatgtatttttacttatgcatatatacccacatattggatttgtctctatttcatctgtaggacctagccactagccaaatgcccgaagcccctagaaccccagtgcctagtgtggtatgcagaaaataatgccctgttatatgtccattacctaattccaagagccttggaatatgttaccttacctggtaaaaaggactttgtagatgtgtttaaagttaagaacctccatatggaaaaactgtcccaaattatctggatagacccaatctcatcacattagttttaaaaatattaaaccttccttggctgtggtcagggagagaaatgtgattgtagaagaatggcaggcaaatgtaacattgctagttttgaaaacaaaaggagtccagaagtcaagggacgtgggtggccactataagctagaaagatcgagaaaactgattctcccctagagcctccagaaagtagcattaccttgccaatttaacctgattttaatcgtcagacctgtgtcaagcatgtgacttagagaagtataagatattacatttgtgttgttttaaggcactaattttgtgataaattgctaagacagcagtagataactaatacagctagaaaacaattttaaaatacattttaaaaagaacttcaacatgccaatatctaatgaataaaaccaaaaataggatgaaaaattaaaatgaaacttagaatttttctatattacatatttgggaaatttgaattatttcataatattctgatctcaaaaatatgaaaaaagtagcttgtctagttatcattcacctgaaagcaactgttttaaacctgtcattacaatctgataaaaagtaatatgtctcattcagtcccaactacgctcaacatgacccaatcttgtcagaacccaatgtgaagcttcaagtgtacaggaatttacaatgacaatgctccatggaattttcaatgacaatcaatgttccaaaaaagctatgacctacacttgaggctatcccaaggagaagcaaatatcatagcagcatcttacatttgtgaacacagtggtaaatatagagcatacaaaaccatgcatgggtattttcttctgtttttaacaatggataatgaatgtcaaaagtgatattcaaactagcaatatgcaagttaaaattaaatccataaagcacagcaaaataagcatttgttccattgtagagctcacgtttccttgagcacttattttctttcttttccctcctctctgctcctgtcccctcccctccctccttcccttccttcctcctttcctttcttccttcgacttccttcctgacttccatttttcttttttcagctttattgaggtatagctgacaagtaaaaatgaacatatttaaggtgtgcaacttgatttttgtatatgcatacattgtgaaatgatcatcataatcaagctaattaacatatccatcacatccataatgtaaaacatatctaatgttgtacattagatatactgttaccatgctgtacaataggtatatgccacattttccttattcatttatctgtccatggacacttaagttgtatccataccatagctattgtatataaagctgaaatgaaaactaaagcaaatatcgattcaaaattattttatttcctttgaataaagactcagaagtgggattgctgaagcatttggtagttccatttttaattgttaaaggaatcttcatattgttttccataatggccacaccaatttacattcccatcaatatgtcttcctttttctccacttccttcacaaaatttatattttgaagtttgataatagccattcaaacaggaatgtggtgatacatttttgtggttttgatttgtatttcctgataattaatgtcattaatctttcatctttcatctacctattgacctgtcgtctttcatctagctgtttgccatttgtacatctttggattaatgtccatttttgtaaatttatttttctattgagttttgtgaactccttatatattttgaatattaccttttatcagatatacagttgcaaatattttctgtagtttgtcttttcagtctgttgattgtttcttttactgtgcagaagctttttagtttgatgcaattccacttctatacttttgtttttgttgcctgtgcttttgctctcatatccaaaaaaatcattgccagaaccaatgacaagaatctttttcctgatggctttttgctattagttttacagtttcaagtcttatgtttatgtctttaatccattttaagttaatttttatttttgtatgtggtaagagcttatcttcatttttctacatgtggatatccagttttctcagcaccatttattgaagaaaataccttttccccagtgtgtattcttggtgcccttattgtaggctggtttactctaagtgcatggatttatttctgggctctctgttttcttgcattaatctatatgtctgtttttatgcaaattccacactgttttgattagatttgtaaattattttgaaatcagaaagtgtgatgcctctagcttgcttttcttgctcataattggtttagctatttgctatttggagtttattgtggttccatataaattttagaattttttttcctatttctgtaaagaatgccattggaattttgacagggattgcatgaacctgttgattccttttggctagcatggctactaaaacaatattaattatttcaattcataaacatttattttccatggatgaatgttttttcatttatctatgctttaacatttttccttgattcctcctccaagatggccaactagatgcagccaggagaaacatctcccacagagggaccacgacatcaggaagacgggtgtacccctagtaaatcttcagagggaaggcattgagagcagatagagagaagatacagaaggtgggataaagggagatgaagctgggaatgctgcatgtggctaccacacaccaggactcattcctggctcccagcaactcctgtggaaggggtgagttgaacagaaatgagcaactcactctcaccatgagcctctggaatcatagcaggaggagtcttgtcagccaccatggacacttgagttggcagagaaagctacttagtgaagtggtagggacagaactccagctgcagcagagcccatggggtttggtgcaggagcatctatagtggagaacagccagggatgcccatccccctaggcttgatttgctcctatagtagacattagccctaaggaaaggggtgaacgtagactctgtagagcagtcttgcccatgagatgagccaggccccctgagcaccctttggtgtgctgtcttctctttgggccccagcctgcctgtacctgctagcagtgtacccccccaggcacctcaagggggcctgcctcattgctcctgcactggtggactgcagctgactgggagagtgctccagaagagcaaaccctgtgtatacatataagactgcccatgtcctccccacactacagcctcctccatactgctttgctggcaggcactcgctgccagcgatccccatacatctctttgcctgtacatgtgtttgcagacagacctagcctttccttctctgacagtgcatgtgtacacatgtaccatgccatgccatgccactattgctggcttgagtgtgccccatcccttctccccctgttgcactgccatttttgttggagcattggagggcatatagtttgacagctctgccaccaccagtgctccactcctgtgccaaaactgctggcatgaaactaagcacagaaaacagtgtatctactcccatccctgagaggtcactgctgtaagcaagaatgctcacagagggtgcacacagtcctgcgaccactagcgccccatccctgtgctaacaccagcaccagtacaaatgtgcacaccattgccagcagggccctccaccttcccaaaccataccgccacagccactactacaaacacccacatggaggctgtcatcttccatgtggatggaggatgccgctggtacatgcaaatgtggacacatcccactacgactgtcctacaaaatgctttggctgggagtagccattagagtgttgtgaccagcagtctgagatcacattgacccctccagtgcagcaggttcctaaacttgatccacaggtaatagctggtgtatgataccagtctcccagagttagagcacacaatgcagagtgctgagctgagccttggccacctgaagtcttccactaacaaagccaggtgactgaacacagcttataccataatcaaaccctcaaggtcataaaatagaataaaagaaaaaaaatccaaaggacagcaacttcaaagattgaaggaacaccagcccacaaagatgagaaagaaccagtgcaggaactctgacaactcaaaaagccagagtgccttctttcctccaaatgagcacactagccctccagcaagaattcctaatgaggcagaggtagctgaaatgacagaaatagcattcagattatggataggaataaaaatcattgagttttgggagaatgttgaaaccacatctaaggaagctaagaatcacaatattaagatacagaaggtaacagacaaaatagccagtacagaaaaacaaacaaacaaacaaacaaaaaacataaatgacaggatagagctgaaaaacactctacaagaatttcataatgcaattgtattaagagaagaataccaagctaaggaaagaatctcagagctcaaagactgtttttcttaaataagatggtcagacaagaataaagaaaaaagaataaaaaggaatgaagcaaacctccaggaaatataggaatatataaagagaccaatattatgactcattggtgtccccgaaagagatgagaagaaagaaagcaacttggaaaacataagtcaggatatcatccatgagaacttccccaacctaaccaccaatattcaaattcagaaaatgaagagaactcccacaaagtacttcacaagaagatcatccccaagatacataattatcaggttctgtaaggtcaaaatgaaagaaaaaaatgttaaaagtagctagagagaaaggacagatcacctacaaaaggaagcccatcagactaacagcagacctctcagtacaaatcctacaagtcagaagagatttgggacctatattcaataacctaaagagaagaaattccagccaaagaaatttatatttggctaaacaaagcttcctaagtgaagggaaatatgatccttttcagaaaagcaaatgctgagggattttattaccaccagacctgccttacaagagcttctggaagcattaatatggatgggaaagaccataaccagcaaccacacaaactcacttaaggacacagaccagtaacactataaagcaaccaaacaagtcagcataataagtcgacagcaacaggataacaagatcaaatacacattaatactaaccttgaatgtaaatgaactaattttcccaattaaaaggcacagaatgtaagctggataaagaaccaaaacacaattgtatgctgtctgcaagagacccatctgacatgcagtgatgcccacagaatcaaataaaggaatggaaaaaaatctgccatgcaaagagaacacagaaaaaaagcaattattgcaatcctaatttcagacaaaaaagattttaaaccaataaaaataagaaatggcaaagaagggcattatataatagaaaagggttcaattcaacaagacctaactagcctatatatacatgcacctaacacagaaacattcagatttataaaccaagttcttagggaccttcaaggagacttaggctactacacaataatacggggaaattttgacacccccactgacagtattagacagaccatttaagcagaaaattaacaaaaataatcagaacatgaacttaacactggaccaaattgagctgtgaaacagctacataactgttcatcaaaaaacaacataatgtacattcttctcatgtacacacaacacatattctaacaatgaccacacaatcaaacataaagcaatcctcagcaaatgcaaaagaaacgagatcataccaaccactctcttggacaacagcacaataaacatagaattgaagaacaagaaaatcagtcaaaaccatacaatcacatggaatttaacaacctgttcctgaatgacttttgggtaaataatgaaattaaggcagaaatcaagaagtattttgaaattagtgagaacaaagatataatataccagaatctctgggacacaattaaggcagtgttgagagggaaattcatagcactaaacacccccatcaaaaagttagaaagacctcaaattaacaacctaatatcatagttaaaaagctacagaagcaagagaaaaacaacaacaacaacaaaataacaacaaaaacaaacaaacaaaaaaacccaaagctagcagaagataaaaaatacaccaaatcagagctgaacagagactgagacataatacaaccattcaaaagatcaacgaagccaggagttgactttttgaaaacattaatacaatagatagaccactggttaaactaagaaagaagaaaacagagaagatccaaataaacagaatcataaatgagaaagggaatattaccactgaccccacaaaactacaaataaccatcagagactactatgaaatcctctatgaacacaaactagaaaatctagaataaatggataaattcctacacacatacagtcttccaagctgaaccaggaagaaattaaatccctgaagataactataacaaatgctgaaattgaatcagtaataaacagcctgcaaaccaaaaacagccctagaccagatgaattcacttctgaattctaccagatgtacaaagaagagttggtgcattcctactgaaacggttcccccacaattgagaagggacttctcctcaactcattctatgaggccagtatcatcctgataacaaaacctggcagagacacaacaaaaaagagaactttaggccaatatacttgatgaactttgatgcaaatatccttaacaaaatactacccagctgaatccagcactatatcacgaatccaccacaatcaatattctttatccctgggatgcaaggtttgttcaatatacaaaaaccaataaatatgatttataaaataaagagaactaaagacaaaagccacatgaacatctcaatagatgcagaaagacttttgaaaaaattctgcttcccttcatgttaaaaactctttacaaattaggtattgaaggaatatacctcaaaataataagagccatatattgcaaacccacagccaacatcagactgaatgggcaaaagctggaagcactgtccttgaaaaccagcaccaaaaaaatgatttctccacttgctatttctattcaacacagtattggaaattctgaccagagcaatcaggcaagagaaagaaataaaaggcatccaaataggaggagaggaagtcaaactaatcctgtttgcagatgaaatgattctatatctagaaaagcccagtttcagctcgaaagctctgtaagctgacaaacaacttcagcaaagtatcaaggtataaaaatcaatgtacaaaaatgactaccattgctatacatcaacaacagccaagctgagagccaaatcaggaatacaatcccattcacaattgccacaaaaagaataaaatacctaggaatacagctaaccagaaaggtgaaagatctctacaatgagaactataaaacactgctaaaagaaatcagagataacagaaataaatttaaaaaaaaattctatgctcatggataggaagattcaatatggttaaaatgaccatattgcccaaagcaatttgtacataaaatgttattcctatctaattagcaactacattattcctatccaattagcaattacattcttcacagaactagaaaaaaaatcaattttaaaattcatatggaaccaaaaacatagcccaaataatcaagggaatcttaagcacaaagaacaaagccggaggcatcatgctacctgacttcaaactatcctacagggctacagtaaccaaaacaacatggtattggtacaagaacatatgcatagaccaaaaaaacaaaacagagagtcaagaaataagtctgtacagctacaaccatctgctctttgagaaaactgacaaaaaataagtaatggggaaacaactccctattcaataaattgtgctgggataactggctagccatatgcagagattgaaactggaccctttccttacatcatatacaaaaatcaattcaaaatgtattaaatacttaaatgtaaaacccaaaactataaaagcactggaagacaacataggcaatactattctgaacataagatctgacaaagatttcatggaaaatatgccaaaagcaatcacagcaaaagcaaaaattgacaaactaattgaaaaactggtacactagtctccagtgaaagcaactgcacctgaagttaatggaaagaaagaaggggaaaaggaagaagaagaggaggtaaaagatgagggtgataagttagaccaagctgaagagggaggatctgagaaggaagcctctagtgaaaaagaggaaggtgagcagaaagaaggagaaacagaggctgaaggtgaagtagaggaagccaaagctaaagaggaaaagaaagttgaggaaaagagtgaggaagtggccactaaggaggagttggtggcagacaccaaggtggaaaagccagaaaaagccaagtctactgtgccaaaatcaccaaaggaagaggcaaagtcaaaagcagaagtggggaaaggtgaacagaaagaggaagaaaaggaaatcgaggaagctcccaaggaatagaaggtagagaaaaaggaagagaaaccaatggatgtgccagagaagaagaaagctgagtccctggtaaaggaggaagccatggaggaggcagtcaccattaccaaattggtaaaggtgcacttggagaaagagaccaaagaagagggaagccacagcaacaggagaaagaggagaaagtgggaggaaatggggaatgagaaggaagggagtgataaagattccaaggaatccaggaagaaagacatagctgtcaatggagaggtagaaggaaaagagaagggagagcaggagaccaaggcaaaaggcagtgggagggaagaggagtaagacattgtcaccaatgacctagacttaagcccagcagatgaaaagaagggggatgataaaaatgaagataaagtggtggtgaccaaaatagtagaaaaaatcaccagtgagagggagatggtgctaccaaatacatcactaaaactgtaaccatcactcaaatggtcgaagagcatgaagagacctttgaggagaaaccagtgtctactaaaaaggtagaaaatgtcacttcacatgccgtaataaaggaagtcacccagagtgactaagatttgagtccactgcaaaagtttaagccatacgacaatttcaaaatgcatgtgattgacagcttcaaaacagaacagattctcccataggggctccagacattgtattttactttgtgcaatatgaggagactgcatgcaagctcagtgtgctcccccctcagtctttgggggattcaaatgcatgatactgtatgtacctgggaaatttaccaatttcctgcactgttggaagggggtcactcagaaggggagatgtcttgagatgtattatgtaaagtaccaactgagccaaaaacaataaatgaaacacagaactctcttagccttaagaaagctatatatgaataattatgtttaccacactggtgcatttaaaatggacttttcttcatgggagaacctcgttgacacggacagtttgcaatcttatgttgatcgatgtgaaatgtcatagcagtacttgctcaataaaggtcatattggaaacatagtcaaaaaataaataaatgaaagagcttctgcacagcaaaggaaactatcaacaaagttaccagacaaccaatagaatgggagaaattatttgcagattatgtagctgacaaaggtcgattatctagcatctataaggaatttaaacaaatttacaggaaaaaaacaaacagccccactaaaaagggtgaaaagtatatgaacagacacttttcaaacacaaaaacaaaaaaatacttgcagccaaaaaaaagtattttaaaaaagctcaacatcactgatcattagagacacgcaaataaaaaccacaatagaaaacatctcacaccagtcagaaagctttttattaaaaagtcagaaagtagcatatgttggcctggttgtggagaagagggctcacttttacactgttggtgggagtataatttagttcgtccattgtaagaagcagtgtggtaactcctcaaagaaccaaaaacagaactgccatttgacccagcaatcccattactgggtatatagccaaaggaatatgattgatgtattataaagacacatgcccacatatgttcatttcagtaaatgtggtacatatgcaccacggaattctatgcagtcataaaaagaatgagaccatgtcctttgcggtaacatggatggagcaagagaccattattctatgcaaactaatacagggacagaaaaacagaaaacagaaatactgcatgttctcacttataagtgggagctaaatgatgaaaacacatggacacaaagacagcaacaaccagacagtgaggccaaccagaaggtggagggtaagagggagaggatctgaaaaaagtagttattagctactttgcttagtacacaggtgattaaacattctgaatatcaaacccccatgacataattttacctatataacaaacctgcacatatacccctaaacctaaaagttttctaaaaaagaaaaatgttgtattttgcaaaaagtaaacattttcctttattaatactttataattttcagtgtatgtattttcctgtttgattaaatatatttcaaagtatttattcttattattatataaataggatttttaaaatttcctttcagataatctatttttagcctctacaaatgccacttacttttatttagagcaactttactaaattcatgtattaattgtagcatttttggttgtcattgagacttttagacttttctgcctatacacctatatgtcaactgtaaacagagataatattactgtttcttgtctagtttgaatgtctttcatttctttttattgtatcattgttcttgactagaagtggcaagagcaggaaatcttgtacaggattttagaggagaggcttttgggttttccccattgattattatgttatcagtgggcttttcttatatggctattattgtgatgaggtaggttttctctacacctattgtattgagagttttttaaattagaaataggtattaaatttgacaaatatttttccagaacttattgagatgatcatatggtttttgtgtttcattctgtttatgtagtgtatcacattgaatgacttatgcatgttcaaccatccttgcaccccagggataagtcctagttggtcattgtgtacaattttttcaatgtgttgttgcattcagtttgcttgtattttattgagcatttctgagtctacattcatcaaggttactggcctgtagtttacttttcttgtggatgtctttggttatcaggtcgatgctggctacatgaaatgagtttgtaagtgttccatcatctagattttcaaatagtttaagaaatattattaattctttgaatgtttgctggaattctcccacaaagccatgcagtgctggactattctatttcttcttcaatcttggtaggatgtatctttctaggaatttatgtattacttcgcatttatctaatttgttggtgtatatttattcataacagtcccttaagggctctttttatttctgagacatctgttgtaatgtttcctctttcatatacagttttatttatttcagtcttctctctctctttggttactctaggaaaggatgtgtcagttttatttgtctttttcaaaacacaactcagttttgttgacttttgaaatagcttttttgtcctttttaaaatttattttttgccttaattagcattatttccttctttctgataatatttgggttagtatgtatttttttctgtctttggctagttatttttttaggttgtttatttgagatgtttctttttttttttcttcctcagaaacatttaataggtattaacaaacagaagccatgtctctcgaggctgtgagacaagatggtggatccccatgccattaacccccagaacccagggcttatatactataggtaaggagaattgaagtaatttggtcagaatttatggtaagtgtgtgctcttaacagtagtagagtaaaaatcttagaggcattcccagaaccgaggttaatgaaaagccaacatgttggattagcatttaagacagaattggtttagcctgtacactccacctatctgacccagattttacaatttcacattctctcttcttccaagatggtccctgagcctagagagaggttgtttgatattgcacagctttagcagtagtgcattggcaatggaaaacagattgggcccagttgctataatgttccttctcagaaatacttttgctatatctcacaactgttggtatgttttcttttcatttttgtcaggaggtaatttttaattttttaaatttaatcttggacccaatgattgttcaagagtgtattgtttagcttccatgtatttgtgaatcatatggtttcttgtttctttaccattaactgatttacactttcactctattgtgacctgaaaagatacttgatacagtttctatcatcttaaagttgagttgttttgttatctaataggtgatctattgtgaagagtgttccatatgtgcttgaaaagaatgtacaatcttctgttgttgggtaaaaagttctgtagatgtctgttaggttaatttggtctctcctattgttcaagtaagctgttttccattgatttctctgtggatgttctgtccattattaaaagtggaatattaaaatcttctagtattattgtgctgctataaatttctccagttctgtcagtgtttgctttaaatatttagatctgatattgagtgcatatacatttacaatagttatatcttcctattgaattaacctttttatctttatgtaatgaccttctttgcccctggagacagtttttgacataaagtctattttgtctaatgtaagtatagccattctgctttcttttcattaccatttgcataaaatatatatttttccatcctatcatgtttaactatgtgtgtccttaaatagttggtgccaagtttttattctttcagccagttaatatcgtgtgattgggcagtttaatccttttacatttaaagtaactattgatagggaaggatttactattgaaattttactgactgctgtttttcttgttcctttttttctttcttgatgtcttattttgtgtttctttttttgttattgttgtttgacaggctttaattcctttctccttttcttttataactagttttttaactactgtaggtagtagattttcttttttaagtactatggctattttctgtgtgaatgacatgagtcttacataaaatataattataataatctaaaactgataacttctcttccacacaaaaacttcacatttttaccttgttcccattatagattattgatatcagaatttacatatcttaacatgtgtatctattaatgtaattttagttatacctatatttaatacttttttaaattttagattagaattaaaagtgatttacctaccacaaccacaataatatagtattttttatttgcctctataaatttaccattaccgatgagttttatacttttgtatgctcttatattgttatttagcatcctttgatttcaacttaaagtactccctttagcattttttatatgacaagtctagtggcaataaactccctcagctttcgatttttttaattttgtcttaagttttaaaggataattttctgggtatactgttttgattggcagttgtgtatttgtttgtttgtttccgcattttaaatgtatcatccaactcccttctggcctccaaagtttctgctgaaaatccaccaatgatcataggagggttccctaacacataacaagttgtttttcttttgctgctttcagtggtctctgggtgtccagagtatgccagctctcatcattgccctgaaacaggtgagatactgatcctttttagtagtaaccataaatgttggggcactaactggattttccaatttcttctctcctcagggaaaagctgggtgtataatctgctcatgctgaactgagctggggaaaagaactatggcaaatgtttgcaagctcattcaaaccacagactttttcaaactgttgctttgatctctgtagcctccatgggcctaatggatgctgatctccattagttctcatagacacgtcagttgaaagctagttcctcaggtagcagctggaaaagttaaggggatagatatgtagataaattccttccagactgaagctagaggcttgcttttatcattagagtgagcaagtgggagaatttgtggaaatatccacatgcctgtttaaaatggctgctttgttttctatagcccacatgtaaatagtgaatggcaacaccaatagctctcatagacagtgagttagaagccagacctcaggtaggagctagaaaacttagaatgcttgatttgtagtctaacttctttcatagagaatctgggaactgggctttgttgttgtagctagttggtgaatgaggaggtgaagtggaggagatatgggaagaacccatttgtttgggcattttttctcaatgtaccttagtttgtctgtagtagctggccacagtagtgatgattctatttcctgagaggtgagaattgctgccaaagaatgtctgccatggatgagaatacaaagaaaggaaactaagaactctcaaagcagctactagaaacccttcatagaggacaagaattatcttcagttttgagatatatgagaatgattacaactcctttgagcaggcttcacatactgcccaaagatgcttctctagtttgtgtccttcttgctatcagaaagagagaaggaaactaaataaaacaaaataaaaattttagaattttgtgctgtcttggacatggaagcaatgggtcaggatcaagattgtggaaagatgccagttcggatgcaggctagaaaaattagtattgtcctcaactggaatcagcaaccaaaagactaagtgtatgtgtctctgtaggctgaagggttttcagatatcataaaagataagaagtcaagctacacttgtttggaagcatgtggcagagaacacagattaattgtttaaaggatggcccaaacttaaggccaagtcacatcaaacccatcagaaaccaaaagtgtggcagaattcctaacagaaggatgagagaggaagagccttatatagatctgtcttctgtttcacattctgactattctaaagcttttaatgaagaattccctagagtcataaaacaaaggctaaatggtgagtggctgcaaatacacataaaaatatagtgaattttttgaaaagatatactaatttcaggtggctagaaagatttattaacataagtaataaaggtcttttagttgtcaaagtaacttatacttaatatttattgcaattttaaaaaattaaaatgctaaaaattatttgtgaaaatgagttgttttatatgtttacatttaataacaatactttttacataaagaaaatacaataattaaatatatctgaactagtcaaaagataattataagatttaaaattgagtttatgtgcaataaatgtggtaaacaataatgtgatataaaatcttctaaatttaataatattcttggtagaggattctggggcaaaaatatgattttctccatatccctgcccactacccaatatatgataacatgtggcattattaaatatggaaaaatattaaagaatggcagtagactagagagaagagaaggaaaggcatacaggaaatccaggtccctgccctcagagacctctcaattcctggcatatgtttatgttttgaacattatgcaaatttgtctgcatgacaaatttattcttgtttcaggttaagagtagaaatcaacccatagtccttacgattagaattgccttagcataacgattcaatcagtaagaaaatataatagactagagggtaatggagattttaaaatttatattatcttaatatatttattagaaaaaatattagattgctcaataaatcaatggtaactttaaggcttttactgtctactacaaagaatttttatagatatatgaagaatgatggtaaggaagagatatgatgccatgaggcctactgtgagcaagacactgctaatcaggctattaggttggtccaaaagtaattacagtttttgtctttgaaagtaatgtcaaaaactgtgattacttttgcaccaacctaatacttccgcactttggaaaggctttgcctacatcattttggttattgtgagaagacttgcacacataaggaatttttcaaaataatattttaacttgaaatacttttctttgacaaatacagtaaaagtgatagagccaaaaagaggactaggcatagccctgaggggatttccgagcaaaaaaatcccaggggatttgtatgcaaacacttcgctcaataaaaggagaggccaggtgtggtggctcacaactgtaatcccagcactgtgggaggccgaggtggctggattgcttgagcccaggagtttaggacgagcatgggcaacatgacaaaaacttatctctaccaaaaaaaaaaaagaaaaaatagcggacatggtggggtacacctatagtccagccacttagagaggctgatgtgggagaaacgcttcaactcgggagtttgagacccgcctgggcagtttagtgaaacctcatcactacagataataataataataattatctgggtgtggtgacacacgcctatagtttcagctactctggaggctgaggtgggcggatagattgaacccaggatatctaggctgcagtgatctgtgatcatgccactgcactccagcctgggtgacagagaccctctcttaacaaaataaaaaatacaaaaaggagaaagtcatcaaacaaaatgatgtgacttagtctggtaatattcgtcaagaagtcaagatttatgctctcttacaattctgactttcacattgaattaaattaagggtgtcttggcttgtttagtgtagtttagtaaaatacagtcatttgttttccacagctattatattattctccattaaaaaaagaagaagaagaagaaatgagaaaaaaaaatcagtccctagctagaaattttaagagtcaataacatttgggaaatgaaaatatattctgaagtagtataatcatacccaaatttttagactctgtactcaatctataagatgtatgtgagcaaaatattattagaagcaacatgaatgataatcacgcactacaagcgcacgaataatgtttccctgaaaggtacaataaaaaattattcaatgtgaaacaaaacgttgactgcaacaattattaaaatttgactattgaattgtcagtatactcaattatgaagacatttggaaaatataaatgagcactactgtttttgctcattttttaaaaatgaaaatttttggtaatgtctgacctgaaggcagatattcattataatagtcaaatatcataaatacatttcaaatgttatgtattctacataaattactcaggagaggaacatgtaggctcataaacttgcacacaagtaaaggaatgtttcttaggaaaaaattctgtgttaaagatattccacaccaatgtctcaggaaaaggcatttgtagtatactgctccattacctatgcttcataaaaaatgcagctatctaatttaatttagctctgaacagatttcttagcagcataatttatgttttgagaatatctcttaagaatcatagcttgcaatctatggtgcttcaatgaagaataatctgtaaacaaaatctccatctatcaacaaaggccattaaagaccataaaataacccatccttgactgattaatgctgctactgaaagggatttcaggctattaacatccagaaaatatactgccactgtggttgcatttattataaatcacatagttatatgtactggtgtaaagcaatgttttcttaaccacctccctctcccaaattaatttaataacaaagatactttgaagaacactaaatatctatagaaagtaaatgattctatttttttccctagaggaaatgtatgtgaaggcagggctatttataatacattagatagctaaatattggtttaacactttatatgcagttcaattatgttcatatatttatgtcattaaaatagtttctctaatgtaaaataaaacattaaattcatttgtatttcttgatacttttattaacaatactgatggtttttcatgggtaaaatagccatcaaaaattgttagttgttacctttaggttcatcctattctgtcaatttgattgtcactaactcttcctcttaggggatgtgaatatagctgttgagctcatactcttggaaggtaaagaggctttgtttactggtgcagatctcgattttttcaaatatagtatttcacctcagaaatactatctattagctcttatgccttacaaaactactggcttggatttgtccaatggttttaacccttgatcttacctttaacatgcttggaatctcacaaatattttcttatattgtttagtacaaggcactgtctaaatagtttagccacattatctcattccatttacaccaatcccatgagataggtacgttttaaccattttataacataagcaaaactcaatttcaagaggttaactaatatttccaagatcacatagctagtttatggcagaggaggattcaaacacaggactgtgttgattcaaaaatctatagagttaaatgtgtacttgtccttccgtaatatctgaggctagacaaaacaatccctggcttttctctcctgctttctatgaatattctgtcttagactacttagtcattatatatttttgtcttttcagtagagttctgttttgctgtgctagttcttttgggtttctataataataaaaataataataaaaggagaatagaagaataagagtagatcagggagaagatattctgaagataagttggtttaaagagaatgagttaatggatcagcttttgtctctgaagtcaacaaatgacaaagaaatgaaaaaggtgtaccctggaacaatgcatctatctgctggtagtacttgagaaatacatacaaaattcatatttttattttcttttgtttcattttattgcttattttggtcagtgttatttgcttcttatactagtaacattcctccagcacagaacaacatatctttgcaaatatttcattaaatatataaatgtcttaaataccacaaatgaaagacatgagtaacacaatatagtccacaaaactcaaaaggaaataaacacagtttagcatttttttcttacaattgaaaagattttaataactgttgagtatttataattatctatgctaactcccattttcttgccaagttatgtgtctttaaacactatggagtccccttgcaaaatttaacagagaagcaaagatatgtatcagtaatattgatgtttttatttttttaaaaaaaacctccctgataatttaagtgaattggattagaataattaaaacagaaatgaaggacacagaagcacatattctcaatatcgtcacctctgattactttagaattctgttagcatgtgctgtaaaaatcctttttaaaataaatattcccactataagcttaagtttattcatatctagggagaattgttttgttcggataattagatcaacagctgactctttaagctgagataatggcccactagccaataggaatcacacatgttaaggagaacagaattcaaagagtctggtcccttttgcacagtgacagaacatatgaggcagctacatatctagagagacaagaagataaatataagagagcaaccaaatcaagatgtaattactctgcatttaatcaaggcaccttagggttagtccagaccttttatccaaaacagctctgtaaacagcctactaaaccagcatcatcagctttctgtatttctcatctgtctaagtcagtcttccttgtttcaccatattcctacttgttttgtcttcaacactttctgagagaatgaagaaaaatgacaaaaaacaaattgtatgattgtatgaatgattaatatctcctctttcatgttgttcctcttctattgttcaaagagtatagagtgaataaatacaaaaacaaacacaacactgaagttaataaataataaggtccatctcatttgttaaatttcgtttcttaaggtatatgtgtctttgaaccttctggttatttctacaaaatagttctagtggctttggcagagtggtagcataacacatcactttttaaacagagttgaataattgtataaccctaaaagtaaaagaggcaaacaataaaatgaaatgaacaaatgaaataaaatcagaaattctcagcttaacaaaaccacctttcttgtgagcacattttgtgcatagtgaaataagggacatatctctaaagctctgtacacatatatttattaaaataaattgaattaacaattggcactacacagagtggcatgaaaaggttcagtatcttaacctcagctattcactaagataaaaggatcaccaacataaaatcttttttctttgcattgttaaacttaaataagtgttttttctctaaataaaatgattaatttttaattatgtagataaattttggatctaggtggactggaggcataaatgacacttacttagagatataaccagcaaagtcaagatggcaactttacagaaaaacataatctaaaagtttgaaaaacaaactgcagaatatattgtgtgtggctctttttatattctaaactatgttataaaaattttgcctcgacttacttatataagaaaaataaaactggttgcagaaatataatttagtattatgtcttgtgtgacctaacaattgggtaacaattatactaaaatgggacataatttattaatttacacagtataaaacctattggaatagactttgtaagttccaagtaagtttcttatcgtacctggtcagatttactttgcaatgtccatcttaatatttatgtttttaatatttttaaaataaattttaaggcaatagcatgaatagatgaatacataagataataaatgaaactctagctctttataacttaaaagagggtaggataaagaggcatggcataattttacattttaacttcagtagatgacaatatttgggaaaactaaggaaatatggaaggttagacaaaaataccgattcagggctagaaacaatatttatattttacaatgcccattttagggaaacacggcattgctatgtttttaaagcacgctttagagagtgaaagagttcactttagaaagtacaatttagaaggacttcactttctaaagtatgccttagaaacacagcaatgctatgtttttctaaaatgaagagaaagaaactttatcactctcaaacagcaaggcttaaaatttgtagagaatgtgaatgaggaaaagaaagacaattgttcaggaagttcaataaatcatatttgctgagtcattgagttattaaattcagcaaatatgattcactttgtggcataagtaacagggaaacatgttccatcacaatttcaagatgaaatataaaaagcttcagtctctcttttgtctctctctcacacacacatacacacacacacacacacactcacacacatacacatatgcacaaggtaattgaggctagggaggtgaaagaaatgtagagtagggtctctgacaaatgtggtgaagggtctctgtgtacataatgattttttgaacaatctgaagacaattaagcaaattcagaataattttaacatttcagcagattaactggtattaaaaggggaaaagattggcagaagctttattctaatcatgcaccagaacaacaacaacaacaaaaacacacacaaaaaatcaaagtggcaaatggtttcattgattattgtgaactatccggcacccacgagaaaacaataatccaaatttgttagctcctcaaccttggatgagttttcatgagtattttataaattagtgctataatggcaggagacaacgaactcccagaccacttccaaatttaaaattatatagttttccattgaatagtttattattttcttaataaagataactgtttcttaataaaactaatgctatataaagacaaagtggataaaaaatcattagcaagagaattagtaaacaatgcatagcaacatacatgcatatgagcatatatatacacccatatatgcatatacactagacctatatgcacataattgtaattatatattagtataacaataaaaatcctaaaatatctcaaatgtggaaataaaaatgctgagccaacactagcctagagggctgagaggccagaagagattttgagtttcaccatctgttggatcattcaagcatttcacaacttcctgccagtatcaaatctccgctattttatttgttccaagaaattttaaaacaaatgagagaggtaaaagcagttgaaaatgctgaaagttttgttcactttaaggggttattgttgaggcaatattgctcattaaaggaattttaatggcttaaaaattaaagcttttcaaagtcaagtactttatccctttggaagttttagcaatttaaacttgaataattttcatgaccaaagtaactgcaaaactataattttatattacaattgtatttgtaccatctgacctaattattaaatgtttaaacataataaacactaatgaagtgctctgtcactacaaataagcttctggtcagggtgctattgtcattctactttcttcttgtagttttgttacttttctcgtgcttgtccacagaaattcccaccaagagtcaaagttccacttgcatactcctgtgtgtggaacaagggtttgggatcaaagagtctgccttttcattctgggctctgctacttattacctcttccttgaatctatatttttaatctagagtttctaatagttgtgatgaggatcagatgagatataaggcagaattgcatttgtcaaatggctaatatatgatatgtataagatatgctaagtactcagtaaatggtaattgtttttgctatttctgatttgggcttggattttaatttattttttattgaatgttggataggtatttacccattcacacaatgttgtctaaatgttcatcatactttctaaagttaagggataaagtacgctgaaaggtagctattacctaaaataataactatacctcaggcgagataatacatattatgaattgagaataaacacgcattaaataagtggtaaagcgatacaaattgagtttatacagtagaaaatagaagggggttatttctattggcagccataaggctagagtatgttgggcataattcttctttaccagatacaatgttttgtatagaagtatactcagtagattttttaattctgtgtttctggaactaaacagaaatgtgtggaaattgtagaattgggcaagaaatggaattagaagattcaagagttaatccaacggatgtgcatagattgaagaaataagtccaagaaaataataaatggattagaattttgcaatctctagtactcatagttttttaaaagcaatattaatcaatgaaatacatatatgtgcatccattctatgccaagaacatcacagttaccttggtacttgagacacggagacaaataagacactgtctatctctataaaaacatcatagactttcattctagtgagagagaaaaacacacataaactaggaatgacaaaataagacacatacaaataacaacgtgtgaagcatttcatatttacaaaataaacataaaatactgttcattttctgaaaaactttctccatttatcttgaaatatgtagtatttctgtcaaattttataatctattattaggtatagaaacataaatacagagataagtttttcaataataaaaatattcccagtggaaaatggcgatggatacttagtcttaatgtcagtggcatcacagggattggtacagacactggtgaactaaaaatatcacacggtttaaaggcagtggactatacttggaaattgttgctgtagacaacagcaggctcagcattaccaaattatctcatttttttgagtagaaataaattttgatattttaatgtgcaaagcctttaaaaatgtgttcaattcaaaaaagtggctaagaaaaaaattaaaaataaagtttaaaaaaccctcaaaactatatctgtgggtggaatcaacattcaggtttctgctgtttgatcctgaactcaaggacttataaaagggaggcatgaagaagagctctgcaaaaactatagaaaattggaagatacagaaagaacactgaagaaaaagctactgtccttagattttctatggaaaattaggtcaggtataaagaacatattcctaatcagatgaggaacttttaaatcagtgaaatcatagaactgcttctttggaggccttaatttttcatctgtttggggttatttaaatgaagccattgcaagtgtgtcctattttttcaaagtatattttgtggactccccaactgtaatcacaggatgtgcttgttaaaatgcagattcccagacacctttccagatacagaatcaaatatttttggttgggtacagaattctgatttttttaaaaaattaactctagttaactttgatacaaagtacatgttgagaattataccactggactcacagccaccaaagacacttgtttagttggcgactttgagacccagtcagacttatgagtacctcggaactggaacccaagagacgtatttataacaagtttaactaggtgacattaatgtgtcttcagctacatggaggctatattttattgcattatatattcttccttcttgttactaatttctttggatgcccgcttttacaataaaattaataatttagaagcttataacttctttgtaaaatggcatttctagcccaaatacttgtttaaattcagcataaaaaagaaaacctagttcataagtgatatgtcattaaggatcactgttgtttatcatgaatttcattgtatctttaaaaacatgacgtttttatttttattttttaatttttatttatttatttttttaagtagagactggatttcaccatgttggccagcctgtctcgaactcctgacctcagatgatccaccagccttggcctcccaaatgctgggattacaggcatgagccactgcacctggcctaaaaatatgactatttggtaaacatcaccagggtcctaagaatattgtgtagattatttccagtgggatggtagccattgagcaaccaactgatcaaattttaagatcttgtaagatcttgtaagatgtaaaatgtagcactttcgtaattacctaacttatttgtgaatctgcttttgaataatagtaaaattgtgttttcaaagccatcttactcagaagtaaattatgttaatatacaataaagagaacatacacttttactatatgtatatggaaaattactatatcataaggtcttctatacagctaaaatttttgtgacctgggtacctggacttcaattgagtgagaaaatgaaactaagaaagttacagcattgatgaatagcatagtatatactatattaacagtcattactatatattaaaaagtagcttaaaagaaaagaaaaggccaggcacggtggctcatgcctgtaattcgaggtgggaggatcacaaggtcaggagttcaagaccaacctggccaagatggtgaaaccccaactctaaaaatacaaaaaaaaaaaaaaaaaaaaattagtcaggcatagtggcgggcacctataatctcagctacttgggaggctgaggcagagaatttcttgaacccgggaggcagagatcgcactgagctgagatcgccactgcagtccatcctgggagacagagtgagactccatttcaaaaaaaaaaaaaaagaagaagagtaagagtaagaataggagaaagaggaggatatagaatggaataagagtcacagaatgagagtattcagcccaactgtaactttgttttcaagatatattagaagcctggggaattcttctataaattctacttcccatttagcatgttctaaagttcttctgtcatgtcagtataatatgagaagaggtaatgtattttgatacctcctgttttctatagacaaagtatgtagattaagtacatgagtatttgaggttcaaatgcacctattaaaatgacagtataagtatctatttaactggagcaataaacatacatatctttcctaaagtgatacttaggttattacaaatgccctattaggtttagttatcttcctcatttaaaacactttccacatacagatagtagtagactactaaccttatgctggaacatacattatgatgtaaaaccggggaaatatttcaggtaaactcattctcagcagtggtacatgattatgaagctgtgttttatcaacatgattgctgtgagcaccaaataagaacatgcaagtagcttggttagcataatgtatagcacagagtaagaatataacaaatgtgagttactaggattgtaaagattatcattattattgtttgaatagtaatctctgtatgtaaatagacatacatattctactaacagatttgtgttatctacttgagtgtgtgtatatatgcgtgtgtggctatgtgggcaccagtggagcaataatgagtttgctacatgttatatatttctagaatcactaattatgttgaaatattattacaaaagtatgtgccttaacaaactaataaatactttggtgtctaaataagctcaccatagagcaaaatatatgaagacacacagagatagctatatatagagacaacggcagcatgttattccatatggaaaaaaaaatttgtatctgcagataaaatggcactccaggaggatatcaaagcatcaaatggatgttttcattaaaagaaaatttgtacatgaatttttaaaatttcagttcatgatgttactcattagctctatttttaacaaaatgttcccttttgcatagagaaaggaaagtcaaacactgatcttcaatattaatagttaagaacctgaaaacatcttacattttattttataggtttaatctaacttaaaaaaaatgttaaataaaagacaatgaaattgaagacccctcctggagaaactagtgaggatactaatatagactctacctcctcaaaaacctaacttcaaagagattttaaagaagtcatcaattctctcacatggcagactgggataacatctgttaatagagacttaaaaaaagtaagtaatttaaggaagaagggttgataattcattgattgggataagagaggaaatggcaagagaaacaggtatggtttcataatgacattgagataagtctcaaaggctgaaggaagaatttaatataattattacatctagtgatactgatgagaaacacatcctttctccctcagttttctttttgtgcgtaatcttgtaacagattgttcatgttttcagtaaatactgggagtgaggaatggtggaatgcagagatgttaagcagagggatttggtcccaccaaaggtactctaaattaaataagatgtgctcactttgcaaaagtgacttcaagataagtgcctagcttccaccattactgctatactccacttctaacaaaattatcatctttaattttctagactgccgcactagaaccatcatagtgtggaccaaatttacactatttttctacttcctatttctattcttctaaagttcttaatctgtgttctaaatctgggactgggcttctaagagtaggttcactgattgtgttatccaagacaggggttggcaaattatagctcaccggacaaatccaacccacacctgatttttgtaaggctgaaagggtaagaatggttttgacatttttaaacagttggggaaaaaatcaaaaaaacagatatttcttaacatgggaaaattatataaaatttaaatgtccacaatcttgttccccttttaaagatatattgttgattattttaacactacaacaaccagagttaaatcgttgcagcagagatgacgcggcccacaaaagccctaaagatttactttgttctttacagaaaaagtttgctgacccccaactcaataacttattttatataaacataaatttttcaggaaaataatactgtgaacccataatatgattgtagcataatgggaaaattaggcaaagattgataaaataccaatcttattattatacagtcacatatcatataggaaaaatctgatacaatggatttaatatatcagatgggaatttgagataaaaaagattctaatatttctagtcttataaatgaaactgagcctaaatgaagctttcaggggaaatgatcatgtaagacaaattacaggggttggtttctaaaaccgattctttttactctttactgaaggtcaaggatactgaatgtgccagtgcaccttcagaaagcagcctgcatcagcacatttaaaccactgaatggtctcaccacctagtttcttgcgaaagctgagcaatacattttgtgatagataccactgagaaagttaggcagaaattgttattagtagtatatgacaatcataatagtctaacttttactgtaaaactctattatttatatgttttctgtacatcctgtaggattgtctgtattttgcaatagaattgcaatgtgtaagagaaaaagaggcagtctatgtttccattgtcattctaagggacatattatccatacaacacctcctttttcccctttactgaaaagctgtgtataaaacactctaccatgctttcctgaaacataaaagaagatttattactattttaataaagaagtaagaacaaaaatatccaatctcctaatattcaatggagaagaatatatattcttttttaggaggacacaaaaatagcaagcttaagtatattctgttccctaaggtactgtgtaggtggagaaaattatttttcatttaaaattatatacttgtagttcattttaagtaagcccagtggacataaagctgattcattcacaaatgcaaaattttgttgtaattatttgcttaaccaaagcaatattcatcaaaaatggattaatgctaggattattttatttcaagtaaatgaacatatattgattagtgaccttccaaaccccatgctagcaacagtaattactattattaataaaatacatcctctagtgcatattaaatggttcaatttattaaatatgctgatctctgcatacctcctcaagattattttttaagaaaagtttactttgcctgagaaagaaaagatgaaatatgcaaacactaagtttactaaaaccaccaaatacaagctgccttggagtcccgttgttctgaattgtcttaccctcttaaaatcagatgttttaagcagataactcaatttttcatacaatataaaatgtccaaaatccgtgtaattctctgcctctgaatacatagtctctatctatttttctcattgttttaatctaaaaggaacattatgttttctctttttaaaagtaccctccttcagcattgtttttacttctaaactccttagattttctcctcaaatcccatttttctccgcacaatctcatcctcctttagctagaatcactcactggtgattaaacagagtcacgcagaaaataatgaatgcaaaaatgtgggcaggaagaaagataagggaagaaatattcttcaggaaagaaaatgaaacggtatttgtcagcgatgttgtaaaggggaagaaacattagagaaagggtgattggttgatagtgtcaaacgctgtaaagaaaggaaagaagaggtattttttaaattagcaaagtggagaatcatttttaaactttgagttagagttattactgaggaatgagaatttaagtttcctttgtggttttctgtgcttactaaatcaccagctcttcttataaggtgagtgatatatagtaagaatgagagtctgtggggaaggctggtgaacatactttgatgaaaaaatggactgtaaaggagtaccatccctgtcataggaagagatattttagtgtctgaatctgtgagggggtgtgtggaggtcaatgttgatgctctatgtatctaccggaggaaatttatgtgtgtgtgtgtgtttatctattgtaaggggaagccgtgagatatcagacttccctggcttttcctatctctgataagaaacactgtagttctagggaagctgagcgctggaaaggaccttgactttgataaatacaataattggtgacaagatttaaattttgttttccatgagttctggtgatagggcattctggcttgttttatgtcatttgtcctaatcctcttaacctcttaacctattctacaaaccactttaaatatttcttctcattattccaaacccttgctgtcaaacatcattgtaacctgtgtgtatatatatatataatatatataatatataatatatataattatatataatatatataatatatattatataattatatatatactatataatatatattatatataatatatattatataatatatattttctatatattatatataatatatattatataattatatatatattatatataattatattatatatatatttttcccactacagtgggaaaaaccattaatccagtggctatttcctgtacactatctctcgtgtctgtgagctcctttctgtttctattgccatcagtgtctttcacaacctcctctttctttatgatgtgtttcaaagcagattctttattttcattctcccaagacctgctgcaccttgcctactaatgtcagatacgttttcttcaaatgtcacacttcaggttagttatttgattgaatgcctatgtgattcccactacttccatataaagtccaatccaatcaacttaattattcacagttttgttcaattgattttactttccctgcctgactttccatttgtctattcaaggtagactagtttccaccattgcgctgacttcttgccctgaaatcactacttacagccttactcatcaaagcaaacgacatcaattaatgaagtaaaactcttgtcctaggctgtctattggtcttctctgatcctttggcggcagaagctctgcatacatccatcttgcctagacagtgttatgcaaattaacacaaccaaaaacaaaagtcaaattgtggttccttttatatattttataagtactattattaataatgaaaagacttttttttaaaatttgactaacttttttacataatactatctacttcataacatgaaaggattaagtggatttttataaataatgtgcatagaaccatgctgagaaaaatatgaatgttctaacattggtactgattgttattgttatttttactgctaattcttaattagtagagacaaatgttgactgaactatttctttggcgagaaataaataatgccatattttgggctcttcaagccgagtctcttctggcttggaacactaaactatataaattgacccttattatttaaaatgtaaaccacattaaaaattcattttcttaatcaagatgaagctaagatatttggtttccaaaccattaaaatttttatgagcaattctctgtaaaagcatttacctctggtatagtcgactactagttatgtactaataactattactaggatccattagctactcgctttgatctgtgttgtcatgaacaggaagatttggaaactgttgatggtttatacattgactatacaaaatactatattttaaaatgaaatcatatgaaattaatttatcaagattaactgtagtgattacaaggaaagaacagagagtacatgtttgatacattaaaaaatcttttcaaaaaccaaagaaaatcatgggtttagattataaagtcataaggtgataaggcaacttttgctcatgcggaaatatgttaattagttttataatattgtttctccatcgaagtacttatacacgtgtttggctacttaaaatagggtaaagaaataaataaataaattataatgctctaaatgaaatttggcatataccatctctcaaatttgcagtttatagtgcaggaacaaaaaagaaaagggaagtgtgatgaaaatatttagaaccacttgtctagagtttaaaagaattagtagcaaaaatattacaaaatataaaactactgattgccttgaatttgttacctgatcccaagttatgaacattaaaagtgtcataaagaaacaaagtcagacacttgttaaaaatagcaagacagatcttagtaagatactgcagtagggaagagagacttcagtggaaactgggttcagctctgatgaaacaaaaggcagaaggctgtttaaatgctggaatatgctaaagtaggggttcccaatccctgggccatggaccagtatgggtctgtggcccgttaggaactgggctgcatagcaggaggcgaatggtgagtgagcaagtctaagtaacactttgtatttacagtggctccccatcactggcattattgcctgagctctacctcctgtcagataagccacagtattagattctcatagtagtgcaaaccttattgtgaactgtgcatatgaggggtctaggttgcgtgctcctaatgagaatctaatgcctggtgatctgtcaatgttcccatcacccaggtgggattgtctagttgcaggaaaacaagctcaggactcccattgattctacattatggtgagttatataattatttcattacatattacaatgtgataataaagtacacaatacacgtaatgcacttgaattgtcctaaaatcatccccccaccccactgggtccgtagaaaaattgtcttcagtgaaactggtccctggtgccaaaaagactggggaccactgtgctaaagcaaaagtaccaaagcactttgaggtggatgcttaatgtgattagcccagttgtgtttgctaactggcacttacagaaataaagtccctactttaccacagagactgggaaatagaggccctatctttctcaatggttacatttcaaaaggaggtctcccaggtccttgagaaagacattcctgagttgcagatacatttcacaacgacaaggaaaggactacaagtttcctaatgtaaattctctaagaaaagggaagtctgggacccatagccaatgatatggtttggttctgtgtccccacccaaatctcatcttgtagcttccataattcccatgtgttgtgggagggacccagtgggagatgactgagttatgagggggagacttttcctgctgttctcatgatggtgaatgggtctcctgagatctgatggttttaaaaatgggagtttgcctgcacaagctctctctttgcctgctgccatccatgtaagatgtcacttgctcctccttgccttccaccatgattgtgaggcttccccagccacatggaactgcgagttctctattaaacttttttcctttgtaaattgctcagtctcaggtatgtctttatcagcagcttgaaaacagactaatacagtaaattggtaccagtagagtgaagctttgctgaaaagatacctgaaaatgtggaaacaactttggaactggctaacaggcagaggttggaacagtttagagggctcagaagaagagaggaaaatgtaggaaattttggaactccctagagacttgttgaatagctttgacaaaaatgctgatagtgatatgaacaataacatccaggctgaggtggtctcagttggagatgaggaacttgttggaaactggagcaaaggtgacttctgttatgttttagcaaagagactggcagcattttgcccctgccttagagatttgtggaactttgaacttgagagagatgatttagggatatgtggcaaaataaatttctaagcagcaaagcatttaagaggtgatttgggtgctgttaaaggcattcagctttacaaaggaggcagaacatgaatattcagaaattttgcagcctaatgatgtgatagaaaagaaaatcccattttctgagaagaaattcaagcgggcggcagaaatttgcagtagtaacaaggaacacaataggggaaatgtctccagggcctgtcagaggtcttcacagcaggcccttataccacaggcctggaagactaggagaaaatggtttcatgggcagggctcaaagtccccctgctgtgtgcagccagggacctgatgccctgcttccaagccactccagccatgggtgaaaggggccaatttagagcttgagctgtggcttcagagggtgcaggccctgagccttggcagtttccacgtggtgttgagcctgcaagtgtacagaagtcaagaattgagttttgggaacctctgcctagatttcagaaaatatatggaaatgcctggatgtccaggcagaagtttgctgcaggggcctggccctcatggagaacctctcctagggcagtgcagaagggaaatgtggggttgaagtccctacacagagtccctattggggcactgcctagtagagctgtgagaaaagggccactgtcctccagaccccagaatggtagatccactgacagcttgcacagttcacctggaaaagctgcagacactcaataccagcccatgaaagcagctgggaatgagactgtagcctgcaaagccacagggatggagcttcccaagaccatgggaactcacctcttccatcagtgtgacctggatgtgagacatggatttaaaggagatgattttggagctttaaggtttgactgccccctggatttccaacttacatggggcctgtagcccctttgcttcggcaaatttctcccatttggaatggctgtattttcccaacgactgtatctgcattgtatctaggaagtaagtaacttgcttttgattttacaggctcataggcagaaggcccttgccttgtctaggataagactctggactgtggacttttgagttaatgctgaaatgagactctgggggactctcgggaaggcatatttggttttgaaatgtggaaatatgagatttgggaagtggaatggtatgatttggctgtgtccccacccaaatctcatcttgaagctcccatagttcccacgtgttttgggagggagctggtgggagatgattgaatcatgggggcagatctttcccgtactgttctcatgatagtgaatgggtctcacgagatctgatggttttaaaaatggaagtttgcctgcacaaactctctctttgcctgctgccatccacataagatgtgacgtgctcctccttgccttccaccacaattatgagacttcctcagccatgtggaactgtgagttttccattaaacttctttcgtttgttaattgtccagtcttgggtatgtctttatcagcagtgtgaaaatggactaatacagccaggttttggcagaaacaaacattaacttattttagcaatgttgatgtttgtcaggtagacatttaagtgggctgggattgttaacctgggacacagccttgaactgttaaaaagctgtgctagaatttgttcaagtctcttagtgtgggacatgcacaaaatcatttatgctgagaatctgcagttctcacaggccaaggttaagtcccagtcaataaaaatgctcggaggagcctgactaaagtctggtcaaggagagagtctttgccataagaaacttaataataactaatatctctaggctactatttgtcatgcaatgagctagtatttgcagctttttcttatttaattctcatatttcctcttgaggaatatactaggattactgcctttatttgaaatgtgtaacaggctaagtaattttttcatgaattaatgctgtcctcatttatttaaactgtattttcataagttagcactagatacaggaaccaagggaacaggtgtagaagtcccaagaaactgaatgtgtgggcaaagcaaagaatggctaaacacacaacatccactgagttaccatgcacgagaagaagcaggaagatgtaggtcccctgttggccttatattcttcccacataaattatagattaacatatttcctgattttttgaagtttccagagatttaccaacttgatctttcatgtgactttctcttattctggattttcagtgacttttcctctcactttattgtctctaaaatcacagaaaccctgtttaccacaattattttcttaaatttatttctacaggtctttagttaaaaggtacagggaagcagacaaaccttaaacttgataatacgtgggaaataatgttactggtatcttagaagtcatgccagtaattcgtctaaatttaagcatcaattgaaatacggatgcaaaattattatacgtgattaattactttaggtctttcatcagtttatggtagagtaaccaaattgcccttgatgcctctcatgtgtcaagtattgttttgggtgcaaaggatagatcaataatatgacatggttcttgagtcagtttggttatgactggagttggtgagaatgttagactcacattcatgagtggatttgataaatacaatgtggctgacatgatgtctgctctcaccaagacttccatttcagttctttgatttctcctttgctttcgttaggaatggcctatatttggtacaccaaaaatttacactaattagtgagcacttctcctactttaaaagagaagctcaaacaggaaagaatacacacacacacacaatttttttggtatgagattcaaaattcctagaaagcttatgacaaaattatcaaatttgttgaattctcaaaattgctaaatttctgaataatgttcatctagctacagtacttattattccaccggaagaaagcatatgcttcaacacaaaaaaaaaatttgagtgcaaaactattaagtaaaactctgagaaaacatcatttttgtacttggcaataaggcaattacttaaaaaaagttagctaatatttgtgagtgttacatttaattaaacattaaagaactttatagaagtatttttaaaaaggaagaaaggaagaaatgtaataacccagaattcaagagaagataagcaaaatgttatttgacagaatccagaagcacatgaaaaagttaattcaccatgatcaagaaggctatattcctgggaagcaaagttggttcaacatacgcaaatcaataaatttgattcacctcatacacaaaacaaaactgaataaccatatcattatttcaacagactcagataaatcttttcataaaattcgacatctctttatgataaaaacctacaacaaactaggcattaaacatacctcaaaatgataggaaccatgtgtgacaaacctagagcaaaatcatactgaatggacaaaatctggaagcataccccttgggaactggagcaagacaataatgcccactttcaccattcctattcaacatagtactggaagtcctagacagagcaatcaggcaaaagaaaaaaatacaaggcatctaaataggaaaaaaggcagtcaaattaactctctttggtgctgatataattctgtacctagaaaactgtaaagactctttgaaaaggcccctagaattgattagcaactgcagtaaagtttcaggatccaaaatccacatacaaaaatcagtagcatttctatacaccaataatgttcaagttgggagccaaattaagatcaaaaacccatttacaatagccacaaaaaaaattaagtaggaatgcatccaacaaaggagatgaaagatttctagaaggagaattacaaaatactgctgaatgaaatcatagatgaaacaaatgggaaaatgttccatgctcatgaactggatctaccgactacgtttttcccagaactagaagaaagtcttctaaaattcatatggaactagaaaagagcttgaatagctaaagcaatactaagtgaagagaagaaagctggaggcatcacattacctgttttcaaattgtatataaggctactttaactaaaacagcatggtattgtcacaaaaacaaacacatagaacaatgaaacagaatagaaaacagaaataaggctgcttacttacaaccatttgatcttcaacagactcgacaaaaattagcaatggagaaaggactttctattcaataaatggtgctagtttaactggctagccatatgcagaagaatgaaactgcacccttgcctttcatcgcaggcaaaaattgtcttaagatgaatataagacctaaaactataaaagtgctagaagaaaacctaggacatggcattctggacatcagccttggctaagaatttatgagtaagtcctcaaaagtaattgcaaaaacaaaaattacaaaaaataaaaattgacagttgggaccctaaagagcttctgtacctcaaaataaactatcaacagagtaaacagataacctatggaatggaaggaaatattcataaattatgcaacttacagaagtctaatatccggagcctctaaggaacttaaacaattcaaaagtgaaaaaacaaataagctcattgaaaagtgagcagaggacatgaagagacagttctcaaaggaagacttacaagcagccaacaaacaaatgacaaaccctctacatcactaagtatcagagaaatacaaatcaaagcaaatatgagatactgtctcacaccaatcggaatgctattattaaaaagtcaaaaaataacagatgttgatgatatactttgaatatatgtccctacaatatctcatgtaaaattgtaatccccgatgttggaggtgggacctgcttggaggtgtgtttgggttatggaggctgattcctcatggcttggtgctgtcctcatgacagtgagtgagttctcatgagatctgatcatttatcatttaaaatgtgtggcacttccccacctctctcttgcttccactctgccacgtgagagccttgctccagctttacctttcacctgaggcctccctagaagctgagtagatgctggtgctgtgcttcctgtacagcctgcagaacaattagccaattcaatctcttttttaaaaaaattacccaatgtcaggtatttatttatagtaatacaagaacagcctaacacagttgctgaggctgtggagaaaagggaatggttatacactctaggtttgaatgtaaattagttcagcctctgtggaaagcagtttggagatttcccaaagaactcagaactaccgttagacccagcatttacgtgactagggatacacactaaggaaaataaatcatcctacaaaaaagggacacattactttgtgtgttccatcatagcactatgcacaaaagccaagtgtattagtctgttttcacactgctataaagtactgcctgagactgggtaatttataaatgaaaaaggtttaattaactcacaattcagcatagctggggaggcttcaggaaacttacaattatggtagaagacaaatgggaagcgaggcacctttttcataaggaggcaggaaggagaatgaactcaggaggaaccaccatacacttataaaaccatcaggtctcatgagaactcacacacttcgcgagaacagcataggggaaaccgcccccgtgattcaactaccttcacctggtctctcccttgacacgtggggattaaaaggattacaattcaaaatgagattttggatggggacacagccaaaccttatcatcaagacatggaatcaacctaagtgtccatagattggataaagaaaatgtagtacatatacaccatggaatactacacagccataaaacaagaatgaaatcatgtcccttacagcaacatggatgcagctggagaccattatcctaagaaaattaacacaggaagagaaaaaccaaatactacatgttctcacttataagtgggagttaattattgggtacacatggacataaatatgggaacactagcactgggaactactacagagggaagagtaggagtgggtcaaggtctgaaaaaatacctgctaggtactatgctcactatctaagtgatgggatcaatcataccccaaaactcagtgtcacacaatataccatgcacatgtgccccctgaatctaaaataacagttgaaagcataaaacataaaataaaataaatcttcgattggcatgataaatgttaaaaattaaacatcaagggaaactgtgtgagaaacatatggggatactctgtattaccttggcaacatttcagcaaatttaaatttatttcaaaataaaaattcatattaaaattacccctgctaaaattttaattaacaatatttataactttaaaaaggaaattaaatgtgtttcaagaataaggggacactgacatcctccttcttccattctgaagaagatcataaaacataagcacctgcacctgccccaagactggatcaaaaggtgaacacacagatctattaatcactcatctaaaattctcaaacgctaagatattccatagactctaaagtcagacctgaatactacctcaaaggacttgaacaagaagttccaagaaaaaaatagcaacagtagttttaggaggaaatgtgcataattaataggtcaacaaggataggtaagagacagatagcctgaattcccactaatgggaatattaaaaagaaacaatgaaagaaaagtatatacttacctgtacaaatgaaattgtaaactaaagagaattccagtttagcagattaaagctgaagtcttgactcaaatttccatttggtctaaaaccataatggaatacggagactgaaaaaaagcccaagtaaatgagacacatttctgtggaaggagttaaatgattttatttttttcaacagagtaacctgaagaagggagcctgcataatcctgaaggtcagggagcaaattaaagagtaaaggggcatccactggagattttcttctgaatgccttgggttttaagcatatccttttgtgagatgcaagggatgttgggttgtaggcagagctagaaatctttcccttcttattttctagttcttttcagaagttgccctaatcatttagaaaggagatttgcatgaacctgaaagttgcagagtttgctttgtaaagaataagaaacactagtgtcaaagatcaaataaagaaggctggttgctttacccgttattcaggcagagaaggaaaatagtgaactgtgtggaccatgtctaggttcaaggaggagacaggtgaaagcccagagtacctaacagtggagaatttctggacactggaggaaaaaaggtttgatgtgaagaagattcaaaaagtaaaatgaaaaagaaacagtgtaaatatgtcctccccacacaaacactggctcactgagggaaatgggagtcttcgtaatctccaaggtttcagaaaatataaagtatctacctgtaaatcaattacgccccaacccaatgctaatgaatgtactttctatggagagatctctctgcaataaccatggagaactgaaaaactaaacctaaatcataagaagagtttaggcacatattaggagtgttttagagaaaatgtcttctgacagcatggttgtacacaaatcagccagaacttttcatgaccccatgcattagctgatatgccaagatgcccatgcaccagccatgaatctccttctggccactggagccaatccttatcttcataaataccttccattactttcaggtttcttgtgtccatagccaaatgactgaattaaactctgaaaaacttgtattaggagcaaccttgattcttaccaaaaacaatactgcatttcaagaagatgaaactttttatatggtaaattataaaatcttgcactgctttctatacttgtatcaggagcacccttgattcttaccaaaaacaatactgcatttcaagaggatgaaactttttataaggtaaattataaaatattgcactgctttctatacttataaatattttgcatatgtcattatagcaaataacaatttttagaaataattaaagtctcaaagtgttcctttcttgaagtcagcagcagttacaatttgttgtaactagaaaaactgaataatattttattcattttaattattggaggtcatataagtctctggacttactgtattttatctaaaacatgtattttcattttggaaatggagaattatttctttattaatctaagcatgtctatgcttttagaatatgaggcaggctctgcaattttcttacaagacgctaaaggaatggaaagcaaaatcaacaaaaggaaaagagactgagaaaaaaattatacatattgtttataagtttggtgataacaagagttacttttaaagatgcttgcgcgtatacactatcttccaactgtttcagatgtaaatatattaaaacaagcattttaacctcagataaataaaaaagacacatagttaggcatcttcacaattataaactgctgcttattcttatccatgctcctaaaatgccttataatatctgctgtcactgccttggattataagcccaaaacagaattttctttttttaatagataatattataaaggtgattttctaagtgtacacggcctctttaggaagatagcagtaaggctcagatgtatgatttatagagcagagcttttaagccataaactcatcattgatgtcttacagccagatttaattaccttcctgaattttgattattttttccttgctttaaacagatcacacataaaagtatgcctacgtgatatatagtttttcttgtttttgaaatgtatacaaatagtctcctataaataaataaataaataaataaataaataatttattcattcctggacttgctttcttgactcagtcaagtcaaagctaaaatgaaagcaattattttagagacctatgtaaaatacatgcttatttagctgagatttgcttcaaaaactcgagtaaaacaaagagctccatgtaaaaatggtgacattcgtgtttaattttccttaattcatctcatatatgtatatatatatatgcacacacataatttcatacactgtgtaattttacaatctgtactgtcaccaaaatttacctattttatcttgtattctaccagagttctattacatggaaattgtgaagttcacagtaatataactactctaagttgttaatcacatataatacattaagcattgtgttgggtaattggcattcttttatctcttttaatttaatgaaaattgtattagttaggataggcaataatgtgttatggtaacaaatataaaacatcagaagcctaaaataagaaaaattatatattgttattcactctcaatgtccaaattgttctgctattatactcactcaaggatgtaggttgacagagctaataatgacacactcaaaagagggaagaaaaacatcataaatgatacactggatcttatatttatcattcagaggtgacctccacgagttcacttttaatcacaaatattatggtcatatatcacttgaaaaacaaaaacacagaagtataatcctgtcatgtgtctgcaaagaaaacgagaaatatttggtaacaggaataatgactaacctctctcaaaaaaaaattacaagacagccactatcatcatttgtgaagtaaagaaacagaagctcaaaaaagtaagtaacgttaataattgacatgaagtcattaatccagtaatactaaaaactgaatactaatccatttctaaaacctttattttttcctagtattaatattttaattggaacttaaaggtaaaacattagactaatcatcaacagtttatgatgcaccatcaccattagcaaataaatggcgcttttcttaatggtatttatttgtacagtgcaatgaatattaaaaatttgcttaaaccaagaattagagtattaccaactatattcatctgcatgtctctattctcccattcccctgtctctttaccctcagagataatcactttcccataggccagacaagagccaatcttgtaagcagatgtttctaagtgcagcagtctcaggtctcttttctgcatactgtaaaactaaattgtatttaatttgcatatatcacattttccttcctaatatgaatttataaatgtcatgaatgatgttgacaaaccatgaaacaatttcatataaatacattttctagaagccacatataatagcaaatgaagtggatttaagattttaggttaggtctctgaaatgtacaaacagaaagaaggggaaagagcagaattgaaagaagaacatgggcaggaggtcacgtcaccagcatagcattcccagtcagctttctagagctaatgactgatatgacagaagaggcaaacaatcccaaatctataaaatataacattgttaaattctttatttttataacttataaataagaacattaatttccaatataccattgccctattattttccagtactagaaaacacaacaaaattttcaaatgatttacacaacgtcatatcaaggcaaactatagccatattgagacatactcatgatgtaatataagtaaacaagatgtcagtaagttgtgattctcccaagtatataaaagcctttcaaacttttatggcatagcgtaccttctttccttttttgagctaaaattttctactctgtatcactatatctattcctctgtctgtcctactcctagtcaagactcaactaagaatcaatcttcaaaaaaaaaaaaaaaacaattcagggaggctagctgaagaatgatttagttacctattttgagctcccatcatcttcttggaacactattttgatagatatatgagttttcttgtcagtatccctcactatgctgtaaaatctataagagaggtgttagttttctatcactatggtaacaatcaccacagacttaaaataacactaatttgttaccttatagttctgtgagtcatcagtctcattagcctaaaatcgaggtgtggacaggactatatcccttctgtaggtcaaaaggaaaatccatttatttgtctgctccggcttctggagacagccctgttccttgactcatggttcttcttcaattttatcagttaataacagttaattgagtaccactcacaacacgcacttattccatagtcacatttccctcagactttgagcttatctgctttactctttcattttcaaggactctaattattgtattgagctttcctgtatattccaaaataatcttttcaggtcagctgactggtgaattttatcttcaataaattctcatttgctatgtaatgtaacatatttgcgagttccagaaattaggacatagaaataattggggagttattattctgtttatcccaaggggcataaaaattatccagtgtttttaatgagctcaataaatatggtatttatcaatctgaaacaatcaagtttcagaacatgtctgaatctatttggtactgtggacagcatgagcaatattaaatgttagaacatctgaaacagatgaagaccttttatgtggacaatactcagatctacttgactaattagtacagtctcttaaaataattcctttagattaattccttcagataacagatgaggaaattgtatcccagacagacaccgtgattttctctatgtccttcatggaaacagggagactccccctccaccctgtgtcacattttgtaactcgcacaacataaaagatctgcttgaaccctgatgactgatggtctcatgaaaaaaaagatctttattttcagctttttgtaactatgtattttagacatatacattatgagactggattggggtaccaatctcagagagaaagtatgtattttacctttacatttttttatttgattacaatctagtaaacaagttaaagaaagaaacccatggcctcccaaataattgacagacatttacaattaagattattctttcaaaattcaagttttgaatttgaggtaagaaatatcccttcagaaatctcccacatttttgctgtatctacagtatatctcattatactcagttaagtcattcagtaataactaaaatcctaaagtacttcgccaaaaatttaaccagataaaaacaattttaaaaagtagctaatgaatttaagatagtgcctggcttccattttttacacttgtcaactagcctatcttttattatttaatttttatttatttctcaaagaactaaagtagatctaccatttgatccagcaattccactactaggtatctactcaaagaaaaagaaatcattatataaaaaagacacatacacatgcgcatttatttgcaacacaattcacgactgcaaagatatggaatcaatctaagtgtccaccaaccaatgagcggataaagaaaacatggtatatagacaccacggaacaccgctcagctataaaaaataacgaaattatgtttttttttgcagcaacttggatggaactggaggccattattctaagtgaagtaagtcaggaatataaaactaaatacttcaagttctcacttgtaagtggaagctaaactatgggtacacaatgatatacagagtgatataataaacaatatcctaccttaacaagccactgtccctttaattttatctcctgtatcccgtaaaaaggacgtaaaattcacaggtgagtactattcttaatgtctccaaaattaatagctgtgcttgatgttttcttatagaattgaaattccaaatatatgcttataaataaacgataaatccaaatttgttacattgtacacatgttgccactttgaaagttaatattattttcaacttccaaagtttgtaataatattttaagagattcagacaaacatgacctcagaagaatctatgaggaggcatacatattctttagccctagatatataaaatcttatttggtcagagagttaagagttataaagtatttcttggagccgagtctaaatttcttcattttgttacattaaaaggcaaaaaaaaaggtctcagaagtttaagtttttgagagaaaactacattctaaaattcatgtttgaggattatttctccataatttgacttaaaatggttattttaataaattaaatacaagatactaatgccaaatgataaggcaatagaacagttacatatttgacatcactacaaagatattcaatacattgagttgtttataatagtgaataaagtagccaaaaactaataaataggagtattcctctgagagtctggtaacatatactgtaaaatccgcaaaatgtatatgggaacaccaccaaaagaaacatgattaatgttgatgattctgaggttttcaaatagattcgtgtgtatctgcagccacccaaccacacattaaccctgtcacctgaaactatcactatttaacaaaaaagactaatgaaacaatgtactttcctgatatatggcactgaataaaatatacctagtgattatagatagatttttaaaagctggtcatggtggtgcatgcctgtagtccagctgatctggaggctgaggaaggaagatcacttgagcccaggaggtcaaagctgtagtgcatcacggtcatacctgtgaatagcactgcactccagcctggcaacatagcaagaccctgtctctaaataaataaataaaaaccagttagaaaacaaaatgagaaaattgagaaaaataatttatagttaatgttgcttccatctgaatgtgtaatttgataataaagttattttgcatatttaaacataatttctttaacaggaaaacagaaataaaatcagaaaaaatgtaaaaattggaaattttctgccttcctgataatttttttttttttagaaaatcagggcaaaacatttaggaatacttactattattgcaaaaatttaatatcatgggttcaaagacacttgagatatataagtatgtacctttaatacttttctatttgttaaatatagcttagtaaaataaatgaactaataaaattcctaaatgttttactgaacaatgatttttttccttgatgtttagatgaaataatataatacctacaaaaagatactaagtgatgtcaccctgcgtagcttgaataaggacatttactgaaacatttttatgaaaaataaacatatttgattacataatttatataccttttccctccagatgtttccttttttccttccttattcttgaaattacttataaatgacaggaattttatatgagttctaaaatcagaataagaggaagagtggaagaattagaaaaagaaaaaaaaaatgccagttgtgcacttcttcacgatgcctttttaagagtcttagtgacatattaaaaagtacaaacaggccaggctcagtggctcaagcctgtaaccccagcactttgggaggctgaggtaggtggatcacttgaggtcaggagttggagaccagcctggctgacatggtgaaatctcatctctactaaaaatacaaaaattagccgagcatggtgatgtgtgcctgtaatcccagctactcaggaggctgaggcaggagaataacttgaacccaggaggcggaggttgtggtaagccgagatggtgccactgcactccagcctgggcgatagagccatttctgtctcaacaaaatgaatataataaaaattaaaatttttttaaaagtacaaacataatttagaaataaagttttgtgtgtgtgtacgtgtaaataaagcttttctaagaacatcatcataaaacaattgcatttgttttcatgaagaatccaagaaatgcacaaaataatcacttctataaatgcttatcttgaccacaatcaccacttattcagttatcttgatcacaatcaccacttattcaggaacagataagagatacaaatttttaagatctagatccagtagttattgaattaactactttctttctcaaagttttcctacaactaaactgatgatctcccttctaaatgtagcccctttaggatgtttatattagtgaatggccctattctaccttattacataccacttttcctccctttattccacttccactccccatttgcaataaatcatacacaggtacacatatgcaaacaccacacacacacacacacacacacactgctgtgtgtatctgtgtgcatgcacatttttctttatctatttttcaatctcttcacttgtctctagctccacttccacctgcttaaactactattatctctccgttggactatattgctaactgtttatttcacctctgatgttagttttcttcagtctttacacaaatccactctcttcactatagcgagtgatctgttttagaataaattgaatcatgatgttactatttctgcccccttcccctgcccccactggtcctgttccagctttaaaaactttaatggtttcacttagaatgaagactaaaattattatcattggctaacaaaccttggtctctacatacctcctcagtttcatcagcatttgatttacattggcctttattcatattgctatagtctgaatattttaactccccccacccataattcatatgttaaaatataaccccccaacgtgatggtataaggaggtgggctctttgggagataattaggtcatgagaccacagcccttatgagtgggattaatgccttataagaggccccgagagctgtctgtgccttctgtcatgtgagagcacagagaaaagaccactgtcaatgaatcaggaagtaggccatcaccaaacatcaaatttgctagcacctcgaacttagatttaccagcctccagaactatgaacaataattttttgttccttataagcagtttaaagtgttatgtttatagcaactgtctatatcaatttatagtgctatgttatagcaacctaaatggactaagacaagacacttgatctcacctcgcttacttctggtcatggaggcttatatattattccctccatttagaataaactccttgccccattatctttcatagtatctagcagatagtagagaccttaaaaaatacgttgaaagactaaataattaaatgaactgtcaccaaaagcaatgaatatatcagcatattatatgtgcattatcagctatgcaatgaattacagaaaattctgtttctcttactaaagacattatgactattccataccccaaatgatctattaggtcagtttagaggttacagtttattttacattgttttttataccttatatagttattgaaaatttattgaatataaataaaaggacaaaagttttacatttggtaataaatgcccaaaatataatttatataaaaagtatcagtctttattaaaatgactttgacccaagtttattctttataaacgtctgttgtaactctccaatgtaaagaaggcaaattggtgataaaattagttttgttttattttttgggacagaatctcgctctctgtcccaggctggagtgcaatggcacagtcttggcttcctgaaacctccgcctcctgggctcaagcgattctcctgcctcagcctcccgagtagctgggattacaggtgcctgccagcacgcccagctaatttttttgtacttttagtagagatggggtttcaccatgttggccaggctggtctcaaactcctgacctcaggtaatctgcccaccttggcctcccaaagtgctgggattacaggtgtgagccaccacacccagccataaagtttgatgaacctactctgacatatgttttttcatttattttagaagagtctcctcaaatgactttttatattaaacctgttcaaaacgatttctaaacctcaactctgaaaggatgctcaccaaatacttaaatgcacttcagaagtgaaagcaaagatatgttttcttcctacttgcatataatgaaagttaataatagaatcttattgataagtataatttgctaatacattcaaacacatgtgttgtcaaagttggtatacatatagtactgtgaaaggagagtctattttgatattttcccaggatagattatcattttgccttttgtacacacttttctgttgctctcatatgaccttaattgtttaaaaagtgttacttttttaaaaaatacatacttttgttctctgttagagcaatatgtatttggtatagattcagaaaaatatttgatatagattcagaaaaatattccatttgaaatctgggcttttaaatcacataaacatataatactagatgggtttcagttattttcttttttttttttttggcttagctctggttcattttttttaaaattttattttattattattatactttaagttttagggtacatgtgcacaatgtgcaggttagttacatatgtatacatgtgccatgctggtgtgctgcacccattaactcgtcacttagcattaggtatatctcctaatgctaaccctcccccctccccccaccccacaacagtccccagagtgtgatgttccccttcctgtgtccatgtgttctcattgttcaattcccacctatgagtgagaacatgtggtgtttggttttttgtccttgcgaaagtttactgggaatgatgatttccaatttcatccatgtccctacaaaggacatgaactcatcatttttttatggctgcatagtattccacggtgtatatgtgccacattttcttaatcctaacatacttttatatagtcaacaaatagatgaatttttaaaaattaatgccttagaagatgtaaagcatattcagtaagctttgaaaataactgaaacccaaatgtcctacaatcatagactgggttccagttattttcaaagcttactgaatatgcttttcatcttctaaggcattaatttttaaaaattcatctatttgttgactgtataaaagtatgttaggaatctttaacttgcaacatgtcatattacaatatattcactcaaggtcaacaaagagtatttattcttagttgactccttctggtattaagaacatggttgaacattttctgttttcaaagtactttatcttaagcttccagttacttgtcttagcaattccatcattggccagtcattcattctattgaacgtctctaatgacgggataaggctagaaaaaaagattcagaataacagtttctttgcaaagatttttcataatgtatcttttaacattgtattatggtttcaatatttgcatctcactccaaaatttatgttgaaacttaaacatcaatgcaacaacattaagaggttgggcccttaggaggtgattatgtcatgagggctgtgcactctgtaccttatagaagggctgaagggaactaactaggcccttttgcccttctgctatgtgagaacacagcattcgtcttctccaaaggatgcggcaacaggcaccatctttgaaacagaggccaggtcctcaccagacaatgaacttaccagtgccttgatctttgacttccagcctccagaacagtgagaaatacattatgttatctataaattacccagtttctgtttttgttgtggcaggatgactagggcatgtaaatattggtattatactcagaaaactcttagatacaaaattttcagtaaatgaaagatgcatttcttgctattttaaaatttgtaggttggcatgtctgtgtatttttcctttatacctaggaatgaagcagttgatatgcaaaaattattgggatttttggaatttaaattagctagccggtggtagagagatgacaagagtttagcaactgctgagagagacagagagagagagagaaatggtaaatagaaaagtgagaatagaagagacttgaatgaaacctattacaagaaaatgaagaatggagatagaataacacccacacacgaatgaaaaatagtaaaagcatttataagaaggaatttaagaaaatagacaaaaagttgtaggagatagagaaaattaaaaaaaataaaagtacagataccaagtggttgctgagttcctattatttgccagatactttaataaaatgcaacagagaaaatcaaagacaagatggacagaaatttgtaagaagaattgtagcacacagaatgaagtatgtagaaagtattatgagtgttctaagaaagaagtggccaatatattgtgcaggtttgtgtatgtttgcatgtgtgtgtaaatgtttttagacaaagaaaacattaaggaatattgattaatgatgaagaaacattaaatatgctttaaattgaaaatattattataacatactaacatatatttatcatttcttatatgccagaaatatactacacaattttcttgcataacattagttaatcctaacagtaatctaatgagaaagttactattattcttgattatggatagagatcagagccttagagaccactcatcaaaaatcatacattaatattttcaggatttgaaaatgttttatctgatttctaagctcatgctcttaactactatgccttaaatatttattttatattcacacactacatgttttatcgcatgttaatcctctgtttctcttttctttgtttatatgaaactataagatttgaatcatagttcctcaaaactatttcattcttaaaatctttttgtaatctattgcaggtgacacagactattactacactcccactttcgcagtataaataacattctttcaactgcagcctggactcagtgtaaaacactgtattcagaatacaaaactcacgtaaatgaaaggctgactttcacagaaccaactgcaggacttgagtatatatggattttggtacctatggtaggtcctggaaccaagccccaaggatattgagggacaactgtatttttatccccagaacttagcacaaaactgtcatatggtaaatttaatgaatatattttggagaaatagacatataataatattttatcacaacttccatcattttcctaaagttccagggggcggggcccacatcattgtacttttgtgattcctacaccacttattactaaggtattaaaatacaatgattaagagtgtggcagcatgatagggattgtattggatcagtagggcagtattaacaatattgagtcttccagtctgtgaacataggatgtctttccacttgttttcattaatttctttcagaaattatttttaatttttaatgcactaatcatcagaggaatgctgatacaaatgcaaaaatgatatatcacctcatgcttactaggatgaccattataaaaaacaaagcaaaaacaaaagacaagtgttggcaaggatgtggagaaactggaactcctatacatgatgggaatacaatatggtgcagctgctatggaaaactgaaaaacaagttctttaataaactgaaaatagaactacaatatgatccatgaatcctacttctaggtattcatccaaaataactgaaatcaggatcttaaagaaatattagcactaccatgttactgcagcactattcacaacaaccaaggtgcggagacaacctaacttttcattgacagatgaatacataaagagaatgcagtatatacatacagtggaatagtattcagtcttaaagggcggaaagaaaatcctgcaatatttgacaacatggataaactttgaagacattatgctaaggaaaataagccagtcacagagaacaaatactgcatactgcatgataccaatcctacaaagtatctaaagtagtgaaactcacagaagcaaagaatagactggtgccaggggaaagaatagaatggtgccaggggttggagagtgggagaagtgagaatatgctaaacaacatgtgtagatatttagttatgaaagataaaaattctagaaacctgatgaataacattatggtataaagataacaaatacagtattgttaaaaactttaaaatatttttaaaaggtagaacctctacttgactcttcttgcaaaaataaaaaaaggatttggcagcatgagccaggtgcctgagccatctttatggctgttagatgtaggatttgtgtgaaattaagcaagatagcttgaaattttaaccttctgtttccacatctgaaaaacaggaataataataaaattcagcttgtgaaatttttgtaatgattaaatagattaaataagatagtatatacttgattgaccattgatttcttcttcctttgccagaaatctggctcaccccagaaaatgctatttttctgtagccctctcactagtggtgaatgtttttatcatattcttccacaactaggacctgagttgggataggtcctgtttcttactccttcttccctattaccactgccctcttgcttaaaaacaaacaaaacaaataaaaaacacttggtatcatatcatcaaactgcctatatttcctcttcctccattctctcttgagccctctccaaactcagtttccttttcaaggttaggaaagtttggaaagagtttcaattattctttaaatttccaatattttaattcaaactggtatttttgtcaaactatatttattacatattaattccaaggggttcctctgataatctaaagtaaaatgtattctaagaaagagaaaattagaaggaatgttgtccagtgaactattgacactgcacccaacccagtacatgaaatgtgtattcatcactgacaacttgtggaattcattaaacaggacagcagcagtgcctttctccagtcagtgtaaatgtagtttttgagaggaggacaccaaaaatgtgacatttgaagacagccatgatttgattatgtgttttcttgttgctttggattgttatctgtctctatccaacataaaacaaaatccgcaaagatgagattttcatctgttttgttgtctgctatatacacaacaggtagaacagggttgggcacctagtagccccttaaaaataaagctatgcaattttgtataaagctatgtaattttgtgtaacttaaatgtaataatacattattaagtgtgttatctataaaatacaatgtgtgtggatgaaggtatatggtataaatacagagaagagtatttctaaggtgtttggcacttacaaataccacaaacgctagttgttattagaaacctgatgttagcataacaggtattacataatgcttgctatacttgaatgaatgaatgaaaatactcagcataaagcattattaatatttgtttataatgatatatatttttttcctggggagatatcatcagaattgcattccatgaatccagcagatcatgtgtggacaaatctttgatacaaccacataaaatattgatgactgtgttaacaatgttcttttaaaacattatctaagtctaagccttaacagatctcatcagtattccaattgttcaatgaagaaacatattaaatgcaaactagctgaacagtcttcactgagcatttagcggggcagcccttaggggcagtataggatcttacaagagtagggaacattaacagcatgaactgggccactgatgtcaggaacagccactgcattatgatccactagcgttataaacaaatactcagaaaggcagctaataatccgacatgagcaaagaagagaggaaatacctgaagaaagcatgaattcatagtttgagttttctacaaatacttttctaaataatacacaatcatgggataaatactaatttgatctgtaataaattacatatatgaaatataacaaaaatactcaacataaagcgtaaagaattattaatatttgcttataatgctctaatttttcctggggagatatcatcagaattgcattccgtgaatccagaagaccatgtgtggacaaatcttgcatacaaccacataaaatattgatgactgtattaacaatgttctttttaaacattatctatgcctaagctgaagagctctcatcagtattccaatttttcaatgaagaacaatatatatgtaatctataattacacatatatgagagattcagttagtgataacccatgatgtgataaattacacatatacatgtgtgtgtatgtgtgtgtgtgagtaaatttttagagattcacttagtattttgtctacacatataatttacctagatttcttgttttcctaacaggatgcaaaaaaggtacactgtggggtgggtaatatctccttactaaatatttattgactgattttgtccccacgtcattgaccagtgtcatataaatcaaactctcattacctatttttgaattgttgtttgaactccagctactatcctcaaagctcaccaacttgcccttctagctgacgcattttatgtctcaatctactttttattcaatgcttatttatttcattaatcacaaattgggtcattctgccaagtcctgaggaaaatataagtaactgagactgtctctgttcaggattttataatctaaccatgaaaacaagcattacatgacatattataaagggaaagatggacattaattttgattgggtgtcatcagtactaacattggagaacaataaataaattagtatcagtaataagtagaattttagtaaaatctagaacaataaacttttgttaaaattttacattataaaatcacaggacagcatgtggctatcgcatttcaagctgagataacagatttgctctcagatttcccacataatagttgaaccacaatgagaaagcaacttgagttccctgtttctttatagttccctgatctctaaactaggcataataatagtaaaatactaataattattgttataatcacaaggaccctatggagtacttgtgaacattaaagaatataatctatataaatggcttaattaataaattctaaataaatgttggtggttactattagtgactgatgcttacacataaaatgactattgatatgattcataatttcaagagacttcttgagtggtgtattagtctgttctcacactgctaataaagacatacctgagactaggtaaaatatgaggaaagaagtttaatggacttacggttccacatggctggggaggcctcacaatcgtggtggaagagcaagtgacatcttccatggcagcagacaagggagagaatgactaccaagcaaaaggggtttccccttacaaaaccatcagatctcatgagacttattaactactgtgagaacagtactggggaaacagccaccatgattcaattatttcccaccagttccctcctagagcacatgggaattatgggagctaaaattcaagatgatatttgggtgaggacacagccaaaccatatcaagtaggtaggaattatgtgtatgaaataagtaggaacattacttaatgttatatgagaaggcactaaatacaatcagtggcaaaaaagtgaaccctacaagcaatcaatcaagaataacttctaggaaggagggagaaagagagagagaatgagtattgttgtaaactggagttccacaaaggaaattgagcttataaatgagccctggatagatggattacgagaaagaaaagggcaaagagagaggatacagtaagaaaagcaaaaagactttaaaacaatatagacagaaggaaataaaatttaacattccaataatggaaaagaatacaatgtgagtaaacaattggtgtatgttgagaaattctgggaaataatatgagtaggcaaagcaagaatatatcacaaagggccaagaaagcttagatgtggacacaatccagtagatagtggaagaaatgttaggagatacttgagaaaagtactgttttaggaaatagagattagcggttcactgttttattaaaaatagctgaaagacagaagctgagtcacttcaacttctgcagtaagcaaagccatagtatgcaaactggcctttaaatccatgggggaatgtattatctcactttcatggtgcacatctatcatgggtaggtgaaagcaagggaaggagagatccactccacctagtcactcaaagataagggctgactgaggcattaccttttacagctgaaccatctgtgatacatatcttcttaagttgttctggcagaagagcgagaaaatgaagaatttcacatagatttttgttgcatcagcccaacaataatacgtcatacttacttatatttcactgcccagagatagttatacagttctgcctaataggtgaatatttaaacaactcatcagaacaaactgaatatttgcaaaatataactgtttcctacaaatgcaatgtgacaaaggtgtaaaattatttatttatttcacaaatgcacatggaacaccaaatgtgaactaagatttcaatgacaaaaaaaaaaaaccacacctaccttcccagttcttatatgcaaggaatttaatgtctaattccaattttcattgaataatctagactaagctgtcctaggaaaagggagtaaatgtagatagaaaatgacatattcccttgtactgccccatttatctcatcagtcattctgctttaaaggaattatctggtcacattttatcttctattcacatctgctactttcaggacctttctttccctcctctttctttgagattttcagttgctgctctgccttgtcttctgtgtccattcttagctccaatcctgagactcagctggagtctcagaggcttgcatctgagcactctgcattgctcagtgactaaggcaactgaattagggcagggacacctggaatagctcagtcctccacagcaggtggggtctgataaaagccatatgcctaagaccctgcagtatcaaagaactaagactcgcaggcattcctaactggaatctatctctatttcagtgttatgggctagattgtgttccccaaaattcatatattcaacctctatcccctagtaactcagaatgtaactatatttggatatagggcttttgaagagataattaagttaaaatgaggctcttaaggtgaaacctgtaagaagatactaggacacaaggagagacatcacgggtgtgcctgtacagaagggcaacaatgtgaagaggcagcaagagggtagatatctgaaagccaaggagagaggactgaggcaaccagctcaactagtaccttgatcttggataattccagtctccagaagtgcttaaatttctgttgtttaagccacctagtctgtggtatttaattacggcattcctagtaaaaggacaacttttatctctgtttccaataaacatttcaatcccatggtaggaaaatgacaatctgcctaatctctgccacctcctaacaaaaatcttgttttattaagaatacaaacaaaacatattttatataattttcttataattttattaatgtctgatgtaccagaaaatgacacataggtattgtatgctttgccttatttgaactcatgataaccctatgagagaggtagtaccattttcctcattttataaacaagaacagatgacttagatcaagtaacttgactctgataacatataggttaagtaggagagctcattcatctaacacggttacctttcatgacaatgatgatgaaaacagctaacagagtatccacgtgaccattattcatctaaaccccttacattaaataattggacattcataatattcctataatgtaagtattcctactagccgtgtgttatagacaaggaaatttaagcaaagagatattgagtaatttactatagccacagagctacagagttttggagccaggattcagatctaggcagtccaaactgaaggtgtgtatttttaaccaccacattctactgcttctcaaagtttggagtaggtatattagcatctggtaatggctgttgaggatattttaaaacttaggtaatgacttctgctattgtatacttttagaaaactggattgggatcaaaactgtccagtacatgctattttgttacctttggattcttttaatacctaaccttgtgcgattggggtcatagcacagcatgtatgatcatcattgctgcaaacggatacacatcttaaaagtgccaactcagtgttattcaaatttttcctgaaatttccatatgcttctcaagttccttaacttgaaaactcaaaattcttcctgcaaacattttctgattatctctactccaaaatgttttaacagttagtcaattagttaattaaaattttaattggcaaataattgtgcacattacatattttggggtacaatgtgatgttctgatatacatttactttgtgattaaatatgctaatgcacaaatttatcacctcataaacttgtcattttatggtgaaaacattcagaatctattcttttagtaatgttgaaacacacaatgcaatattatttattattgtcaccattgtgtgcaatagatcactgaagcttattcctcctctaactgaaatgttataacttttgatcaacatctcctctttcccatttcattgctcactccacccaccagcttctggtaaccaccaaccacatccagtggacagcaagttaaataataggaagttagagaaagctgacagttacaaaggatatgatgttatttaattgttcagaatatacaaaatgtgtttattataggatacagccccttatggaaaaataaatgagagtggggaaatttcaaaatcagacaaaagtaaaaagtactatgttcaccagaagatggagaagtctgataggaagacactcagaaaaggtcagtaaaaaacctctgagaaaaagaaagttgcaggaaaggtaaatcaataatgctgtttgctgaaatgctacaaaattatagtacttgtctaaggaagtagttactggaagccatagagagtgcactttcagtatagttacaagaaaaaccaaattgcagagcttaagggaattggtgaagaactggtagcaacagatacaaagatttgacagaacatctaactaaagaaaaactctattatgaattgtataagtcattgatgactcagagccaagcaagtttataattacatttttgctcaacttcgatttctatgaagaacatttaaaatgagttctgctttttcatacaattagaatgtgggcatttttcaatcgttctaaaattttcagattattagaaccacaaagacaagcatccaccttaccggatattattgattttatatgcattgcctggactctgaattagaccttttctttcttttccctgtctcagcaggacaaataagaacatctaggccaggagcggtggctcacgcctgaaatcccagtactttgggaggctgaggcgggcggatcacgaggtcaggagatcgagaccatcctagttaacacggtgaaaccccatctctactaaaaatacaaaaaattagccgggcgcggtggcgggagcctgtggtcctagctactcgggagcccgaggcaggagaatggcgtgaaccagggaggcggagcttgcagtgagccgagatcgcgccactgcactccagcctgggcacagagcgagactccgtcaaaaaaaaggaagggaggaagggaggaagggaaagaaagaaagaaagaaagagagagagagagagagagagagagagagagagagagagagagagacagagagagagacagagaaagagagaaagagagaaagaaagaaagaacatctgagcaccaatactgggatattgtaagttacctcagaaataacatccttgggtaaggggtgtgtgtgtggtggggtgtgtgtgtgtgtgtgtgtgtgtgtgtgtgtgtgtgtgtgtgttttagcagaaagagaatcttctaagtacaatgaaatgggcttctatttatcagtaccttttttcttctctctcttttagttctgttgctttccaggatatacacatggctttaacagagtctattactggaatacggagaagctattgaagtaatccttcaaggcataaggtcagaacttagagaagtcacagagtttgtatttctgaacctgattaccagaaaattcttctaaagcaggaaaagatatatgctttcaaactgttatcctacaaccaaatccattttggagacacaaggatccacaagattactcaccttcaggaaaacatgaagacaagaaatgctagtcttggtacaacctaatgaaaagacatagctgagatttcatatgaagataacattgagattgcttagaaaaaaattattggagttaacattgaaagtaacaatggtatttcttgtcatccctttctaaatggcatatatggtatgtaatctagaaatatgtacatatacatgtaatagcttacaaagcttccaataaaaaagacaaaatctctggattttgccatctaacgaaaacaatgtagttactattaaaacttgaatttaacttctcagaataaacatacagtcaaggtttttgtttatttctttgtttttccaacatggttgactgacttgggatgctagttctcggaaagatcaaagttacaggtgaatggtaatgatctgaatgaaacacagtcagatgagagccaggacctgtcagagaacccacaagaagaagctagggtacagaaaaagaaagcaggaagagtctggcagagattgacccccaaggaacttagagaccccaaaaaagtataggtgggggtgcttctctgttcccctcaccctggcaacaacctgctaaccatcgaattattagagagtccttctaccctcacaatcctgggcaatgatgtccgtggcaatttggaaaattcccaaagacagaaatccatgttgttaactcacacaggggtgcccacactcttctcaggcctgaactgagatgtcaagtgccgtactagttgtgtacacatagtgggccactgctgtgcctgtagaacctcagtcattgagtcaccacatcacaagatcccctgcaaacataccccataacctgctctgacatccacaatcaaagggaaacagagaggatccctgaggaactgtggatccctggtaatctagccctcagtgtgacctacccctggggaatgggggtgcacagacagccctccaaagcctgccttgagagaaaggaaatgtagtgtgacacagatcactgaagggagtggcaccggcagccgggaatggatatggagaggtagtcatcttctgctcctcccatctactcttgcagacacagcagaggctctaccagttaaaggccagcccttgtgaaattggtgtaaacttttccagtggttttcacaacagctacacctccattcaaagtaagcccctgccacagaggcttccatgaagagtaagacccatctctccccttctatacaaagaaatagcatcccagcaactgaaggcagacaagctacaaagttgtctgtcatgaacttggggaagaggatttgccctgagcccattttgttggtagctgccggaggggcatacccatggtctccagctgcactatggccaggagtcaaaggacaatgtatatttaaactgaaggtcatgagcaaaatgcaacagcggcatgatagggaagcagatcacattcctgtctgcccaggatgaggacctggtataggcctccaacgctcttccattgaaacattgccacagcccaacaggatctccaccagctacacctgtcagggtgggtgcctccagtcattactgagctaccagagaatgagcaggctcttatgcttaagtgccatcactggactggagagtaaaatagaatacctgttctcagaaaggcacagggctagtgaataagataagcttcctgagacctctgtactctcagcctcgcaggagatagtgtcagctgacacatctaacacatcaaaacaacaggcaacattcaagaaaaccaccatacaaagattacccacaatcaaggaacccataaagaactttggcacactgaaagcaccccaaaacaaagcatatcatacacatcataacataaatcacagtaatcctctaaaggaaaaataaatgatagaaaattcaaaaataagaagtgatatctcctttagatgagaaagaatcaatgcatgaactctagcagtacaaaaaggtagtagagtgttttgacatctctaaaggattgtacttgcactctaaccatagattctaaccaaaatgaaaatcctgaaatgacagataaagaattcaaaatacagagtgcaaggaatttcaatcagaaaaatgatgaaggatataaaaggcaaaatagctatattagaaaatagaacttcatgtattgaaaaagtaactaaaggaatttcaaaacatagttgaaagctttaacaatacactagaccattcagaagcctggtttttttgaattaaccctgtcacacaaatataaagaaaaaataatttttaaaaatgaacaaatccttcaagaaatattggataatggaaagcaaccaaacctatacttagaggaattcttgaggaaggagagaaagaaagaaacatgaaaaatataattgaggaaataattgaggaaaattttcctcatcttgtcagagaggaggacatccagatacaaacaatttagagaatatctgtaagatattatacaaatgaacattactaagtcataaatttatcagactatccaaggtcaatactaaagaaaaaaatcttaaacagtaagtatcaaactatctataaaatgtagtcccattagactaacagtggacttctcagcagcaaccttacaagccagaaggaattagaggtctattttgagccttcttaaagaaaataattttataataaatggcatccaaaatttttataacctactaaacttaatttcataaacaaagtagaaaaaaagtcattcccagacaagcaagtggtaagggaaattttcacccatagactggtccttcaaaaaatccttaaaggacttctaaacatgcaaatgaaaggacaatacttgctaccagaaaagcatatataagtacaaagttcacagatcccataaagcaattacacaattgaatatacaaagtatctagctaacaacaatatgacaggaataaaacctcacatgtcaatattaatcttgaatgaaaatggcctaaatgctccacataaaagatatcattttgcaaattggatgaaaaagcaagaccctaccatttgctgccttcaagggactgacctactgtgtaatgatatccacagccccaaagtaaagggtggagaatgatgtactacacaaatagaaaacaacaaagatcaggggtgctattcttgtatcagatgaaacagatattaaatcaagaaaggtaaaaaaaaagacaaagaaagatacaattcaacaagatttaactgtcctaaatatatgcacccaacaccatagcacccagattaataaaaacaactagacctaagaaaagaaacaagtcatacaataacagctgaagtatttaacaactattagttatataatctgtctggtgacagcaccagatagattatcaaggcaaaagaaaaccaacaaagtaactccagacttaaatggaactcttgatcaaatggatgtaatagacatctacagaacataccatgcaacaaccacagagtatacatttttcacatctgtgcatggaacgttctctaaaattaaccaaatacttggacttaaggcaagtctcaataatttcaaaaaaatcaaaattatgccagttatcttctcagatgacagaggaaataacattagaaatatatatcagccgggtgcagtggctcatgctggtaatcctagcagtttgggaggctgaggtgggtggatcatttgaggtcaggagttcaagacccacaaggccaacatggtaaaaccccatctctattaaaaatacaaaaattagctgggtgttagtggggcatgcctgtaatcccagctactcaggaaactgaggcaggaaaatcgcttgaatctgggaggcagaggttgcagtgagctgagatagcaccactacacttcagtctgggtgacagagtaagaccctgtctcaaaaaaaaaaaaaaatacatatcaggagaaactctcaaaaccacacaagtacatggaatctgaacaacttgctactgaatgattttaggctaaacaagaaaattaaggcagacataagaaaaagttgaaataaataaaaatagaaatataactcaccaaaactctgggatacaatgaaagcagtgttaagaggaaagtttaaagcactaaatgcctacataaaaagataaaaatatcttaaattaataatccaatatcatacatcaaggaactaggaacataagaacaaaccaaatgtaaagctagaagaagaaataacaaaaatcagagcagaactaaatggagttgagactgtaaaaaccaaacaagagattaacaaagcaaaagttgtgtctttgaaaggataaataaaattgataagactgctatttaagttaattaaggaacaaaaagagaagattctaatacgcacaatcagaaataataaaaatgtggcattacaaccgataccacagaaatacaaaatatattcagagtagtctatgtaaattctcagagagtaatcatggtagactatgaatatctctgtgatcaaaaacgagaaaacctagaagaaatgaataaatccctggaaacatataaccagccaagattgaaccaggaggaaattgaaatcctgaagagacatataatgagttatgaaattgaattagtaataaaaaatccattttccaaaaaaagccaggaccaaacagattaacagccaaactttaccagacatagaaagagctagtacccatcttgtataaactaataaaaatattaaggaggaatgactcctctctaactcattctatgaaaccagtatcatcctgataccaaaacctagcactgaacacatacacacaaagaaaactacaggccaatatccctgatgaatagacacaaaaatctgcaacaaaatgctagtgaaccaaatccagcagttcatcagaaagataatttgtcacagtcaagtggattttattccagggatgcacaaatagttaaacatatgcaaatcaataaatgtgattcaccacagaaacaattttaaaaacagtagccatatgatcatctcaatacctgcagaaaaaacattcaataatatccaatatgtctgtatgataaaaaccctcaacaaactaggcattgaaaaaaacatactgcaaaataataagagccgtctatgacaaacccacaactaatatcatactgaatgggaactgtaacaagacaaggatggccactctcagcaatcaggcaaggaaaataaataaatgtcttccatattgaaaaagaggaagtcaaattatctctgtttgctaatgacaatcttacacctagacaaccttgatatttcctccaaaagattcttttacctgataaactacttcagtaagatttcaggatacaaaataaatgcttgaaaatcagtttcatttacatagatcgacaacactcaaactgagaaccaaataaaaatctcaatttcatttataatagacacaaaaaataaaatatctagaaatatatttaacaaaggagaccaatgaggtaaaagatgtccacaacaagaactataaaacactgctgaaagaaatactacatgacagaagcaagtggaaaaatatcccatgatcattgtttggaagaatcaacatcattaaaatgactgtactgcccaaagcgagctacatagtcaatataatttctatcatagtaccaaatttattactcataaaattataaaaaaaaattctaaaatacatatggaaccaaaaaaagagccttaatagccaaagcaatcctaagaagaaagatgaagttgggggcatcacattatctgactttatactataaggctataataaaaaacaaacaaaactcagcatggcattggcataaagatggacacatagatctatggacacaatagggaaactagaaaataaaatcacatgtgtataaccacggttcttcaacaaagctgacaaaattaaacattggggaaaggtcaccctattcaataaatggtgctaggaaaacttgcttgctaaatgcagaagaaagaaacttcactcctatctctcaccatatgcaaaaattaactcgatgaattgaaaatttaaatttaagacctaaaactatagagatcatagaataaaacctaggaaaacctctttagacattggcctaggcaaataatttataaataatacctcaaaagcaaatgcaacataaacaaaagtagacaaatgggacttaattaagccaaagagtttctgcacagcaaaagaaacaattattagaataaacagacaacctatagtatgggagaaaatatttgcaagtaatatatctgacaaaagatttatgtccgaaatctataagaaaaacaaatcaacaagaacaaaacatataactccattaataagtgaggaaagaatgtaaacagacacttcccaaaagaagaaatggaagtgaccaacaaacatatgaaaaaacattcaacctcactaatcattagagaaatgcaagttacaacaaaaatgagacaccatttcatcccagtccatttgtactttttattatcatatatatcctcaaattcaaaacaaaataaaccacaacataaactgtgttagtatagtacattaaagtcagctccactgtgctgtatcacttggcaagtctgaaattccaatgggcttcagaaagttgactatgcaatgcccaataatgacctgataatctcatattagaggcaatgcaaatatatttataagactaagagctacaacaagcttacgaagaaaaccaatttatagcattacaggttaaaccagaagtgatttcctctgttaactaaaattacattactaaaaagtgcatggttcgtggatgtctaatgtgaaaaaagacagacagtgaatactttcctgctcagtgtgaacacttaataagaatgaaaatagaatgccttattatataaagtaataccaatacattgatttccaatctactcctctggcacaatttaaaatgagctcttgaactatagagtcacaactctttttcatttcaatgtgttttccttcaaaatagcagttatttatacatactgcttttaaaaatcatttttaggctgcagattcacaatctccataaatatcaaagatgtgaagttaagttcagatgcacttgaagtaaacaccatgctaactagcagcagtgttcaagagatcatgctgccgatcttatgaaagggaatatactattgtgaattattttgcaaatcccaaaagaagtttatctctcacattattgaagactgagaatgtcttaatatatgcacaacttgaacattgtttgtgaaaaagccagactaattcatctatcttctgatcaatcagtttagccaagcaaagcacaaaataaatgcacatcctttgctgccgttaagagcaaccagtttgcttgtctgtgcatcatgaatgccaaacaaatcttgaataagaacgaggaaaagttaaaagaaaagaaagacaggaaagaaataaaactcaattttcttgaataggaaatttctagggaggaaacattttccatttttgtcttctatcaaatttatatatatataaatatatatataacatattatatatatcctaactgtcattataggctattctaagacagattctgccaatattgaaatatctaagacaggcacaattgggccattgcaaacatcatgtactaaatggattctaaggaacctgaaaattaatgaatctttctaaaatgactgacttactgttaggggaaagcttaagaaatcaaataccaaatcaaataccaaaataccaaatcttttttcatttttctattcttcccaaaaaaaaaaaatagtgggggataaaataacgcaatgcccagttaaagtgccaacaccaaaacaacttatggctgctacttctgaccctttcagggggtcaaattttgttgtcttttgtatttctagctttgtttgagacctttgtttgcatatattcaaaggttagtaaatacaatttaatattgtttccacagaaattaagcatttacctagttagaataagcattcaaacagaggtcttgcattaaattttgtactaaactgtattccttctaccatgctgcaatctttattaagaaacaaaggacatctgatttcacttttctaagcttattttagttaaggttaattattacacagagatactaacctttcaatcataaactacaaattagcattattcatctctgtggtatattttcaatgtaataataaaaatcctggctcgctctaaaggtcaagctaaaagcaaccttaccatcatcatactggcccaagcagatttcaaagagagagcccaggatgatccctgaagctaaacatgtccagagataaaactgtcgaaacatcttctgtcaaagttcactcaaagctgatctgaaataagaaaaggtagaaagaaacatttgacatgttcattaatctgttataggtaaacacaattgtcacagcacagaaaagccttaatgacttcatagttaattacctgtgccacattatccattaacaaagtaacacactggtttaatgcactggaactgtttatcaacataaatttgcagacaagtaatctctaaggaaagacatcttttctgttatttaatttgccagcaagtaggttgagaagttaacatactaataatatcagaagcacactctttaaaatttaagacattatgggtaagtccaatgttaatcagtttaagttactaaacttatgttgtctacagcataattttacaacaaagtgtaagatagtaagccagttgttagtatcctacatgagcatttcaatgaaaatttgtcttatacaattaagtagaaaagcccatcattaaaatgttaattcctttctagtagagtgatcagagattgacttaactatgccaggaaagactaaggaaaatctgtcaattttcactacatctgctttatgaagcatttggatgcatttcattttaattctcttgttttacttttcaatccccagcaagttaaaaaaaaaaaaaaaagaaagaaaacaactgattgagaaattagtggcctgtgagcacatgagaatgtcttattgaaagaatgacatcctcagtttctttgtaaatttaggaaattatccacacagaattgttcaaaatgctcttgattataaattgtggcagactagggattggaacactgtttctctaattcagaggttccaaactcaaatgcctacagaggacaagcagacaaaggaaaagaatgaattagccaaaggggacaatagtgatggtagaggctgtgataaactgtgcaatgcaaggttttctaaagagaccagctggtgctcaacttctgtcagtggttgtgatgtggcaatgcaagccagtgtttctgggtcttctgattttcaaagagaaggcagaaatccaaattttcatgtgatttccaagtgtttacatgattgtgcaatcttctttataagactaaatgcttctagcaggtaatattgatgtctcaagttctccagttttctatttctgcccaggattctctctactagactagctgaggataaggtttatcagagggtacaaaggcacgattttaattctgcttttgtctacattttatttttgatttattgccaagtatttaataatgtttatttgtccagcagcatgtataaatatatatattgcattgtaaaattgtattaaaggtgtaagctctttttttaaactaatgggatacacagttcttgactttaaaagatcactgctctagatcacacacattttaatatgaagtctattcttctttgtttctttatctaagatataaaaggagctgccttctttttaactgggccttccacattttttcctaactggcaaagtgcttggcgcgtgcatttataatttctagggacagaaagcccaaagaagagctcattattagatgccaagagatcatcacaatccacactaacctgtagaaaaaagaaaaataaaattgaccaatgctactggttgtgtagagcagcggataagaatgtggctttttttttaaattcaagcttttcagcttactagttatatgactttgaagaaattaaatagcatctttgtctcacatttctcattatcataatggatataaaatagtatttacctcataagattgtcttaaacattaaatacgtaagggaatataaatacgtgcttaatgcagtgtacttacagaatgagtaccccctaaagcttaatatgagtaccccctaaagcttaatataaaagactcagcatctatggaacctccaaagtcttaaatacagatttactcaatctatctttagcaagggctggaaagtagatattattatccccattttgtggaggaaaggtcaggctcagagagaataagtgactggctcaaggttataaactggtgagtgtctgaagagaccataaagtctgtgagtaagacacttctgctcattccattagagaaaagtattggaaaaattcccagaaaacacagggctcagaagttttcaaggcatatggaggcccaggagagcctgctgtattgcttcccttaaactctgagagagacattctaacccccttcacaaaggattagagctctactaagatttctatatacaatggcttcaaatctttttttatttggaaaaacaaacatgacattaagaaataaaacaatgttatttaaattttaaaaatataaagagaaaccatatacaaatacaaaccagaaaggatatatattggaaaacaaaattaatacaaaccagaaaagatatgtattagaaaacaaaattaaagagacggtaatatcttagcaaaggacaaaaggacatagttgtgttcctgtgtgggtccttgatctgccagcttgacttcctttatagtagtttatagtattatgcattcacaaattatggcatattcttttattcctaactgaagctaatttggtttcatggaacagtctccaatataaaaacaacatgatggatcattattttaaaatcattaatgtcactgccattattatgcctccagaaacaaaacctcttgatctatggctctgcaagtttttagaggattatatgcatatttctgaaagcatcacagacaaaactcataaaaaatctatttagaatagatatagcatttactgcccagaggaaggagataattttaggggaaatattatacttatttgtctttgaataatgataataataacaatttctatagtttttttactctttcatctatatctgcctgatttccaaagaaattttcatcacttcaatgggctcaatatttacagagacctgaaagaaagctatgactcatcacatcaacccgataccccaaaacacagaacacatattgacttagtgagaaaacccagtttctaaacaaagatataatgaaaaggtacctcccacaaagagattgtgtaaatgactacaggaccaagatgtttagtacaatattgtgccaatcaactgacagcctatagtggcacttctgtgattgtgatcaaattaattggaagagatcaaatgctttagacaaaagactgtttttgttactagctttttaatctctagaattaaaagagaaagtcctataggagatgaattccataatcttgctaagtgactgtaggtaaatgaaaagcctgtcaaacaacacctctatggtggtactttacttttactacaaatcccacatcaaactctttccatgttccccgagtatatatttttcctacagaatttattggctaataatgttatgttctaaaaatccaaagcatgttcaattctaaaaagaattgtaggtgacctataaataaatatgttatacttgttttttaagagataattaaattggtgtattcagtactctaatatagctaataaagttatcattttgcaatcgtgacttagaaatagtattctgttgtcaaaatactggggaaaagtgtttttttcctattacagtataatattacacgtaagtggtttgcattccatgtgcattttatgacacaatttccttaggcttaagaatattttactgcaattattcaagacaaacatactaattttgaatttcacatcatttgtatttcctgcaagataaatctcatatttatttatctggcattcaatgttctcaaaaattaatttattcaacaagtacttatggagggtctactagataccactcactcttctaggcagttggaaaatatcagtgaacaaagctgacacatttcttttctcccatggatgttatattccagcaaaataaagatagaccaataacaaacataaataagttatataaaatgttaaaatgtaataagtgacatgaaaatagcagctagcatttcaaaactgtatattgtcactttacaataattttcattcagtaaatgaagtgagattacacaaagcaaccaaaatgctatccgataaaataactgaatgagaactttacaatgaaagtataactattccgacaaccctgacagcatccttgatggtatctactattctgagtacagatttctgtccatctcttggaaggagaataaaggtctttcactgcctttcactttcaaatataaatccaaagtctggaaatacacaaaggtctgtcctttttctgtttatccctgctccctgagtcttgggtgtttgcagtgacacatggcaaaagcagccaaggttgacaccacagcagttttctcttaaatacaattttgacaatgttaactattttttagcctatgtctctgactgctatgtgaataaacactaactttcttgagataccaaaacttggaacacaccgtcattactttgatgagaaaccccataccaatacacaaccatgaagcaagctggagtctcacagtgaagtgagctgtatgtatgcagtctgcccttcaacagttggttcagccaaattactgttattcttgatctgtaacaatatctagataaagctacaaaactaaaacttgtcactgctttgtattccttgtgagaaacgtatgctatctacctgctggaataaagcaaacttcccttcaaagcaacctcagcttcaaactaaaaacatgaggttttccaaagtcactgtatcttaccatactaaatatcaatttgcttaaatgactagagagaaacctgtcttctacctcagcatggtggtaaatattaataatgtcttcatcagtacagagggtacttatcacccttcagcattaccagatgaatcagctgttccttttttaaaatgtgtaatatgaagtttaggaaaataaaatttcagagagcctttcagatatattccttccttctagatcatattatatttttctttactaaatatacatatgtataagtttatatcatatattcatctataaaaatatattgatatttattgacaattttatagtacatttatacatatttatatataaaattatgttacatagtcacatatacaatttatataaagaagtatatattttatttaaatttacattaatgataggtaatatcaatgatattgatattatcgcccacttttttaaagtttgcaatttaaattcaaggggttccgttgtagctaatttgaggtaagtttggaaagtaactaatgtttttataggacactgtgaggtccaacctacctctcccacccggtcctgctaaattcggcttactagatctttgctcgggcttacagttttttttaacatgctactacatctgaatgtgtcttgactaccaaatttaaaatatgtgctaatttggccaggcgcggtggatcacacctgcaatcctagcactttgggaggttggggagcatagataactcgagatcaggagttccagaccagcctggcaaacttggtgaaaccccatctctactaaaaatataaaatattagctgggtgtggtggtgcacacctgtaatctcagttactcaggaggctgaggtagaagaatcgcttgaacccaggaagcagaggttgcagtgggttgagattgcaccactgcacttcagcctgagcgacagagcaagacagattccatttcaaataaaaagaaaatgttaatttgctttttgggtgcactctgtctcaacatatagattcatcctaaacattgtgggataaaataaaattgatgaaaatcatttttaaaattaagaatataaattattaagaactaatcttgctatcacttcaatcatttacaaggtctttcatttcagttttaaacattttaaatatataatcaacagttgtaaacattagatgagactaatttaacccaaaatatatttcccgaaaccacatgaaacacataaggtaagtccaagctctggcattcttatactacagctatggtgaattcttggagaattcaaatcagtgtcttaacatgtctgttgagtctattcattattaaattctggttttaataatagaactttaaataaaagagggaagaacactggttttctttttggggaatactacttctcaagaaaataaatgactgaccaatataattaatctgcttatgtttaaagattgtgtcttcatggaaaaaaactaatattcagtttagtctataatagatacatgccaaatgttataataatgtagtcatactagttggtttaataaaatataaatacaccaaaaatgtttttaaatgagtggaaatttaatctccatgtttactattgctattatattggatattttcttagtgtttatacatacatttactcaattagtatttattttatatttagtgcatatcagacactaagcttctactatagaaataaattattccatttcctcacaatgactttgctattgagcatgcactacatttcatatttttttacctaatatacatttcaaggtactttagtaaaataactccaaattaggagataaataagttttaattgccaatttttttgaggtttccattccatctatgttttcagaaccttcatctaaatctcagtcttttagataaatacatttctcactatttgttagaaaagtcatgggaaaaagcttagtttgaaaggagcaagcaaagggaaatataaaaagagaagcccaaacattatttcatcagtggagtgtttagcttaaaaatataaccaagtaaatttaaaatggagttttaatgctcaagcaaacgcatgcatcattttaaaaaagaagcttgaaagagagttctgtgcagtgttattacctggcacagaaaaatgattctgattaatattcttgtttgatgaatattatagattctaagaaacacaaataaattaatgagtaaatgagtattttcctaaggcaaatccatcagcaaaaaaaatccaaaagtattaagtcagtcaacagagactaaacgtaaaagtatgaaaatgtcagtgacttgtataatgtaatataataaaagtcctggctctggcatgagagagtcttgcattgcattcctagttatgttgcttttggagggctatataagggtaaactagttaaaacttgtgagaatcagtttaaaattaggacaataaaatccattttattcttctgtaattgacagatgaaaatttgaacaaaaaataaaagttaagaatattcatttgttcatttatagcataagtgtttactgagcactgattctggataatgcactttataagatgcagtggctacagctttatgagaaaaactaaatgaattaataataaatacataatagtccatatagagttttcagtctaacagagtgtgacagtcacacctaaagtagctcataatgaatcaaatcctcgtataatactattctatagatcaggggttcagtactggtccatggcctgttaggaaccaggccacagagcaggaggtgagtggtgggtgagcaagcaaagtttcatctgtatttacagcccctccccatcattcgcattaccgcctgagctccgcctcctgtcagatcagcagcagcattggattctcataggagggcaatctctattgtgaactgcacatacaagggttccaggttgcatgttccttacgagaatctaatgtctgatgattgatctgtcattgtctctcattattcccagatgggatcatctagttgcaagaaaacaagttcagagctcccactgattttacattatggtgagttgtatgattatatcattatatattataatataataataatagaaatagagtgtataataaatggaatgcacctaaatcatcccaaaccactctcctgctcccagccccaggtcggtggaaatttatttttcatgaaaccagtccctggtgccacaaacttggggaccattgccatagatagtggaatctatgacttgcttctaatgtgtagaatatgataaaggtaacaagatatcactttattgtttcaattaagttatataagattcagtcttagcacattggagaaagataaatcttcctgctctgtgtaaagaagcaaacgtattgtaaactgcctttggagaaggacatatgccagggaactccaggtgacttcttggaccagaggatggcctccagacaacagccctcagtcatataaccaaaaagaaatgaattctgccaacaatctaaatgagctttgtaaaacaattgcattccatattgttaattatattttgaaaagaaatgtaatttaaatactaaataatgagattttattttatatatgatcaattatatacaataaattattttcttataaatctagttacaacttttctgtttcttatattgaacaaattttgagctataactcagtcatattactttacttgcttttgccattaccatagcttggtaggaaataaggttttaaataatagtcttttaagtaggtgacagatttagaataaaagattcataacagttctaattttaaaaaatgacttcacatgtttaatgacatagcaaacaggtagtatctacattcctaattttttttcttaaatctgcttgcatttaaacaatgtaaaattaattggtaaagcatgtcatttaaaaaaaaaattaaattaaagttctgggatacatgtccagaatgtgtaggtttgttacgtgggtatacacgtgccatggtggtttgctgcaccgaccaacccgtcatctacattaggtatttctcctaatgctatccctcccctaacctccccacccccgcgacaggccccagtgtgtgatgttcccctctctgtgtccatgtgttttcattgttcagctcccacttacgagtgagaatatgcggtgcttggtttttctgttcttgtgttagtttgctgaaaatgatggtttccagcttcatccaagcatgtcatttttattagatatagttggtaatagaaggaaacatataacttttttttgttgtttgtttgttttgagatggagttttgctcttgttgcccaggctggagtgcaatggcatgatctcggctcactgcgacctcctcctcctgggttcaagcgattttcctgcctcagcctcccgagtagctgggattataggcatgtgccaccacgcacggctaattttgtatttttaatagagacagggtttctccgtgttggtcaggctggtctggaactcccgacctcagatgatctgccctccttggcctcccaaagtgctaggattacaggtgtgagccactgtgcccggccaacatataacttttaatagttatttaaatattaatatgtatgtaatggatactagagtaaatactgattgggaaatacaaactgtcattaataaaatatttgttttctatatagctttaatatgtactttttaacatgtacttacaacatttatttaacacgaatagagtagaaaatgtgtactttaatactttgccaggtgacatgtttaagtagaatgaataaaactaggtttatcctccattgcccctcttcttatcagaggggtcatatttcatatgtcatatcttttctacactttattttctacttcacattatatgaagtctaaccagagatcataaagtttcatactatatcaatgcagaggcagaatcaacattctatacatataactttttactttctttgcaggattttttaggtaaggtcttcggccaactgaactgcaactgtttcatttacaataattttaaaacagtaaaattctctcaagaactaagtttgtacatttgatgttgataaaaataatgctaatggtgaatattttttgagtatgatagatgttgatattattgaaatcattagatatgctttaataactttaaaaccaaatggtagactgttccatttcatttctctttgtactttaccaatttatactatgaaaatcatgtatgaaatgtatagtctagaacgtttgcagaaatatcatctcaaaaacagtaactcaaagtctaatacagaaagacatccatataaggaagcatttcacaaatatttctaagctttgatttgatatatattaagcttttaccatttatcttataaatctacatggttaaagaaatgatcaaccttctcaactggcacaatgtgaagatggataatttgacttagaaaaataactaattgtgtagtcatgtaagcccttcatttatgacacaaatccataaaggtcactgtcatatttcttagagactggattttaatgtaaagctgagttttatttttctaggaaactgtaacttttattgaaaatagttcatgtataagcagatttatggaattcaaactcatgttgtccaagggtcaattgtgtgtaattttataattgtaaaactctgtcttatctgtaaatgataagatattacaattagttggttctttatgtttgaggggcaaataaaatttgaataagttgtcttactcacaaagactatgcttcacgaataatacactaagaactttagtctcttcctacaaatacctaattttatagtgtatcctggcatttcaaaattaccaaactgaaaagtagtcgttctctctcttagtgtcaatgctaattgtatggtacgttcattactagagtacattttttctaacttaaatttttaaatttattacattaaatattagattatgctattatatagtaaattcaaactgcctgtataatattgtatcctattaaaatgatacagacattaaattttatgggcattctaatgattgttttccatttttccatacttttaaaataagttgttatatgtcccttggggatggggattattttaggaatactttactacttattaattttccaaaagtcaataatgaaaaatatttacttcccaacacaccctggcaagatattttataagtgaaagacataatttcattctgacctttttaattctaaggccttttcatgttgttttttttttttttttcaatctgatctaatttttaactctctctatttattaccataaccaaatttcattttactttatttttagctagttatttctgcctaggcattttctcctttttcatatttcgacctaagaatttgttcctcatgtaagacttctctgacaagtcacttcctcccccaagtataggtcaaatattttgcgataatccttagcctttcctttgtattcagcgaacacatctcagtttataattacattgcttgtcagtgggtactttggcaatatttgtgtttcactttatgcccctgagaagaggaatcattattagccaagctcctatcccagctttttatcccggagcccagcaaatagcttagcccagattagcattgatgttttgaatgaatgaattttaaaaagaaacgtatcattttcacaaaatgtcctgttatttacattaaagctaatttgttcttgtcaaatctgtattatatatgaaatttagttttaacacttattcctgcagcatttgctgaatatgcaaggatcgataattgataaattctaaggaagttctatttcctttaagacacatttaaggtattgttggagaaagggctatgaatattgtaaattctcacagagagtatggagatgtttgtacataaatatatacttattataaaataatattttaaatcgtcgaacttagataaaatatatgcttataaaatataagaataaaattctaatatacttggaaaataagaaccaaatctcagcctgtaagttaaaacttatggtttatatacaacaaaaactactggggctgtttttatttctgtgacccaattaaactaatcttttctcaaatttcatccctatgtctgagtatactaatattggcaaagccctctctatcctaaaataatgtctattttaatatgtcttcatagaaaagtcattaaaaagcagtgaacatagccactaagtatgattttaatatttttgttgaaatgactaaattaatagaaagtgacaaaaagtaccttaagaagaattttaaaaaacaaaaacaaaagattgaacaaagcatatgtggaaatataaattataattttcttccactttattaacactcttgtctaattagacaataattactttaaaaactaacactttccccttagaattactgctgaagttgaaaggttcaagtttttaattactgctcataaagcatgcagtgaaactttctaaactatgaaaagtctactatcttacgattcagcaagatatttatcttataaaaacatcattaataagtacaaaatctcatttaaattaacagcaagaaactttcattttcctttccagtgtcagagatgggtgaaataaatcaaaatcaaggatcttttgtggatgaaaggaagtagaaatcttaagactagaaactcactaatgtgatgcccatgggcaaagatgaaatcagatattacagatgattttgaagttgcagttttaataatgataaaggtatagtgaaagggagaattgaagcagaaatgaatttcatactgttgcccacaccaatcaactcatcatgcatttcaaaagtatattccggcacaacatggtggctcacacatgtaatcctagcactttgggaggtcaacataaaagaatggattgaggtcaggagttcaaagccagcctgggcaaagtagcaagacccagtctctgcagaatagacaaaataaaaaaattagccgggagtaagggcacacacctgaagtcctaccactctccagaggctgatgggggaggatggtttgagcccaggagttcaaggttacagtgagatatgatcgtgttactgcagggacagattgagagcccaaaaacaaacaaaacaaataaacaaaaaagtatattccactaataccttgtaaatgggggtgtatgaagtttttttaaatcagatataatgataatagcgtgtgtgcatggcagtgtgtgtgtgcgtgcgtgtcaggttgcatatattaagtgtaaacaccacagttatttcaggaagggatcataaatgcataagaatctaagtgtccataaaataccgtaaataaataattaaagctgattgagaaataatgggggctctggagactgtgcagaatttaaacttagcaactttgcagaagtctacgtctattttttccatcttccaattttttaggtaacattgagtgtctggattttcatatgcaattatgcaatttattttaattaaactattttctagtgtatagtgtggccaaggaaacgcagctttatgtgccatccagaccatgttgcaatagtttaaagccttgggcttaaggatctgttagtaacatgacatttgtatgatcagagctatctctccatacgcatttaggaccactgtactatcatcacgtccaaaacttcctttcataatcacaatctttgaaaattctcacactttagagtatcttcctgcctagaaaaatctatcacagtaatatatgcactcaccataaagataatgtaccaggatgctgaggatatactaggtggaaattttagaactgctgttgttcaggattttctcaaaagagaaatattcagaaatatcaggtagttactttacaaagtaacatatataaatatatgtatatacacacacacatatatttatatatgcacaaagggtttcttaaatgcacatgtacctttaaagtaagaatgcattttgggcatagtcatcaccaacacaaagttcattcttgcctcatgtattgatttatgctttaaattttgtaatcatgtgagcaatctttaaaatgataccagattcccaggttaaagtcatttggatgacatttatttatgttttttgtactattttgagtttgagggatggtgttagaaaatcttgtaaactagcttttggtattttctgattattattttttattttttggtgagcaacactaagactggcatttcaacttccaatgagggtccttatataatactcagttaagcatattactgctaaattcaaacaaattttaaaaacaaaaaaagatataaatgattgaaagcatgacaaacgttccctgtagatgttttctaatttttaatacattgaattaaaaatatgcctttccaagtgaattttagatattggttaccaccttcaagatcatcatttatgtatttgtgaaggtgaaagtaggaggcatacataatattatatctgtaataaatgtaactttttaaagtaacataacatctatatatggcaggaaataataatgatacaacattaaatagatatagacctgatgatatagttggaattctccaaactcttgcataacacttatgtaatcaatgtgaatttaaaaacatacaattggccgggcgcggtggctcacgcctgtaatcccagcactttgggaggccgaggcgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcgtgaacccaggaggcggagcttgcagtgagccgagattgcgccaccgcactccaacctgggagacacagcgagactccgtctcaaaaaaaaaaaaaaaaaaaaaacatacaattgacaataatatatgtgatatagtagattgtccaatattttgttggtctaaactacaaaatttgccctgatgattggtgtattgaagagaaaaacaattatttgtatctcatgatacttatcgaaagagtttgtagacaaataaaaaacacactagcaaaacacactctgtttcatgttaattaaagggagaaatactgttcacagaaattagcttccaaaaatcattcttcgtgaaaacacataagtaaactaattttaatactctcagttataactaaaatggtatcatccactatcttccactaactaagtattaaatacagagcataagctattccaactgacatattaaacaactttaagtatggcttatgtctataattttcttgtaatctcattctgaatggagctttcttgagcaacagtaattacagaggagttaagagtctggaaatagttatttgtttatagaaagaaaaactaataagagaatgaacatacttagtctaattagaaaagttttgtttaaactaccattagaagtaaaataatgccacaaactgaaatgaatccctggatattcttaaaacattattgttactttagtttcttaaaaacaaattaagcagacactcattttttccaatagcttgtaaacttttgaatcttgggtataattttaattcttgagagtgtcacatatttgataaagaatgtttgtctaagatttctatgcatatgtgtatttgagtatatgctatattaacatatgtgtattagactgccaagataaaatataactaatcaaagcatttattatttaactttgattaaatctattagcttctttacagattttgctcatttgtaagaggaggttaggtttcttcccccaggataaaagggatgagttatctgtttctcttgggacagatgtactgtggtaaatgcagtgataagagataaatgaaaataaagagaagcccctaaccaaacagaaatgaaaagaacaataatagaaaagagtgtctggggacagtgttcgaggttactttttcttttttctaaaatgattttttgcaattcatgaaaacaagcctgaagcgtaaacttgtcatctcattttaagatgcatttctcctaatattaggtattaaaatataatgatcaggcatatttttaagactcttttcaccttgtttgaaatgtattgcttcacaaagtctttgtggagctttctttttttttaagaaaagaagaaataatacaaatatagtttaggttgtgttaatgcttgaagaaaggtgtaaagggagtgatatgctttggttgtgtccccacccaaatctcaccttgaattgtaataatccccatgtgtcaagggtggggccaggtgaagataattgaatcacggggcattttcccccatactgttcttgtgatagtgaataagtctcatgagatctggttctataaatgggagttcccctgcacaagctctcttgcctgctgccatgtaagacatcactttgctgctccttcaccttctgccatgattgtgaggcctccccagccatgtggaactgtgagtcaattaaacctctttcctttatacattatccagtcttgggtatgtctttattagcagcctgagaacaactaatacagagagagaaagaaggttggagtagggagaagattgctagggtattaaaggaaagccctctgaaaatgacacttgagctgagacctgaataaactaagggatattttagagaatcccataacagggaagcaggcataccactttcaatggctctgagtggggagcatgccagccatggatgagaaacagcaaataggccagattaataagagggagggagtagtactagagatgagagacgtagccaacaagaaactgagagaatggaggtgccacttactggaatgtgatcctccctattggggagcggcaggtttggagtagaaatcaagagtttggctttgattgctcaaataaagtttgaaatatctattaaactaccaaatacagatgtcccatagattgatatgaatgaatctgaaagtcagggtagacaaaaaattgccagtcatgaaatgaacatggcactaacataggctatctacggaggatgtacaaagagagaaaaaatcaggacttgcaaatatttagaggtcagaaaaataaagggtatgtggctaaagagataagaaggagtgagagggaatgcctgaagccaaatgaagaaaggatttcaaacaggagagaatgctaatatgttgagtgccactaataggttgaggaagataaggattgaggattaactcttgtgtatttgcaaaacagaagtcactgatgcccttgagaagagtggttttagtggaggagtgggaacaaaagcctgactagaggttttcaagaaaatagagttcatataatttgttagtgtttttttttactgtgcaagtgagcaaccaaatgcggagataggaagacagtggggacaatgagtccatgaacttggcacatgtgtgcacttgtgttaaagatagagctattaccaatgaaaataatctattaaaaagtacagtgcagacaaaacaggagagagaatggacacacctgcacagtaagagaaaagtcctttcttaggttggtagaggaaattagatcctccagacagtggtaattaaccagagagaaggtccaggataggtggaagtttgcggatgagaaagatgtatcggagctttgaggataaagagaatgtatgaaggattcctttgaaaagtaatagtgtgaattaagtggcaaaatggcatacagttatacagttattgcatagggatgatggaccacttgatgtttgttttttcttttattttccagccacatgaagctgttggcatgtaggattagagtagacaaactactatttttattttttttatgtttagttttctttataatacacttcttcaagtttaccaattaaaatattttgaatctcataattaagtcttaaatatacgtgttcatgggtggtaattacttaaaacacttggatagtagcaagcaatgaaacttctctttctcttctgttgtattcaccaccactttagcctgaataactgagcaaataccaggttcttggaacactggcataaactatgtatctaggactatggctctgtccatcagcacaagccactagtaattcagaaattggtcatttatataatggcatttattgcatctttaccacgaacaatatgattttttaaacatggtttaaactatattatacaaataattcagctgtgtttgatacttcttatatgtaagaatcactttcctttttataggttacttttcctctttttataatatctgaaatttaaggatgctgtctcagagagccctttatttatgcaggcaagataagaatctatctgagatactctcacattcttaaaaactaaatagctacccatgtgtgtgtgcatagtgatgtcagaagttcttaactgagtcgtaaattccaaagaatcttagctaaaatgaagctcatatcttgctaattcttctctgttaacccataagaaaacagaagcccagagaaattaaaagatttgttcaagatttgcttgatagcatactaaggtggatttaggactttgggctctgaattgcttaatatggaagtgttgctcagggaaaagcccaaaccccagcattacacaataaatccatgcaacaaatttatacatgcagcctctgaatctataatttaaaaatgtgcaaaaccaagcatctttgaggaacaaaattctgagatattataagactttgaaagtcatattaggctttgctattgttcagattttttaaatatttttaatttttttcatttaaattttaagattttgttgtggtaaaatgtacataacatataatgtaccattttagccattttaagtttacagtttagtggctttaaggacattcacattgttgtgtagccatcaccaccatccatcttcagaacttttcatcgttacaaactggaactctatccattaaataggtgctccccattaagccctgctccccgcccctggtaaccattattctatgttatttctctattaatttgactattctgggtatggtatatttgtgaaatgatatgaaatttgtgctttcaatggacaagcatttgaggggattcaaaattgaattattttatcacgtttcagatggaactacaattattgagcatcaccattttagacattttactaggaaccttaaatacatgttttattttaaattctggatcaaaattctgaactaattgatttcatttctttataaattggacagaagctgagcatgagaggttaggtagccctctcaaagtcaaacattagaggcaagactagaagtggaatcttcaaacccatgtccattaacatttcacagaactttgaagtacattatgcttgcagtgattaaagcttgcgatcaagtgtctgactaacctgagttgcaatcctgactctgcctcttacatgctacaatattttgggcagttttctgaacttttcaaaccctcagtttttcctttgcaaaatgttaaaatgatagtttgaaaatcatctagaaagggtgttgattatagcatagcacaagacagaaacttttccatatcataaagaaaaaaatataggctttttgagatactaagaagattatcatttatatctgaaagggaattcagattgcttagggaaattatacctaagatgagactcacaatggcagataataataaaatagcgatatttttcacatattaaaatgcatgtgttattgtatataacaattatatatttaaaaattgtccttcagatatactcaaacacgtcttcaaataccttcatataaggatatttactgaagtatgatttgtaatacgaagaggttgtaaacaattagaatgtacagcaataaaggatacaataggttaaagaaaaaatgtattgtaggtatagaatatttgctatgtacctaattttttaaaatcatatttataaactaaaatagatactctaggatatgtcaaggagctaaggaaatcatttagtttactatttggatgtttacactgaatcttcaaagtgttacattttcttaaaagaaaatgttaaagcatatgtggcatttagtcaaatgtatatgaatatgtatttatggcctctttatgtaaatgcatatatgagatgttcttgaagtaaaaaataattctgtgtttttttctcttgacacaagttgaagctattacaaaagctaattatttaattaaaataacactggaaaaaatgttttaaatttcatttgttaagctagaaaatatttaagaagggaggaaataatttagatcaataccatgtgtatatttaaatcagattttcaaagtttgacctttttacagaaaatctaacagcaacaatcatttccagcgttactccaggtcaaatcatttgatagtgttatttcctatagtagtgtgtattagaatagaatgtctgaaaacttaggctacactaaatttataaaatgcattttttaaatagtaaactaactttagcttactgttgtttttaataaaatttttaatttttaacttttttagctttttgactcttgaacacatggtatagccatacaacatagtttctttctttatatttttattctataacctttttctattttaaaaattattaatttaatttttacttttaaagcattttttaaacctagacccaaaaatacacattagcctaggcctacaccgggtcaagataatcaatatccctgtcttcctcctccatatcttgtcccagtacaagactctgagaggcaataacatgcacggagctgtcatctcctatgataataatgccttcttctggaatatctcttgaagaacctgtctgagggtggtttacagttaatttttttataaggagatgaagtacactctaaaataacaataaaacttacagtattgtaaatacataaattagtaatataatcatttgctatcgttttcaagtactatatactaagtgtatgtgctattatttttatcactggcagcacagtaggtttgtttataccagaatcaccacaaacgtgtgagtaatgctttctgagatgatgttacaagggctatatcaccaggaaatagaaatagaaatttttcagctatgttatagccttatgggaccaccattgtatatgttgtacattgttgaccaaaatgccattatgcagagcatgaccatacaaatgtacagatgctcatcaaattacaatgaggatacatcctgttaaaatcattgaagtcaaaaatattgtaagttaaaatgcatttaataaactctgtctactgaacatcatagcttagcttagcctaccttaaccatgctcagaacacttgcattagcttacagttgggcaaaatcatctaatacaaagttaatttttataatagtgttgaatatagtatgtgactgattgaactgcactgaagtaaagtttccactgaatgcatatcacttggcaccatcataaatccaaaaaattgtaaattgaaccactgtaagttggcgactctctgtatataaaatatgtgtgtgtgtgtttatgtattttaaatcatcactgcctctacttttctaatttttgcatggaaatccaaatccaagggagcaagacagccaattttttttttttttttttgtatttttagtagagacggagtttcaccatgttggtcaggctagtcttgtactcctgacctcgtgatcagcctccccaagtgctgggattacaggtgtgagccaccgcactcggccaagatagccaattttaattataacccagagctaaaaatgtctagaaaattaaaatcatcagctaataaccaaactattatataaatatagattattttctagaaaagaaaagttcaaaggccatttaatagttgaaattttatgatgggtgcaaattttgatgcactatgttttgctttagatcctttttaaagaaagcattaaataaggaatgctttacagagttattgagattttttagcaaaaagaagtcctcattatttttgttttggtttcctgtgcttttggtgtcatatccataaaatcattgctgagacgaacatcatgaagcttttccctcatatttctttttgcactttaatgatttgagtcttacatttacgtcaataacctattttgaattttttgtgtgtatggtgtaaaattgtgtccaataccattcttttttatattcttatctatttttccaccaccatgtgttgattaggtcattgtgactttttggcacccttagtgaagatcagttgactatatatacatagatttatttctgagttctgtatcatattccagtattctatatgtctgttgtacaagtggtactatatcaaactaaaaaggctctgtacagcaaaggaaacaacagagtgaagaggcattttgccttaacagaatgggagaaaatatttgcaaaatgtatatttgataaaggtttgatctccaaaatactttatttttgaaactcctgtaactcaataaagcatgtgacttgattttaaaaatgggctaaagacttggaaagacaattttccccaaaagaactataaatagccaatagatatatttaaaaatgttcaatgtccctaatgataagaagaatgcaaatcaaagtcaacaagagatatctcctcacacctgtcagtatggctattacaaaacaaaaacaaagaaatcaaaacaataaaaccccaaagacagtatgtttttagtaagaatgtggagaaagtggaactcttgaaaactgttggtgggaatgcaaaatggtgcagccactatagaaatcactacggaggtttctaaaaaaatttaaaaatggaactaccatatgattcagtaatcaaaattcttggcatttatccaaaagaatcaaaattacactctcagatacaatcatatactagtactcttatgctcattgcgactctatttacaatatccaagatgtggaaacaacctaaatgtccatcaacaagtacatgaataaaaaaatgtgctacatatataatatatactgactaaaactctctcctttgaccaaaactttatttggactcttttgaatcttatgcttggctaggtctaaccttgggcttctctttctgtccttgttgaatccagtttgagcaagattcctgttaagtcagcttaggaaaaaagcttcaatatcttatgacactggactccattcagcaataattccatcaagttgatgtagctagaaacctcgtttttctgtatgtttcctcttagtaattttccattcactgaaccccaccctgctttttggtataagtctccacttgtcatggtggaagtcagaattgagtccaatctctctctgctcctttaagaccactttgctggggtccctatacctattaccatgcccatccttgaacaatatctgccttaacatctttaagaaaattctgcaatatataatacaatgttgtatggcagaaagtttcagtcaagccaggtaaaaaagccctagagatctgccaaacaacattatgtctatagtcaaagattatacacttaaaaattggttaagaggataggtctcacgttaagcattctaaccacaataaaataaaattaaaaaaatttaaaaaagtcttcactagcattaaaaattattaattataaatttattacagagctgtcctcaattaaattaaaaaataaaattgtcagcccaatgaaggcattatcttaaaaattagaattaatgtgcaaagagtagaataatgggagtggtaaaaattgaagttataaaagttatgttctaccctcaaccatcccattagttaggtaggctgggtaagtcatttttttttctctaagcctcaattgtacttctttagacttgggctaatcatactaaacaaatgggattgctattatgttaaaacacagacattaacaaacagcagttcaatctgactctggctaactatatactgaatagaatgcttaatgtattttaaccattctcacagaagtagaataaacaatataaacaataaatttccgaatccaaagtttaagagatgttaaggcaaatactgtattgtctgaaaagtatacacttttgaaaaatacataggattaatattgaaaatatcagaatatgcttaaacaagtatgcttacataggttttctcctttcatctcagtttgaaaatctagccatgtaaaatcagtttctagttaccagtgattcacagataagcttcacccattaaaatttccattcctacttaagaatcacaaagaagttaaaccccaaaagcagcatctcaaaatcaactctgaaaggcaattactttttcaataagtaaaattcatgaggaaaatttgtcactgcattagcaagttgtctctccatagaataaagaaccaaagctttacttgttcattgtgtatgagaagatcaggatcagtcagttaatgcttgtgttgagaacatttataatgtcaaaataaggttaataatcctaaaaattagataacttaataaagcaacattagactacctaaaaattccaatgctcaaaaagtaattcaatatttttagatatgctaaattgggtatctgctttctcagtaacgtttccaaaatacctatcttctcttcacattcaatttttctttcttactacaactctttagccacaactacataaaccttaaaataaaattttctgatattattattaatatatatgtccacataggtagataaaatggctataaaataggtaatttttaaagtttatgagctaagtgatgctaacagaagcaattctacaaatacatatgcaaagtgtattattcatttaaaacaattaacacaaagcactcttttttggatatggtaactaccaaagtcaaaaaaacaaagagctgaaatattatgtaaattgttcacagaaactgttgatctccaaaccagtcaattattatcacggcttgaatgttatataaaatggtagaaaaattcttgatcaacacttacattttgcctctgactactttcctcattaacttaccagccatgaaaagcactgtgcaaaagtcagcaattagggactgaataaagttttaagtggatcaatataacatatttggcatatctatgacacttctattaacattcatcaatttatgaaataacgacattaagtaattgtgttcatcccaaaaacccaaatatcaaatactatttgcatgactgtgttatacatagagcagaaggcagtgaagacatgatctttgcttttgtcacctatgaagacaaatatattgagtcacctatgaatacaatatattggagtgtgctctataagacaagtagatgccaactcctactggtcttggagaaaatgtaaataattctattggatgggagcagcaaagtaggtagcaatttcacagaatgggtggtattggggcatgttcttgaaggaatgagaggtcatcaaacagacaaaaacgttttgaacataggttataagcaataaagaaactgtggagttgcaaaaaatacagcatgatcaagaaattgtatagtcatgtgccacttaacaatgtttctgttaataatggaccacatatatgaggtgatcccttaagattggaatggagctgaaaaatgtctatcttctgttgacactgtagctgtcataacattataacacaacgcattactcatgtgtttgtggtaatgctggtgttaacctactgcactgccagtgtataaaaatacagcatatgcaattatatatagtacataatactcaataatgttaataaacaccatattactggtttgtgtatttacaagactaccttttttttttttttttttgagatggagtcttgctctgttgccaggctgggctggagtgcagtggcaccatctcggctcactgtaacgtctgcctcctgagttcaagtgattctcctgcctcagtctcccgagtagctgggactacaggagcacgccaccacttccagctaatttttgtatttttagtagagatggggtttcaccatgttggccaggcttgtctcgatctcctgaccttgtgatccacccacctcaacttcccaaagtgctgggattacaggcatgagccaccatggccagccacaagactatattttttatagttattttagagtatacttctcctacttattaaccagagtatttgaattttgcattttaagctgtggggagttgctaaaccagtaataactataataagaatatcaactaacgtttgtcagtactgttaatatcattcaccaacttttaaaatcacctattatatttgaaactgtttattatctcagtgtccctagaaaagcaagtactgcattaggtgcataagaagatgaccatcattgaaggtcaatgagcaaaatgtccaatttttttctcaacttggctgaatatgagacagaggagttcctctgagcaggtgagttatgtagcttatgacttacaaatgatccctaaaaacttcttatatggtatggtgtaaatgaaagtacaaaataatttatgacagtacgtagcagaacaaaagaggaaaatatgttttaattatcaattaaaaattacctccaaacttcaaatatgaaaacccacaaataaattgcatctctattgaaatagcacaggcacttcatggtttagatttgtagaaatgtctctgaaaactctgtatttcctacttttatgtttgtttatatttaggagcagcctacacataatttggctcacttaaaagactttcttaatgagtagtaatctacatagttccttgctgctttattttttagattgggctggggaagtcaataaccactagaaactctcaaaccaagaaattctcctgaagcaatctttcagctgtaaaccacctcagctaggaacccattgtattcctataaatttccttcagtattcctaagactaaactaatctgaacctcatgactgacaatgagttgagaatgaccttttgcaccagtgcattaattgtgaaagctttctgcagcaggagctaggaaattactcttctgagtacagcagccagagcactgaaatggctctggctgctgtactcagaggagtattttgaatggcaatgcttaactcttcagccacacatcgtctacatttttatattttacagacattttagatgtgtccatcatcctccaaggaaattggatttctgaataagaaatttcttttcaccctgtgatttctacatgatacttatagaaacagtttgacagctttggagaggatatcctatgcttcatgtagactttctgcttacggagtttaacacactcataaatttagctttactgactttacaatcttttatatgagaacagaaaagtcagcaaatttggaaatagaaagtttatgttccgccacatataaagtatgccaagtaatactttggccacttcacaaggaagaaaaggatatatatccaaatttatataacattcaagaaaatctttaattatattccagagctgataatttaaaatttatcttcaataattttatttgtttccaaactacctgctgctgagaggaaaataagaatatgcaatttgaaggcatggcttgtagtgtatcatagctctatttattatattattatattcatctacatacactgaactgaaattgtagagttcatttatcatttagatcaacttttaagaagatatatttccaattcttacctgtccatctcaaattgagctcactatattcactttatgtataaatggtatgtatacataagcaaaatataaatacaagcagtgatatatttattgcactttgtatcttaaactagtatacgtttgcttccagcagtattttgattttactgcaattcagatattctgattatcttttacctaaactttaacaatcaaaacaacttatcagtcatctaactttaaacttcctctgaaatcatagtctttgtacacgaaatctaactggggttaaatgttcttcttgttctctctgattgagccttccctgggacatctcatgcatagaaaagagttcacaaataaaaatcggttagagctgtgattcagtttacataagatctagaaatataagttccataacttctaaacgaagtcatatccttaagccattcttaaacttaaaagcgaataactccaaacatccctgattgaataactcaaaataataagctcatcaatctgataggaatgtcaatctcagatacattgccaagaaaatgaaaatgatgtagtaaagattaaatgagaaaatgatgccacatacttagcataaatgcaaacacaaaataaatactcaagtaaataaaaccattctttttttaaatgtattctaaaacaacaacaataacaacaacaaccacaacaacaaaacaggatacaggtgcagaacgtgcaggttcgttacataggtatacgtgtgccatggtggattgctgcacctatgacctgtcctccaagttccctcccctcataccctaccccgcaacaggccctcgtgtgtattgttcccctctctctgtctatgtgttctcattgtagagtaactcccacttatgagtgagaacatgtggtatttggttttctgttcctgtgtcagccataaaaagaaataaaaccattcttaggatgatatttctccttacccttctctttttacaccgagaagaattatcactttgacaactgacgctctctttctttctttcctgaaagtaagttacactgtaacttatatgagtaaatgagccctttatatgaagcttaacatttaaattctaaaggattcttaaacacatgtgtaacaacaccatgtgttagttaatcctatcataatatatcatgttcatatattagattaatacaattaatcacattctaaattgacaacattttctgagatcttggtttcttaatatttgcagtagaaacaaatattttttctcacccttgagaattaaaagtgaagcagaaactttagagtcatgttaagttgctgactatctaacttggtttctgaatgataaagtagactctaatggtgattgctttttcagtaacaactttcagtaatatttgtatttttctatcacacctttccctgaagaagaaatgctttcagatgaatagggaaagactctctaagtataggtttgagttttagaattggctagattggagagttttagatggaagagggaggtatcaatcaagtacagaagttaatgctacaataattacttgggaaaattctcacacttcagtgattgccaatcagcctgcactacttactgagtgaaatgtctatggttatcagaaatcgtacaagaaaaaaccaaaccgaaacaaaaaatagtgtagttctttttttctcaacgaagtatatttaagagcattaatttagatccaactaggcctaggtttgagcacaggattttccactgtgattaacttaaactctcttgtttgaagttgtctcacctataaaatttgggacaattgtggtaattccagaatgaaaataaaatgatgtacatacatcatttagtatattaaaaattctcaataagaattgatttttctgttaatacgattataatataatttgaggctacaactaaagaatgaaatgaatagaaatgtaaacagaatggtcacttttgaaagggcttattctgtttagaagaatgtatagacatgatcaaataaatgttcagataaatttatagagatgtcaaataataactgcaaattgtgcaattcaactaaaatgtcgagagacaatgagacaaataccttttttattcaagttttaagaaaaattactgaagtttagaaaatctatggaataaatagaacaatacaggcataccttgttttgctgctctttgctttatttcactccacaaatattccaatttttacaaattgaagttttgtggcaacctggtgtccaacaaatctatcggcattgtttttccaatagcatgtgctcacttcatgtctctgtgtctatgttttggaaattatcataatatttcaaactttattattattattatttgttatagagatcagcggtctttgagatcaactactattgtagttgatttgggccaccacaaaccaggtccatagaagatgataaacttaactgatacatgttgaatgtgttatgactgctccacccacttcagcttccctgtttccagaggcacacaatattcaaattaggccaactaataattgtacagtggtctctaagtgttcaaatgaaaggaggagtcccaggcctctcatttttaatcacaagctaaaaataaataagcttagtgagaaaggcatgttgaaagcccagaggccaaaagctaggcctcaagcaccaaacagccaacttgtgaatgcaaaggaaaagttcttgagggaaactcaaaaagtgctacttcagtgagcacatgaatgataagaaaacaaaacagtcacacaccagggcctgttgtggggtagggggagggggagggggaagggataacattaggagatataactaatgttaaatgatgagttaatgggtgcagcacaccaacatggcacacgtatacatatgtaacaaacctgcacgttgtgcacatgtaccctaaaacttaaagtataaacaaaacaaaacaaaacagtctgattgtggatatagagaaagtgttactggtttggatagaaaatcaaaccaaccacaacattcccttaaaccaaagcctaatccagaacaaggccttaactctcttaaattctgtgaaaactgagagaggacaggaagctgcagatgtttgaagttagcagaggttgtttataacatttaatgaaagaagtcatctccataacataaaagtgtaagatgaagtagcaagtgttaatgggtaagctatagcaacttatctggaaaatttagctaagatcattgttgaaggtggctacactgaacaagagatttttaatatagatgaaaataccttctatggaaggatgccgtgtaaaactttcataactagagagaagtcaatgcctggcttcaaagcatcaaagtacaggctgactatcttgttatggatgaatgtaggtggtgactttaagttgaggctgatacttactgaccattctgaaaatcggagggttgttaagattatgccaagtctactataactgtgctctatgaatggaataacaaagcctggataacagcccatatatttacaagatagatatgaatattaattttttccattggggcttcaaatgaatatttaagccccaatggaaaaaaaaagattattttcaaagtatcactgctcattgacaatgcacctagtcacccataagctctgatggagatgtacagggagatcagtgttgctgtgatgcctgccagcacaacatccattctacagcccatggatcaaggagtaattttgacattcaagttttattatttaagaaatacatttcacaagactatagctggcataggtagcaattcttcttatgtatctgggcaaagtaaattgaagaccttccattctagatgccattaagaacatttataaattataggaggagatcaaataacaactttatcaggagtttggaagaagttgattccaacactcatgaatgacttcgagaggttaagacttcagtgtagataatacctacagatgtggtagaaattgcaagggaactagaattagaagtggagcctaaatatatgactgaattgctgcaatctcatgataaaatatacacaaatgagcaactgttttgtgtggatgaatacaaaaaaagtggtttcttgagataaaatctattcctggtgaagatgccatgaactccattgaaatgacaacaaagaatttagaatattacataagtttagttgacaaagcagtggcaggttttgagaggactgactcccattttgaaaacatttctactgagggttaaatgctatcaaacagcactgaaatctatggggaaatctttcatgaaagaagaaaagtagcactggcagttgaaagttaaaagcttcccatttctgatcaaaaagattctttcaaatcagaaaataaatgaaaaaaaaaaccgccctatttttgtattttaatttccaccctaaatttctacttcgagctttattttagcatgcccattccttaggtttccttttgttttgaataatacttccatagctatcctgaaaacttttaacaagttaaagtaaaatgatgtgattataagttaagtcattgcagggatggatgtttttatctatgtatgtgtatttttccccaacatctcccctgaccatcaggctgtcatcttataggatacagtggaaatttacgtttcttttagagatggtgtatcactatgttgcccagactggactcagattcctggggatcaagcactccttggcctcctgtgtagctgggattacaaatgcacatcactgaacccagctagtgccaatttttgaagatattattgttattatgtctttgcagaaataaagttattttatttatttgtagttactacagaagaaatgactttgatagataaaaaatagtaacaaatttcaaatagaatggaaagagtaaattatctaaaatatcagaaataacttgttttagcttatatatacttgatagtttaaaaaatatttttctctcaaagtagcatactatatttctgttgtgaaattatttagttcacatatcatgatcttttaaacttattttatttacaggtatatctgcatataaatttaaatcttcatgttgaaaatacatgattacctgagaacacagtttaatttatttaaaacagttacattatgttagacttatattttgtttttattttttcattatgtatatcgctatgcttattgaaatgtgtgtatatatatatatatatatacctctttacatgcttgcaatagttaacctctgcagaaatgtttatgcttatttttgcttattccatttatggtcagagagagagagagaaaaggaaggaaggaaggaaggaaggaaggaaggaaggggaagggggaaggggaagggaggaagggaggaagggaggaagggagggaggaagggaggaaggaagtaaggaagaggcaaggaaggcaaggaaggccggcaggaaggaagaaaagcaggaagggatggagggagagtgaaaaaaagaaaaagaaaagaaaaaatagccaggaagactgttcttacataaaaacgttctcacctattggttatttcttactctaacaggcacttacgatactatttaggccacctgctaagttctgtatacagtggcatctgtacattcccttcttatcattggtagagagactcctaaatcaatactcatcctgagagtgagctttaatatagtatgggtggtatttataagtaatgaagcagtcaagaggagaaacaagtccatgtttatctgaaatgactatcttctcattcaatgcagttacagccacctacagaaagggaaaatcatccaaacagaatttaagaaagaaagtttacattcgcttgactggaaatcacaggcaaattgctttgttggcatgggataaatgaaagttaaacacgtttggatattaggagagacaagctaatttgaagtattggaattaaaaaattaagtacatagatttcttgaaacaatcactcacagatacagtgacatgggtttgctcaaagaatagagaagactggcacattttgacagaatgttgccttgggtttattatttgcatcagatctgctcaatagtttagtgctgtatagattctgtgtttagaaggattccgagggtgtctgttgctgagcagagaaaaagctacacactatttgctatatcagccaggggaaatggaatgagatgagatatttgtcattcatgtggtagtgcaaagatctgcagctgtgctgccttacagaacctggttttccaccctctacatcatttcaaaactatataaatttgatcaattacttaacctttttaattctctattttcaattttatcacttgtaaaatgaagataataacagctaccctgattacctacagtgaatttagaggtcatagataaatgttctaacattatgcctggcacatgatagccaacatttacctagtgccttctattatcatgatttcttccctgacaactgagccactttttatctttagaaggcaccattttttaactattgccagtgtcatttgtgtaaaagtttcttagtaaagcagtctttgataatgattatgacttttctgtgtcctcaagaagggttccttgacttatataataaattcttctttgtctttcacatttaaaagggaaagtcaatattaatcaaatgagtgtgttcataaaagtaatgtcctcctcttcggaagaggaaaaacagcattggtttacccaaaatctgtttctgtgcttagaataaagatctagtgtctgaaatcataatggcattctaacaaaggattaaacaaataacttcagaaaacataatacaccttaatgatatttcaaagtatttatcaatgttattgtcaactttgaaaggtgagaattttgtaacatgatttgacaatgcttaactacaggttttatgtaaaaaaaaaactagtcacttacatgttcctcaaattattagttcatatgttacggaagaaaatgtttgccacatttctgaataaaagtcatcaaaatattgtgatctagatgtcatgtaaactgaattaccaagaccctatcttaagtgactctatcaagacccataaccagaagtaacaaaatctctgaaggaaaggatttctgcatgttttcaatatgacagaaaattattttttattgttctatgatgataatgatggcaatgcagtcccacctcacttttgaaaccagacttcagtgtttctctgaatacttttaagtgtggccaacagcaaagtggctgaagtagtaggattgaagactgttagccttaaggacaaaaatggtaatataattttcatcatactataattttacctaatattccttatattgaatgtcaggagaaatatattcatatatattatttccattaatgcattttaataacatatttagaatgttacattatttagcatctcagtagcaataaatagttttttatttctttatctttttaacactttgtaaagaaaatacattttactggtaagttatgcattgcataggggaaaacaaatggacaaaatgaacatatgaaaatcagctatgccttaatgattatattttatgtattttaaatatagtattcctaaatctattttacaaatgatgctcagtaaaatccttaacctctccattgcagcaggttcccagcatgaaggggctaaactaacaaagctaggggcctggcattagccccccagagttactgcaagcaggcctggagtactaaactaatctttggccccctgagatcttccagagacaaagtcaatcgactgaacccaccatattcctctatcaaactcccaagggaatcaaagaagataaaagcaaataccttatccaaagggcagcaacttccaagattgaaggaacatctgcccacacagattagaatgtaccagcatgagaactctggacgctaaaaaatccagggtgatcatcctccagatgatcatgctagttccccagcaatggttcttaaccaggctgaaatgaccgaaatgccagaaacagaattaagaatattgatagggatgaagattactgagattcaagagaaactcaaaacccaatccaaggagtctaaggaatacaatacaacaatacaagaactgaaagacaaaatagccattttaagaaaaaacaaagctgatctgatagagctgaaaaactcacttcaataatttcaaaatacaattgcaagtatcaacgcaaaatcaaccaagtggagcaaagaatctcagaggttaagtctggtactacaaattaattgtcatacaaaaataaagaaaaaagaataaagaatggacaaaacctttgagaactatgggattatgtaaaaagaccaaatctctggctccttggcatccctataggagaaagagtaagaaagaaagcaagttggaaaccatattttgggatataggccatgaaaattctccaacctcacccaagggccaacacttaaattcagaaaatacagagaacccctgtgagatactatacaaggtggccatccccaagaaatgtagccggaagattctcctaggtcaaaatgaaagaaaaaatgttaaatgctgctagaaagaggcagcaagtcacctacaaaggcaactacatcaggcaaacagtggatcttttagaagaaaccctaaaagcctgaagagattaggggcctatattcagtatattttttaagtgataatgcttcagatttcttcctacataattagaaaaaataatcacaacaaattggagaggaaatacaataaccttaaagataatctgggtcttatctaattccaaccaaaaatttcatatctagccaaactaagtttcataagtgaaagagattaagattcttttcagataagcaaatgttaaggaaatttgttagcacgtgacctgccttaaaagaggtccttaaaggagtgttaaatatggaaaggaaagactgttacaagacattataaaaacacactttagtacataaatcgacattctaaagcaactacacaatcaagtctgcataatggccagctaaaaacatgattaaaggatcatatctgcacatatcagtattaaccttgaatgtaaatgagctaaataacctaattaaaaggcatagagtggcatgctgaataaagaagaaagacccaactgtatgctgtcttcaagagaactatttcacaagcaatgacacacagaatctcaaattaaagggatggagaaaaatcaatcagacaaacagaaaagagaaaaaagcatgggttgctattttaatttaagaaaaaacagagtttaaacacacaagcaattaaaaagacaaagaagagcattacataattgtaaaagtttcaattcaacaagaaatcccagctatcctaaatatatacatgcccaacacaggggcatccagatttataaaacaagctcttagagacctacaaagagacttagataaccacacaccagtagtgggagacttccaacagcccactgacagtattagacagataatcaaggcagaaaattaacaaatatatttggaacctgaacttgacacttagccaaatggacctaacagacatagacagaactttccaccaaaaaacaacataatatacattcttctcatctgtacatgacacatactatataatcaaccacacaatcacccataagacaatcctcagcatatgcaacaaaattgaaatcataccaactgcactgtcagaccacagcacaataaaaatgtaaatcaatactaagaagatcactcaaaatcatacaaatacatcaaaatgaaaaaagctactcctggattacaatgtgggtaaacaatgagattaaggcagaaatcaaggaattatttgaaatgaataacaaagatacaacacatcagaatctctaggacacagctaaagcagtgttaaacaaaaataaacaaaccctaaagctagcagaagacaacaaaaaaccagagtcagatctgaactgaatgaaataaattaagacctgaaaaccatacaaaagatcaacaaatttagtggttgtttctttgaaaaaataaataagattgataagtaggctactgaaaaataaaggtctgaatatccacaatcagaaatgacaaaggggacattacttccaattccacagaaatacaaaaaaaaaaaaaaaccttcaagtaatattacaaacatgtctatgcacacaaactagaaaacctagaaaaactgataaattcctggaaatacaaccttgcaagattgaactaggaagaaattgcaaccctgaacagagaaataatgagttccaaaattaaataagtaatacaacgcctaccaaccagcaaaaggcttggaccagatatatccacagctgaattctaccagatgtataaagaagagctgcatcatttctgctgaaactattccaaaaacattgagaaggagcaactcctcctcactgattctatgagtcatgcatcattctgatatcaaaacctggcagaacacaacaacaataacaacaaaagaaaacttcaagccagtattcttgatggacataaatccaaaaatcctcagaaacaaacaaacaaacaaaaactagcaaaccaaatccagcagcattctaaaagctcattcaccatgatcaagtaggctttatccctgtgatgcaaggttggttcaacatatgcaaagttagtaaatatgattcaccacatcaacataattcacaacaaatccacatgatcatctcaatagatgcagaaaagtctgttgataaaattcagcagcccttgaggttaaaaacctccaccaaataaggcattgagtaaacataccacaaaatagtaagagccgtctatgacaaacccaccggaaatatcatactgaatgagcaaaagcaggaagtgtcccctgctgagaaccagaggaagaaaagaatgcccactcctaccattcctatttaacatagtacttcaagtcctagccagagcaataaggcaagggaaaaaaaataaaaatatacaaataggaagagaggaagtcaaactgtctctatgtgcagattatatgattctatatgtaggaaaccccatagtctctgcccaaaagcacctagatctgataaacaaattcagaaaagttttagaatacaaaatcaatgtacaaaaatcagtagcatttctatacactaacaacatccaagatgagagccaaatcaagaaggtaattgctttcacaatagtcacaaaaacgtaaaatacctaaaaatatagttaaccagggaggcaaaaggtacctataatgagaattacaaaacattgaggaaataaatcagaaataacataacgggaaaaacattccatactcatatatagcaagaatcaatactgtaaaaagtgcaatacttcccaaagcaatttaaaagaacaaagctggaggcatcacattacctaacttcaaactacagtgtaaggctgcaataaccaaaacagcatggtattggtaaaaaagcagacacatagaccaatgggacagaatagacaacccagaaataaagccacacacccctacaaccatctgctcttagacaaaattgacaaacaagcaatggtgaaacaattcagtgttcaacaaatggagctggggtaactggctagccatgtgcagaagattgaaattggactcattctattcaccacatacaaaaatcaactcaagatgaattaaatacttcaatataaaactcaaaactttagaaaccctagaagataacccaagaaataccattctggacataggcaaaattttacaatgaagatgccaaaagcaattgcaaccaaaacaaaaattgacaaccgggacataatttaactaaagaacttctgcatagtacatgaaactatcaagtgtaaacagactttgatagtttgaacttctgcatagtacatgaaactatcaagtgtaaacagactttgatagtgtaaacctacagaatgggagagaatatttgcaaattgtgcctctgacaaaggtctaatatccggaatttctaaggaacttaaattaagaagcaaaacaaacaaacaaaaaccacacaaataaacaacccattaaaaactgggcaaaagacatgcagagacactttcagaaagaagacatacatgcagctaacaagcatgtgaaaaacgctcattatcactaattattagagaaatgtgaataaaaatcacaatgagataccatcttacatcaatcagaatggttattattaaaaagtcaaaataacagatgcctgcatggttgcaaagaaaaggaacacttataccttgctggtgggaatgtaagttgattaagccattgtggaaagcagtttggagatttctcaaaaaacttaaaacagaactaccatttggttcaacaatcccattaattgagcacattcccaaagaaatataaatcattctaccataaaggcacatgcatgagtatgttcattgtagcactattcacaatatcaaagacatggaatcaatcaaaatgcccatcagtagtggactggataaagaaaatgcagcacttatgcagcatgtcatattacacagccataaaaacagaacaagattatgtcctttgcaacaacattgatgaatgtcattgttctaagtgaactaatgaaggaacagaaaaccaaacactgcatgttctcacttataagtaggagctaaactttgagtactcatggacacaaataagggattcagagacactgatgcctacttgagagtttagggtaaggattgaaaaactacttatcagctactataattattaccttgggtatgaaataatctgtacattgcacccccatgacacctaatttacttatataacaaacctgcatgtgtacctatgaacctaaaataattaaaaaaaatacatgctaagattaatccatatcagttatttccagaactgtcatttgaatgtggtagagatataattaatataattgaaagaatagttagaatgcctgggttcaaattatggctccatcacttgttagatatgcaattttgtgcagtttatctcatctccccaaacctcaatttcatcacatataaaatattttaagcgtaatatttcataggttgtacttcttgatctataatcagtttttacaaccttttgaatttgtttatgacataagtgaccatagcaccactattatccataccatgagttgttctacaaaaagtgcatagagaccattttcttctagaacagtgatttgactataatagattatcatgaacattttaagctttatctgatttgaagaatatttactttctcaaatattacttaatatttactggctcttggtcaggtggcatggattcacattttgattctatcattcactactgcataagtctgatagttttactcaaattataggtgattatagacaggtatctgatgatggatttttttcaaaaatttctgaacagtattgatagatgtggtatcaacggtacagtgaaacttgccatttctctttctcagagagtggagattaggcatcttaaaaagagaagagcatattgagaggtaaacagcataattactcttaacagtgagccagatattttgaatgctcagatgtataaagctgagtctcatccaactaaatatgaatggttgtctgccttagcagagtattttaatcacattcatcacctccagagtaatgctgattacaaggaactccattaaaataaaatgcatttgatattccaaatagttttcatgatagtatggctgaaatatgtacatttaaattatctttaatatagaaaacaaactgatctttctaacttccaagtcaatacacaacttaccatccccacttttagctataactcaaccctagaaaagtactgttagaaatcaaatataaagtaaaaatgagtgtattgggtttcatgttatttagtcaattatagggctaataggcctataagaatttaaattgcattgaaaacttgaagaaatatgacatgcagagattatcctagtagataaaattccttagatggtatgggatagtaatataaatttttagaattatttccatgtttcctactttaagttttacacctaccatacctggagaataggatatgtaggtatttgaagacttaaccacaggaaatgggggcgaggaagacatattttaatttattttttcaatacggtgtctcgctctgttgcccaggctgtagtgcagtggcgcgatctcggctcattgcaacgtccgcctcccaggttcaaacgatcctcgtgcctcaacctcctgagtagctgggactaccagtgcatgccaccatgcccggctattttttgtatttttactagagacgggtttcaccatgtgggccaagctggtctcacactcctgaccttagtgatcttcccaccttggcctcccaaagtgctgggattacaggcatgagccatggcgcccagccagaaagacacattttaaatcttagaaaataagatgcaggaaatcctgttgagaacatagaagcaatcttcatgatgttatacagacctacttctctaatataattctaatagggtttacacatgttaatagtaagagatgtggaacactgtagctgtacttggtatactcctagaggctgacctctataggtaataaatgaaactggaccatggactacttacctaagctacagaacctagagtaaattgaggtggtaggcttgcctgatcagccccaaagaagggtcagagaaattaagtaagactcaactgacaaaatttgttgcaaactccagggacagtaaagtttcttaggaaaaatgagtagtacatcatgcaacagtaacttagtactatagataccactgttcttgcccaggtccatataaaattgagaggaaaggagtctaaataaatcatattttgatatattttccattggaagtaacttgctggtatagaaacttgaaatttgaaacaactacttctgtccagtttgccatttgcaacagctaccaagactttattctcagaagttacaaaaataacaaatggagactaaataaatacacaaataataaaataattaaaatagtaaaaataaagcagcatgtagatttaagattcctgaaaatacacagcctatctgactttttgaagcctgcatttatttcaaaataatacaaggtctttcaccagtaccaaaactgttttgggacagtattctgtgattctcacttcatgaaaaactggctatttcatttcaacaaacacacattacatgtttaccagacataatgcttagggttgagtatacaaagataaaaaaaaccacatgctggctgtttcatcaaatacatagaaacctaaaagaataaagaaacccataaagagatcattttaagaaggggaataaaggacatgatataaactcagagcaggactgcttagccccaatcactagattggtcatcacttttgggatggcataatttctaacataatctttaaatgcaggtaatgagttaagtaagtaaataagtcagagtttatcatgttttagcaacaggaaaagcatgagaaaatatatgcaattataaaataacatgcatatgttgtaggaactatattctatataattgtaacataaacatcaagttatgcatattagtggaaaaggctgtagaagcaggccaagaccacgacacagaggacatgttgtatgccatatggataatcacaatagagccagagacttgctaaatagaagtggaataaggccagttttttcttgtggataaatcactatggcaacattgcggatggtgaatttcaagagtgcaagataaaaagcaaaaggtcatggctcatatttggtattatatttgcatcaagtaaaatagactaacccaagttggactgtgacaaatatgctgaatcttacagagttgaatattttttatccagatgataaaacatataatgtattgaatggcaaaaattccatctatgtagatatatagaaaatgaagaaaatttttgattagacattatattacatagatcggacattagatctgacattctattacagcagccatgtgaattttgcagttacatggttttactgtttctctttgttttctctctttatagtcaggattttacctgagtatctagattatttctcagcttttattttacttaatctatagtgttggcctcctcttaggcctaaactgaactatttcaaatatctgactcctaattgtgcaaccttaaggctgtcagaatcaccccaatgcaggccagaataacgtgtgtgtgtgtgtgtgtgtgtgcgcgcgcgtgcgtgtggtcatctttattcttggcatgcttaaatagattttcataactgttccctcagataacgagcaataatagctctaatgatctctgaaaaaaaggaaacaaaatatcagaagcaaacatttgttttcattattttctcagaggagttttacaatttttatcgcttgagttagacatcatgttgtaaagtgagtgccttagttttagggaagaataattcaagattgactatcaaaacctgaccgtggatatttgctttaaattcttaccaccactgattatcttctttcattccaaagaaaaagaagagaaaaccaaacaattcattactatatggaacttacacctccctctgataagaaatcagttgctcaagcactgaaacaagatctttgcaaatgcattctttttagtatttgaaacttaatcacatcgtatagaaacagaattttatacgtaagtaaagaatactatgatcggttccaagattctccacttattcttggattgattgaagagagaaggaaatacacctactccatacattattatacattaatgaagaaatacacatttccttcaaaagttatactgcacaatctatttaagcctcagttttattttctgtaaatgaatatgaggataataatatcaataacaattgtaataatatctacttccattgttgttgtgaggatcaaatgacagggggtctttagtatatgcctggcacaaggaaacaaggaaacacacaagtcttagcaattacaaataattcatatatatatatatatacatatatatatatatataaaatcactttaaaacaattctaatacatattaatgtatagttatgggagtaatgtgtgtgtgtgtgtatatatatattatttatgcaggacatatctaaaatatatatattcataaatatatgtgcaggacatatcttaatatgtatataaaataaggcttacattgaatgagtcaataaacacagaatgaaagattgctgaacttatggttttactttaaccagatttttaggaattttccactcatgcaattgactaggataatgtatatgaatgtgtatatgtgtgtaagtgttttttaacacctttatgtatatatatattacatatttatatgtaatatatgtaataaatatgtactagacatgtaataaatatgtatatattacatatttagatgtgtcctgcatatatacttaaataaaaatataaatctgcatctatatacacatttaaatgtgtcctgcataaatgtagcaattcacaatgctactgacgtgatcctaccaagcaaacgtttgagtaatccttcttcctctaattgtattcattcagatcaatgcaatcagtcccactcaagtggacgatcatgcaatgattctttacaaaattggtaaatgaaacatcagttttcctagtgacaaaagcttgtatctaagggttttacaaacactgagaaatcaataaatagtgctggaaaagtattgtgaaggatattgttagtttcaaaattaatcatatttagtttaatattgtttaataatactgattagatttttactgtaggttaaatttctgagcgaagcatttctctctcaagactatgttgcccaccacacagttttagaatagcagtatattatgttattattagcctatttattttctactggctgctgcagaaaataaacacctctataatgaccacagtctagatttcagcctgtgtcaaaaggattttgaattatacttcatttttagcttttgctcccaccctttgcacaaagtagaagagacagaacagaaatgttttcctaattgctgttgcaagaaatacttcatctagaaaaaaatgaggaattaatttattttagcaggaaaaaatgaacaataaaaaatacatagagtgaaaagttgtagtcttctaatacctcttttttacttgatgactcaactttttgggaggtttctgggtctaccacctaattatttttactcaaattttattcctggaaggaagatggccatatgcagtaatttatggttcaaaccagaatacttttgagggtgagagcggtattgttaataataatgcagcaggcataaaccggattgctttgggaaaaccagtatatatgatcacctgtatataagggactacaatttcagtacttgacagcatggcaacactctatttagcaatgttttaggtttatttaatggtcacttcccttgccatgtggtaattacatctgctaaaagggtaagaggctgcttgctgtcacaactcaggctattcacatacttaatagacctgaacaaatactcagaagagtttcattgaatagctgtgtgtaccattgagataatctatcatttaacgtttcaaacaaaaatgatatctttcctctgatacttcaagtcattgcaacatatcagtaaaacagcattaaggaagtgttgataacatatcttttgaatgctgataatgtgactaggtctagtgacatctttcatatatttaatctgacaaacatgaacatacaacacttgaaaataagaggacttcttgatttatagggagtatattgtcactatgagttttttcatgccatagatatccattcctagggcaaaacaataaggacaacgtacaaaatcaaatctgctcatgtatcacatggatgaaaactaaggaatcatagaattctgagtaggtatagaccttaaagttcattctattttccaacattttattaaaaataatcacctttataatatccataatttatgagtatatttttctgactataaatgtccaaaaatgtcgataaattcctcaaaagaaagcccagttgaaaatatacaggagtttattcattcaaccttaatttgaaaaactaataaaagttattatttttttaaaccttacttctaatgtcttgaacaatgctgtagagtttactcagattttaaaattataatccttaagtagtgggactaagcaaacctgtattaaaccattttgcaatgtataatatcttctatttctataattatcatggattaacttccagatatgtcataagtaattgtattgagatttgtataatgtttaattgcttctgagttttctgcctttgattatacaaatgaatattacacatccttaaattctgaaatacttacaggtatttctcgtatatacgtagtagtgtaatttgttccctgaggcactcctaaatttgaatgtaaagagtatagaaattactttttccctttacaaggtacaatttaattatcaattcttttcctttacttaatcttcaaagtttcaaaaagggagagacaaagaaaatctattgtcagtagaaaaatgaatatttaaaaaagcagaaaacatcattgggtagttaggctaaaagaaataatctgttctccaagttcaaacaaagcatttcgaaattcattgttttaagcattaatttatattgctaaattttaaaagagatttaaaaaatcataacagctaagacacaacaagcagtagaagagacatatgaagaaatactacactgatggaagagacaatgatgaaaagaacatgtcatttgaagcaggattgtgataaggagagttttgaaaaagtttgagtgctatagaaaatgtctcatatttatagcagaggttagaaagaactcagatgtcaatgcaaataatggaattataggttgatgggtgcaccctgttctccagctggaaaaagtgtagttggggctttgggtgtacaaaactaagggggcagtaatttagttcatatagccacggaaaataacattctaaactagaattggaggctacatttagcaccccctaagatgatgagaagagctaaccaactgggttgaagattggtaccagtttaaactgaaacactagaaagaattaatcatcttatgagttatagcaagattcatgtcctaaattttaattatcataataattttaaacagatggatagtttggataaactttgaacttcactatgcagtaaaacagattttagtattccatgttttaaatagacctgtaagagatgtatgatagaaaacgttggcacagatgaaaattacgaagatagcttttaatttctacctcaaatttttaaaagattatctctttatgccataggtaatgggcatcataaatcactagctgcaaaagcaggtaagtgtgaacattccttcaatgccttggcataaatctagaacagttatttctttagactttatttcatagaattcattcaatttggcatgtgttcatagatgtggctgtttgtaactgaatgaagttaaaacacacacacacacacatacacacacacatacacacacagggcctgatttcaagtttttttacatttaatagtccacattaaagaaaatattcttcaacaaaattaaatttcaaaactccttacatgagtcattgtacaacttaatactgtgaacagacgcacgagaggaatatatttaggtaaataaaacttgtacaggttggagaacaatattctacctttcatagtagcaccgtagtgttgttcaaattgcagctttatgctaattagtgttgttctggctttttaaaacgtttaagaagtaacagtttaaataaattccgaattgattaagtagtcagtattccacagatcatggaagattttagaattctggatatatttccattcatctgtataatcagtgtctgggcaaataatcaatatgtctaaaatcttcatgacgaaacacttaaatatttcctgacaaagctctaagaacattttaatatatctggccatatgcctgtaaggttgtattacattttacaggtatcttatttatttaaaatttgaaaattgcgttttctaaatttactgaatttctttccctagacctgaaaaggcaaaacatgttttatcaaaaaggttaaatcctttcaccacaaactccattttgacttttcccttgataaacattgaagtaatattttattttgctttcacagaagaaccaaatggctcacattaattctgtgtcttatgtttatcaatgaaccaatagattgtgatgaacagaatcaaggctttgaagttgaaagtgtctctgactgatgctacttcacctctgtgagactcagttttcacatcagaaacactggccacgtagcagcccctttattcttcggttatattttctttcacaacttcacagttatacaggacttagaaagaacaatgtcagacagactaaagtgggacactgaactgtaatcagagaaggagatctctttttgagaaaggtgtcagatatcctgtgaagtgaactgtctatcgcaaacatcactggtgtctctaaacagctccaccagtcgcaactaaaagttagcctttttcagcagtgtagagatgagaagagagactgataggtaatatgaaataatagaacttacagcacgtattcagattgtatttgtgtccagtcgcaatgtataggttcatacatgtaaacttcaaacacatatgtacagtttaagcttcactctttatcctcattaggattcaacaaaactgttttgtaaaaaggccttaaacattcaattaatagcagtataatctaattccaatataggaatcataactttcaaaaagatccatttgattcaatttttctaaagtacataataaaagtcatcttataggcttcttacatatcttaggatatcttttagagtcatagtgaattggcttcattaactggtcttgaggtttgggaagttaagttcttcaagcccatggctaatagatttaacattcaagaccatccatttgatatattttcaaacttcacaggactcctgtttttattcccaaactataaccttttgaggtcaaaaataaaactttttaaatcttcatgtattctattcacttaatgttataatttttataacttctatctttgtggtataaacaaatatattcaagtgtgaaaaattttaacatcatgttgtgtggtaaatttatttacattcagttttggggtagaaagtgtattcttaaaaagtttaaaaccaactgttttcatgattaagctaatagaaattattaagcacatatttgtttgccaagagaaatattgagattgctgatactcatttttttttctccaagagtaaactatagtgagttccacaaatgcagtaaatatatctgttttagttcaccactatatttcaagtgcaatgctcggtttagacttaaaataattttccttatgcaaggtaactgactatatagaaattatttgaatagagtttgatttttctatccattaagaaattaccaatatggaaaataaatttccttaagggaaggtggaggcataggcagattgattctgctcaccctccatcttattcccccaagtgtagattggtcttgttaaatcgcccatgcacttgttgcagaaacagtcaaaatggcgggttagaggctgttagcatgcctcagccactcggaaatagcaaaacagtgcataaagattgacactgtgagctttaattcacgaaggaaagtgggaattcaccagaataacaaaggacactccagatccaagggagaagatagtgggcaagccaccccctgatggcgtttggctggtaaaacgatatgggtgcagtggaacattttctttcatggccagacatatctccaggcttttgatgcaccatatctcctgggataggagcttcagttgccattcttttcccacacagacaatttagtacagcagcactccctccacgtcacactcagacatacctccagtcatttggcacacacacgtccacagattagtagtttgagccattcatcccttcccatgcaaagaccttattacagcagcagtttctctgcttttggccagggtatatttgcaggcatttgacacacacattctcttggcttaggaatctgtgctgcccctcccttcaggtgcagagattgtggtacattggtgctctctcttcttgatgcccagacatatctctggaatttggagcactcactcttctaggttatgatttaggccacctcactcttcccatgcagagaacctgaggcagcagaagtttctagaattcatgcctaggcacatctcctggttctcacaggctgcccactgggacccttttcaaagctgatgcatgtgcatgccattgggaaacctgtgggtgggcctgctcagtctggtcccacacatcttggatctttcctaaggaggaaggtgataccactgtgcattccacagatcaacccatggtctgaggcaacagagagcttctcccattaaaaaaggattaggtatatacccacctattttgaccacaggtggctcatacccataagtgacacctactggcctagagtttgaaatgcaaaacacaatagaaaatgatattgattcttcctatccatgagcatggaatgttcttccatttgtttgtatcctctttaatttcattgagcagtggtttgtagttctccttgaagaggtccttcgcgtcccttgtaaggtggattcctagctattttattctctttgaagcaattgtgaatgggagttcactcatgatttggctctctgtttgtctgttattgatatataagaatgcttgtgatttttgtacattgattttgtatcctgagactttgctgaagttgcttatcagcttaaggagattttgggctgagtgaaaatggccataccacccaaggtaaatcatagattcaatgccatccccatcaagctaccaatgactttcttcacagaactggaaaaaactactttaaagttcatatggaaccaaaaaagagcccgcatcaccaagtcaatcctaagccaaaagaacaaagctggaggcatcacgctacctgacttcaaactatactacaaggctacagtaaccaaaacagcatggtactggtaccaaaacagagatataaatcaatggaacagaacagagccctcagaaataaggccgcatatctacaactatctgatctttgacaaacctgagaagaacaagcaatggggaaaggattccctatttaaaaaatggtgctgggaaaactggctagctatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttcccaaaagaagatatttatgcagccaaaaaacgcatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggaccataaatcatgctgctataaagacacatgcacacgtatgtttactgcggcactattcataatagcgaagacttggaaccaacccaaatgtccaacaatgataaactggattaagaaaatgtggcacatatacaccatggaatactatgcagccataaaaaatgatgagttcatgtcctttgtagggacacggatgaaattggaaatcatcattctcagtaaaatatcacaaggacaaaaaaccaaacaccgcacagtctcactcatagatgggaattgaacaatgggaacacgtggacacaggagggtgaacatcacactctggggactgttgtggggtgcggggagaggggagggatagcattgggagatatacctaatgctaggtgacgagttagtgggtgcagcgcaccagcatgtcacatgtatacataggtaactaacctgcacattgtgcacatgtaccctaaaacttgaagtataataataataataataaaaagaaaatgagctgacacaagtcaacagacaagtcaacagcagtggggaatgagataggcttcctgagatctccatgattccagtccaataggaagcattgagcctgctcacatgcacagtgcattgctactaaaaataacattcaggaaagccatcatacaaaggctatatgtaaccaaagaacttatacagactctttagccctgaaagcacccagaaccaaagccagaaggaccctacaaatcatacattatagacacctcctgaaggagaaaaattccatccaaattaaaacaaattcaaaaaataaggagagatagcttatctagatgataaagaaccagagaaacaactatgaaagtatgaaaaacagagtgccacaacacttcgaaagatcacactgattcttttttttttttttttttttcttttgagatgaagtctcactctgttgcccaagctggaatgcagtggtacaatctcggctcactgcaacctccacctcctgggttcaagcaattcgattctcctgcctcagcctcccaagtagctggcactacaggcatgcaccaccatgtccagctaatttttgtatttttagtagagacggggtttcactatgttggccaggctggtcttgaactcctgacgtcctgatccacccgcctcagtctcccaaagtgctaggattacaggcatgagccactgcacccggtccacactgattctttaccaatgaatctaaactaaatgaaatctttgaaataccccatgaaaaattaaaaatattgattttaaagaagctcaatgaaatccaagacaaagctgaaaaaaacacaaagaaatcagaagaacaattcagaatattaaaaaagggtagatatcattaaaaaacaaacagaatttctagaaataaaaaattcattaaaataattacaaaatacagttgaaagttttaacagtaggctataccaactggaagaaataacttcagagctggaagacagatcttttcaattaatccagtaagataaaaattaacaaagagtttttttaaaaacttaacaaagcctttgagaaacataggattatgtagtgtccaaacctacaaactgtaagtattccagaggaagatgaagaaaaagtaaaatgtaaggaaaatgaagaaataattcagcaaaactcccatgggattgtcttttttgtgcaaatggtagctatttttattatttccttttttttttaaattttactttaagttctgggatacgagtgcagaatgtgtaggtggttacacagatatatgtgtgccatggtgatttgctgcacttatcaacctgttatctaggttttaagccccacatgcattagctatttgtcctaatgctctccctcacctcagccgccaccccccgactggccccggtgtgtttttttccccttcgtgtgtccatgtgttctcattgttcaattcccacttatgagtgagaatatccagtgtttggttttttgttcctttgttagtttgctgaggatgatggcttccagcatcatccatgttcctccaaatgacatgatctcattctttttatggctgcatagtattccatggtgtgtatgtaccatattttctttatccagtctactattgatgggtatttgggttggttccatgtctttgatattgtaaatagtgtaaatcaaaaccacaatgagataccatctcacaccagtcagagtgatgattattaacaagtcaagaaacaatagatgctggtgaggctgtggagaaataggaaagcttttacactcttggtgggtatgtaaattagttcaaccattgtggaagatagtatggtgattattcaaggatatagaaccagaaatgccatttgaccaagtaatcccattactgggtatatacccaaaggaatataaatcattccactataaagatacatgcacaagcatgtttattgcagcacttggattgtcttgggagaaatttggacatctagatacaaaaggctcagagaattcctagtagataaattggaaaagcctcactaatgcatatagtcatcagaattttcaaagtcaaagtggaaaaaaaaatcctaaaatcagcaagagagaagcatctaatcacctataaagaaaatcgcatcaaactaacaaaagacttttcagcagaaaatctacaagccaaaagagattggaagactatttttagtctcttccaaaaaaaaataccagctaacaattttatatcctgccaaatgaagattcacaaatgaagatgaaatagtctttccaagacaaacgaaaggaattcattactaccagatcaccttacaagaaactttcagtacaactttcttcacaacaaagtttcaatgcaacaaggtttaactatctatcctaaatatatgtgcatccaacaccagaacactctgattcataaaacaaatactactggtcctatgaatagagatagacagttatacaataatagtggaggacttcaacaccctattgacaccactagactgatcactgaagcagaaaatcagcaaagaaacttaacttaaactggactatagaccaagtagacataataggtatttacattacatttcatcctaaaccacagaaaatacattattttatctttggatagagcattctcctaaaccgaccatatgcttagccatccagcaagtctccataattttttaacaataaatcatatcaagtatcttcttggatcacagtggaataaaattagaaattaataccaagagtaattctcaaaactacacaagtaaatggactaaacaacttgcttctgaatgacatttgtgtaagcaacaaaattaaggcagaaatcaggaaagtttttgaagcaattgaaaatacagacacaatatttcaaaagctctgggatacaacaaagaaaagtactaaaggcaaagtttatagtgttaaatgtctacatcaaaaagaatgatctcaaagtaacatccaaattttgcacctcaagcaactagaaaaaggacaaaccagacccaaatctagcagaagaaaaaaaataacaaagattatagtaaaactaaatgagatcaagaccaaataaataacaaaaaggaccaattaacagctagttctttgaaaggataaacaaaattgacagactgctagttaaattaaccaaggaaagaaagagattcaaagaagtacaatgagaagtggtaaaagtgacattaaaactgatactacagaaatacaaaagattataagagactactatgaacacctttatgtgcataatctagaaagcttagagaaaatgcatttctagaaaaacagacaacttcccaagattgaagtaggataaaacagaaatcctaaatagacccataatgactaacaaagttgaatcatcaacaaacatctaccaacaacaaaaagtccaagaacagaaagattcaaagccaaatttcatgagatatacaaagaagagccaatactcattttactgacactatttcaagccatcaaggaggaaagactcctccttctctcttttaacaaaagtggtatcatcttgataacaaaatcgagcgaggcgacaatgtaaaagaaagctactggccaatatccttgatgtgcctaatgcaaaaatcttcaacaaaatactagcaaaccaaatccaacagcacatcaaatatacaatacaccatgatccagtgggtttatccaaatgatgtaaggatggttcaacatacggtaatcaataaatacggtttaccacataaagagaactaaaatagaaaaaacatatgattatctcaagagatgcagaaaattcatctgataaaatcaacacccctttatgatgaaaaccctcaacaaattaaacattgagaaacatacctcaatataataagagccatgtatgacaagtcaacaaccaaaattatgctgaataagggaaagttgaaaacaatctccataagaactggaacaagacaggatgtcaactcttattcttattcaacatagtagtggaagtcacttgtaatgtcatttttaccatttatcattattcttctgggaatttctcttatctcttggttaatttaactagcagtcaattctgtttatccactcaaataactaattgcttgtttagttgatcctttgtgttgtttatttggtcttgatcttatatagttctgctatgatctttgcctgatctttcttcaggcaaaataaagaaaaggcattgcaattgggaccaaaaaaaaaaaaaaatgtcaaattatctctgttaaatgatggcataattgtgtatcagaaaaccctaatgactcccccagaagacctctccacttgataaatgacttcagtaaaatttgaagacacaaaatctgtgtacaaaaatcagtagcatttctatacaccaataacattcaagctgagaaccaaatcaagaatcaatctcatttaaaatagctgcaaaaaataaaataaaatacctagagatacaattaagcaaaatagttaaatatctgtacaagaagaatgacaaacactgatgaaagaaattatacatgacaaaaacaaatggaaaaccatcctatgctcatggattggaagaatcaacatcattaaagtaaacatactgcacaaatcaatctacagattcaatgcaatgcctatcaatttagcaatgttatttcttacataattataaaaaaaaaatcttaatgtttagatggaagcaaaatagatcccaaatagccaaagcaatcctaagcaaaaaggacgaatctagaggaatcacattgtgtgatttcaaattatataatactataagtctatagtaattaagatagcatgctactagtacaaaaatggagacatagatcaatggaacagaaaagataactcagaattaaagcacacacttacaatcagtcgatcttcaaaatgttaacaaaagtaaatagggaggaaagatgctctattcaataaatgatgctgggaaaattggctagccacgtgcagaataatgaaactggaaccatatctctcactgtgtacaaaaatcaagtcaaagtggattaaagacttaaacataagaccagaaactataaaatcctacaagaaaacctagaaaaatctcttctggacatttgccttagcaaataatttataatgatgaccctgaaagtaaatgcaacaaaaacaaaatagacaaatgggtcttaattaaactaaacagcttttgcacaacaaaataaataattaacagattaaacagataacctaaacaatgggagaaaatattttcaaatcatgcttctgacagaagactaatatccagaatctacaagaaactcgaacaactcaacaagaaaaaaaataattccactgaagagtgggcaaaaacacggacatttcttaaaagaagaaatacatacagccaacaaacacataaaaaattgctaaacatcagtaatcatcagagaaatgcaagttaaaatcacaatgagatataatctcacccagtcagaatggttaatattaaaagtcaaaaaacaagagatgttggtgtggatgtcaagaaacggcaattgtttatacactgttggtgagaatgttaatcagttcatcttctattaaaaacagtatgtagatttctcaaagaagtaaaagtagaactaccgttcaacccagcaatctcatccctgagtatctacacaaaggtaaagaaatcactgtaggaaaaaggcatctgcatttgtatgttcaacacaatactactcataataggaaagtaatggaatcaacctaagtgtccaacagcagttgactgaataaggaaaatgtggtgtatacatcatgacaaactgtgcagccattaaaaagaataaaattatgtcctttacagcaacttggatggaactagaggtcattatcctaagtgaactcagaaaataaaatattccatgttctcattcataagtggaaactaaacaagaggtacatatagatgcaaagatggaaataacacacctcagagactcaaaaatgagcgagggtagaaaaagtttgagggttgaaaattacctattggttacaaagctcactatttggctaatggatagagtagaagcccagtccctaaccaatatacaatataattatgtaacaaatatgcatatatacccccgaatctaaaataaaattaaaattaaaaaaagaaattaatattagctgtagagagtagtatatcttcactgaaaagttatatgttaattttgtatggtgcaccagaatatataaaagtatatttacagtacataaaaattgtaacaaaatatatatttccttttaaaatggtttctggaataaacgactcaacagaaaagcaagactaaaggtaaacaagaaagctatatacatataggtttcttatatatgtgtgttagtatacatatatacatatatataattttagattcaggtggcacatatacatatttgttacattattatattgcatagtggtggggattgggcttctactctacccattagccaaatagtacatatatatatagatatagatatagatatagatatataaatagatacacacatgcacacctatgcacacatacatacatatatttaaaaacacagctaatgtataccttacatatatattacatacacatatattttaaaagcatgttcccattagtccgaaacacagaaatggattttatgaatttgtatgccagaataagacatcacattgagttgtagaatattccaacactgtgggttcatgagccattctgaaaaataaattacaccaataatggattccaatactttaaccatttcttgcgaaattttctatatattaatattactaatttgtaaaaatatttacattatagtcacagacactaaaaaccttaaaatcattgaagaaaatgtccattttcttagtaaatgaatgaatatttaaattatacagtaatgagcgaaatttagtaatgaactgaagtttaattcaaaattacaaattagcagcttagatcaggcatgattcctcatgccagtaatcccagcaatttgggagaccaaggtggaaggatcacttgaactcagaagtctgagacgagtctgtgcaacacagtaagacctcatctctacaattgtttatgtttatataaatataattatatatataattatatatatatataattggaaactcatttctctgattaaacaaaggaatgtaattaataaaacactgcaacctcattattcataaagaaatagtctacaatttgtatttcactctaagcaactcatttaggagcttgaaaattttatttttacagttttttaaagcacaaaatgagcacattcaagctaaaactgataaaatgggaataataccatccatgtgagtggctgagcctagtaataatttgcagtaaatattatcacaaaaagttggaactggaattcttgggaaactgttttctgctgaataatttcaagttggaattcagttctggtaaaaaaaaattactgctgatatgcactaacttgattgtcacaggttagcatgtaaatgaagaaagatttaagcaggtacctgtctaaattaatgtaggcagctgttacaagtacatgcattcaaacctcagggcatagctctgcctctctaaaaaggacttgcccaagatcagaatatagaataagagctttacattttatctttatttaaattctccctcccctttttgtggaattgtgagtgagcagcaatactacatgccttttataaccctttctaaaaatatattgaccacagttttactaacagttagaaaattggagtatgatctcaaatatacttaatgaagacacacattccacagaaaaaaattagtttaaatttagtttcctaagaaaataattattattatagagaaactattttgaaaaaggagataagaatttaaaatatttgtaaaataataaagttgattctccagtcatacctcaaaatcagtttcatctttagcacatttctacccatcaggggtgtgtgtgtgtgtgtgtgtgtgtgtgtgtgtgtgtgtgtgtgtatttgaattgacagtgaatagctataaaataaagtggtatgaaacaggaccgaaaatgctagagaaagagaatgatgagagggcacaggtcaaataataaaatgagagatatggaattcagaacttggttttcaatgaagatcatcgagattcacaacaaagtataaatgcaatccaagtaatctaaggaatctagcaaaatgacataagagctgaaagacaaaatattcatttataaaaggaacaaactgatctgatgaagctaaaaagctgactacaaaaattttgaaaaacaatcaaaagcactacacagcagaataggccaagctgaagaaaatctcagagctctaagactggttcttcaggtcaactcattcggattaaaaagaagaaaaaaaaaacagagtaaacaaaataaacaaaatctctgagaaatatgggattatgtaatgagaccaaacctgaaattaatttgcatctctgaaagaaagagagagattgcaagaaacttggaaaatatttttgtgggtattaacattaaccatggaaatgtctccaatattgctagagaggttgacatgaaaactcaggaaagacatttgagaactatactcaaacacttgactagatgagcctaacagatatctatagatttctccaacaaaaaacagcagaatatacattcttcttacctgcacatggtacactaaaatcaaccagatgattttccatgaagcaattctcaacaaattaaaaaaaacacatgcacacaaaatcatatcaaccacattgagaccacagcacaataaaaatagaaatcaatacacgggagatctctcaaaactataccattacatagaaatgaaacaatctgttcttgaatcacttttgggtaaacaatgaaattaaagcagaaaacaagaaattatttgaaactaatgaaacaaagatacaacataccagactctgggacacagctaaagcagtgttaagaggaaagtttctagcactaactgcccacatcaaaaagacagatttcacactaacaacctaacaccacactgacaggaactagaataacaagagcaaaccaatcccatagatagaagaagacaagaaataaccaaaatcagacctgaactgaacaaaactgagatgcatcaaaccatactgaagaccaacaaaaatatgttggttctttgaaacaataagattaatagactggtagctagactagaaaacatgacagaagatccaactaaatacaatgagacgtgacaaaggggatattaccactgatttcaaagaaataaaacaaaccctcagagaatctggtgcagatttctagtcacataaactagaaaaccttgaaggaataaataagttcctggaatcacacaacctcctaagattgaaccagaaagaaattgcaaccctgaatacagcattaatgagttacaaaattgaattagcagtaacaaaccaaccaaccagaataagccctataccagatatatttacagctgaattctacaaagtggcttaacaaaatctggtaccaatcctactgaaactattccaaaaaactgaggagggacttctccctaacttactctatgaggccagcattattctgataccaaaacctggcagaaacatgaaggtaaaagagaacttcaggctaattactgtggtgaatgtagatgcaaaaatcctcaacaaaatactagcaaactgaatccagcagcatatcaaaaagttaatcaaccaaaattatgaaggctttattcctgggatgcaaggttagttccacatttgcaacacaataaaatgattcagcgatccatcgtataaacagaactataaaccaaaccacgtgattatctcaatagacacagaaaagacttttgataaaattcagtgtccctttatggtacacatcctgaacaaagaagacatcattttgaatatacctcaaaatataatagccttctattgactgacccacagagaacatcatactgaatcggcacatgctggaagaattcttcttgagaactggaacaagacaaggatgcccagtttcaccaatcctgttcaacatgatattggaagtcctaaacagaggcataatgcaagaggaagaaataaaatgcatccaaatagagaggtattcaaactatctctgtagacaatgggattctatgcctagaaaaccccatagtccctgcccaaacactcctagaattgataacgtcagcaaagtttcaggatacaaaattaatgcacaaaaattgtagcatttctatacatcaatagtgtccaaggtgagagccaatcaagagcacaattgcattcataatagctgcaaataaataaaatacctagaaaaacagctaactagggaggtgaaaatatttacaattagaattataaaacactgctgaaagaaatcagaaatgaaacaaacaaatggaaatacataccatgctcatggataacaagaatcattatagtaaaaagggcatactgtccaaagctactacaaattcaatgctattccattcaaactaccaatgtcatttttcacataattacaaaaaactattcaaaatttacatgaaaccaaaaagagcctgaatagccaaagcaatcctaaacaaaaacaacaaagttgaaagcatcacactacctgactttaaattatacgacaaggcaataataaccagaacagcatgatactggtacaaaaagaaacatataaatcaatggaacaggttaaagaacacagaaataaagctacacatttataaccatctaatctgggacaaagtcaactaaaacaaccaatgggaaacaactccctattcaataaatgaagctgcagcaactggctagccctatgcagaagactgacactggatcctttcctttcaccacatataaaaatggatttaagacttaaatgaaaaacttaaaactatgaaaattcttgaagaaaatctagaaaatactagacattgtccctggcaaggattttatgactacgactacaaaagcaattgcaataaaaacaaaaattgacaagtgggacctaattataccaaatggcttctgcacagcaaaagaaactatcaacagtgtaaatagagaacctacaaaatgggataaaatatttgtaaactagacttctaacaatggtctaatatccagaacctataaggaattcaaacaattgaacaaccataaaacaaacaaccccattagaaaataagcaaaagaaatgaacagacatttctcaaaagaagacatatatgcagtaaacaacctataaaaacattctcatcatcaataataagagaaatgcatatcaaaaccacaatgagatagtatcttacaacgctcagaatgactattattaaaaagtcaaaaacaaagatcctggcaaggttgcagagaaaagggaatgcttaaacaccgctggtaggagtgcaaatttgttcggccactgtggaaatcagtttggagatttgtcaaagaacttaaaatagaacaatcattcaacccagcaatcttattcctgggtatatatccaaaggaatataaatcattctaccatgaagacacatgcatgcatatgttcactgcagcactacttatagtaacgaagacatggaatcaacctaaatgattatcaatagtggactggataaagaaaatgtcatacatatataccatggaatactacacagccttaaataagaatgaaatcatgtacttttcagcaacgtggatggaactggaggctattatcttcaacaaattaatgcagaaacagaaaaccaaatgccatatattctcacctatacatgggagctaaacattgagtacacatggatacagacaaaggaacaatagacacagggcctacctgagggtagagggtgggagttgaggatcaaaaagctacctattgagtactatgctcattacccaagtgatgaaataatctgtacaccaagcccccatggcatgcaatttaccttgtagaaaacatgcacatgtaccccaaacttaaaataaaagttggaaagaacaaatcataagaaagtaatcaaagtagaacccagatataaatccatgcattcacagccaactattttttgaaaaaggcaccaagaacaggaaatggggaaatgagattttcttcaataaatgatgctgagaaaactggataaccatatgtaaaagaatgaaaatggactcctatttctcaccatatacaaaaatcaaataaaaataaagacttaaatttaaacctgaaactatgaaactattagaagaaaatattgaaaaaatacttaacgacactggtctatgtaaagagttttctttgtgtgtgtaatatctcaaaagcacaggcaaccaaagcaaaatatagacatatgaaattacattaggctaaaaaccttctgcacagaaaagaaaacaatctagaaagtaaagagacagccagagaatggaagaaaatatttgcaaactatccacctggcaagagattaacaaccagaatatataaggagctcaagcaactcaatggcaaaaatagatgaaattaaaaatgggtagaagatctgaaaagacatttttctaaagagacatacaaatggcccacagttgtatgttgaacaatgaaaaattgttcaacatcactagtcttcagtgaaatacaactcaaaagtgcaatgagctattatcttaccatagcttaaattgattttatcaagaagacaaggaataacagatgctggcaaagacgtgaagaaaggagaactttgtacaccgttggtaggaatgcaaattagtgcaaccactatgaaaaaaagtatgacagtttctcaaaaaaattaaaaataaaactactatatgatccagcatttccactattaggtatacattcacaaaaaggcagtatattgaagagatatcttcactcccatgtttattgcagcactatttgctatacccaaattatggaatcaaccaaagtgcccatcaatgaataaagaaaatgtgagatagatatatatatatatatatacacacacacacacacacacacacacacacatatatatatagttgaatattgttaagtcatacaagagaatgaaatcctgtcatttgtagcaacatgatggaacaggaggtcattataagtgaaattagccaggcacagaaagacaaattgcatgttctcactcatatgtgggaactgaacaagtgactatcatgaagataggaatttgattattgggtaccagtggccaggaaaggtagatgggaagggagggtgaagagagtttgaataataggcacaaatatacagtttgagagaagaaataatatctagtgtttgatagatcaatagggtgattatagtttgcaatgattgatagtatatttcaaaatactaagaataatttgaatgtttctagcataaacaataaatatttaatggatatctcaattacactgatttgatatttacaaattatatacatatatgacattatcacatgtaacctgaaaatatgtacatctattatgaatcaatgcaaaaattggaaaaaaaaattaaaaataaaaataaatataccaacaatgctgtgaataaaggtaatcaaagcagcacagtagaatacagagagcatggaatgagaagcagacaaacttaaattcaaattcatattaggagacttctagctaaatgatcgggggcatatcacattaataaaaattattaacctccagagagccagagccagagacagagcaagtcagacacagagaatgaaaaaacatccaaactaccaatatccttatgaaagacgggacatcactatagaacttaaaaataacaaaaatataataaggaaatactgtaacaactctacatttgcaaattcaccaacaaatataaaatggaccagtttccttgaaagacacaagactcactcaagaaaataatggataacctaagacatgtcatatatttagtcaagcaattagatttagacttaaaaattcttccaacaaagaaaaattttgtctggatggactcactggggaattccactaaatgctgaagaaggaattttaacaattctgaacaatcccttccaaaaaatagaagaggaagtaacaactctcacctgattttacaagggagcattgtcctgatactaaagtcagacaaaaacatgatcaagtaaaacaatgaactaatctctctcatgagcatagatgcagaatttcttaacaaattattaacaaattgaatatggcaatatatacaaaacatactacatcacagtcaggtggagcagattccagtaatgagagcctgtttcaacatcagaaattgagtctacataattcttaatattatcagaataaaaagaaaaatcaatagattcagaagaaaagcatttgataaaattcaagatttgtttatgatatacactttcagtaaactataagtacttccttaacctgatagagtttgtctacgaaaacgtacagctaacattataatggcgaaagactgacaaagcaagtatatctcttcctcatcactactatagaacattgttttggaacctagacagtaaaataagacaaagaaaattaataaaatcctccagattggaaagaaagctctctctattaaaaagagaacatgattatctatgtagaaaatatctgaaatctcaaaaatgaaaagaaaataaactttcaagaatagcaaaagaatttagtaagtcacaggatacaaaaatcaactgcatctctgaatgttaacaatgaacatctttaagtcaaaaactgtaaccataccatgtacaatatcataaaacaattagatatttaggttaaattctaacaaagtatatgcatgatctatattcagaaaaatacaaaacacaaaagaaatgaaagaaggcctaagtgatgggtatacatattctgtgttcatgtatttgatgacttattaatgagataaattattcccaaattgattctatacatttccaattgaattcttagcaggatatttttagataccaaaaaactgattataagtttacatagaaaaggaaaataattataatatccaaaacattttgaaaaagaatttatttcaagatctcccactacctgatattcaaacttttttaaagttatagtaatcaggacagtattttattggcaaatgggtagatacacatatgaaaggaataaaataaatagaatataaatagaaccacacaaatgtttattttctgacaaagttgctttaaagacaataataaaaagacttaattttaaataaatagtgccagaaaaattagacctccaaacgtaaaaacaaaaatggaccttcacctgtacttcacattttttatcaaaatcaacagtaaaggatatagatataatatagaatgtaaaatgttaaaactttacaaaaaaaaacaaagaaaatttggaacataagtttaagcagccattttatagaaagaatatcaagagaaaaaacattattaattggactttaacacacttaaaaaaatgctctgccaaaaaacatatttaaaaagtgaaaagactagtcaaagattagaaaaaatatgtatttgtcaatcccctatctgacaaactgtatgcattcaacacagagaaagagcaattatgacacgataataaggaaaatatgtgggcaaagttcagtacaggcactttaccaaagaagaaatatggactgcaactaagcaaatgagaagatgctcaacaacagtcattaggggcatgcaaattgaaaccacattataatatttttttaaaggctaagattacaaagaaaacaaaaccttgttacactaaataccagtgaggaagtagagcaattgacacactcatgcattgctggtgaaaatgcaagataagacaacaactttggaaaatagtctgccagtttttaaaaagtgatcatttaactaccaaatgaccttgcatcaccacccctaggtatttacccaaaacagattaaaacttatgatcactcagaaatctatgcaaatggctatattgcccttattcataatggtgaaaaatggtaagcaatcgaaatgcctttcagctaataaaaagaaaaatgagctctggtaatccatacaacagagtactattgagtggtaaaaaaagaacgaaccaactattgatacctacaatccatgtggatgagtatcaaatggatatcctaactgaaaaaagtcagattcaaagggtcatgcatgatttaatttacatgacattcagtaaaaagcaaaactataagaaagagaaaattttgctacaaagcagcagcatggaagtttctttggggtaatgaaactatttcagtatctttattgtgatggtggttacaagactacatgtttgtcaaatataatatttcataccctaaagtgtgaattttactatataaaattcagttaaaatcattaaactatacatttcaacttattatatgaaaactaaatcataatacaactgacttttaaaaaacatctggtatattaaccactttattatactatccctttatagaaattctcatgttaaatctatatattttatgcatagaaaaatctacaagaaaagatagtctcaaaagtatatttgtccatgaggattttgcttttgaccaatttggttaattctactattttattatttgagtgtcttgaaaaatattctgtgtattttctgtgtcagtcagaatgattgccattctaactggtgtgagatgatatctcatagtggttttgatttgcatttctctgatggccagtgatgatgagcactttttcatgtgttttacactgttggtgggactgtaaactagttcaaccattgtggaagtcagtgtggcgattcctcagggatctagaactagaaataccatttgacccagccatctcattactgggtatatacccaaaggactataaatcatgctactataaagacacacgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaaaaaagaaatatactttctgaatgtcaagatctcgactttctttccttaggtcaaactgcattttagagttatccctcttgagcacttagaagctgcaataatcctggcaattggcaaactggagactgaatctaactctgtagcatgtgaccatagacaacagtatcatcacattatttctctaaaaaacagccaccttgctcttgataaatgctgtaattcccattttagtagacaatccttcctttcagaatcaggtttgccatttgattttatcaatcacaagtttcaaatgatcaataatccattagaattattttcaaaaaaatagcttttggaagatgatttcaacatatttctttctctctcacccaccccatcccccaacaaacgcagccctcagtatttataaatgtgccccatgctgctttcttggtcatgctatgaccatcaccagcattacacatgttgttgtacttatcttctttctaagaatacttcaatcatcatttagtacaaaataaaattcatgtttctaacaaaaactcttcttcatctcggcaaaaggagaactctttcctctgcagttgtgtgtagtttttgtatgagtttagtaagatatattagatggtacttcatagtagttacgtaggtctgaatataccttcttctactaggttttaaggttcttaaagacagtatatcagcatttttgagaaagaactttaggcgaaaattcatgtcccatatttttgttaggaactatgattctagagaatagggtgtgagggaaaaggagagtgaggcaggaagcaagcagggtcaatatgacaatgcattactgagctggtcactgatggcatcaggtataacgaatcacttgattttgaaggactgtcttcaaaaaggtcaaataatctctttccaggggggacaaaatcataggccagcttctgtttctctctgaattaaggtttaccagagggagcactaccttcctgtacaaatggattgcacatccatgagtgctacaagggtcccaaagcattacatgcctcagtggcagcactgaattctcacagaagacatgaaagaagcacagaaaggacctgatgttagacctgccgggtgcttcttatgcgaaactggccagaggtcactcatattcgttgctccaggtgctggcgctgacccagtggctatctgccctggatataggtgacactgaaagaacctgaagtggcacataagaggtgtctgattgagcatgcatttgtggtaaagctgtaaccataaagctgaagttcatctttgaatcacccactatactacaaaatggtgtatacatcaattattaaaatacttgctaaataaataagatttctaagaatgtataatggaaaggtaagagtgaatgctcacaatataggtgagcaatcctgcttacagaaaaggtaatgagttagtaaattccaaatgtatgaaattgaaaagagtgttaactactagtgtaagtacaaaattatacaaatactttgctgaaaagtcagggccattttcttattctaattttagtgaaaacagctgtgtgacctctctgggcctcactttttttcatctgtgaagtcaaaagcataaatttgatgacatttaagattttagtcaaactttgaaactgatgtgtttgaagttctgaatctatggcaaataaataattaaatattaatttattaggtatgattgagtacaaattgtgagttaggcacctctccagttcctaagaatacagtaatgaaaaagcagatatgaatactgccctattcgagtttaaatcctaatgtggagagtcacaaagcaaaataaatatctatgcaatatgttagaagtggggaggccagagaactgcattgcatgtttactcgggtggccagggtaggagtcactgaaaagctgagctgaaagatccagccaaatggataatgggggaggagcactctaggccattgtctgagcagggggtgaacttcacatgttctggagaataacgaactctttgacttgagccacatgatagaagttagagactgttatgaggatgatgccaaagagttaagaaggacagatcatgtagcaccctaggacattttgagaaatttgggttttactcagaatgagtcattgaggattttgagcagataaatgtatagcttgatttaggtttataaaaggatcaggatcaaattggctgctatattgagaatagattataatggggcaagtgtgtaaacagagatatggaaataaatagtttccaaaagacacatctagcataatttctgtaaggtaacaatgtggctaaaatgtgttttaatttagtatttttatggtcgtcagggtggttaaaaggttttatttattttaaagtaggtaaaacatgaatttactttacaaacatgtaaaaaacaactaataaaagttctactcaaactatttcaaaaaattgaagtggagggaatacttcaaaactcattctatgaggccagaattaccataccaaaaccagacaaacatgcaataataataataactataatccaatatctcttataaacacagatgcaaaaatcctcaaaaaacactagcaaactgaattcaacaacacaataaaaagatatttcaccatgattaagtgaattcatcccagagacgcaagtatagttaaacatatgctaatcaataaacatgatacatcataacatatgatcatttcaatagatgctgaaaaggcattccataaaatccaactttccttctttaaaaaaaaatttcctttggttattatcttgattaaaaacacctaacaaactaagtataaaagaagtatacctcaaaatagtaagggccacatctaacaaacccacagctaacataatactgaatgggaaaacattgaaagcctttcctctaaggtctgtaacaaggcaaataggctaactttcaccactcttattcaacacagcattggaagttctagacagaggaatgaagcaataaaagtgaataaagaacattgtaaaggaagaagtcaaattgtccttttttgcagatgatatgatcttatatttagaacataaatattgaaaaaaacctaaggattccactagaaaccgttagaactgatccatgaattcagtaaagttgctacaaaatcaacatacaacaattaataacatttctatattccagcagtaaacaatctgaaaaaaatacaagaaagtaattcaatttacacagctaccaaaaacaaacaaacaaacaaaaacccgggaataaatttagccaaaaaagtgcaagatctttactggaaaactggaaaagattgataaaataaattaaaaaggagacaaaaacatggtaagatacctcatgttttgggattggaagaattaacacagttaaaatgttcataccagctaaagtgatctacagattcaatactatccctatcaacataccaatgacattcttcacaaaatcgaaaaaaaaaaaaagctaaaatttgtatggagccacaaaagaccacaaatagccaaagcaatccagaactaaaagaacaaagctatagtatctaaaaaacagcatgatgccgtcatagaaatatacacataagccaatgtaacagaatagagaacccagaaataaatccatgcattttcagccaactcatttcaaaaatggtgccaaggacatatgctgataaacaaatacttttcaatgaatggtgctgggtaaactagatagccacatgcagaacaatgaaaatagactcttacctcttactacatacaaaaatcaaataaaaatggattgcatacttaaacgtaaaacctaaactataaaataactagaagaaaacattggggaaacacttcaggactttggtctagacaaagattttttgggcaagtcctcaaaagcacaggaaagaaaagcagaaatagagaaatgggattacactgagctaaaaatacttctacacagcaaagaaagcaatcaacaaagtgaggagacagtccacagaatgggagaaaatatttgtaaactatccatctgacaaaagggttaataatcagaatacataaggaactcaaataagacaatggtaaaaaacaaataatcaaattttaaaatgggcaaaagatcttaatagatatttttaagagaagatacaccagtaggtatgtgaaaataatgttcaaaatcactagccatggggaacgtaaatataaaccacaatgaaatatcatctcaccccagttaaagtagctataattaaaaagacaacaaataaccaaagctgatgagaatgtagaaaaatgtgaccctcctacattcttggtgggaatgtaaattggtacagccactatggagaacagtatgaaggttctactgaaaactgaaaatagaattagcatatgatccagcaattccattccttggtgtatgtccaaaaaaaggaaatcagaatatccacaaaaaatctgcagtctcgtgttaattgtactactattcacaacagccaagacatgacattaatctacgtccatcagcaaatgaacagattaagaaaatgtagtatatatacaaagtggcgtattaatacattaaaaagaatgctactctgtcatttgcagcaacatggatagaactggaggtcattatgttaattgagctaagccaaatacagaaaaacaaatatcccatgttctcactaatatgcgggagctaaaaaacttggtcttctggagataatgactataacagtggttatcaggggctggcaagggtagggtagaggatggatgaagaaagattggttaatggatacaaaaatatatatagatagaaggcacaatttctagcatttaataacacagcaggagtatagctaacaataacttattgtacatttaaaaatggctagaagatttggaatgttctcaacacaaagaaatgataaatgtgtaagatgatagctaccccaattaccttaatttgatcattacacattgtatgcatgtatcaaaataccatatgtaccacataaatatgtattattatgtaccaatattaaaagaaaaaatataaacagaaatatatttatacattctcttttttatatactaatatttaaaactaaatcatactatatactagtatacaaaaactatatattaatatataaaactaatacatataaaaataaagccatgcatacatatttagtaactaaaaatgtactctttctctttccaagtattatgttgtgtattcctctcaatgccatgaaataagtaatttttcatttacagatgaggtcacatggtcaaggacatatagaaagtgaaaggaaggcttacatattagtgaagcataatcactgatggcagaaaaaaaatgaagaatggggtggtagattcctattactgctattaccaatgactacaaaattgatggtttaaaacaacacaaatgtatcttataattttggaagtcagaagtaaaaaataggtctcactggactaaaatcaaggtattgacagggctgtgttttatctgtaggcttgaggcagaatccatttatttgccttttctagcttcctgagtctggtcacattgcttggctcatggctcatggcccccttctatctttaaaaccagcaatggccacctgagtctttctcaatttgcatcattctgacttctatttctgcttctctcttcgacttcaaaagaccattgtgattatattggacccacctcaacaatccagggtaatgtccttatctcaagtcacttgagtggtaatcctaactcaatcttcaactttaattcccacttaccatgggctataacatattcaacaattgtgaggtataagacattaacacctttgagtggctaatgttctgcctactacaaatggtgagataaatttgaggtgatgggatgctagataagtcttttcctttcctcataacttttgtcagaatctatgtgaatatatatagcagaatatgtaccatcactatttcaaggctatcccatttaatttttgttatgaggtcattgactctttacagaaaacatctaacatgtcagcgctttgtccttattattgtatttatctgtgtggtcatgaaagaagtggtctatgtgggagacttttccaaattatgaatctagaatacccataaatatttagtctcacttattcctacagtgtgtatgggtaagtgtattatttttcataagatgatggctggggaaattgggaatacagaacatgaagacagttaacatacgtgccagcctagttgttacccctcattatattacagactggtaaatgtatctacctaaatggaatgatgatgctactcaagactgaagaaggtagccttagaaaattttctaatgtagatcgttgaatgttgaagaccttgccatgttaagtgatgtagagaaaggtcctagaatactggctttctcctgaagagacaatagatttccactgatgacgtagagtgacacatcctgagtaaggctataaggattgtggagactgactttataccagggtgaagtcgggacatgttctttcttcaaaagcttttctttaaggcctgcattctagaaaggagagacagtcccaagggtactttcctaatgtcatggtacactagctcctgtgttaagttggcagcctggggtgagggaagaagtcttcgtcacaaagaatacattgcccagtaggaaaccactatggaaatttatggacttaagttattcaggaacagtcatattgcatactgagtttcaaatgaccttgtgtagaaatattcatcaatgtcttacaatattcaccataagtctggtaaaagttacaaactggtctttatctaaccgtttgaaaaaagaagggataggtgtccacaacacagtgcggagtgtttaaaagagagccatacaagcactaagaaagccagaagtgagtaaccagcagaaaagtagataaaggttctgatctggatccagatgataaatggaatggcaagtgaaaatcgggatatattttccagaagataaatgttcctggatatcttggaacatcaagtaaattattaagttcttatatataataaagcaagattgtagattcatctttttattcaggcatttgaggaaagtgtgacttcaaggactattgaaatctgagacatatgttctgggtacattaaggagaaggtatagtagtattgaagaatataaaaatatatttaggtctcgtaagtcagcacttctccttacattaactatatgactccttcattgtggattattattccatccaaaatttcctatttagaaggccacatttggttcatgcaaatacgaaaagatgccataatcggagaaaaaagtttggagatcatgaagatgcaaacaggagtatttcttaatactttattaagcttatacgaatacactaaagtacagttttaatttggcttctaagtatactttactctatacaaattaccaccacttgaaagaaaaaaagagagccagagatgaatatatagtttccaacataatatagaggcatagtagcatccttaacatgacatacactgtgctcctaaatactgctcctaaatattaaggataacatgctaaaatttgtctttatccccatgttttgggttataaaatattagatttagaaaaaagaaaaaaaaagaaagtaaaaagaaaccactctaacacaaggaattttattttcataaaacatccatatccatatactttgtaggcagttttcaaaatggctttcagtgatcctcttctcttaatattcatatcctgtcctttcagcttgatagttggcttgagattaatcacacttgagcttaatcacttccaagtctagatgacaaaagcctttgacttttctcttgcacattcttttttgccttcttatttattagccctgtcaaagctgcttctatgttgtgagatgctttatggataacatccatgtggtaaaatagtgaagtaggcctcttgccaaccaccagttaggaataaccatggaggaactgagtcccaccaacagctacttgagtgactataaaagtggacccatcactggttgaaccttgggataactatagcccaattgacaccttgattttagccttgtgagatattcagaaacagaggatgcaactaagcattgttttaatttctgacccatggaaactgagataataaatgtttgctgctttatccagtaagattttgaataatctgttaaacaaataaatagtacacatacatatacaaacttgcaagataaaacataactttagaggaaaaaaagaaatcaagcaagaactagatacagttaacataaacaaaactcatcatatttcattacagcatgtggaaattgtgaagtatctttttcttatatatgttaattactcagtaaaaaattagagtatcgctgaaatctgtataccaaagttgaaaaagacaaagaaaacttatagaatgtatgggaggtggtgaaaagataattaaaagattcaaaatcaaaatttatataacagaatttgtattttaagaaaaatgtaaagtgttacaaaaagtatgtctccttctctggcagtaattatcctatttgctataatataataaataggttttgagtaactgttttgtggccgatttaagcagcaatccacgtaaacagacacctggatttccttcagtaagggagcaggaaatgacaattacattcttcagcaaaaacattttatctttgtttacagacattttgtgtgtgtgtgtgtgtgaatgtttctcacaaattgcaaaggccccccaccagtcttaacaaagaatttatttgaccattaactatatttcatgcgtaacatatattttatgacatgaattatattttgaatttagatttttacattttgttaattactacttcacaagaaggggaaaaataaaaaatcttcaaaaagcaattatagctcaatgatttaaatcaattcaccgggttatggttgtggcagataataaaaaattaaattcttcttccaaagctaagttgattactctgagtacctacctgtgttcttccaaaattttataaattacgtgtgattggagctcagatgaaatttagattgctgattgactttaactataggaaaaactattcaaagaaaagattaaatgagaaccaaatccttttatatacacacagaaaaaaaaacatgaaagtgaaagtgatctaatcagaagtattacaaaaaatagacaagaagaaccaacagttatacgatctctctgataatggtaaattctctctttaagtaggcatgttgctattgatgtatgctgaatgagtgtgttttagttttccaacatagcaaatctgacagtgaacttgaaatcagttagactggtaaggggtttctggctggattccacataatgctgttggctcatgggatttccttggtctagccaggtttagaaacagtttttaatcagttaatactggatttattatgttaaagaatgggggagggtaaaactcactgattcagaaactggataatatataagtgtataatataaaattaatctgcagcgaaggccagagtgctttcaaatataagccagtacatttctttaacagtttccaaatgtctgggaattttaatcactaattatagcattaagtgagccaagaattttagaaaagaatatacttttattagatattttcttgaagatatggcagtctaacaaggaacaattttagataataggaaaacttattggaatagtagtcaaaatctccttcctgaactgtgagataaatacttaaaaatttactaaatccttcattcataaataattcttattttccacctattaatttgttaggtgattgaatgttatcttgcactcttatgtacaatagggtttctcaagcacagcactattcgcattttgggccagatgacaccttgttgtgggggtgtcctatgaattttaggatgtttaacagcatcctggcctttctccacctgctggatgatttgcgccctcccagttgtgacagccaaaaatgtttctaagcactgtcaaatgtccttttgggggcaaaataattgtctgttaagatatactgctcaaaaagaaagaggggaggagagcaggtagtggcgatggttaatgggtacaaacatacagttagatgaatggataagatctagtattcatagcaagaaagagtgactacagtctgcaataatttgttcacattttaaaataaccaaaagagtataagtggattgtttgtaacagaaagaaaggataagtgcttgaggtggtgattaccccatttaccctgatgtgattatcatgcattttatgtctgtatcaaaatatcttatgtaccccataaatatattcacctattatgtatccacaaaaattaaaaattaatgaaaggtttctatgactcatgtgcaaatataattataatcttagtggtcacaaccagtatatatatttttatccttcttgtgtcagggttccccaggaccactctaaagtttgatgatatacatattcacaactatggtttattacagcgaaaggctacacagcaaaatcagcaaagggaaaaggcttatggggcaaagtccagcggacaccacgtacaagtttccaagaaacctctcccattcgagtcgcacagatgagagtacagatggtccccaacttacaattttttgactttacattgggtttatcagagtattataggcatttgtgacttacaatattttcaacttacaatggttttataaggtgtaacaccactgtaggtcaagaaacatctgtgattcatagcaatgagttgtaacaccagttgtggaatgtcctctagataagttcattagagacttaatgctaactgcttagcacataccacatttccagactttcagaaataaagcaattgtttagaaaaaccatcattgtttttacaaactgtttaggtactacacaccatgcttatcagttagggaatgacgagatccctttcagaaatccaagttcccagacaccagccactggtcaactttgcaaaaagatcattctaatcacagcagtctcaggtctgttatgttaaccctttctctatgctttcctacaaaatgttttgtgacatgtcagctgcattttaggcacccaaagacttatacaataaataggtgaactaattaatcaaccagtgatgttttcagttagaattccttaaatgtctctattgacacgtttgttcctaaggactcttacacctacaaagaggaaaatgttccacataataaagcataactacagttttataatagaggaaaattttagttaatcaaattgtaccagcattaacctgcatttccagaaaagtcttcaaacaactcaagatccaatgggaggaactcattttcagtgaaaagaaaatgatgtatggtaatattctggtcgatgtaactttcaaatgcaaccactaagagaaagaggaatttaaatttcttgaatctaagactccatgaataaccattttctgtcaaggagccaatattatttttaaaaataaaatcactcaatggttacatttttttttttttttttgagacggagtctcgctctgtagcccaagctggagtgcagtggcgtgatctccgctcactgcaagctccgcctccagggttcacgccattctcctgcctcagcctccagagtagctgggactacaggcgcccgccaccacgcccggctaattttttgtatttttagtagacacggggttttactgtgttagccaggttggtctcgatctcctgacctcgtgatccacccgcccccgcctcccaaagtgctggaattacaaggcgtgagccaccgcgcccgaccactcaatggttacattcttatttgagatatggagttgtctagagcccttcactcaagacgatctgctttagattaataggatgctttgagaaaataaacttcatgttacttttgagaaaatatgatgcacattaattttatgataattaatgttgaaacacctcccataaccacacatccctcttttatacacgggataaaattgttagtttagattttattacttaattattgtctggtcatcaccccttatcccctcctgaatatttaatgagaccaaggtccgtgctcttttttaattcacatttgtctctccaggaccttgcataggatgtagtaaagagtatttaacaagaatctgttaaaatgatttttttgaaaaagctcagagagataactgtccataccccatgtgtccccacggtatattcgatctttattttgaaggcaaacactatattttaaaaatcaaaatctaataaagataaagcaccatccctttacaggattgatttctttgattgtaaagtgtgcgaaaaaagggtttccggtgcactctgacaccattcataaaatcctaaccaggacctggtaaggccttagtttgtcaacactgtaccagaaatctctaatataaacaggctcatattataatcttctgcatttgtaatttttgagaacagggtggaaaagcactcatttaagtggaggatttttcttttaaatgctgtacttgagaatgtatcattattccagatgagacagataagacgcgttgctcccttgccctggcagtggatttgtttgtatattatgctttctaactctctttctttgctgagctagctattttatgtttctttgtgaatgactgtaccttaagggaactatattctgtatccattattttataaaggtgagtgggctcagtaaatgcctgaaaaagtaccttgactaagatcacagagttaacataataaacctgatagtgctgtaggaagaaagacctagttaggtgtggagtaaaacttagccttataattcccaggccaaagtgtttccaccatcaccaaatcagcgtcagtaactaatcaaataacaatttatttaagccattaaaaaatgtaatgctttcactgcaatgtgaacatatatttaaacatgatgacgatttgtaaaaacaaagatttttagaactaagaagaaatatatattacaaagtagttagtattaaataaactgtttcctggatcctgaatgatgataaaagtttaccccattaacactagggagcatattcaaagaatccaaaattctagcaattctttggtttagtagaagccacaagaagataatttatatctgaaattctgtaatattacagcatcccagttccttttgtgaaacccagagttccatttactcattcgaatggctatacttttttagaatctcttcaaatttgttccatacatactttttagatatgaactaaaattaggcagagtaatatagttttctcctcaatatggaattgaaaaaagaaatactccagttacattttccagctgagtactttggcttattattggatttgattttacctttaacagtgatacaaaggcaaatgcaattgacaaagttaaatatgtggtagcagagtttgaagtttaaaaccctacgtgcttgcttgcttgcttggttttgcttttgttttcttgagcaattgttgactactcagcctgctctgtaaagttaagagcatagactctggagtatcagatgtagattagaattctatttttgccactacctatatttatgaattaaaacttttttttaacttccctgatctcagttttctcatactttaaaagaaatttatgtgtagacaaggaggggtcttactactctcattagcaataaataatattattacttcattgtcaagtttcctactacctaggtacatgaagcgcccttgctctgtctctctttctctctttctctcctctctttcttccagtttcctttatttaacagcaagttaaaaatgcagttggagaaatcaatttattattctcaaacaatttattttacatttataaaaccgtagagatggcttatattgtttatgtgacattgtttatccacaggataaaagaaaaagagttaaacagtaaataattaaaattgttagtttatccacaggataaaagaaaaagagttaaacagtaaataattaactcccacagctatagtcattcctctttaaaaactctagtcaactaaccaaaggaaacacctttttggtgaatacaggtaagttagggcaaagttttggtagtgaaattgtaaagaatcgattactactgtgatgaatcaaatcataaagaatttaacttcactgtactatacaatctattttcaagttgaaagttagttaaaaatgtttcactttattttctttgaagacaataagttggaggcaattcaaacattttattatgaattatcaactaagtttatttaaataatgaatttatctttatgcttaatgcaaattgcatatacattgtattcaaaataaaatgcaaataccaaagaaaaattgttttctaaaataatgttacaagtttatatttgtttcacagtaaattatttttaaatttttgtcagtttacaaacaaaagattgcttaacaattgcaagcagcaaatttaccaatatataaaattcaaaatgttcttccaaacacaaatataattaagcagcaataaaagcttagtatatgaactttattaatagtggttatatctagtttgtagttgccaagaagtaccagctttacatgcactggcaacagtaataaacaatttatggctttctaataaacagatacgtgttaaaagcacatttaaaagaaataccagaagagtttataacatttagcgagcatatggtctctataaagtagtaaattaagtactttataaaactgttagtattaatactatattacaatattttatatttgtgctgcatagttttcaaagtatcatttagaaggattctaatatttttagaacttatttattcttcccaactttgccagataagatttatctctactatgttgaagaattaaaactgagactcaagatggttaaaattttgactgacgtatttcaccacttggtaggagggccaggactcataattaggtttgtgtaattctaagtcaatgattgttccagtttatcttgctgttgctcaaacaggtgtgcttttaaatttgcttataaaatatgcacaaacagatggcacctgctaaatacataactggcaataatatcttgatattttcaaatactcaagagtaatctagcacaaagagctcagaaatttgcaacacaatatattgcacccagaaaaaacccttaaaaccgtctagttcaatcatctatgttagagaaaaattggacaaatagaattaaatgtctagccaatttactatctagaaaatttcaaagttcagactcaaaaatcacttctttgaatccatttctagagctttctgtgttacatcaagaaaacagatttttttccaaatgtttatgtttctttgtccaatctaaaggatgaaagatactaattctctgtaatacataagaagaaaagagaattagacagtatctttatcaagtcccatcagattagcaacaaatttacaaaagtgatgttataaaactttttgactaaaaggctttcccaatattataaaaagggtatcacattatactgccatttaatgctattaagaaaacattacctactacaaataaatcttaccgtcatgtttctcaatctattataattaataaaatattaggaaaagacttgttttattgtgaaaatgttattcaatatattttattccagataaatggatattaaaggatatttatagtactttcaatttgttctgaaagctacatctgtattatcaggaatatgtataagcactaaacattgttgcagaatttgtctaaggctaacaccattttcaacaccatgaagaataaaacaggccgggcgcggtggctcacgcctgtaatcccagcactttgggaggccgaggcggacagatcatgaagtcaggagatggagaccatcctggctaacatggtgaaaccccgtctctactaaaaattacaaaaaattagccgggcgtggtggcgggcgcctgtagtcccagctactctggaggctgaggcaggagaatggcgtgaacccgggaggcagagcttgcagtgagctgagatcacgccactgcactccagcctgggtgacagaacgagactccgtctcaaaaaaaaaaaaaaacaaaaaacaaaaaacaaaaaacaaacaaacaaacaaacaaaaaaaaacaataaaacaattttcctatatgtcagaaaaaacttctttacagcttttatgaagtgtataaatccctgcatgaatatattcaactcagtgactctattacattctttgatgtccctcatgtttctaaaaaaaatgatgccgagtgtatctttaggatttgaaagcaatgaaagtatataaagccaactgacaggacctcacttatttcctgctggtttatcagccgtcaggaaggatttgcactcaaactcttccacctttccccccttgttatcaatggcatacatggagccacaggaagagtaacgcatagtgtggccatctaaaacagggtaaaattcagacagtcttatagaaataaagtcacaaatgaggttcgaaaataattaccaacagacacaaaagaagaatctttaaaactccatgatctaaatatatattgacaatataattctatgccaatgagtagttttgaattcagcaccatatactgactgcctatttatcacatactaaagatacaaataagtaaggagttacccacatataaatattccatcaatgtttgcacatccatggtatatattataaagatacatctagcaccagaggatgttgggtgctatggaataagaaaatagagacgtgatttttttttttattttcgagacagggtctctgtcacccaggctggggggcagtggcctgatctctgctcaccgaaacctctgcctcccaggttcaagtgattctggtgcctcagcctcctgagcagctggaattacaggcgcatacaccatgcccagctaactttttgtatttttagcagagacggggtttcaccatgctgcccaggctggtctcgaactcctgacctcaagctatctgtccacctcggcctctaaagggctgggattacaggcgtgagccaccaggtccggcagaggcatgaattaaaaacaaacaaacaaacaaaaaaaaaaacttaaattacattctcaccccatcaacttatttgatcttaccaagtcatttcatctctatcttccattttttaaccacagtgtaaaaacatttgacttttcttcccactatattgttgtaagtataaaatgccacaatatatgtgaaaatggtctgaaaatcctaaagcacttctatattgctctatatacactagagcaagaagaggttaaatggtttcccctggtagcaccttcctgagcacagaaaggtgacctcggcaccagggtgtactggctcacttccctaaatctggaatgtaatctgaagagtattacccaaatcctttttctattgttttttttttgttgttgtttttttgtttgtttgtgtttttttttttttttttgagactgaatctcgctctgttgcccaggctggagtgcagtggcgccgccaccacggccggctgattttttttttttattattattattttttatttttagtagagacagggtttcaccgtgttagccaggatggtctcgatctcctgacctcgtgatccacccgtctcatcctcccaaagtgctgggattacaggcgtgagccaccgcgcccggctccccaaatctttactgccaagaaaagtgacaggtttagtaatttcatagtggtttggataatttggctttcaaatttcctttagattagttcctttagattataacattgctaacactataaaactctagtttgagtgaaattcttgtggattcagatactgcaatcaacgaacattgagccaaggatgaattggtgctattcctggtcaattctctttggcaaataaagatagactcgttccatgattgaaagctacataaaaaatatctaatatcactacatatcaaatataatttaaaatataaaatcaaaattaagtccttattaagccttggtagattaagaaaatacaccattaatatgccgacacacatctaattattaaattaaggaaaatttttgtatcaatttttgattggtaatacagaaataaattttcactacaaagaaattttgaataagtattgacactgatataaagtacatcatttaattattatcattattttttcaaattttagttatatttagaagattagattaccttagattccaattcaaagactatatcccatatgattatttcagcttttttcagaatgcattatttaaaaaacaaaacgtttatggacataaccaattataatgtgctgctgctcacaaaacaattgattataaacatgccagaaaaaatgacacaagtcgcatatgtgttctttccagattcaagctattatcttctaaatattctaagtagatagtagattaagataatttatttgccatgtttttcacacttagagtttttctttcttttttttttttttttttttttttgggagacagactcactctgtcacccaggctgaagtgcaatggcacgatcttggctcactgcaacctctgtctcttaggttcaagcgattctcctgcctcagcctcccagtcccttgccatcacacctggcttattttgtattttcagtagagacagggttttgccatgttggccaggctggtctcgaactcctgacttcaggtgatgcacctgcctcggcctcccaaaatgctgggattacagccttcagccactgcacccagccaggtttccctttatgcagaaagcagcttgcaggcaatgctaatattggtttaattttcttaggaggaacccagtatagtacgggaaataattaatataatttgttcttaaaaatatagcttagtattgtattaatttttctagagactgagccaaatcaagtttattccaactaaaatactgcaaacatttacttaagctaatatgtcttattcttaaaatgcttaagggtgcagctctagaattatatttcttagtcacaccttactgcaaattatattaattggagaataaatttatttataatcctagacacgttttaggaagagaatttgaatggaataaacagggaagagaaagatacatcttcttatgataaaataaagatactagagatctttatgacacaatagtaaacatatatatgaattatgaattaatctaatcatgctcatacataaagatctaactgtgtatttttcattttaaatcagttaaattagttacataatctactgtataagattaataaaaatgaactaaaaatatctgttggctcatcagaataatgcagcacttttttcattgggttattaaggataatatttataataataagtgcatacaaagttcttattacagtgcgtagagcacaatggatgctaactggatgttactttctctctctctatcgtgtaaacaccatgagacaaggcgcggtagctcatacctgtaatcccagcactttggcagcgggtggatcacctgaggtcaggagttcaagaccagcctgaccaatatggtgaaacccccgtctctactaaaaacacacacacacacacacacacacacacacacacacacacaaaattagctgggcatggtggcaggtgcctgtaatcccagctactcaggaggctgaggcaggagaatagtttgagcccgggaggcagagtttgcagtgagccgagatcacgccattgcactccagcctgggtgacagagacagactctgtctcaaaaaaataaaaaagtaaaaaataaaaacaaaaaatagtaaataccatgagtgcaaaaagaaaagctatcttattactgacgtgtccctatcctttatatagtgtccattacgtaataagagcccatcagtcatttttttcaatatgtaaatacggagaaatatcttgactacagtgcaggactccatgtttgtttggctctctgctcaaattagacttttcttccatcaatatagaataagccatgcatagacatagtttctattaaaaatctgtaccctaatgagtagaatgggctcacacagatcttggaaaaatacatttagtaggcttggtgaaactgtaatggctttgtacagaactccactgcaacccacctgacaaactaggatatgctaaacaaaccagtcatttatgtgagcgtgtgtatgtgtatgtgtctttctgtctgtctgtctgtatgtatgtgaaagagagagagagagagagagagaaactatggatacttcctttataaattctggctttgccttgccttagaacaggacaacagacttcacaatttttctacatatatgcaaataaattctcggcactttaactgtctttgagttacactttgatacatccacagtgcaatttatgtcaataaaaatgaaattcctaagtaggagggagctgtgtcttaacgtgattagtatttggacttcctattattgtatttgaagacagaggatgcttggctttatgaagcaagctcccaattggattaccatatgtctcaaaaaacatgatagtaaatgtcttttgatagcatgagatataaaggagaaatataaaaatttgctttatgaatgttctgcttccagccggggtatattcagttgtagttaagatagttgtgttctattagctggggacaatttgtaactgtccttattagaaacatacatgtgtatgccaaactgctaagaaatgagaaatttctgtctatatcacctgtttttggcttgctcagaattctaccttttttttttttttttttttttttgagacggagtttcgctctgtcgcccaggctggagcgcagtggcgcgatctcgactcactgcaagctccgcctcccgggttcacgccattctcctgcctcagcctcccgagtagctgggactacaggcgcgcgccaccatgcccggctaatttttgtatttttagtagagacggggtttcaccgtgtcagccaggatggtctcgatctcctgacctcgtgatccgcccgtctcggcctcccaaagtgctgggattacaggcgtgagccaccgcgcccggccaattctaccttcttaaaaattggctttcctttagaaaactacttcatttgccttctttatggtagtcacagtgctatgcccaccaacaatgacaagtaagagacctaaataagaccaattagattattccttaaagttttatttatgccgagagagagacagagagagagagaagggctcctttccttagtaattgcaattatgaatttaggttgagttgtcagcagccttaatatatagctgcatggacaaatattgactgagagttaaagccaaacatcatgggatgcaagcaaaaggcatcaaaagaaacagattcctcaggaggtcttattgggtctctgaatacagccatgcctgaaaaactcactgtaagacccttcattgctttatattatttgagctgcttttctttcccttgtaatcaaaggaccactgacaaatactggctaagtagaatattaataagaatatacacgaaaaagaaaaacatgaatatgcttttggtataaatttacctaaaatattttaacatgcaaattagataccatgtagtttgttaactttaatagttcctcaaattaaaatgttttagtatgtaaatacagatggtttccaactttaaatggttcgacttataattttttatttgattgtgatgtgaaagccatactaattcagtagaaatgtttcatcaaattttgaattgtgatattttccaggctattaatgtatggtaaaatactctctcatgatgctaggctgcagaccccagccagccacaagatcatgagtgtaaataagtgatactctacagtgtattgtgttgctgacgctttttggatattgtcttttcacatcccatcatgtttacaaaatggcatttttgacttacagtgttgtaaatgtatgatgtgtttatcaggccacaactccatcataaatcgagcagcctctatatacacaatatgtatataattttgagtatctcttcatattaatgtaaagttttattttacacttcatttgtggctacttttttcctttaaataaaggcaatgaaaccagatcaatgagagtacttgaattaattctagttgtagaaaagcttggatgatacccttacaaaggaaacccaaataaaaacctaaccaattgaacttttgggttgtgtttggaactatctcttttcaatgaattaacatgtgttatgtgtttatgatgacaaatattagactatattctttaaggcttatcatcagcaaagactttccgggttataggacttctctttatgatttcatctttccaatttttctgacttatgcctgtattttcttttatctttgcctcctataggtctggcttcttctgtcctctcatttcctggtctcctactgactcgcctcttatctctatggcatgtgaccttgggcatgtctttcagtgcctgtcattcttcttatacttcacttcctgtctctgccttccctccccctccatcttactacttctcagcatccttatatacaggtgaaataaaatcacttaaaattatcaattagatttctagtaggaaattgaaaagtactatcatcattttctttataataaagaatgtgacatgatatttaaagaaaattatttttagaagtgttcaattccacttgaacactaccgggcaaacacctaaattttcctttgttcaggttgcaaaatgtgagcatttcctaaatttgctgtgaaccctcaggaataaagcaaaaaacaattttcaaaataaaaatgaacaatttaatagatttaaatatgaatgtttcctaaaaaggatatattaataaagttctgtactaatatatataaatcctaaataaatttccatttcaatacttccttttgatatttctgtcttctctctcttgatatagaaacaacctgcatgtatgcagttcagttccttaggcatatatgattcattcatcttaatttagaaaatatcaaggccatgcctgggagcagaattggggcattatttgtctttcggcagcgtatttttaaaattgttatgaataagtaaattgacaaaatcctttctaagatgtacagacattttcaatcaataatgcacactatcaggacataaaatcttccctaactttttgagaaatctttacgttttctttagggaatagattcacacttaggttttatcacctatcctacactgacgtttgggggctgaactttttgaggtaatgggtgcctctgtacagctgcaacccagaatgattctttcactactatgccctgagcaaaaacagtcttgggttacaggagtgaattagtgccttctcctgtttcctgcaccctttatttcatgaccttatcccatgtatagggcgagtaagagtagtcagttcatactgatctcagcagatagcgatataaacagatacttggctcatagggcataacttacatttactaagaaaatgctcaaaaccattcattgaagtttttctatacagactttcaggaattttaatgagtacttgcttataaaatgttgacaaccttaatcataaagtggtaaaaactaatatgcaatgtatcaagggaacaatacctccaactgttttcccagaatatactttacaaattaccaaagcagataactgaccacatttcctttttaatttacctcactagttctttgaagttctattcaccattagctctttgaataactgttttaaaacagatgggatgaacatctggataacacaacatatatattttttttatcaattgcctcactgatgtgaggaacatctcctcccacacacaccaccctgtgcctcatctaatgtgttaacactttggataatgagaacaacagaagtggatactaaatatcttattcaaattaactcaaatctgagtgcaaatgtggaagtatccatgcaattcacgaactgctgccccagactgtgtttttaacagcagtgtttgatgatgttggcactcttgatcattttctgtttttgaagttactgagttcaatgatccatcctttgtgtttatttatcaggactgtgaacatcacaaacaatttgagatgtttagaattaaatgttgattttagctggcagaaaaaatgcaaagttaggtaaattgatgagcatcattttcatgtatatattatctctttgttaacagttatctttcccagacataatggaaatggctgaggagtatgggtaaactgaagtatctgagttcaaatttatgcatgttaagatagaataataaacatgctactcttctgtgcagaaattcaatgccaaactaattcatgaaatactgtacaatactatacaatacaatatagttcaactatattggctcgaatcaatataactggtagtttaagtcactggtagttcaaagaaagaccaactagattctgagcctcaaacagcattattagggacttgcctgcctctttgtctggcttcctctacgatggcttacttttcaggctgggtttcttaataatgttggtaaatatgatcacaacaagctctaaaattctacactccttgcctttctgcctgaatcttgcccccccaaaaataatttatttcaggcacttccagtccaaattttaaaactgatactaattttgtgtagtttgggtcatgtttatgacctactaattagtcacagttgccaagaaaccgaatgacctaggtaatatgctcaactctgaagctaggctatcaggttttgaaaccaatggattaagaacaggtaagtagctgggcgcagtggttcatgcctgtaattccagaacttgcgggggccaagacaggtggatcacttgaggtcaggagtttgagacccgcctggccaacatgggggaaaccctgtctctacccaaaatacaaaaattagcctggcgtggtgatacacatttgtaatccaagctactcgggaggctgagacaggaaaatcgcttgaacctgggaggtggaggttgcagtgagccgagatcatgccactgcactccagcctgggcaacatagcgagactctgtctcaaaaacaaaacaaaacaaaacaaaacaaaacaaaacaaaacaaaacaaaacagttaaggggtaattctccaaaggaaaactatcattattttatcaaactaatgaaggaagcatgctggtcagtcaaaccaacctgtgtctataatcaaagtgcaagctttgcagaggagcttttaatacataactgaaatattattcataagtaattggagtattctggggaatagatattagtaaaagttaaggaaatagaatgacaacaagtgataacaacatatatatatgtatatgtatctcctaacattagtctaaacatagagtccataccactgacagcaggcactggacatggttagaggaccattctccttaccataaagtgagaactcagatatactctccaactaatttaaccttgaatcacattttacctatgtatgagctatagcataatgtcagagcatattaatcataaccatatagcaagaatattacagattaaaattgtcatagcttatttttcttgtcttataagaaatgctaattagggtgaaattcatgttataaaagtatttacatataaatacttcaagaaaaaatttgctggagatattagcagaacatgtcgtacttaaaaaaatgcaagaatttggtctaggctgggttgaatatgtttaggaaaacacagtcttttgaagaaaaagtagattgcaatatctcaaataataactagtgacaatgaagaaaataaagtgttcttatgaacataagagttgatatttgtaacttttatggcatagctgatgaatcattcagtaaaaccaaatgaaacaaataccttcaatctctcaaatcaaacaccatactattgagattttagctataactttatgtttgtcttgtttgaaaaaatacttcaaaaccccaaaatattttttgttaaaccatcttacatggttaaaacattccttttagagtaaacacttatgaaattcttaagcattgtaacttcatcattctaaaggattaaaatgtttattttaaattgaacatttatgaaatgcttaagcattttagctagccttttttaaagtgcaatcataaaaacaatggttttataatgaaagaaatatttcataattgcattcatacatttgaactgtttatacatgtggcaataaaatgaaatacaattgtgaaacacatattttatataaagtatagttgccaatgtttttgttttcttgaaataatctttttattctttttcgcttttaaagcataagtttgtgtcacaatttaaattcattctagaaacttgcagttaatccctgattacttgtcatgattagatattcagctaaggtatacatcacagaccatctgtgagaggacactatttcatttgtcttctgggtaatagggaggctcattttgaggatgaacccaccctgctcttttgtgaaagcaggagagtgccaggtggttggtagagataaacacaaagggtaataccggggaaaaagaaacgcagggctttcccagcaaacctttacaatattggtgcactacaacaggtggaaaacagtgagatgtcatatatgtgtgcaaagccagaacacatttcacaatttgtagctcagattccatgagacactaagaatacagatgttaggaagtttcaaatttcaataagggtagaatgtaataccaccttgaaaataccctttctcaactgcatgtacttatattgctaactggagaaaataactctggagagtaatcatggaactgtgtggagtttatttggttaatgggaccaaacatacagttaggtagaagaaataagttctagagttcaatagcacactctaaggtgactagttactaattcattgtatatgtcaatatagctaaaagagaatatttgaaatgttcccaaaacaaataaataataaatctttgtggtgatggacaacctaaatatggtgaattgatttttacgtgtggtatgcatgtatcaaaatatcacatttactttttatggatacataagagttgtactatataaatatatatatatatagtatataaatatactatataaatatgtacaactcttatgtatccattaaatgtaaatacatgaatagattaacaaatagaacaagaaaaaatgattagtacagaatatttagcctttttctaagtttcatgagaaatctgcagatttcctagggaaacttatgatagcctattaacatgcaaatataacgtattagatctaatttttaaaagtaaaaagggatttttttaatcgactcgaagaagaaaaagatcttttaccatggttttcttgtcctgggctcaacatgtaatgatgaaagcaaactagaatagaaagtaaggcaaagaaaaataaatatatatttttttcagtggtctctaaatgtcttataaactttgttatgtctcttgtctagctttattccaggcacaaactgatcaaaaattggttcactgaatgagcttgccatatcagatatagaaattttgagatttgctaattcaaagtacaagaacacagtaaatagtaagagaatacatgagcctgtgagtatattaaattcactggcatgttttttcatctatttccctttagaatctattacaaaacctagagaaatgtgactcctatgaaccactgttatgcaaaggtgtgccagattcattgtgtttagggtagaaaatatagctgggagtaagaaaataaaaaataaagattttaattccaagaatgccccaaactaagtaaatgatgtattaccaaatttttattgctgcataaaatacctctttgtgacaacccagtttacaggcaatttcagtgttgactattagagaactattaagctgagaaggtcatgtagcatagggtaaacctcatgacctcatctgttagaacatgtgttgatacgatagaccaaggaaaaaatatgctctgagtaagaggtaagcatgcaggatcaattcaaaatggtcccagatgaagatgccttctgagtatatgtcagggaagtgaagacaatgaatagttccatgcaagcaattcaagtgagaaagggcaatgcgtaaggcaaaataaatgagataagaagcaactgttgccctcaaagagcctggtaagaggaagaatttttgtaagtcttgcttatttttcattagaaaaaaaatttagaggcaaatctttttatttaggcatattataaaaatatttctgtatcctaactatgaatgagaaaataagcataaactcaaattataaaaagatccaacaggcaaaaagctatgacatacaacatttgtttgaggttgatacttgaaaagaaattacccacaagttgtggagaaaataaatagaaatctgtttttctccactgctttaagaatctatactaatttcaactctcttagacaaaatttcacataggccacgtgcataaatatttttatgttgccattataccttatatggcaagtaattcctgtatccatactaactttactctgttgagctaaatacctttttagcaaaaaatagaatgtatcaaaatcgtaaatgctgacatttattgggaaaatggaataaattacatgcgctataattctcaaacctgtttagtgcaaaatatcttaaaagatgaaaaaagttcagagagagcaatcacaaatggatagaaaggaaaattcaaaatgatgtcaagaaaaaactggaatattagctccaggagagcaaaaacttttgtcttttattttttaaactactctcaccctggtacccagaattttgtttggacatagtaagcactcaatagatttagtgaatgagtaaacacattttaaaacatcaaaagtattacctgtattacagtgaaaaatacctaatgaccttctacaatgtgccattctttatgcaaagtactttatatataacagcctgtataatcactgttaaaaccacagagaaagataatcatttattgatgagaaattagaagttcagatctattaagaaagtcatccaaagccatgctgacttcaaagtacagactctttactttaggacatggcataacctccagagggtaatgatattgagaaagctttgccattggaaacacaatttcatagacaagaagagaaggttatgttcacattacttttcatgcttcacatggcaataacattctgatctttaatgttaggatttataactttacactaaatactccatgatctgttgtctaaatggtaacaccaagaatcatcacttttcctctgtaataagatgtgcagtgtctttgtgtgaaatatagctatatacattgtatatcttctagttgagaaaattaatcatgcaatgtatctggaataagaaaaaaatacagcaacaataaaaataggacaataaaatgagtaatacgtttaaatttctattgccagaaaaattgttcaaaatagaacttatgaaagagaaatagtgtagcacaaaacaacagcagaggagaaatgatgaaaacaatgagagaaagagataaattagtgaaataaagttgaaaaaagtttcattttaacatcattgcattttgtgaaaaaattttacacttttacattaaagagtttaagcgtatactaaattgaatttcttacttgatgcttctgctttaaattatatcaacgcttaattaccatttaaagcttattattagttaatttatatatcattactaatgtcagcatcttgtcaggcataagagttaaatataaatttatattccccaggtgaatgcaattgatacaagaaaaaaaaaaaggagttcctttctctaaatgtatcacatagtgatacaactttttatacactacaaatagactgggtcagaagttaaaaaaagtagtttgtagggccaggcgtggtggctcacgcctgtaatctgagtactttgggaggctgaggcgggcggatcacaagatcaggagatagagaccatcctggctaacacggtgaaaccccatctctactaaaaatacaaaaaattagccaggcgcggtggcaggcgcctgtaagtcccagctactccagaggctgaggcaggagaatgacgtgaaccccggaggtggagcttgcagtgagccgagatagcaccactgcactccagcctgggcgacagagcgagactccatctcaaaaaaacaaaaaaaaaaatctatccactatacacctttttgtgttcttaatataatcttcccactgaatacacaatcatatttactaacgtctataaccataaatgctatattttaacattatagacttagtagggttgttacttaaacagaatacatgacaacatcttcatgttctctaatctgcagacaccttttcaggcttttgcaaaatacgtaactgtttggctcaaaatttattacgagttcaaaaatatttttaaatactgaatacaaacagagagtattgaaaagctattttaaatattcaagaggactggagaaaactcctccattaattttaatgatgaaattaaaactgaacctattaaaactaaacctattagtcatcaagaatgatgattaaatgaaagtatcaaacagaatctatgagtccatgctaataagtgtttagatcaattaataaatgagggagtagaggaaaagcctcccatttagaagaattccaattaaattacatagacagtccacactaaaggagggaaagcataaatccttacatcttaagtgtgccctggtgtaagaaacttctttcctaagagtacagtatgggaagggggaagaacagtgacatcacagttgagaaatccgacaagtcctatttcatccaggagatcaaggtcaaatttaatagtcataaattacattggtagtatgtaccattgatacaatgtgaggaaaataacaaattccctctgtaatatacctcccccaagcactagtcttatcaataggaaaagcaccaacaaatcccaacacatggtatgtattctacaatatctgactagcatgcctcaatactgtcaaggtcatcaaaaacaaagtccaagaaattgtcatagccatgagaagcccaaagagttaggacaactaaatgtaacatagtgtcctggtgccaccttggtatagatagaagacattacataaaaacttaggaaatatgaataaactatgaatttcagttaataataacgcatcaatatttattatctaattttaccaaatataccatgctaatggaaaaatgttactaataggtgaacctgtatgctggggtcatacggggattttctgtacaatctcctctatttttctgtaaatctaatttttttctattaaaatgtctattaataaaaataacttaaccaaagagtctaaatatgaatgtgattatatgcaggtctgaagggcataacagcatgagagcatagagagaatgcaaattacacagtccagaggatttgacaagaagtcttcttgctttgcaataagctgcttgggcacacttagataagtcatttaagcctcttttccctggtttgctatgaaatgaatgaacaggactacaagagttctgaggccccactgagctctgttgtccgttgatttacctacaaaatgatgtcaccctcagagagattacaatctacttgagaaagtaaacttgctaacattgaaacaaatcaaaacatatttaggaacatagttcaaggctgggatcatattctatgtagttcatattctcaggatttcagagaaactaagcagcattatgaaatacttaagaagtaagcgagacttaaggaccattttgaaaaattggaaaatatgaatgaagaagtgaaggacaccccatatcccaaataattggaatctgactcttacagcaaattctccttttgcttcagttttaggttctgaatggggtaaaatattccttcaaatccctctatgctttattatcacatatagcatgaaacccaagtgccttacatggtgtatcccaccttccttgacattgtccttgttagttttccaaacccatgtcatgccacttgtaaagtgatctgcattagcacagtcctgagctgtctttagtttcctgcacagactatagttttagtttgaaacctaaatagtgttctgtgccaggacaggactctgtctgggaaagaagtgtaaaacttttggacttggtttggaaatgctcgttcattttaattcctcagtttgttttgattatctgagcctgcagaaatgatgcacccaacatttctctcaatcattcaaatgatttaaaacagatgaaatttttgtatataatatatcagatttcagtgagttgttaacttctgtataggagccaacaggaattttaaaaatctgttgttaaacactaataataatcaaagttgcaagacacttcatgttgagaactacaaagacacagccatagataaagttaacagcgacctggtgtcactgctcactccagggtgtaagcttattgaatagaatggcaggcatgcttgacagcagagtacgcaatgcctttttttttttttttaaatctcccactctttttctattttatcaagcatacataattaaatttgttaagtgaaaggatgcttaaaacacttgcagggatgtttctcaggaacatcctgagatttttttttttttcaaaaattagtgactttaaagaaaccagcatcctttgcaaactcaccaaattagtgtgtgcgtcaccaagatagaccatattttcttatgggtgggatgctagcatgcaacctgggatcccaaaatgtgatatatttacaggaaacatcatcacaaaatgccatgagaaagcagactgtgtacagaatccattctgctaaaggtggcatcagagcatccatctttgggaagtagttgtgacaaagtttctagaatccagtgcctgagggtcagcagtccagctctggtgtctgtatccctcaacagtatttcttcctgcataagccagttagggtgaaatctgttctttgcaactcagagcactgatagacaatccttcttttcttctggtgatacgtttctctaattctttagcaaatacctttttgtctgtagttctcaatttttggttccctccttaactgaaagtaaaaactaatactctgttgtccagtattgtagtctaaacacatatgtatctatttacattaaattagttcaaattgaataaaattaaaaatttacttcttcagtcatcctgaacgcattttaacggcttaatagcaacatgagctaccagcaacaacatcaaacaatgcagatacagaaacatttccattactgaagaaagttctatcagaaagagctgctctaaggcatagaaaatttgactagggcatatgtttctgcatctacatcagagaatccccttttaatgagttaactgattctgttaatggtttcaaattatgaccttgataccatgacatattacattcatctttcactctattattcattttgattttgcaagtaagtttacaaatgatcagattagattcagagctcattttgttagaataacaaaaatttaatctcattactactcattcctaaacattgaagttttcctcccagttaccttctcatgaatgatattaaactccagagtaaaatctgaaggctgacactaacagagccatccttttcagaaagtacatccaactatgttaaagtgttcattttagttcaacgatacctgaaatgcaggctgtgaggtggacatttaggatatgtacctgcctagcatacatttcccatccttttactaagagtactccaatttttgaagtctcccctagtatacaaagtcttggtacttctgtcagtcaagttattttctcactctcccctggccttgtgcttgacttaggaaacaattaaccaattggattatgctgtagaaacttacaaggagggaaattaaatgaagttacttaatctcaacgaaattacccaaatatatgctcatgagttccccttcactagacccccagagctgcccttattttgtccttcctgagttttgattgttcaaaatttactttgcatatgtgtcctcctgcaagattttaatgataatttttagattttgcttttagaatagccagttggcttttgcaaaagtattagatgatatcaatgtgcccatatttttacctacttgggaactttttcaaattacatctgttcttgatattctgaaatgccacgcttacccctttcttatctgtcttggtagcctaccacactattgacacactcatcatgaaccagataggtactttgaattcatctgcctgagaataatttaaccttcatggtctatttctgccaaaatactgctttaatacccccaatatttgttaactctatttgaagttaaatttctatctgtttgtgctttgagagatgttggcaaagagaaaggaggaaaataaactattttagataggcctagccttgtcaaatgtgttggagactttatagaaatcatgttgtcaaagtgatcaatttaaagaaaaacatacttatgtcttcttattttctgtatcaggatgtaactgaatatcttttggttagacatttgatcatatgttattttcccaaaccatcatttcaaggttattatcataagacaaatcactctaaaatctaatagttcaagccagtcagaattgagtgatgaaaatatacagctttatttataagtacattttatcattaggcttgaattggttcagacgtcatgaaaaattttgcatgctagtagtaattcctcaaactccaaagggattagagtttaacaaaattgccaatccaaaaaaaacaccaagcaaacagacatttattttaataagtacaaattacacataattataaatattccttatactaatatttaaactcagcagacagaggacaggttgaggtttgatttatattcacacttccgtcttaaaattttcaaaagacatcttttatttgcttacacatgaagaatgatcagtatcactatctgaatataaattaataagtgaaagtatctgtatatgtaaattcaggcaaactcaggcttaaaaatctaccttattgtaccacattgcaaaatagaaaggattgtaattctttataagtattcggtggaattaagtgcaatgcaaaacatgctatgaatgtcagctgttatatggaaaacatctaccagaaaagccacccatgagtccactcagataataatttttcctcttgtctgttttataagctgttgaggaatatataaaagaaatggaaatttacaaatttcaaataaatgaaacatacatatttttatagctatataatattacatacatttaaatagttacttgtattttattggctcttcggctacattccaaaacttaagcaagttaatttaggaagagccattaaatgcacgttctcaggcatattttcctacttgtaatgttcatgttcaaacatatttttcaatatgtaaaagtaaagtctttgtaaaataaataatttaagacattccttgtattataactgcattcagaatgtataatacaattatggcttggaaaaatcaccttaaaattttgtcttatctttttgttgtgcagaagctccactcaaaagaagacatacatgcgtccaacaaacatatgaaaaaaagctcaacatcactgatcattagataaatgcaaatcaaaaccacaatgagataacatctcattccagtcggaatggctcttattaacgttcaaagaaacaacagatgctggtgaggttgtggaggaaagggaaagcttttacactgttggtgggagtgtaaattatttcaaccattgtggaagacagggtggcgattcctcagagacctagaggcagaaataccatttgactcagaaatcttgttactgggtatatacccaaaggaatataaatcattctactataaagacacatgcatgcatatgttaattgcagccatattcacaatagcaaagacattgaatcaacataaatgactatcaatgatagactggagaaggaaaatgtggtacataaataccatagaatactatgcagcataaaaaggaatgagatcatgacctttgaagggacgtggatggagctggaagccattatcctcagcaaactatcataggaacagaaaagcaagcatttaaagtgggagctgaattatgagaacacacggacacatggggaacaacacatactggggcctgtccaaggggtggggggcagggagaacatcaggaagaatagctaatggatgctaggcttaatacctaggtgatggtatgcatctctgcagcaaaccaccatggcacacatttacctatgtaacaaacctgcatatgctgcacatgtaccccgaacttaaaagctgaagacttttttttttcttagagggagaaactagatctaaatgagtcataaaatacaaatgaatacaaatgcttaattctcctaatacgtcatttttaataaattaaaactatgcttatcagttcatgtgggattgtctaaaaattataaatgaaagatttaaattctctaccttcacaaatcaggtacagctagcattgatgtcattgagatttggctgatggtacatcattagattctataattaatcaccaacacctgcagatgcattctcaacatgaaattacttttgatatcacatggagaaggagagatctcactaaatcttttaactatgagtactttggaggtaacagagatgattgtcatcttgtcacactgagacatgttgattctagcacttttggattcttccatgaatatgttaaaccattaccaataggtcaataacctgcccttttcacccctgactagaaacactattttaaaagagttcttattgatttttttctagctgtttttatttttctcactttctaaaataccaagaaaatatcattcaatgctgcaaaaataacctaaagaaaaaaaatctaggagcatcatacaataaaaatgaactgatttcttatgaagtcagcttcaaaactgtgtaaggcccaattcttatctctgacaatctgttacttaacatttgctgcttaacacttcataaaagtcaagtctagatgaactggcatacttcataggctttttttttttttttttttttttttttttttttttttttgagacggagtctcgctctgtctcccaggctggagtgcagtggcgcggtctcggctcactgcaagctccgcctcctgggttcacaccactctcctgcctcaacctcccgagtagctaggaccacaggcgcctgccaccacacccagctaattttttgtatttttagtagagacggggtttcaccgtgttagccaggatggtctcgatctcctgacctcgtgatctgtctgcctcggcctcccaaagtgctgcgattacaggcttgagccactgcgcccagccacttcatagtcttataaataatttactgtaatactcattaagggcagtaaaacaatcagcagttactacacactgacagattcaagtatagagtgaatgagatactatgtatctactatatcttgaaactaaaacataaataagtgtcacaaatttaaaatatacatttaaaaaagaatagacacacacacaagcacacatacatacaatcacatacacatccaaacacaggcgtattgttatacatgcatataaattaatattaaataaaacttatgttttaacaaactctgtatacttaaattcaccagtggttagttatcccaggcagtattacctactaagccttagggaccattattttcatttaaattccagtagtaggtaaaacctaaatgtcaaaacttagcacaatgtttaatgagtggataaatattagaaaccacgtctcctgaaatcttaggtaagtcattattaggggcttactactttcagtacctgacatttactcctttttttcatattagttttattttttattaaatgtcctcctgccttgaagataatctatttaataaagaagaaaaaaaagtgcttttttactttgaggtttacttgaacataagcatcacctttgtaattccacacaagcgtcacctttgtaatttgtcctttaagacaattagactgttttatatcaatgtattattaaacttgattgcacttatgcaggacatattataaaagaattatgagggaagtacacagatgctgttagagtctactaaaaaatagattatttactattggaaacccaaaggagagaatgcctcaaaaatgtggtaataaatacctgtgggaaaatcttaagttgaagaataatcctggacataattttatttactattgttattatatctttatcctaacgagattaatgactgatgttttcactgcaatttcagttaataggaactctatacaatgaaattgcttgatcaactgatagttttttagtttattgttttattgacacataatagttatacatgtttatggagtacatagtgatgtttagatacacacaacgtatagtaatcagatcagggtaattagcatatccattatctccaatatttatcatttatttgtgttgaaaacatttagtatcttctagctatttaaaaatagatattattgttaaccattgtcattctacagtgctataaaatattagaacttgatcattctatctagctgtaattttgtgttccttaacaaatatctcggccgggcgcggtggctcacgcttgtaatcccagtactctgggaggccgaggcgggcggatcacgaggtcaggagatcgagaccacgaggaaaccccgtctctactaaaaatacaaaaaattagctgggcgtggtggcgggcgcctgtagtcccagctactcggagaggctgaggcaggagaatggcgtgaacccgggaggcggagcttgcagtgagccgagatagcgccactgcactccagcctgggcgacagagcaagactccgtctcaaacaacaacaaacacataaaaaaaacaaatatctccacatccttcctttccctctaacctttccagcctgtagtaacctgttttgcattttacttctatgagatcaacttattttagcttctgcatatgagtaagaccatgcagtgtttaacttttggttcttatttcacttaacataatttcctccagttccatccatgttgctgcaaatgacagaacttcattttttatgtctgaatagtatttcatgtgtatatgtgtcatattttctttattcagtcatccactgatagacatttaggttgattccataccatgacaatcacgaatagtgctgcaataaacattggggtacagatttctcttcgatgtactgattaattttcctttggataaatggtcaatagtgagattactggtatgatcattttaatttaaggaggtattcatcaaactggttgataaaattaactagtcccagcttaagatatctgggatctagaagcactgtttatatactttgcatgagacacagttctaaccatacaattaaaaaaaaaaaagattccaagcagttcatacctgtagcctcagacttaagcttaccctctaattagttaaacattagggcaatgattttctgcctgtattttataaaatgtcttcatgctggtggtagagtgaatgtggaggaaaagaacatatttaagtggaggccattcatgatataagataccatggaaagcttgagttttcagtttaggctacagaaaatgcaaataaataaattaaacagttggtttaaaatattactacaagtaggattttcccctgaaggaaggcttggttttgtcatgttttatgctcggtttgttaggttttattgttggcttcatatgtctcttgctgatgggagtatgtgacgtcaccacacggcatagagaggaccaagaagctgtcccagtatcataacagaaggagactggaggcaatgtgagaaataaaaatgcagagttaagaggaggtttatacaaagaaagaactagggagtgcgaagaagagacataatttaaaagaaatgttttcttttattatggaaaaatatgctgtttatagtataatgtgaatcctcttctcattatttttactcaaacttcattaaaatatcaatttctggttgatgcgttgtgctttttaagagataccacgaaagaggacttaggtggttattctggaatatgggtatttacgatgagtaaggtgactattttcatgcaatcatttcagaatcagcactgtgagctgtcctgccttaagacaatcgttgcgcacatctatacaatactatctatttcactccaccaccataccaatcatcgagcgctggctgctcagcagggtgcggatgtgtacttgaccatagccatagtggttctcttgagatgcagacagtttctacactaaaaatgagttgacgtttaggagaaagaaagaacaatcttggtggtatccatttgaaaaagggaagcggaacttcaaggaaatattggcacaaaaactaagactgcttacaagaggattacctcatctgggttagaggaggatttcaaggatatgaggcgctctcatcacaataaagcagacattcccaacagtcacagaagcaggcaaatgaaagatgatgtaaacttatataagacttgagttgcttcatcttaagcatccatccaatttcagtacatgggttcttttgctgtttcaaagttctttttttttcttttagtactgtacatttccatataaactttcattcagagtttttacttttaaataatttctgtagctgccttttgtacttatttgaagaataattgaaaagaaaaaaattgagaaaattaaaacagatttctttttgccaaaagaaagtattggtaatttatagcaaagctggaaacgagggcctcttaagagttttccaaagtatgtcagctagtagcatggggttttagatcttttctttactgcaatcaatcctgctggaaatatgaagtcagttcagaagatcagtagagttgagctagcaaaagaataaaaatcctgaaaggagttattaattatgtgcatactgtgtgcagacagaatcagaagatactggccaagacattatgaaacaaggaagaattcacgagaaactttgaaattgccatatgcaagatgcaagttccctttacccaattttgcactcatcttctgatgctagaaaagcaaatgagaatgttgctaacacaaatgttatgtatttgcactgatcgagatgggtgagttcaacaagggaatccagtctcagtgtggattactgataaatgtccttgcttttgtgctagcctaaatttctagtgttgagagacacattttgtgtagattccctatttatattacattaactaagtatcttgaggatatgatgatttcagtaaatgtcattcacacaatccatcaatagtcccggggtggaggggcgttatcagctattgtttctctgaataagtattatcaaacattgcttttctgctatacagaagcactatggaatgaaaccacaaagtctgtagacaatgtttttgcacactgtaaaaattttataaagtcaggtttcatttaatttacacttttgtttctggttagtgtttttactataatttgggaataatgtacagtggtaaatcattgtgaagtaacactgcattctccttaaaattgggatgtattcaggcatattaattatttcaggattcattaaatataattctaaaagagtttctctttaaatatttatctactcttgactggtcgtattgaatctcacattcattactaaaataaatttaagaggccttgataattgcagaccaaatatatagttacaattgtcgctatttataaagaggttcaagaactctaacctataattcacattaagttgaggcatcaaagaaaaaaatacacaaaaaaggcatgttggcagtgatggtggtactaccaaaggtagagttgggtttcattcctttcctgttccagcctatctattgcttttaaataacttatgctgctcgtgtgtgaagggatttctccttttactcacatatttacaacctctaattcaggagagagattagagatagagaatctaatacccttttaagttgcaggactataaaaacaaaataggcctcactccacttttctaaggcaagattctaggaaaggataaatatattcatgagtcaaaatccactacaatgaaataagtaaccaagggtaaatatattcatgagtcaaaatccactacaatgaagtaagtaacctaggttactgaccagaactctgcattgaggataaagccaaattctttataacctcaactctgtcagagttggtagtaatcaggactaggattcagtaataagcacttttatttaatatatatatttatctgtctctctctctctatatatatatgtatatatatatatatacacacacatatgtgtatatatatatacactcatatatgtgtgtatatatatacacacatatatatgtatatatatacacacatatatgtgtgtatatatatatacacacacatatatatagcatttcttcccctttctgttcaatacagcacactgattctttcctactatgtgatgctccgggctggtatgtaaatcaagaggcctgccttccctagccaaaatgtgaacacagcagagagttagcagggtgtaaatgaatcctactgtcattcccaataatttgaactgtgagtacaatgacacaagaatgagaaaaataaatggacttcattcattcaattggtggtgctctatcaacattgtcgatttgtgcttcctacatagacccctgaggctttactgcagcatttttataaactagtctcattctcaaaccttctcaacatttgtgtgggctaatattctccagaaaagatccttttatgattaaattggccactattggtttatgttcatgcaactacagaatcataatttatagcacatggcaagcatataagaaatatttgcacttattcttataaacagcagtggtaaattctacattgtttagccctttggggtggtttgcttgaattctatatagaattacaaaatgttccgcagagaagttctcaaataattcttgctgtcattcatgtaagataagtaagacactacttcgtgtgaggtgccacacataagttctagggaatacttcatcacttttgagcaagccagcaagaaagcccttaccacaaggaggatatattttaagagaaagagaaatgtgagtcaatcagttttgatagcttatatgcaatggacagttatcagtctgagcttacattacatttactaacgtaaatacaaaaatctttgggacatggtgagagatgtcagcattagctagctgtgggtcagctgtttactgcaaaacctgcaaggcttgggaactgggagaactgtttgttctcaagaggagacgtgaaacccgaaatatctcccttgaggatgggattttttaatgtacaattctttatatttttcactaaaatctatgtaattttctttcacaatcaacataatctgacaaaaatgagctgttcctcataatattgagacattcttggaaacattttgaggaaggaaagcttaggaaaacactatcaagtttctggccaaagagtagggctccacacatcaggatttgaggtatgaataaaaatgaggcatttttacactcatcaggtgataaagcaattgtgtaaaaaaaaaaaaaaaaaagaaaattctagaatataaattatcttttaacgaatgagaacaaattactttggagatatttggtagcttccttaatcatagtagctttgaatgatatagatgcccgattgtcaacagagatcaaaactaaatcagaaacttaaaatggcccaataaaatgtaaagctccttagaaaaacagcattgctataaagtctcaaatacagtaatgtgggagaaaatgacacgcacagcctatggtaagggataagagctgcaatatggagaagtttatcttggattctattttattacctctacctaagccactttttaataaaaatcatcaacagttcacaccataaaacattttggacctagcccaagtgagaaaagtcaaatatatttatatatgttttttggctttttaagagattatttattttttattatactttaagttctggggtacatatgcaggacgtgcaggtttgttacataggtatacacttgctatggtggtttgctgcacccatcaacccatcatctacattaggtatttctcctaatgttatccctcccctagcccaccatcccccgacaggccctaagtcaaatatattttatatgagatccatagtactcacaaaatttaatacatctatgtagacattgtcaaatataggaagacacttaacatatttctttgaatatactgaccctttttatatattaatgcctgtgtatcaaagtacatttcatacacagtttatcttctcctgaaatgtgattataaaattgatactctacaactgatgaaaagctagtaattgaaatgaagtcattctaatgaagcaataacactaacatagttttccaataaatatactgtgaatgacttagcctatggaaaaaggttttgaataaaaattattattttctaaatatctgaactgtaagatattagttctctaaatctatcttttttcttttccctggatttgaatatcatagctcactaaacatctttacaatttgcttcctctaaacacattctttcttctggaaataaaatggtgctttgaaagaatattaccaataggaagacatatttcaaacacgaggttcctgctttcaattacctaacagctggtactatgcgtttacatttagaaagacaaaaccttacaaagatgtattatgctttttcaagtaatttagatttgtcacagtgcaagaaaaactcattggcaaataattcaaataggcttgtaagtctcagagataaggggctttaaaaaaagcaaaatacattctttaataagcaaagttatgagacagatctataaaatagaattgagaaatctttcaaagtattccatgcagaacagctgatttagtaacctactgtgaaaagaactattgatactccaatagcagcggtgatacagtgaaaaggtaaattttgaggatgcgatatgactgcttgatctagtagtacaatactgtgaacaagcagggactttgcagctagacgtatttaagttccagttctgactccataatttacactgctgtggttcacttaaaactctgtgagcctcagtttctatatctttaaaattaggctaataatgcctatgtaagtgttgtgaaatgctcagaaatataaactaaaatcaatgctattgttttcctgtcatctggcaaagagtattgctccaattttatgtgtcaagtaatgtaaaacgtaaaagtactaacctaccaaatctgttctttttctaattgattacagaagaatccattaactttagtggcaagaatgtctgttatctctcaattgttctctcccttcaggctgatttttttgctaatatctttggtgctgagataatccaaaagagaacccccatctcctttagtggcagagctggcacaagcttatacacgacctcagggacctaagaactagcccaccaagcttgctaccactggagtccccaacacatccagtggtagtactgccacacacaggagagctggccagcccaatatctttctctccagcaaggcctcaccacagtctctacaaacaactgtagtctatgctaccaagacactcacccataccactgatgttaattgaagtcagagaaatcacatggagactatactaatgtgcccaccagaacccaagccaaagcactctaccaaaccaacactctaggacacatctacaggaaaaaaagtcttttcctataaaagctactccataaaattggaagaagaaactattccaccagttgcacagatatcaatggagggatacaaaacaggtaaatgcaaggaaacgtgacactttcaaaggaacaaaataattttccagtaagagaacccatctctaaaaggaaatctatggaatgcttgaaaaagaataataataattaacaaagaaacagatacaagaaaacacagaaaaaatgtttaaataataagaaaaataatttatgatctgaatgagaaattcaacaaaaagataggtatcatgagaaaaaatcgagcagaaactctggaactggaaaattcagtgactgaaatgataaatactactgagggctttaaccataaagtaggaattttttacttgaagacatcttttgaaataacctcatcaaataaggagaaagaaacaaggaaagaaagaatgatgaaaaggaaaaaagaaagcaaagtaaacatagtaaagaaagcctgtgagacatatggaacatcattcagcaaataaatatttgcattatgaagtttctgatgaagataagaattcatagaaaacgtgcttaataaagtaagagctgaaaaattcccaagtcttcagagagatatggacttccagagtcagaaagattaaagatttcctagtagattcaacccagagggttttcttatcgatacttatagtaaaactatcaaaagtaaaagacaaagagaattatggatactggagtctccaaagtggggaggctgggaggggaataagagagacaaaaagccacatattgggtacaatcttcaccactcaagtgatgggtgcactataatctcagactttaccaattgtattaatctgttttcataatgctataaagaactgcccaagactgggcaatttacaaagaagagttttaattgactcagagttcagcctggctagggaggcatcaggaaacttacaatcatggcagaaggcaaaggggaaacaaggcacctttttcacacggcggcaggaaggagaagtgtcaagtgaagggagaagaacttattacaccatgaggtcctatgggaactcactcactatcatgagaacagcatgcaagaaattgcccccaggatttaattagctccacctagcctcttccttgatacatgagggttatagggattatgagggttacagttcaagattagatttggttgaggacacacggcctaaccatatctccactatacaatttatccatgtaatcaaagaccacttgtacacctaaagctactgaaattttaaaaaataaaaaaataaataaaaagatcttagaataataataataaaaaaaaaaaagcaagagaaaagtgttgtcacatgtaggggaatttttaccagactaagagcagatttcgcggtagaaatgtaacaagccaggaataatgggataatagattcaaagtgctgaaagaaaaaaataaaagttggtcaaaaatactatgtccagcaaagctactgtttagccatgaagaagaagtaaagtctttcctatatggacaaaaactaagagaatcaattcatcaccactagattggcctgaaaataaatgcttaagggagtccaacatctggaagcaaacagatgatatctaacatcatgaaatcatgcaaaagtagaattactgatggagaaaaatgtaatccaaggaaaattgtggtgctatgatcagaaggcaaaaataaatactgggaaaaaggcaatatatatttgtataactctgcataatcatataatatattactgctttttgttttgtttatatctttatacatgctggttttggtcttgaataatctgaagatgaatctatgtgaatgaattaatttttatatattttattttttctacctctgacttcacccagctcccaacccccatcgcatactgaacccattaatggcttcatttccatcatgtcagtcatcagtccttctctaagccccaagacatccctgaccaagacaggaagtgtgcctgcatttcagaacggaacacagagttcatctacccgatatgacccaaatatcagatcagaagaagatacagagcaggcaaaacacaaaaaggaaaggcagcataaagtcagttccattttataaaaatgcctttcttttttactcttcttggaaaataacttcttgttctcaaacttttggtgatcagaaaaaaaaaataactttatttttttctttctgatacataggagcctggagcctgcctcaacatttttttctcttattgttctacctagctgcatacctcagtattaatactagaataaaatgtattttgcttttctttcacaatcccctcctcctttcttaagcttcatattttagctctctaattaactcccaagtagggtaatacctaataagcattatgtatacaattcctgagagactatttaagaaacaacccatagagttatcccttgcatacctttgatgagtttcctggatccccttttgatctggattaattaatgttcctgagggagtgctgattttctagcattcttccacctttgatgcagaatctcaaaattcccttgtacaataactttgggtagcaacatgaacgcaaatggctgttcagatttcaagaccttctatactaattctttgtaaacttaggctgagacaagggggaaaaaagcatgtagcaccctggataaatcttaaattctgccatcagagctaagatttaccgtcatctgtttctgcagagacagacatttttttttaaaaggcatcctatgcttgactctaaatcctcacttatatcttcatcaccatctagagatggagcacctcagggaagttccagggattgccatcagcacccccttctctctgatacgttgttaaaggtttcctttctaataaataatttattgagttcctagagctatagactgaagtgtttattttggattctacattttttcattcaataaatgtattgagtgtccacacttatgatataatatgcacttatacttctccaggtaaagtaatataagaaattgtactgattggtgcaattactgaaagtgaaagtcccataatcaccgtcagttataattctgtgcttttagaatatatgacacaaaaccggcagcttgatgagagcatagcagtcatgcattcatctgtatatcaatgctaggataatatcatctgaggagtccatagttaaagtctcgaatgtagcttttgaatgaatcatatatgacatacataatcagcaagaacagacacatgattctactacttcactctattccaccagttaaagtttgagctcctaggagaagatctttcatatacaagacttttccaaaataacagataaaaacatagacacaatagtcccaaaaatattttcagagaattcaggcaagttatttttcaagtatccatgataatgctctgtttatagaagtcaaagacataaagtacagattattcacaagaaacagctgtcttgagaaacaaatctgatttattcatttaataaacatttgttggcaccatgcaggtcagtactgttgggaatatagtcataagaaagatacgtttttattaaagcagaattttaaatgaagggtatgctttgtggaataggattttatagatctttgaatttatgtcaatacaatgaaatgacaaaccgtagtttcttatcatttagtcttcaatatatgactttaggttttcttcttatcaatctgttcctgttactaagaaaacaatttatagtattttataataatgagaataaaatcaaatagggtatggcaggtcttcatattattattacaattgttcttttataacttgtatccattgcaattttctttgctaatttcctcaaaagttaactatgtaaagatattatatttctatataatatctctagatttgtttgttctaggttttacttgtctaacctagaagattatcctacaaagtccatggcctttaattatctaactttgaaggtatcatctttagatagaatgccaattttgattctaaaaaacttgatcttgctgtacatgtgaatcacataatgcagttaattggttcattaattatctataaaaatgtggaaaaagtcctaaatggttgacaaatatatgctaaaagcagggtataaatataggccaacatttaaaaggtttccaaaatattctacataaagataaaaaggaaaaaaaaacaatttttacaaaaatcatcttaatgtatgctttgtgacagttacacaaatatataaagtgtatgatacaatcctttatctaaaagcatttatttttcaagttttgaacttgactttttagaaaatatgtctaagtttttacatatcattatgtgatagtcaacaatagtgtcaaaattctaaacaatttgattcaatgtgagaggctactgcaatgtttctcacttcagttactcttaagtattctcttctgcaaggcaagttacactacctctatattatctaaaagtgactcttctccaggcatcaagagtgcagaacatgacaggatgagccagtatggacttttcaccttcccttcatggggcagaaaaacattcaggaaatcagagattttcagtttaatcatcagggcatgaacctcagggctcaaagctgctgagagccaacatacggattttgaggacagattcaactagcaaagccaatggagagatgcatcccaaattcatgtttgagccttaagttcagcgaagcttgtagcaagccagttatatatcactaggttttcaattagttagaacaataaatttatttatcttctcttttgaataaacttatttaggcagaaagagagtatccgagagagcgtgaataaacagcatgagaaaacttggaatatcttagcaacgcaatgacaccataagactggcagcactgtagagaaaacagagtaagaaagaagagaggcacaggaaggggagaaacaaaaaataggaagggtgaccatcaggtgaaaaataatgagaactttcaggaacatatgggaggaaggtttgactctaaagctattaaggggatagaattaacaggaaaaaatatagcatttgaaatacgagcagaaacaaacagggataaaacagggctgatatatgggtttcaagcttgtaatatgatattagatgttattagtagacgaaataagattataatgaagaaaaattagaggttaggaagcagggatggagaagagatcatgaacttagttttacaccttatgaatctgaaataatcatgggatatccaaatgaaagttccaagagacagttggttatgcaggtctgagctatggaataaaatttggagatgtcagagatacaattttagctgccatctatagacagaaattagttaagaatttaacggtagataaaataaatcagaagtaatatggaaggctggaggggaaaaaaataagaaagtatatctgagaacattaacgtgtgagatatacatagagtaagaagagcttgaaagtaaacctaaaatctgtcttcagtaataagatttaaaatgtaaataattataaacaaaaaataaacaaaaggtgaaagttatgctatgtaaaagtaggcagaggagagattctaagatgggggaaaagtcagcaatagcaagtaatgcagatgggtcaaatcttccattgagtttagcaagtcattggtgacaactggtatggggcatctcagaaaaatagtaaaggtggaagtaagattgcagtagagaaagtggaattgcattaataattcactcaatgggtcatcgagtttgaagttgaattcaaacttatgaatctaattctttatagaatcaaggtcctctagaaacttggtcatttcctatatgaaactttcaaagaagatatttatattccccatgagaataatactaactacatggaatatggggtcacattgaatgtctcaggaattgttgctgattttttttctatgagaaagcataagtacgtctaatatagtgaatggctcccaaaacattcatatttaaaattcatttgacaaccaatatataacataacatttataagaatgtctttggtatgaccaacaccaaagcaaatacaaaaacaaaaatccttaaagacatactatgtgtgaatgttataagttatccaaaaatcttgtttctattttgtcccttgttaaatttttaccctatgacttgctgagaagctgcaggagagagaatttcctgatgagttgtctaacagcttattctttcctcctgctatgtcctcaacatctatgttcaatattaaattgcactgcagcggagatgactgtgtgtgtgtgtatgtgtgtgtgtgctttaagcaaaagacagaggcttgagtgatttagtagctacaaatataaatcactgacaagcaattaacatatactttggttcaaaaccaaatatttccttagcaacaatcataatcactattttacagtgaaaattggcatatttatgatatgttgacattaagatattcagtaagcatattgatgtttaaattccatgtttaaatgcaactatttataaatcaatcatcccacaatcaccttttcttaattttgaagtgcaaatatgtgagtttaagattttagattgaccaaagtgcttatttgttttcttccacatagctcagtttaaaatttgtaaaaagtattaaaccacaggaaagaaaagtgataaaagcaaatatgtgattcagcaagtttcttaatgtttgaaagtaaatggaaggtcataattatttaaagcagaatacaaaaatatcacattgaaaatggcaaaattgggtgagtatggataacatacactatcaaattgactggagaaaatacgacaaacttaacaaataagggtagcatgaaaatcaagaaagattagtggtgtcagttaaaatattaaataaaagtataggtaaattagggggatccttccccaagttctgagcaattttcccataagacttctccttccccataactaagattttattttctgaagaaattgtcagagagccaccagacttttaagtcaaagaaagtaaggccaattctttgcttgagtacaggaatgtctacctgctgacaagctctgctcatacacagaagatttccaaagagcatctcagtgcccagccactagtgacagtgacaactatctattaaaaatccacacacacatttttacatatgtatatatttacatatatatatatacctatatatgtaaaaaatatatatatgtatttccctcatcttttagaacacaacaagagtatttatctcaacttcccaatagttaaacttggccttgtgactgagttctagacaaaggcaggtgagaagtcccatgtgccacatcccatcctatcttgatttatgaaaccttctttgcaggctgcttatttttttcccgcagaaagttgtctggggtaacaaatcctctgagcgagcttggaagccatgtgttgcagatcattcccctggccccaaggtcctgttgacttaaaatccacccacacagagatacatgaaaaataataaacactgaacaattacacgtgaagatatatatgtttccattgcctacatactcatctaataatttaatgtgaatggagaagcaggattaatcagcctctttgaataaaacctgaaaccctaaaaatggaaaataaaacagaataaaaaataaaaggtgggaatagggagaggaaataatagagaggtagctaaataaaactgctttaaaataaacatcctcacaaagataagaaaatataattttaaaaaagcaaatgacttagaggataagaatgagatcttgagagaaaaatattaagacccacaaacaaaaataacaataacaacaaaaatactcaaaatactcctagaccaattatctttcaatcctaacacagcacctgaactgcttttcatgtttactaataacctccatttttgaaaccagtaattatttatcagttcctgtctttttggaatcattaatggtatttgaaacaattgatccttataagggcccagagctcttcttttcttaaaataaaagaaatatgaggtagtactcagcaatcaagtagtccagataggtcaaatcttccattgaatttagcaagtcattggtgacaacaggtatggggcatctcagaaaaatagcaaaggtggaagcaagattgcagtagagagagtggaattgcattaataattcactcaatgggtcactgagtttgaagttgaattcaaactggagaatctaatcctttatagaatcacagtcccttagaaaccttgacctcttcttttcttaaaatttaaggtccacagaccttttcttttcttaaaatttatatccagcccaacttctcttctaagctctaaacttgcagggttatctaatttgtatgcattatactcatctcaaacgtaacatgtttaaaaatgagatcttaatttgcctttctaagctcatgctaatcttcccatctcagtgacaattttaaaaatcctgaagtcatccaatctctctctctacttcatatctcacatttaagccatcaatacattatggtgattctatctttaaaatgtattcagaatcaaaaccacttctgaccaccgcactgctaataccttaggctgagccaccatttctttgtgcctaaattattgcttgggctccttaatttctcatttctgctctcatctacctgttgactatttccacagagcagggagagtagcacctttacaatgtgcattaggaagacttctgatttcattaagaagcccctcttgttacaacacaaaagccctgtacacaacacaattaatgagcatagaatgaccctgagaagtagaaagaacaaggtgaactggctagagacctaagggccaacaacaacatggcagtgagccctctgggtttccttattctggcccataatctggggcagggctccaaaatggactggaatatagatgcaggtccaaaaagctccaagaaaaatatctttactctaaacaaaggaccagaaaaatggtggtctaaaaacagaaaaagttttgggaaatacttgcctactccagccaaataccaaggacaaaaattgcaccatctctaccccactagtgacttcagcaatgtcaagtagggagcagatttttcacaaatgacaaccttgcttctgagaaagcaggtagctgccactaaattcatctactcaaggagctgtgatgaatggttttgtgtgtcaacttgactgggcgataagatacccgaatacttggttaaacattattctgggtgtgcctgtaaaggtgtttctgaatgacattaacatttgaattggtaaactgagtaaagcagactgacaacccaagtgtggatgcgctttatctaaaccactgaagtcccgaacagaacaaaagttgctctccctacctgtcttcaagctgggacgtgagtcctttaccatcagacttgaactcagactggatcaataccatcagtattcctggatctccagcttgctgactgcagatctagggacttctcattctctgtgattacttgggacaatttcttgtctatctatctacagatagacagacaaataggtaacctatttgtcacctatctaatttcctattcattctgtatctccagagaaccctgacaaatacagtaatatagccaggttgagcactggcagggtgggatcttatatctcattcactaccagaaagaaggaaatgtactgagtcccccattcccaactcctacccatatcatgctgttagcagagtcctccacctggaccaccaggtgagctaggtgagcctctattcctacccagtaccaagctgacttaattaaggaggcaatatgaggatgatcttgtcaattgtaggctccactccactactccatgtcaccaccagcacccaatatcagtaggctcaggggaactgaaccttcatccccacctgggcatcaatgagattgaaactgtgttgcaagtctaggctagttagcactgcgctttatccccacccttggtgtcagggatattgagtagctgagcctccacacccattctgcagcaaaaaagtattgcaagtcaattctctattttcaatatctctggtggctctgggatacaggagggaagctgagattttatacacccacccagaggcaatgaggcagtataagtctgggtcttaaaactgctgaaaggaggactgccattctgaaaaatcatggaatttagtggccagcatttttgaagacttagaaaaatttatttttctaagtcaatttatctattgactatcatgatctgtggaatgtctcaaaaaaatttaaagatacaggttcagcaaagtaagctgaaaaaggcatgaattaatgatagaaaaataaaaaattagaaaagaatcacaatctatttttgcatattgtagtaaagtagccataatttatatatgtatatatatgcttatatatacatatatacacacatatatatacatatataaacatatatatacatatatatacacttgtgtatatatatgtaaaactgtgcttagaacttggggtaggataaaaaatgagctgatggtataaaataaccaaatgttaaatagcgtaataggaagaaaacaatatcttgaatcagtaaatcaaaagataacatcataatcatgttatttaaaaatatgtgaataaataaaataagaaacatcacaaaaaagggtttacaaagttgtataggaaaacttgactaaggggcaggaatgtgttcttttttttttcattatactcacaatttaatgttcttttttgaaaacaatgcacagctatttctttgattaaaataatcatgaattctaagaaactgctttgagatatatatatatttcctttaagatatatatttctttcctttaagatatatataagatatatatatatcttatatatatcttaaaggaaatataatctacatcaaaatggcaactatttactaaacatgcattttattacataaacacacagcaatgctctttgctttggcattttctcaattacacaatatcttccattcaagttaccatctcctaaaaagttatttgagaaaatcttatttctcacaatgaaaccttattatctgaagctcagctgaatattgttctatccttagccctaatttacaaatacaaaataataattaatataatgtatgctattgaaagctcagtatatcctgagtggaaatttttcaataaaccttataaatatgcctgaaatgtttgctgtcatttttttgaaaaatattagcacaccaatgcaactatagctaatgttccaaatggagtattttatttcatgcttaccgtatcagatggaatgtaaggttaacagactttcaacacctcttaaatgaagggcttcatgcacacacattcagaagtaaaattaatcagaggggcaaaatctgtacctacctggtagaggttaaatggatggcatatttaaaatcaccattcatagctcctggcacacagtagactctaaatattttttccttctatcatttataagataaattcaacaacacatcaaagaaagtaggaaaataaacattcaaaccaaactcttgcattcattcctagattgctttttttaaaacatagtcaaacagtagtaataacaaatttagtaaaaagttctgaattgtaaaattcaaaaattgtttaagttcaaatttttaacataaaattgaaaatcaaaatttgagtactttactttctggcaaatctctttatttatcataatctgccttatagctagggatagccttagtactttcatattatacattttcacttacaaaccatacacattctttatgatgatatttctcccatcttttcttgaaattcagaaaaagaagtatatgtgtgtctcatttaaaattctccacacttcttagttttatactttttttctaacttaatggtccacttttccttgtccttggtcgatcttcactcatcttactataaacattcacttactttttaaaaattcctaccgcctctctcttccaaaaccagtccttatattaagtaattaaataaaaatgaccaagtcaccaccaggacaaaataaatgtccattctcaaaactattacttcagttggccttaagaaagtaggatggacagtagggagatatcttttctagtaattctgcaaatcaataccaccattctctgcaaagcagacaggaggaaattgattgtttcattgcaatgtttcatattaaaaaaccaaaacatcatttcagcttttccatactctatggaaactaatattcagagcaaatatgtattctttcatcaaatatttattgagtacttaccaaattttggacactgagctagttagtggaattactaaaatacaacgtgcaaggccacaaatgaaatatgctttttcatttaattgagagcaagactatgagatagaaaataatacctgagttttccaggtgatgcaactatagcttatcaatattaaattactcactatattctgtgcagaataagggttgaaacaaggatttaacttgacctctgatgccttgacctctgatgacaatgcttttgctttcaagaattatacctaaataattatgttgatgtcaaggatgatgatgatgataagtatcaatctccatttactgaaatataccttggtttcaggtcctgtgcttgcatgctttatgtatgtgaattacatccttttatcaccctttacagagagaaaccaaggctcagagaagttaaacaacttgatccttgctggtaagggagtggaatagaattaaagctcaattccatctggttctgtattcttttctttaccatcaattctctatagcaacagttattgaaacttgaagacccatctcacagcctctctcttacatacacacatttaatttcattctccatgcttggatcacaggctctcttctctgtctttctacattatctatctatctatctatctatctatctatctatctatctatctatctatgtatctatgtatctatctatctatctatctatctatctatctatctatcatcatcatctaggtatctatatctatatatcaaccttcctattatctgtatgtatgcctgtctcagtctccctttctgtctctatctctcagactttctgtctctatatccctttccctatctctttacatttttttgtttcattttgattattatttgtctttctggcaatctgtctatttctgtctttcttgaccctgtgttttcccggcctgtctgtcactctgcttctacctttctgtctcaacctatctccacttctctctctttctgttcttttctaagtgtatatctcagtttctctttctgttccctttctctttttcttatatttgactgtctctaacttttattatgtttttccctgtgagtctctctcattttctttgtgtgactatccctgtatctctctttgagtttgtatctctgtgaatatctttctgtgacttatctgtgtctgtctctgtctctcggacagagatgtaagattctaaagtaataaaaacctctcatccagttttaatgacccttttctggattccagtgatgtgctgcaaagttgaagaaataagtcccttaaatgataaagcaaaaagaaaagtcactgtccttggataaacaatttgcatttccataaggattcagtgatgcagaatcagaaaaggctcattctgacacctccatgaaaacaacagggagagcattcattagctgggcttccttttgaatgatgcacttcattgcacacaccgctgtcctcccccggtcaggaaacagtgcttaattctatcggaagtttgccctttcactaggcatgagaatgaatgacttttcaaagtaataggaactacacatctgccatggcctgagaatgcttacactctaaaagccatacagaaagttacacctcctatcaatttcttatccatcaaggaacacaataaacaagctttgaacttttccatttaccaacttgaaggaaagaaatgcttcattttctttagttttttgaaataatgactgcttttgcctcttacatttatagcttcaatagccatgatctaattttaagggtgaatgcaacctttaaacaaggtttatgatataaaaggaaatttgtccattacagtgctcagaaacttttactctttaggtgaaaattattttgttgctgttattgttgaaacacacacacacacacacacacacacacacacacacacacacacgatcatcttaggaagtaattggacaagattaaaacaattaattgtatttaaaattatttagcaatttacaggtttcttattcattttgctggcttcatttataagttatgtattttaaatgtggacactgaggaacaaatgtttagagggtgtgctgaggttctcaaggaaaataattgttgtccttcggacagaatatgatgtttctatgctccttatattaataaatagcacacatgtgtatgtgtgggcagggggggagcggggtgtgtccatcttactcagcgtgactgacttttaggctgagattaagtcatactcgtctacatattcttccaagtctctcacttcagtttatacaccacagttgaaaattgtattttaaggtcaagctagtcgctctcacattcaaaactacctcccatcctgcccctgccatccatacatgcaacgaattaacatgtgcatttggaatttctgggtgtattctcggttcttgtcaccatttcaacctaagtgcttccagtattcaatttaaataaacgttacagtttctgggtgatttacacctctggaatttctatggcgactctatcaagagaaaataatctggccataaattactcacattagctttttttttttcctcactcaaaattgactatgagcactaatgagtcaccacacttccttccaatacccttggatgcaactcagtcatatttgagtctgaaactaataaatgaagccccacaggtcactgttagttttgaatccacattctctcatgctatagtgttaacgacaacaacaaaatcccattacaaaagaaaatatatcaaacctcaaacaaagttttagttgagagtaacaaaaatagtttttggatgccatccctgacaagtaaaacaatcttttcaatattataattgtatagtcttattttgcatgtgaaaaccacagatacatagaatgacaaaatgattctagttcacaagtggtcccgatactaagaactcttttaaaaaatggaaaaatacaaacaaaatgactatgaccaaaacccactcttaaaatagagtctgaagtaaaattaaacttttagataataaatatgatcattttatgaagtagtgtggtctctttgtttagattattatttctgctaacttttccttgtgttcaaatcctgagtgaaacttaaaaccatgtatttctcccagcattagggctacaataaaatgtaaatgtatatggggggcttctgtgttaggaagaagttaatataacagctcgtttatgaaaagctattgttttacaccatttaagtaggaaaaaaagttcctacagtctgaaattgtatctgcacatttacagaaagggggagtacactcatctacccaataaagtagtcacatttatgaaattactttataatttttggttttacattttactattttgagaaggttcataatttgtctaaggagtaaaagtcctcatgataaagtgataacacaaaggaatcattaattcctcaacatgtatttgcttgacgtacgttttgtgatcaaataattatagtgatttcctttgataaaaataataattaccttttgcctttaatttcaaacataagctatgaaccaaatactggagaatttttgcaagtggcataaaaacaatttatgtctgcctatctgctgtgaaagttgtataataaaaagatacaacacataccatgcaaaatttaaatgtgaacaaattaagagcaaagttgtaatggacatttatttttcactgggtttttttaaagcataattattagtgttttttaaaactatagttcagatacttatcaaatattatcagtgggtataccatatttttaaacatttcctagaaaatgaaatgttttatttaaatctttttgtgaataatattcaaaacttcatgccataattttccagagaagttgctgacacttaggtagcacaaactctgacctgttcaggtcacttaatgattatgtttaagggtaatttggggggcaaagttgtagggattcacatttcctgctcagcacataattgcaacagctgaggggttaggaggtcgccactcagtggaattgggcacccattaaatggcacttttatttcataggagaatgagtccacagtcaaggggatcaagttgctgaaacttgaagacacacatgtacagatacattcactcattcacacttagccacaacttaagcaaactaaagaaactaatagtaaaaccaattttctgtgaaaagaaaacaaaaaaacagttcacatgagcatatacaacaaagcttcatacctgctgtgcaaaccacagcaagcattttgcgctcaaaatatgcctcttttacagattatttgtttctctaatgttaagcaacataataacttaagtatttggttactagatttgacaattggctcttttgtgaaagcaaatgagtatgacttggagttaaccttacaggaggccatcatattatactctagttaacaatggctttctgcatacgtgctacaagtccatcaaatcgatggccatctgtgtgtactagagacacagagtatcaacacactgaacctgaaacttgttattcagggcccacccactctatagctaccaaagtatattttttaaagtaaaggccacatcacaaagtgggaaagctgttaatactatctagcattaattctgtattagaaggatacagttgacctagattcaaattctaaatggttaatgcttccagatacgcacaaaggaagtaaatattctaataaactaaaacatccacagtaaaaatatcagtatactcacaaaagacaaaaaatactgttcattgtgaggcagaattagctactttaactcaactgccaactataacctccagcaacaaccactcataaaacaaatcatcaatatttgcacacagaaaaacaaaaagtcaattctgatgccatttttctgtattttttcaggttggaggaagtagaagaagtggttgaggactaaaaattcttttaaataacaaaccagagttataattcaaaagcttgtgtctttgtaaagattacattgtcatctaaacaaaattacaataccagacagtaatcaggaagaatgaaaggacaggcagttgtgttcactcttccagcaaataatcacttgcaatcattactactctattctttcaacaagcatgacagaaagtagcatcatgacagagatcattgtactgaaagaacatcttaactttctctgtggttcactgctgccttaaatttgaaaaaaataagagaagggcgggggaagaacttacttgcggtttaaagtttcatctttagtccatgtaagattatgcagcaagttttcttgccaaggctgcctcttgcacatccctttaaaaagaaccagtgctcataatctagttccaagacgattcattcacatgttccacctcttgtttctgtgaggcattgatatccactctcatatcatcaagaaaatgttactaggaaaatttttagaaaagcaaaacagttcaacatgttaactcagaaagcataccatcattctccacgttctgagatgtatgccacctgccttagttaccacaagcaactaacactaagctgctagcaggaatctgtctgccctctatctgtcgctattagctcagcacgttg

SEQ ID NO: 926 - DNA, 980192 bp, Homo sapiens; identical to SEQ ID NO: 925

SEQ ID NO: 927 - DNA, 980192 bp, Homo sapiens; identical to SEQ ID NO: 925

SEQ ID NO: 928 - DNA, 980192 bp, Homo sapiens; identical to SEQ ID NO: 925

SEQ ID NO: 929 - DNA, 980192 bp, Homo sapiens; identical to SEQ ID NO: 925

SEQ ID NO: 930 - DNA, 980192 bp, Homo sapiens; identical to SEQ ID NO: 925

SEQ ID NO: 931 - DNA, 992600 bp, Homo sapiens
tcaaagtgctgtgttgtaaccttcagagtttgctcctggcgacttcttttggtttgcattcttgcttctgtcatacgctggtacctgatagccccatggacctccagactgactttcgctactactgctactactacctgattctgattcctcctcactttccacacctccttccaccgaagctgattctgcactgccctcttcagggatatcttgagcttcagggtctgtactttcttccacaggggctggtccactttcttcttcttctgagtgttcttcttcttccatcttaggttctttttgttcttcttgtggctcctctttcctacccttgacttccttgacctcctcaaccatgggccttcttcttgcaagcacaatgtttttccttgctttttctccttctgactctgtggattccgattcttctgattcaggggtggaactctcctcctcctcagagggtgtctctgactcagattcctcttctgtagtctcagactcactgaactcagactcttcttcactgtattcagtatagtcgctggaggattcctcctctgattctacagtgctttctgttgcttcctcttggtccagagtgagtttcaaataatctttatcttcttcctcaaggcgtctctgccactcttcaccctcaaggtcaacgattcctcttttatcagctaatcctctaactttcttaaaaatcatggggaatattctggctctcttccatgttgtgtatgtaggctcagctgctggtggtttttcgatagttacaactacttcttcctcctcactaggctctctaatttcaacctttggttttttaattttctttggctcttcctgaaaattgtgaaaatgcaattgaagtgtcagcttggagatagctatggtatgaccttgtcccacgaaagctacgcaggaatgaatctgtgggtgatagcttcatgcatgttatataactggcttaagaaaataatcacaaaaatttctactgcatatagacagaaggtgattaagagaaagtaaattattttattttagcttgtactttacaatacccaaatatattaatttccttcttgttactcaacgtttaattttcctcttagatcaaataaaaaagaaagaattattgtctcttccttccttccttcttctgtcactagacttaggttaatagctttctgtattcccttgaactaaattttcaagaattttcaataatcacgaaaatatgacgatttatctcattttatgagaaatctattttatgaaattttgcacatgttaaagccacagtgacatttatttcttgttagtgttgtttttgtataaatttgccaagtaaatagtgaagacaaagtataagaattttatagaaatgagtcatgctaatttaaacataaattacattattccttgaaaattatttgtggaaataatttacttttctctgataattgaaaggtggagactatattttttcatgacttttagttttgctagataatgtgggagcaaaagtaacctttgtattgcagaactttaaaatatatttgcttataatatctttatggagcaagatttagaattttagaaaacataattttcattgtgccctttccaaatgtttaacacttttagaaggaaataaattaaatgatcaagaattaattttcctccaaagacaaggcaatgaaacggtcagcactgtgaaatttctatgggaaatacgtactaagtgaaaggaatttctaaaagctgaaatgttctacagccgctagtcacgtagggttaaacaatatttttcttggaatattatcttacataataaaattacagtaattacctcttcctcctcatattcttcctcagcttcaccaaccacctcaccatattcctcctgtccagctggtggtaacaatcgacggcgactcccatattgaggcatttcatacctgtaatataaacttacatctttaaacagtttgtcatgtgatttctgtagaatctaccatgagtgatctgtttccttctttttcttccgccattcaatcgacagatatttacacagcacctatcaggctccttgtaaactagttacaaaactatagagtaagaactgctacctgatgaccagtgatttttgccataatggtaccctggaataacaataaagagagttgagttatttcagatactcgtttttggagaaactagaacgagaaaaaagccatattgtgtcttaactagctgaagaatccagaacacaaaatagatactttggaacagtgtaatggctcattcaccacattaaatctgtatgttggtagcaagaagttgcttcaaacatggtctgtaatggttttcacaatttcttcagtattttttttgaaagtggttaatttatatgtgtacaagtgacttttgagacacttatcagtggattctaaggtgtgttttctgtttcctaactgctcttgggcaaaactttaaactgattagataaaacattaacatcttatatgaaagaaatggtgaatttaggaattgagcaaatatgtttcacatctatttcccatataaataattttgaataattttaccgcatttctagaattgcaatcgatatcaatgtaaaatatcaatatggaactcaatatagaaaaatggttaaaacttggttaaaaataaagctagatatactattcattttcaagtattatactagtgagatcgacatgacattaaaaacaaattctagtaataataatcatttaataatttcctattaataaaatattaaaataagaatctgaattttaaaaatctgaagatgtacccatgctcataactgtaataatcttgtccatattcctggccaggatcaattccagactccatggataattcctattgttcaaaaagaaaaattgcatttgaaaacgaattcttatcacgtttcaggtcaaagtcagatttctacacctagaattccatgattctcaaaacattcctgccaaaataactttaaatacaagtgtcagttaaagcaattaaaattactctatttaaaagtgttagtcaaatctattcatttttttctggctgtaaccatttgatacaaaataaggttatataatttgacctgaagaggaaaaagtaatttttttctaatggcaaacctgttaaaacttgcagatgagcattttcacttgtttttggatgtcttttaaaattatcaatcaatagttaatatttaactcaattttaagttaaattattaagtgatgttggccttaagaaaaattataacactatctacagcattttttttcatctccccactaacagttttctagtacccagtattcttctattcattgaaactgttctgataaagtcatctgagaacaagaatttaagttaatgtgtaatgcttcccaaggatgtttatactttaaaacatactgctgattctaaatttaagggttttttgtttgtctgttttgtttttttgagacggagtctcgctgagtcgcccaggctggagtgcagtggcgtgatcttggctcactacaggctctgcctccagggttcatgccattctcctgcctcagcctcccgagtagctggggctacaggcgcccgccaccacgcccgtctaaatttttgtatttttttttttggtagagacggggtttcaccatgttagccaggatgttcttgatctcctgacctcgtgatcagccccaatcggcctcccaaagtgctgggattacaggcgtgagccactgtgcctggcctctaaatttaaggtttttaaaggaaaaaaagaatttgttagaatagaggtccttttaatatttccagttctaaactctaaacatactgattgatttctgtcaaactctacttatagaaagatgtttttcttgagatatacatgtgaaaacggtttctgataactatcaaatgcaatttctctacatttcccttttaaattctactttaacatgttaagcaggttaaatgacaaaggttaaccaaattcatttcgcaatggaatacgagaagagaggggggaaaaggataggtactcacatgaaaatagattggtacatatttctatcatctattatttataaaaatttaattttgttgatccaggaatagtaatgagtcaggaaataaaaagccctcctctgagggcacaaatatgtcatttgcgaagtgtggaaatttacagcctgcatgattgatatggataaagaccctcagttgtgcttggtgtggccaacatcattttaaaaaattgaattcattactaacagtgctaatcagaaaatgacaccaacactgtggatgttggtttctcttgaaaaataaaaagatggaaacactaggatcatatttttacattccaataatctagttggctagattaatttttacagcaagcatgtcctctcctgtttatgacagtatccccaacgacacttttctacattcataccctagtcactatgaaatctgtcatctgctattgctttgtgtctaataaactccattcacttacattactaccctagatcctgtaggtattgacgcttgcattacttcttctatcttataattttgccgtttacaaatactttgtgaacctactctaaaggaatccaattttgatgttaaaactagtatagtttattcaccagaataactaatatttagacaaacccacgatgaacaatactatgtatttgcagggacacagaagagctaaaactctcatctaagtctggagagattattacttggtaaaactttttagaatatgtttggcaatagtactaaattaaatataaccatttcttctttcacagaacttaaatttgtagttaaatacccaacagaaacatgtacacttgtgagaaaacacattattcgtaacagtcccaaattggaaacaatgcaaaagtccatgagataaacacgctaccacatcgcacaacaacataaatgaatctcccaaacagaatgttgagcaatataggtcaggtaccaacgaaatatattatatcattctatttatataaatttcaagaactgactaaagaatatgttacaggccagaaggaaaactgatatctaggtgttgacatagaagagcttgaggggcatgtgcactctgtaaaaattcatctagttatacagtatggtttatacttttcttatgggcgtaggttttatttcaacaaaaatatatttattataggaaggttgaagtgtgggggaaggaatgaggttaagaaagacctggaagaaactgagacaaaaagtctagatttaagttatttcaaactaagtactttgtaaaaacgtttcctggaggtaagctaagaattttagggtatgtaaaactcagtgtaatgacactggtttaaatgaagcaaataggtctcagaactaatattttcaaactgcttgaccaatgcacgtttaattaaatacatacagatactgagaaaataacttcaaacagttttgaagtagacttttaacaacattaggtaatagtaagaaacacgaaataaaaatttcaagtaaatatttatggagaaataatgcaactgagtggattttggattttagaagtcagcatcaaagaattttctttacataaatactttttcttcattaagggaaaataacgctcagctcttgctagctacaatgcatatggcatcaattgcattaaaaatgtaataagaagtatagaagggatgcggataggaacccaggaaactcagcaagatagcccttgattcaatcagtcactctgtatttctgagttgagtaaagagggataggaactagcagaaggaaatgatctaaaaggtccctcttggatgcttccaccacccatgaatgaagagcagagccatcagtcgttaaaaaaaaatttgaggaaagagcccgggtgcggtggctcacgcctgtactcccagcactttgggaggccgaggtgggcggatcacaaggtcgagagacagagaccatcctggccaatatggtgaaaccccgtctctactaaaaatacaaaaattagctgggcatggtggcacacgcctgtaatcccagctactcgggaggctgaggcaggagaatcgcttgaacccaggaggtggaggttgcagtaagccaagattatgccactgcactccagcctggcgatggaacaagaatctgtctcaaaaaaaaaaaaaaaaaaatcgagtaaggaactgctgaccagtcagatccatgagtcaacctcaaccaacaagggaatgctggccctttttgttgttccacacagtcccagtagactgtaacaaccccttagttgatgaattctagattttagaaaagtatgcaaagtaacacactagtgattttcttgggtagatcaaacacttaatgtaatttttaatattcatttttgctgtccacacagggaaaacatagaattaacttaatatttaattattataaacatttatactgatgcaaaacaaaaacaacaacaataattgtaatttactgaatttcttcctgttacattccagttgttgagctaggaacttacacatttattagatattactgctaacattttatagaagatgaaattgatgttcagcagatgtgtatcttgactaaggtcttgcataaagtcattggtgtttggatttcaaccctgagttttccaattcaaattttatggagccctctccatggaaatttttgctaaaaccttataaaagtttaatattcctgccacacaacctccagattttggagagtagattctaaccaagaaatgcctctttttagcaaagacagaattctgtactcaaggaaaaggaataaaatttttgtaagtggagcttatgaaatactaaatttgccgtaaaattaaaagtaggatgtctgtgtttttatttttaattacatatataaacataataagtaaatacaataatatatatttattatacaaaaaatatctttttcacattgcagaagaaaatgccataggcaattggtaatatatgtgtccaaaagaagtattttgaatcacataaaatgatatttaagtacagatatcagcattctgtctttaaactttgcataatctaaatctgatgtcaggaatggatagatgaattcagattgattaagacaagtaactgctgatcgggttcattaattgcttcattcaatgaatggcccgtatttattaggaataatgggcttgtctcattcccagagaatgaggctaaaaatttggaagttgagctaccagcaacttcaggaggtgatttcttggtttcttttttttgaagttattttgaaagactcttttcttttcctttaaaattatgccacattggcagacacccactctgcctacaagaattaatacaatagatcttaaagtcacagtgaaggctcagtgaggttgaaaagaaaatgaaaattgatacctctggtttaagaagagagggcctcagcagttgctgttgctgtcaaaggaaattaaaatagaaaaagatttagaaaataattcagatgggaaaggtagatcatgattgagaagagaggaaaaaaaggcgacagtttaaaacgtgtttccttgggattattcattattcatgtgttagctaccaaaagcattaaatattttaactaattctttatattggaacataaaataagaattcatttgttatgttttaatttcatcattcttctagttaatgacaaatttaatagccttaataaacaggaatctatacagatttttgttttgttaagctccacagtacaaagagttatttatgtttctaaaagtactgtgtgtcatataattacttttatcaagtttaaccttgttttaagttgcccttctttttttccttcccaatcacattaaatgtgataagattcattgggaagaagagcagaacacacaaaacgataaagttgtaatgtatctatcaacatattgaagacatgctctccatttcttcttcttaccaaagtgtggatttcttgcactaaaacattaagtgtgttttcagaatgattaggaaagtcattaattatcagatttggtaggaattgcttcctgcctcttccttctttcacttgtatttatttaaagctaatacagtcaccattgatctgtttcataataatacacactttaaccagataaaaacaagatacacaattcaaattttggggttagtaactctttggagggaaaacagcatattaaactaagtattggaaaagtgggtagtgaggttctgggaggtaattccatcattgaacccactgtttaaactggctagtagaacaaccatttgactgaagggatatcctttttataatacagttgttggtgagttagttattttacttataatgaattctaaactacaatccaattaggtcgtatacttctcttgattgagaagctgtatgctaaatcaaactaggttcgcagtgacttcattggtaacatcacctgcagtacagctggccaaatactactggccagaatgcccagtaagttctctgcagacagaatcaaatgaacacagtagaaaacccagagctttctaacattctgattatttttaaaatctttaggatctcaagctttaacctagtgataggatggcgccttgaactggtaaaaagatcaaaagttaagtagtcctatatatatattctttgttttttttttctttttcttttttttttcttttttttttttttgagacagagtctcacttttgcccaggctggagtgcagtggcctgatcttggctcactgcaatctccgccttgccggttcaagcaattctcctgtctcagcctcccaagtagctgggactacaggcagtaatcctagtttctaaattatatgtatagccttagacaaataaattttggggaaatgtcagaatactgagtaatagtaatgcagaacaaaatacatgtatccttaaaaaggtaagcaagtgatctttgaccattgaataagagatttaaaaccttaaaacagggaagcaacatatataaaagaaaataaatagcataacatactaatatgtttttgctgaaatcaaagaaaataaactagttcaaaagaatgtacattagtcttgcctattacacaagtattttcctagtatgcttgttacgacatcaacaccataaagcccttacctctgatccataacctctcctgcaaggcagaaataaataaatcagtattaaacatcttagattttcgttattaaacaaaatgactgacagataagggctttaaaaaatgtctgagtaaaactgagaagacaatttctactaaacactatctcagtgggaagtatattttgtggaattatcaaaacaggaagatcatggtttcacacctgaattactaaaataatgatcaacccagagcctcgttccatatgagcaacaaaacatgcaaaatctattttatttcaatagtgtataatgacaaactttgactctattattatcaatcaatttggataaaaaatattatacatgatctctgttatacacaagtcttgatatatatactaatccttaggggaagagatatgctttatacatgaagaatgtaataaacataggatgaaaattatgtctatgattgaatatattcttccaaatgattgtatgatattttctttatgttaattctaaaaataatacaaactattggctgtccttgcagggtcaattataatattagaaattaagtgaagaagtttttagagctttaatagccaaatattcaatattacataaagatttataaagttcacacatcacaagatggtgaaacgtttgactatacttgagggggagaaaagaatatagagttttcaaagttgaatgttactaataaataatgaaaatgttctatgtgttattttttaagcagttaaagtgttaaactgatgctgtcaaccatgttatgtagaattaatcaatcagtgtaatgaagaattattacaaagaggcacatattacaaagaggcacatgcataactttctaaaatccaacaaaagaatctctgtagaaaaatttttaaaaaatgttgaggccttcacaaagtaattctacttatcagaaagcatcttgtatggtttatgcattgtatattgaaactgtttgtaaaaaaaagtaaatacaatgcttacttaagcttctcaattgattctttaaaatggttctgcagtgaatttcgtagagtgcttacacggttctgccaatatttataagactgataattcttccagagcctttagaaattgtagacattttcaacttttaccaaatttatatttttcagaaataattcaggtagggaaagctcatatttaggtttaaacaatgacaactgagtcatataccttataaaatatccaaccaaagccaggctttattttttagacgatttcttctgactccttttattagcaatgttttccatcaatgtgaaaaataaaatatcaatagataaactataactcaatgttaatgtttccattcacatttttgttgccttttatttggttatttgtattgcttgtcttggctcaaaggcagaaagttacttgaaagaggtacataacagaactactactttacctgtgtgctttcaaaacatgactattgatacttataaagccagttcatataatatcgatgcacctctttatgcaattcataatcaattgtattatttattttatatcatgtatatgtatcactgtttacttttaacaataaggacaaatgtttggtcatctttcttaagtctttatttaaaaggtatctaataatttcttatgcattaatgagatcataataaatattgagaaaaaagtgttacttttctcctctctggttgtcaggttgtaagcagttagggtttgagaggaggaagaatatttaggcttgtgtactcaaataatactaaaaggtctcatatagaagatattttaactgacttttataatgtatcataatgacattaggaatctccaaatacaatgtgtcagaaaaagactggcttaaatataaaacacaggtatctatgtttcaattaaaaagtacagaataataacaaaactttcagattatgtaaatagtaaaatgttatagaaaaaggcaatataacaatttaatagggctgtaggtacctacacaaatatgttttttggacttctcttatttcttttgttactatttatagatttatcaagaaattataaattttacatttgcaaaaagctggtgtagatattagcttagaaaagacacactcacattaaaggcttacacaattgtgaataccttgtcagagtccgccaaatagcacaagttctcatgcatatgaccagctgccaacaaaaactccaactgaagtttttcagtgaaagaaagaaaaaaatcacgttcaagaaccccaagaaagtaattactcttgatttcgatgaaaagattttgaagcagatgggctaataaaaataatcagatttacagattgttttctgtctgatcttggtaactaggaatgccaggtcaaattattgaagaaatatgagggatgaagaaaacctctgaaataacgcattgaagggggctctcaacttatattcatatacttccaatagtaattatcaggtatgagttttgcctgtattttagaattgtacccttctccatgcaaacttatatcttctaaaatcttaaaactccagagtgttttataagtatttgttttaaacacttacatgtgcattcaaaatgtgaacttccagtaaataaaacctattccatgtgtttcatgggaaaaacaaagtaattacttgatggtcacatattatacattatatactaatattgaaagtatagtttccttaggaaggaagggacatagatagtatctagcttaagtgatgctgttcgaatttaacaattggagcgctaagaactattactacaactacagaaatctcttcccagagtatacagttttattttctttgtttaaaacaaagagcagaaacctaggtaaaagagtgattgatagttcagcaaatatcacttctcttggtttttctatttaagctttttatatttcatttattaaactgaagatcatactttctttaaaaaggaatcttatgaaaaaatttaaattagggagatgattaataatatgaacaaacaaaattaaacagcactttttaagcatctgttggaacaatgaaatgccttacaaaagtcaacgactcaagatttattttcattataaagaagggaagggaaagcacaatgagaaataaagagaataagacagcaactgaaaaagtataagatttatcaaatccataagcatactactaaatccataagcatactactaagataaaagcaagtcagagtaaaagatgttcttatcagaaaacagatgactacatgttatagcacctgagatttattttgaaataccttatgtctgtcatctcctacaatctaggtacattatattttacttcggtagtatttcttcttaccaaatacataggcttcaagaaaaaacagaacctatcaatcatatcagttttaacttatttgtaacagtctgcttttttcttggaacattcatataaaactacgatcaaaaactaaatgtaaatgttactgcatccacatgatagacatgcctttggtttaagttgggtatctaattttcatgcccacatattcccactaaaaaagagattaaaattacttacttttcaaataaatgtagaacaaattatgctactttgtagtttttaaaaagtaaggtaaatctattatatgagtgagttagtagtgatgaggttaatatctttttaaattaaaaacgagaaaaaaaactgcatttcattgaatttggggtaaaataatagagtcttctttgacgttcaaatttgatgttcaacttgaagactatgatcaacaagaggtttgcccgactaaaataagaaaagcaacattacagtgaagtagattgactgtgagattgtttttcagttccctcgacaatattgttcaaactccccttgttttgttcagatgtgatttccatatttgttacttctgaagggcacatagtttgaagttctgaaacatttgtgcgtagatagtttttttctatttgactgtacatgttagctactgatttttcaagttctgctaagtttttaacgtgtctgaggatgccttttggttctctctgagggtctgttttacacactgtcgttgttgatagctgtgtcatagaggacttaattttctcggcaggcatcaagttggtcgtgcatttaacacctgttatacagacacactctgtggacagaaatgaagctgaaggaggtggagggcaaggaatagaaggaggtggtggaggaagaggagttggaaatggaggtagaagaggtggtgttgggggaccagacgttgaaacggaaagtggaaaaaatgtaggaggaggaagaggaagagggatagaaggaggagagggaggaggacaaaaaagagaaaaaggagaaatgtcaggaggaggagcaagaggagcaggagcaggaggaggagaaggaggagaaataggaggaggagggggaaggggacaggcagaaggagagatgtttggtggatgggcaaaattttcaaaaatatttctttcggtttcaataggtaacatacaaataggtgtctctctcctagagagtgaagaatgtaaaacacaaggccttgaaggagaaagttccaaggaacactcagcaggagaactgatgacattaggttctgatttgagttccacagttcttgaaacagttggcaaagtggagaatgagaagtgaggcctgggaaagcaaaatgaagagtctgaagagagagatttcaactgttctgttccttctatcatcagtgtttcaccttgccttatttcctctttctctgtcaaatttgcctcttcagttgtaagcaatggattgctgctacctcttttgtttgtacagattccagtgttttcattttcagctttctgcctggtgccttgccactgctgcagatctatgatctctggtctatttggaactttcctcatcagcctcctgggtaagctgactgactgactccacagcctctgaatcttttctcttgggcccctcagagacttactcttggcttgtattttgggtgaaaatgggtctacaaaatctgttctctgtgaaatgtctgaatttgttgatacttgacttatgttttccttataaaggggattatgggcacttaagtcatcctcatcagatagaaatgtgaattttcttgcagacttcagtttgttgctcttaagtgatccgtctacatgagctgacttgtgagcctcaatagtattggaagaaaagggcatcacaacttgttgatgtttcctgtcttctgagactgagttatttcccctgctttgttgaaaatggtagagaaggaaaagacttgaaagaaaagaagataatgaaatgtaaggaaacaagttgtgacacagctttcatgagaaagatgtttttatggctctcattactattaaatacttaaaaacatcaaaggccaaacaacactaacctactaaagcaagacattattttaattccctgctcttagaaaggcagggcagaaaaatcttagagttgtgagaagaatgagaaatgtaaatgaaaaaaaaagtactcatctctagattattttggaagagagtattttttgtttttgttttttttcagctagtgtgatacagcaaagcatccatgtccacacgtaacagttcccttatgcacaaatcacagttcttcccattgcagaacaccatccttgcctgaggatgctcagggctgcctgttacgcatagaagattcttagctgtatctgattcagtacttctgtcctagagccaaaagtaatctcctctctgagccatcatgtggaatatcctgttctccaaattaagagaattaaaatcaccaaggacagatgggagtttgtctcacagcccaaaaatcacaattgagaaattgaatgtatgctagaattgtgacagaggagtttttcttctgtttaaattttgtgcttaattagttttaaaaccttatacataataccaatcaggaaaaattgttttaaaaccttataaatagtaccaatcagaaaagatgttgtcagtaatttcttagactgatctggatcaaattttacttaaaactcaccttaacaaaaagattgatgctaaaaaaaaaaatcactttttgatatcactgaaaggcttacttatgcacggaaactgaatcataggtagttgtgagtcataaataaagttgcatacatcaaagatcacaaattaaatggctctaaggaaagcatttggacccttctcccaggattgttggctgattgataggtggttccgaattctcattagcttttactctcaagccaaaacagaataacatttattttagttactgcttaatatttacccacttagcaggaatgaaataaaaaagaaatattctgaatagaaattaactagccatattgaaaaattagggtgatagtttaggcaacaaaataataaagccacagttgttaatgtgtcttttggcaaagatacgaactataagaaagagaaagaaacaattcacacaggtagacctggagcatcaagcctacttggacaacaaagaaaattcagacaatctggactaatcagagtgcaaacaaacacttttactcttcgaatcttgaaaagtatttttcaaatatggcacgaacaactgggattgatattatatactggttgtttttgtaaacaaacatttgttcgtggtttgatttctcttggtaaagcacccaatggatataacaatatcacatcactttgactaaaagaaatctataaataggtttctatttatagatttgtaaattttaagttcttaaaatttaagaatttttaaaaactaatttaaaaaaattaaaaacaaggagaattttgaaattcctttcagtaggcacaggtaccatcacagcgaacacatgttttaagctcatgccatcaaaaggaaattgggtgtggaagacaaaactttccttttaacagtaagtgagtctgtggcaaaagatgaagatcactgtatttacagtacaacagcattttaatctgttctattgtatctatttttctaacgctcttctattagagtgatattatttacttacttatgcctatgtatccacaggtgagaaacagaaaacatgtgatagaaaaaaagaagtttttactagagttaatttaaaacaattctgaaaatatgagcaggaacttgctttaaacaaacacttagtacgtatatcaaaaaaaaggcatgtttttatattttgttattattcatatgaatgacatttaatagtagatgaaatcaaatgacattatttgaatgtcttttcacagaaaattgtatctaataaagtctgtttactatacatagataaaaattcacttctattaaacctggatgatgccaatcctaaaataaaaattttaaatgagagtttaaaaattgcttctatgatgtcttaactctgtaaaactggttaatgcacactgacttttaaagtagatatattttgtttggaagaaagtaaatatacaactactatgatgacaattaattacaaagtaattatagcattcataggaagttatcatacgaagttattactttgtgaagtagtttttccaaaatgatctttgactttgttctttttaagataattgataataatcatttaaaactaattcattttctagtaacttaatgcttagaattcctgtaaaaagttcttgaatagatagataggttaaacatttactaaagataagataattaaatatgtagaacttacttaaactatttcaatgaatacatatattacaattgcaaaatctactgagtctactacaattgttcaagtaaaaataatcttaggtattgctatttgaaaattactgtcatcaaactatgctgattccagatgatgttatagtatacctgttcttattaatttaaaatgaatacataattcattaatttcatatataaacacacaactttacacataatccttttttttagtttctaaagatctttgcttgagagaggtcattaacatactcaaatagaatcaaatcatattggctcaattcctacattcaccaataattaattacaaaagaaacaatcatttttcaacttacaaaaaaggtgaaagcatatatctaaagcatgaaccctgtattatgtccttattttggaaatagaatgtcatgctttaacctattataaattcagattttgtgttaaaataatagcattaagatcaattttaacattaatacgactatcctaaacaaaaccttgtataacattattaatatggtaagtaacctgaacacatttgtttaaaaccagcttttccattaccaggtcaatttcatgattttttaggcttttcttattgctactagtaactgatacggatgtcacatgtaataacatgttatagtccttctactccatcaaattccagttaataaaaggttttctggatttaattgtcatattcaaaattgtaaaatattcttggttgttttacatatcatgtccaaaagcagttattcttgaatttttaaaatactgacaaactgaacatcaccataaggaatccaattatgagggtagcatcattatacaagcaactgtgaggtcttttaacagttaccagtgtctttcaaaaatgtatgattttttaaatagtgactacaagtttcaaatcgtgcaggagaaatattcggtaatcaccgcagtctgagagtaataaagtgaaaaaagcattttctaagtagttgggaatttaatatagaaattctgtaatttcattgagattttaatttctatatcatataacgtcctaaaagtagtatctcagaaaatactacgattttaaaccagagaatttggttttgattaccaaatagggatcggtttggatacctaatcaggattactattttatgattgtgctttatttctctcgtctcctatgcaaaaatatatttttcagaatctatttatatatttatacatatatacatatacattatatatatgtaaaaatgcatgaccctgaggattgagatattaaatattatactcaagctataaatgtgcaattgtctcctgaagttgaattctgcttttctcttagctttctttaatttctggtttggttttggctattatttttcaacttaacctttcttagattttcgtcttaacaaattttctcttgaaaataatagaataaaataaatagtccatgtaggcatttccacatcagattgaaattaaatactcaccacacagaattcagtaaaacccaactacttctcagagttcctgaacggtctacttacattgagctgtctccaagttcttcatagagatgcgcacctggcggaggcggcggcggcggcgggggcgctgccactggtgcaggagccggcactgctggtttagccgcgggtaatgcggcctgaattcgtgcagtctttgtacactcagcttgacgtcttggataaagtaaggatggcttgtaaaactcattttagaaatcataatgcttatcaataagccaccttttaataatggggtccagttatcaggggaacccactaaaattattttacacaaacatcaatttataaacagatgtaattacaaaagcatccccacagggtatcatttgcatataatccctgctttgttcttgaaaatagctatctcttgaataaggggtagaattcagcagacatatttgcaaattaaattaaatgataatcttagagaaagcaaaattttaattaaaatgggatggataattaattggtagtttaatgaatctctttcataagatgaggcatattaaagataagatagataatttttctttattatttgtcttttaaagttatttgaaatgatttgaaacatttttgacgttatttcacagaggctgtacacacatgtacaagggaaatttggttagcttgtatatcctttaagattcctaggaatgcctaggccgggcacggtggctcatgcctgtgatcccagctactggggaggctgaggcaggagaatcgcttgaacccgggaggcggaggttgcagtgagcccagatcacgccattgcactccatcctggccaacaagagcaaaaagtccgtctcaaaaaaaaaaaaaaaaaaaaaaaaaaaaaaaaaattcctaggaatgcctgtgattctcatgttacagctacactgctgtttttggatttcctggacactgattaatttcttcctcaaaaccaagatgttacaggatggaagctataggcaaactatctttttcacatttgtgcaagttacgtccaattgtctaaaatcagctcaattctatatatatcaaaccaagaaataaactattacaaacgcaaaacaagggaataagatgtggttctgagcaggctgacttgattgatataatctcgggtttctcttttcctattacatgaaaaggatgtgtaaaatgttaattatacttacactttaaacctgtttgggaaagcaagagtaagaaaaatagaaagctacattagaactattgcattaataacattttaacatctgatttattctaaatcatgaataatttatacgttaaattcataatgacagagttaatgacagactaagaaaactaaggatatcaattcaaaaggtgaaaatagtatcgttaccgttagagtcattcaagccattaaaatatccataacagaaaaataaagaaatgaactacatagaataagaaaactggattaaaatgtaaatgtgagaatttcaactctagtggaaaaatggaatattaaagatgacctgacctttataattggcttcttggtttaccctgcttgaagaatattacaggaatggagagaggtagcaagccctgattatactcttggcttcactttgaagctgaagctacaattggaaggtcctactcttgggtaataaatttatgacagtttttacatatttgctttttagtttccattcatagaaaagttcaaaggcatatcattatataaaaggatagctattcattcttaccttatttgcaagcaaatatcaaggtacaaatgttaggtctttaaatattagaattttactttgctatgtgagcagagaaaaactcattttgtttaattatgttaatctataaaaagcagtaactaaattcatatggtattgagctgattatcaaactaaaggagaattaaataatgcgtctataaattatttaaatattaaacatctcaagtatttgttgtatttcagactaccttgtataacatccagagcgcttcagttttgatcattgcatactgtgccaaatacaagaatttttctcactgatttgcttgctagcaggatataataaagctcctttggaaaatagttaagtgtaaaaagataactggtaatacggaatggatttaacattataattaataatgggttgatggcttaataatttaaaacaatttgttcagtatcaattttgttcatcagctttagatttagcatatcaattgattggttaaggacacattaagctccagtatatcaaccttaatgctgtatttgcaacttcacattgcttttgaggtagaaaatatttctgtagtttcaggttggaattacttgaaaagtaatgacctgcttgaaaaatattaaaggaatggagtcatgcagcaagccctagttatactcttggcctcactttgaaaacggagctagaattggaaggtcctacttctgtgtaacgaattcatgatactttttttcatatttgctttttagtttccattcatagcaaagttcattcagagcatacatttggattttcaggttggaattaccttaccttattcaattcacaagaaaattttaagtatttgagaacaaagatgacagtttaagaatacataaggactattggctgggcgcggtggctcacacctgtaatcccagcactttgggaggctgaggtgggcggatcacgaagttaggagtttgagaccagcctgaccaacatggtgaaaccccgtctctactaaaaatacaaaaattagccaggtgtggtggcgcatgcctgtaatcccagctactcaggaggctgacacaggagaacagcttgaaccttggaggcagaggttgcagtgagctgagatcacaccactgcactccagcctgggcgacagagccagactccgtctccaggaaaaaaaaaaaaaaagtaaagaatacataagaactattttagtatttcctctgtaggtagtttaaatgatgaatagcagttctaccattatttcttattgtttattacataaagtaatttacatgatttattattactgtctgctatttattttctttttgtggcacactcagggctacttctcttcttaatcagctccccaattttttcaagtcattgtctatagaaatatacttaaaatgtgtggctctctatcacaaagcttccccagacctagtgtcaaagaatatattactaacctacttcaaatatggatgtttaaattagtgataattacttgactactctagataagttaaatacaattttaaaatatggatattgtcaatggatgcacttgactgcaggaaccagaaaaattaagagcctgcacagccagaacatgctgtcaaatagtacactaaaaactctggcaaagcacccaggaaggaagaaaccacatagaaaattacatcttacatgctatgattttacaatgcttttgctaacactgtgatcatttgcacaaaggcaaatttaacagtttggataaaaacctatcatgacaatgtcgcgaagttattgaccttcctttggagctgggcagagtgggtatccgcatatgacattccattgcttttaccccaggatacctgttaccttctctcccaagttggctcttaaacaaaagaagagcataaacaaagccacaggaactaaggtgatatttctattgaaagagaccgaattagaatcacaggaatattgggccatcagtgaaaaatgtactgggagtttgtactgttttccttttgaagaaaatcatttggtacgagatagacagacagataaagcaatctcagagtagttgcaccatcaatattttacaacgcaaagccatgttaccagagatggttttctgcaatgacttctgaggaactatccaggtttaccatccttgaatacttactgtctgtagctgaccaaaaccaccaagatggcaggaatgcagcagaggatgatgatgaaggccagagccaacaaggccccttctgtgtatcctagactttctcctctctttttaatgctggtcactgcctctggagtccggatctccagaatgcgtcctccttccccataatacggctgaaagtctttattgatatcaagtagtttgccatccaaaaatctttattgttagataaatagtaaaattaatgatgctagcagagaaagagcattttaaaaataaaatctttttgtaagatctttcaatattttctctaattgaaacacaagctgagtcagaagtctcatgaataataagaaaagcatatataaaaagcataagcaataaagaagaggagtaattacacatctgtatagaaatatcaaaaatattttaaaacacagctcttgatctgcttatagacttaaaaaatctaattatcagtatcattaagcttaatattactgtgtcaaaataatttaacaacattttagatggaataaaatataatatcctaaattatataccatagtttatatttatgcattttatctccttgggtcctgtaaccttcaggataaccctgtaaagatcaaacattacaatactgatttattgcaggccaaaaagctatacagttataaaaacaaatctgaggcaccaaactaagatttcagactcaaactctgtatttgtttgccataacaccatcttaaaagtaaacattctcaagtttcaaaccaaaagaatgttttatggtcaaatggtgaagacatttaaaagacccttctgcctaggaaaaaaagactaaataaatgatgcgagtagtatatcagtgttgtaagaatgacaggaagtggtagtcaatgtaattccttcctctaaataatgcaattccaactatgagtcttgaattttggaagagaatcaaggaataattattcctaatcttatgagattgaaaaaatttgttatgtatttaatatcataattagcaggtgattttttaaacaattccttgggaacttttgaacagtcccttataagctctacatattgatgcagcaactgtgttcttaatacaacaacaccataaaggtcaaacgtcttactatagaatattggaaaacaaaaatagttcaagaaaaacacaattactcatagtcccatgatctacagacagtcataatcacttctaacatcttggtatatttaagtctaatatttttttggaggggtgatattaaatattttatatacttgagtatactgcatatataaagtgcttatgttgaaaaatacagaaaacacaaaaaaatgcaaaagaaaaaattaaaatggccctaaatttcattatcaaaatataatcaatgccatgcttgtgtacttttttcagtctattttatgcccttttgagacatttaattttaatattcagagtgaccatgctgattttaaatcccgttaacacactgttcattgcttaaaaatagaagtgcctggtatcacatatgaattccatcacatatgtaactcataaactaattcatatcacacatgtggcaattagaatgcttttttgctttttttaaacagatacgcttttatagattaaaaatgtactttttatagcaattttccaagctcattgttacacgttaaaagaaaataaaaatttagccatttttatgattactagaaatagaatagtgaaacttcttgtttgaattgtttattagataaaggaagagattctaaatgatgcatagatcaagaattgcttcacaggaactatattattagaacaaggaagaatcagatccagaagaggatcattaatttaagggaagaatatacccctacaatgtggagttcagttgacagatcaaaattctattggattcctggatttcatatccaaactctctaaagtaagatttgttagtctttttacactgcaagagccctattacttagatacttattttcacttatcaatgtgatgtcataaacaattttttactagaaggatggatcacttttgaacccacacctgatctagactatctttctttactttgtgtatttaaaacaacttgtctgggtaaaaattcttgagtcataacattatcccttacaaaacagcaaaattgcttccattgccttttgtcattttatcatgcaaatgagatatgcagggcttacctaatttttgttcctttatgagtaagatatttttatttctgtttcagtgatttttaaacatattcagatactattcaaagaaacatggctaccttttcattgatttttgcctgtaatataataaactcttgaattcttttttcgattttttgcttctgttataaatactacaattttaacctcagaaataactgtcattatcaggttgtattttaatcgtcctataaatatattttgatctcttttattatttatatgttttttcctttttcttaatattgcataaattttcaatggatacacttcatgttgtcaatttaattttcacatgccttctcatttcaggaaaggttgaatccaggtgctcaattgattttaggagataaaatttaatttataaattaggcacagtaagatattaacaacaataactaataacaaaatagaacaattatagaactatagtgtaataaaagttatgcaaatgtggtttctctctgtctctgtcaatatcttattgtattgtaccattggtaactgaaactgaagaaagcaaaaccacagaagagggttgactgctatactccagttggactgaggggaaggcactttagattaaagactaccaccgtgtaggaaagggacaattctcacgagagaaagtggaattcttttaccagaaacaggagaaggactcaagccatgtaaaacacacacaccatttcaccaatccataccattctgttttctactaaaaatgttaaactgttttccaatggtttctgtaggagaaaatttccagagttatatattctccctctgggtcatcaggttattatctcctgattttccatatttattttgttttttagtatttattgctgatcccgtttttccactgcttacttatcctaaaaaagagatagatctgcccaaatccagcatcaacacagaaatgtgttttttttttttttctcgtcattttcatctacagtgtactcagttactatatgcaaaccttttgtaattctaagggaagggtatacaggtcccttcccaggatgtagccaacatgaattgattactgctatgttatcctgaaatgagataagttgctaaaccaatgtcatgtcttattattttctcaagcacatgcaaacatgtatttctgcctccattgatggatatggggcctaatgttgtgttattcagcatataattaataaatacataatcaacaatctaccctgcatctcaccttcgtgactgattaccttgatgatgatgattttgatactgcaatgtacatatgaatgtagaaataagtaaagggtgagcaggagattgtactctagacagtagagggacaactgtctatttcctttgtaggtacacaatttaggcgtacagagtgggcagtggttaacatatctacctacattcattacactgtataagatttttctgcttaatcaagcaaatcatggttagatcatcaactattttcttttcacagtttcataactgtttaactagattctaataattagtattccattgatttggattttcagtattttgaatttatatgtatagttttttacttagaacattgaaagaggctttatcagagcctgttaatcagataccgtttaaggtctaagtgtgtttttaaacattgtggtttaaaggcagtgtataaagtctttttctgccttctccatctttctcttacgatttggacatactgtttttaaataggctggatataagacagataaacaagctaaaatgtatttgcttatttttaaattttaattaaactatattttaaagtagtgtgttctgttttgtgtagaatgcagaaagccacaagagaatatggctattaacagcaacaacaaaatgacaaaaaagtgccaggttatactaaaatcataaatttccttgagctgaagtcacaatgtgagcaaaaaaaaccaaattccattgagtgacaattaggataatttcatggtgagatgtgaccatacattgtttcacctttggcagaaaaggttaaaagtggctgccataggctgggcacggtggcttatgcctgtaatctcaacacattgggaggctgaggtgggatgattacttgagctcaggagtttgacagcagcctgggcaataaagtgagaccatgtctctacaaaaaacaaaacaaaacaaaacagctaaaattgtaataaataaggttagaattatagacacccacaaacacaaggggagtctcccctcatttgaaaacttctttgcgtagatttctgtaagatagattgggggacaaggcaggacacaagagaatattccttcatggtgtaagaataggaacaaatcagcaaggctggtgcacaggcagcaacccttgtgcaattccccagacctttatctcagatgaaacaagggccgtaagtattagagggaggaggaggaagtgtgcccatccctggtgctcaggcaaaggtctactgcttctggaaaagaggtataagcaaaaatcccctacccctgggggaggagcaggaagtcctctcaggtgtaagatcttgcaccaatacaaagtagaggtctactatggattgagaaggggcagaaaattctcttgcacccaagaccccctgtaaatgtgaagcagaggatggctgccatgatgccataagaaagagggggaaaaaatcttgagaaagcccataccaaggcttacacatgcaggctgtacaaggagaacagaggaacccctattccatgacccacctcttccttataagagtggaacccagcagcaaggaggagcagtctaacactgtgggacagatcagagtgtgggcagaaacctcttctgtggcacaagcatatagagagcactgagagctgaggactgagtaagaagactgagaaaaccctacagcacgcaggcctctattctaagactgagttgacaccattccaccaataaaagaatttttgaagcttttggcacagtggaagtaataattgcaacagcaaaatccaaataattcctgaatagctttacttaacagagtaaatgtctgtaatgtccatttacaggcataaactctatttacctcacttcttactgttcttccacaccatgtctggcattcaatcaagtaggacacaaaaagcctacaaaatataaaacaaccattttcaagaaatgaagtaacagagccagatagagataacccagatattggaactgtcagacaggaactctgattcaactctgattaatacattgcaaaatagcagaaagcacaaacatgcctgaagcgatggagaaattcagtagagtggtggaaataagaaataatctaatagaaatgctagaaatatctttctaaaaagataaaaagatgaagaatttcttcagtgagttcatcaataggctaacacagatgaatcagtgaattcaaaaatagggcagtaaatattattcacactaaaatacaaagaaaaaactgtgtgtctatgtgggcgggggaggggagcagagtcagaacggaacaaaattatgagaaaaatcaaattgtaattggaatcccagaaaaggaataaagagaaaatgggcataagaaatattagaaaaaatgtctgagaatattccagaaataaaaaaagaaaaaactcaaaatcaaactcacaaaaaaatgcagctccaaagagttgagaactacaaggataaaaaagcaggataagagtaatatataattattgcataaaatctaagcaattcaggtaaccaaaaataaaaaaattaaaataccgataagctggccaaacaaaataagttattaacatatcactaaaagtcattccagtcctgtctatgcatttatgagcttttttatttttgattgccaaaatatattttttcaaatcaaagtaagttcccaggacaaattattattatgatgatttctaatcctttgacctgagcattccaacatcctcagaagcttagattttaaggtgaaaggaaattgaaagaacacttccattgacctggaccggcatcttaatgttctagtacatttatgcagtgttaaaaactaaataaccaataactctcacaactacagaatagataccaatacttgggcactggcattatcagccttggaaaacacacacacacacacacatacacacatatacacatgtatatgtatgtgtatacaattttattataaaatctttcaagaaacaattctagagtttcaaatagaccagtgactctaagcttactataatacttcaaggtgaagactgctaaggcaaaattttcatatttcatggctattctatcttttcttcaatataaacatatattatttatttatttatttatttatttatttatttatttagaggcagagtcttgctctcttgcccaggatggagtgcagtggcatgatcttgctcactgcatgctcggcctcctgggttcacgccattctcctgcctcagcctcccaagtggctgggactacaggtgcccgccaccatgcccggctaattttttgtatttttagtagagacggggtttcaccgtgttagccaggatggtctcgatctcctgacctcgtgatccacccacctcggcctcccaaagtgctgggattacaggcgtgagctaccgcgcccggccaaaaatttattttatgatttatatatattctgttttttccttgcctgctggctatgatagttattttattgaatttagatgtttactgtccataatataatttaggtttggaaaaacttatttagaattaattaaagatgttcatcttgtatttcatggtgtcacttaaaacccaagtggcttttttttccccaaatatttaatctctagaaggtttgctagttaaattcaaattctaatcaccattattttactctttaaagttagcccaaatataatacatatttttatattcaggtaaaaacaccctaaactcaatcaatcgtgaaatttaaaaacaaaactaatgtatgcaaaaaacacagaatgcaggtagattcacataaaaaagaaatgtgttgattttctgacaatcgaaagaatatatatgaattactttggaagtttattcctaaactttttaaattaataaactttttaaattaataaaacttacaaaaaattggcttggtagatctaaatgttgcttcattttggtggtgactataaaatcagagtgcgagctattacttcattcatctatatttcctccacggttagtatcctgttttgcacatggcccaaatatctattaaaaatgaattgatgagccaggcacggtggctcacacctgtaatcccagcactttgggatgccaaggcgggcggatcaccaggtaaggagatcgagaccatcctggctaacatggtaaaaccccgtctctactaaaaatacaaaaaattagctgggcgtggtggcgggcgcctgtagtcctagcttctcaggaggctgaggcaggagaatggcgtgaacccgggaggtggagcttgcagtgagcgagattgcgccactgcactccagcctggggcacagagtgagtctccgtctcaaaaaaaaaaaaaaaaaaaaagaattgatgagtaacatgttaaataattatggcttttaaaaaattttagctgatattaaatcattattttattattgccaaaatagaagtgatgaaattttgtcgatgaacacatttaaaataaaactaaattcagaatttattaatttgaataaaaattgaatagatatttacaaaataaataaatttacatacacataatatagatatatttgtaaatgtgtatatggatatgtttatatgctgtttaaaaagtatagacaaagaaaaactaaattatgatgtttcacatatagagttcggcatgactatatatacaggcacatataaactattatgattgtatatcaatatatatttttaactaaaaatgtttcattgagatagaatttcattacaagacccagttggacactaggtgtcaccagagtaaagaaaattctgttaacaatttttttttttttaagtatttaagtgtgctcgaataacatccaaagaaagtaagtagcaggattttctttaagattctgcactttatttatttttaggatttataactcaaatttttaagttcctgctaggatgaaatttcacatagagcatgaacttaaatgggaatgattatcccacctgctctccacctgtaagttaaagaaaaaagcagatattgatttttgctgatttagtagacctgtaagaaaggtggatttcttcttaaaatgcaagcatatgaaaatcattgcagaaaaactgcctctttaagaatctgtgctttcctcattaatagccagtgcccttgagcaagagtgaggagctggcagcaggtgatttcaaggagctgttccttgttcttaagtacaaaaggtcatctgatgcccataaagaaaatgggccctctgaagtcactgtagcccacacttagacctgaaaactttaaggcatgagaatcctaggtatttcaggttctttgcttacacttcactttcagtaactatttggtgggttttaaactttaagtacttatagcctcaagtcagaatcatctatggttgctattgtaaccaaagagctgttacagataacaaaaagcacttacttaaaaagctcatttctatcgatggctctgttggtttgggggtcaattgcatagacagtcaagtcacatttggtgtaatcttctagggaaaaggcatctccatgccggcgagctccaatggactccactacgaccttggcaccaggaatttgttcctgaacatagcgatccaagatcctataaatcaaacaaagtacaaacatgacagtccaatgggctttctgggagtaaaaaattactcttaacttgaaaagacatttagtaaatgaaaaatgatgacagcctagttttttgttaatgtttactgaatataaacccttgaaaaacattctctatattttttcagcatttagctcccaatgatgctagaagctgaatacggtagaaaaggtcaccaaccatgtcctatttaactttaggctttttgaatttatgatactatttgagcttttacatgagaaatgccaaatatgctgtacaaataaagctgtctatgctttataggaggcatggggtcttagaacccttgacttcacatggttggtgtcataaattacatctcccactaaagtctgtgacacatgacacgtagctatatgctaagaagcaggactaggatgcctgttttcccaaaggtataaaaatccttgcagaatcacagcaacgggagaatgtggagatattttgcaatggcaggattaccacgttaagataaaaatatggcatgcaaatctcagacactatttaggtgaataaaaacaacatataccatctggtataaattagtgatatttaatttaaaaagcagagacaatattaatcaataagtaattttcccatctcatgactggattttaattgaaagtatgaattattaccatttcccaaatgtctcattccttattaaaaactttatattattaacccaagtatataaatattaagagcatataattcagtatttacagatgtttaaatttaaataattttaattactatatatgataaatattctaaaattcgtagactcaatgctcttttctgagtctatattttgaggtttttttagggggagaagggcaatatattctaaagtcctttgatacatcagaaaataacttttgcttctaatgccacaattgacatatttcttgctcgactgaaagtatattcccttaagagtcttgtatgtgcttggtttgccttgttattagaacaatgaggttactaaactttggaggaaatggctctaccagtgcatgccaggagacactaccaatcatagtgaaatgtttgcttgcttgtttttaaatgtttgtaacccagtactgttgaagtctgtcttattgaagtactattcattattttccttttctgtcaccactccacgcccactggtctctcggcttcgcaatttcttttctgatgacatccttgaagtagactaagaaaagatgatgtgtaaaaaaggaggaggagcaaattcacttggaaaatatcagttaatagttgaatgcctgcaattccagctagtcgggagatgaaacagaagaatcgcttgaacccgggaggtggaggttgcagtgactccagcctgggcgacagagcaagattttatctccaaagggaaaaaaaaaaaaaaaaaacaaccccgggaacctgaagataatggatgtactgagagacacagactagtctaacatcatttggactgtgtttttcagattttttttcctgagagatttatgctcatttaacaaaaataagagaggcctcggagtcaaaccatattatactcttgacattttgtaggaggcacaaacaataatgatataatgttgaggagtacagatgtctggctggcttcaattttaatttcctttgcctttcaattgcataaccttagacaagtaatcttaagctctcaaagtctcaggtttgtttgtttgctttttgagatggagtctcattctgtcgcccaggctggagtgcaatggggcaatctcggctcactgcaacctccacctcccgggttcaagggattctcctgtctcacgcctggattacaggcatgcaccaccacacctggctaatttttgtattttttagtagagacagtgtttcaccatgttggtcaggctggtctcaaattcctgacctcaagtgatccgcccgcctcggcctttcaaagtgctgggattacaggcatgagcatcacatctggccatgtttccttaaatagaaaacaaggaaataatgtaccacatggggctgaatgtgcattcggtgaaataaagcttttacacagttcctagcacatagtaactattcaacaaaatgaatcttatttttattaatttgactgaaatatttccattaataagcttcttccttgtctcaaattcattcaaggcctttaattaatttgtggaataggaaagtatacttctcactagtataatcaatcagttcacaaatcaaaacgcaaacaggagtacctagttaaatacaatgcaatagatggctctctgtcccaatactttggtctaacaatttatgccttctccagtgcattttggcattgatttgacatgttccaaggaaatccttcatataagcatagattaattgtgtgtgatcctacagtgaagaaacatatctattgtgcttgggttcttttctattttcagtgcaatactgcagaatcatttcactaaaaaaaatagatgtggaataaaatataactgtaccaattccttcatggtagcagggaatcatgaataaaagaagtctaaaaacaaattatgtcatttaaaacatgcaataatgtcttcactttgagcatttttttgttaaacttttaaagatcttttgggacaaagtatatcttatgataaaaagagatatagcctaatcttaactgcttctgtatctttttcttataaatgtaagtaaaactaaataccttttaattgagaacacatttcataaaaatctatcttttcatttatcatctatatctatatactaagtattttctacatctatattcattacctatatgtatataaatttcctcacatatatacatatacccccacacacacaaagaaaaagagatttgcaatgatgtttatctaacccataatatttgtatcatacacacacatatcaagaaagatgtccataatgatgtttatgtaatgttaataatgcttagagctggatggtatgattttgagtttaccttttataactttcttcttcatatattatattgcttatatttctttataatgggaataaaagaacaatatagttatatttttaaaaaatctccttaactccctatttcctctccccaacttcgtgataaaaaaagtcttcatataaatctatattttctagtttaaaaatgaaaaaaattaaattggattcagggcttttcataaaattatagcaaaactcactcagggaagtgttaagtaggaaaattttcatttattcattccttcaacagatgtttattcaatgcctatcctgggccagaagccattccagacacatggaatacatcagtgaacaaaatacaatctttgatgtcaaagaagaatttacattcaaattgaacaagacaagtaacagatcatggattgataaaattggtaaaagtgttcagaataaatatcattgagactttgatatttgagcaaaaactttagggaacaatgtgtgctgtggctattctaggaatgagtgttctaagaaaagagaattgctaactgcttgtataaatgtgctgatgtagtagtgtgtggccagagcagatcacgtggggactttgaggattgtaagagcattgttttttgttctgagtgagataagaatctgttgctggttttgaatactaaagtaatatgatctaccttacatttaaaggaggcacactggttgctgtgttgagactaggctgagtagaatcaggaaaactagttagtaaagaacttaagtacatgaaggttcattaaatgctcagcctactcaataatttagaagaaaagacacaacccaatccatgactattagccatatgaaataaaatataaatatcagagcagatataagcaaaactttgaccaaaaagaaaacacaaaaaatcaagaaacagaaaatttgcttttttggaaaaaacatgatatgaccataaaaacagacacgtacaccaatgaaacagaagagaaaactccaaaataaatccacactcttacagccaatcatttttgaccaagatgtgaagaacatacactggggaaaggacaatttttaatgtatgatgataagaaactggatatccatattcagaaaaataaaaatagattcccatctttttctatgtacaaaaatccactcaaaatggattaaaagcttaaacataagacataaaactgtaaaactactagtagaaaatattgggaagagacttcaggacattggtgtgagcaaagattttgtaagactccaaagaaatataaattttccaatgaaagcaaaaataggcaaatgggattacattaggcagaaaagcttttacacagcaaatgaaacaattgtcaaagagacaacctatagaataagagaaaatatttgcaaactatccaatcaacaagagattaataaccagaatatataaggaactcaacagataaaaaccaaataatccaatttaaaaatgggccaaggatctgaatagacaattctcaaaagaagatatacaaagagtcaataggcatatgaaaaaatgctcgacatcactaatcatcaaggcaatgaaaatcaaaatcacaatgaaatattatctcatcccaactgtaattgctattgtcaaaaaacaaacaaacaaaaaataacaaatgctgtaaggatatggagaaggaggaacatttatacattcttggggggaatgtaaaatagtacagccattatggaaaacagtatggaggttcctcaaaaaactaaaaatagaactataacatgattcagtaatcccactgctaggtatacatccaaaagaaagaaaatcaatatattgaagagttatctgcatgcctatgtttatcacagcactattcacagtagtcaagatatggaatcaaccaaaatgtttatcaacagatgagtggataaagcaaatacagtatatatatacaatcaaatattatttagccataaaaagaacaaaatcctgtcatttgcagaaacatggaagaaactgaaggttattatgtaaagtggaataagccaggcaaagaagaaatatcacatattctcattcatatgtgggagctaaaaaatggatctcatggaggtagagagtagaatggtgcttaccagaggctgagaggggaagaaagatggggataatgataaaatggttaatggatacaaaaatacagatagagaaaataaataagttatagtattcaacagtacggtagggaatttatagttaaaaataatgtgttgtatatttcaaaacagctagataagaagaattgtaatggtcccaatacaaagaaaaatattggagttgatggatattccaattatgctgatttatcagtacacattatatatatatgaatccaaatatcacatatatcccaaaaatatgtacaactaggttatatcaatagtgtatgtgtatacacacacacacacacacacacacacaaacaaaaaaagaattaaaaaatgaatgccaaaaatttccctgaatctgacttcttggtagcaatatacgtatttaaaatgcaaatagtacaatcaagtatgaagcaaaacagtatctgattatgtcgagcattctcaaaacagagaactggctgtgattggtcttctaaaaagtgaaaaatatgttaataaatttggatgataattacaattattgaataaaaattacattttaaggctatattgttccactttactttgaatgctctctaacatactcctgttaatgtctatttaattatgtcacctttaggaaaagttttaaaaacagaaaacttctaaagaaatacgttaatatagctaatacaaacattttatgtaacatatgttagtatagtaccacatactaattaatgtccaatacaaaacagtttatctaaataaccttcttagaataaatgctgaaaggtttatttaactgattttttttcctatgcagatagcattattttaaaatcacaaactaagggtgtcaataaacaattggttcgcttaacttacttattcttgaaccaagttatttttggtagatgctctaaatttcaatttacagcattaccttatccagttacctgtatatacatcttcaattagtttcaactagaaattgcattatgaaaaactgtagtgtaaggtgtttactgatagttttatagctgggacaggtatttactcatggttgatttagctttttatttatttttttacactaaaattattacagcagccataatctcaattacccatttgtctgtgtgaatgagttgagttaaaattaccatgtgatgagaatttctggttttgcatgctcagtttactcccaagaaaagatgggttgggtttttaattaggtttgcctcctaagaggcagtgtaacagaggaaactccatctgctggtggctggtagacgtagattaaaattaaacctccattattgtgtctttgtggaaattacttaacttttcaaagtttcagggaatttatctgtacagtgggaaaagtagtcaaacctacctcaaaggtcctctgtgataggttaaggagactacacccattaaatgcacaaaaatctaaccaatatgaagcgtgtcataaatgttggctacctgttgtgatggttacaagaactcttcagatttcatgattataaaccctacttaggcttttgttgaggtaaatggcttatatttatctagcatcatagagagttccaccccaagtgcttatcaatatttttacacaagcttagctaaattaatcaataggcattgcagctggctggagggataaaaatacaggcatacagttcctactgttctgaacttctttcctccattaatacagacccacagggactctacccagaccatatcctaagtagtgctctagatgccatggagcattttgttcattacattacatggtaacctctctgtggtatcccacaagataaaaatattttcctctaatctggaattagactttgaaagagttcttttgtcccagaagagatatggttttgttaattttgtaactgagtctgttctttttgtttagcttgtttgcttctttcactttggccctaacaaggtgacagtcaagtttgtgactactctatatggactatacaggcctttgcagcatctctgtaattacttactcttactctgatcctttctttaacttctttctcatctgtttgctttatttttctacactcatttttaatgtattttacctttttttctgtgtgaatcattgtaaactacttctgtttttctttggaataaggtagaaaattaaaacaaaattaaatttagcctttaatatttattagacatatatggaagcatctaaaatataatttatgactttctgatacaaacggaattctcttgcataaacattttgtggagtttatgtctcacattaaaaaacagcagtacagactgcggtaaattgtgaataaattgaagaaagtatagaaaagaataataaataggattaagagaacagaggaattgactcttgatgattaaagtggcctctaaaggaagtgatatatctaccttgtaccatgagttggggtgaattacaaaaataacaagctgttcaatttgacaaaacttctaggttataaaaaaaaaaagaggaggaagagaggaaataattttaaaagaaataaatgtccactatgtattttagagatctccataaagcaactgtgattcaaatgttttgataaaataatatataatgatgtccttatttttacactacaactattttctagttattttctacttggtacaagcaaaagatcttaaaaataaactgaactgaatgatatttgaggggagaaaaacagattataatacaagttaagattaaccgctcaatctttctttgcttttcttcctaatttctagatcttaaaataaaaacataaataaagttgtctggaaatgtttttttccttagtgttttataagtgaatttcacttttgaacatgaataaccccttaccttcaaatctcaggaaaaaatatacctgtatcaattattttttctccatcataagttgataagaacattttaaacactttaaaattttgaagcacaattcaaagattcagttaatatacgggtaccttcattacgatgattcattgtgcattaattaattttatttctttaatgtatctttcgatcatgctattttcttaaacaaaatagtttccccaaaattttgtttgtattattttcatagtgcaaataaaggcaacataaacatatttatctttgatttaaaactaaacacatagtgtttttaattgatcttccaataaaatatatttttaatctgggaagatctcatttatctctttttgaaaacaacaatagctcaaagattttaaacttttttcacctaaaagcaaaatgaaaatgtcctcaatgttcatttatttgtttgtttgttttggctttccattgtctccaaaagtttgaatactaaaaaagtaaaaaagataaaaagtagaaagaatattgattctgacaaaatacaccacctaaatgtagcagccctgcctcattctttagtttttaatctttttttttctatgttgctgagaaggcatggagaaagtgtgcaaatatgatttcttttttttatattacatctctcagatggcaagtgttaactaagaaagttgatttattttgtatatgtatatatattttttccaaacagaagctgttataatagactataagcattcagaaatgtgttaatgaatgaatgaatgacgaccattaaaataagaaacatatctatctgaagcaaacatgtcagcatacaggaccctttacggaatcaatatgcaatggaatcttaagaaaaaaagtaaaacctacttgataagtgatttgcttttggttaactttgcttatagaaaaatatgtacaaattggccggacgcggtggctcatgcctgtaatcccagcactttgggaggctgaggcaggcggatcacaaggtcaggagatctagaccattgtggctaacacggtgaaacctcgtctctactaaaaatataaaaaattagccgggcatggtggcgggcacctgtagtcccagcaattcaggaggctgaggcagaatgacatgaacccgggagacggagcttgcagtgagccgagatcgcgccactgcactccagcctgtgcgacagaggaaggctccgtctcaaaaaaaaaaaaaaaaaaaaaaagaaagaaagaaaaatttgtacaaatttggaaaatccaagtcatacaaaataaaaaaaagcttaccttaatatacgtgaaatatattatcagagacaaaacactaattattgtgactttgagccatgtgacagatgattaatccttaaagtaaacaatttactcatattgggctaagataacattcctccaaataataactaagaatccacgtaaaataaaaccttttaactctcaaaaatagaacagaactgaaaatcatggagcaccttagtttataatcatctttgttccatgtgattatttcaatactaaagttttggaaacaattaaaaatcctgccatatttaactaaaaacagaattttaaatctgtgctttttctacatttcaaagagttaagcattaaagatgctactgcaatgtgcacaaggattattataaaatagtagcttttaattgtataattgcatattggggtatcttcagttctgtaaagaactatgatttctttaatcataattaacctaatgagttaaagacaagtcattcttcttgtaaacagaggttacttctctactaaataatgctccaaatgaatatttcaaaaagtagcaaataaattttctttctgtcaaaacaatgaatttccaaggctttgaataaagcttagtcacacttaacctttttttaaagaatagtaaattataccttgaataataaatggtaggatttattattatatttctggtttgtattttatttttatgattgcttttagtttattttatagctattacattcctattacagaaacattattttcaaaaattgtactattaaaatgggtgtgctgcattatctgataaaaattaaatcattcatggcaattctctgttgataatatcttcaactccaactatatctttatgctaagtatgctgagagaaaattggcatgtaatagacaatacagcaatttaattgtagaatatggcagctagggagaagactacataacaaaagaaactcttaaggtatctagtggctaccatattgaacagatgggtctaactaaggactttccatctcacacagaataaaacttgaaatcgtccaagtgatctatcaggtcctagaactgattttctaccatgatatctatattttaataagccaagcatggctctttctctgggttttcataactgcagttctctatcaggaattgtgcctcttcctctctcatagtcaaacgactttttccatcacttaatatagatgtcttctcagatttcaacttatcagaaaggctttctttaaccatcctatttaaaacagcacctctcttccaaaattttctacttgatacttgtatttatctgtctttattacagttatcactacataacttaatattacatatttattaatattgttattttatatgccatttttatgcaatcgaatagaagctccatggcagcagggacttcacactgttcactgataatctccagtgcttacaatctgtaactatttattttttaactaataaatccccagctctaagatacaaatgcaaaaactcaaagagtttgatagactggcccaagacttcctagctagtctttggtggtctgggaaatgagcctaggttctctgaaacaaaaaggagctcaaactttccccttaaaaccaagtttttattacattgatttaagaaaatgtgctagcagttagcgtttcataggtatgcttcccgagagaccttctaattatcctcctagaaatatatatatatatatatatatatatatatatatatatatatatatatatatttacacacacacatatatacatatatactatacaaataaataaattctatatacgtaatatatatcctggctacatttctaatgtaggttttgtaaccttaattctaggaactatagattgattacacagcacatttcaggtgctacataaatatttcataaagttgaggctcttcctcatcaagtcagtaactacttcagtaaagctctactataattgaattttcatattttattcagaaggtaagagatgggtttgagcaactctgagaaataagttgtcagttccgattcatacaaaaatactctaactcagtgtttctaaactcgagtttataattttcaaaatatctcttttatagatgcttaaggatttaaattttagaaccacagattcctcttatttgagtttcatggtgaactgggagtagaaagaagttataaaatgcaaacatttcatagtttcttctttagacaattatttgccaattatttgtccattgtagttacgtgtccctactgttattctcacagctgtttctcctataccttaatttaaaaaaaagtaatttaaaaaaccacaagccttacaaagaggtgaattctaagatcaacttaaaatacgtcagagcacagatattcaagggtatctgtagtggatgcagatcctcactggaatttgttgaatatattaatctaattaaaaaggtatatgtttccttacttaggggaattggtcaattttataagcttaaaatctaaaaagtagtaaaaaattttcagtatagtcatttcagctgattcagtgaggtgaggagtaatcattacagcagctaagatttattacaagcattccattttccaggtactgcggtcttagctatcaaagtgtactgatctttgtaaaatctgctccattgtaaaatggatatgtcaggtcattatttttcctttcatcaagtgtcctcatttgtactgattacatacttaccaaggaaactttatatttttgcctaaaatattggtctaccaaaaaaaaaaatgatcacatgacattccagttttccacttcatcggatagggatgtctcaagggaaatatagaaatggctttgatgataactaacttgtcacctaagaatgtcacagggaattaatgtgtttactggtctcgtcactagaacaataaattcttctatttaattaactatttggcaccccgatggctacctgagttatgtgtgtattttcatcactcatcccagacatggatagggggagcactggggcttcacagtgctgactcaggtcttacagttcttatcactaccacttccatctactaatgtaggtttcaaaaagagatcagaaatatttctgcttaagaaaactctaaatttacataggttttaaaaaaaatctacaaaatgaaatcagacatggaagggacaatttcttaaacaactagtattgaaaaaatggaatatccatatgtaaaaaaaaaaaggctggacccttatcttacaccatatacaaaaattaactcaaaatggattaaagatctaaatataagacctccaaaccataaaatgcctagaataaaacgtatgagaggtgttttgtaacactggatttgacaacgatttattgaatatgacaccaatagcacaggaaacaaaagcaaaaatagacagatggactacctctgactttaaaactttttgcccaattagtgacacaatcatcagggtgaaaaggcaacctatggaataggagaaaatatttgcaaatcttacatctgataagggattagtatctaatatctaaacaactcctacaactaaacaactaaaataaatcaagtaacccaattaaaaatgtgcaaaggacttgaatagacatgttttaaaagatgatatacaatggccaatagcacctgaaaagatgctcatcatcaataaccatcagagaaatcaaatcaaatgacaatgatatatcatctcacacattagtatggctactacgtataaaaaaggaaaaagaaccagaaaataaaaagtgttgataggaggttgagaagttggaaagcttatgcactggtggtgaaattgtaaaatggtgcaactgctatagaaaacaattttctttaaattagaactaccatatgatttagcaatcccacttctgagaatgcactcaaaagaatgaaagcaggatataaaagatatattttaatatttatgttcatagcagtattattcacaatatccaagagggggaaacaacccaaatgtctattgagaggtgaacagatgaacagaatgtggtatgtattgagaactattcagctctataaaggaatgaaattctatcacatgctaagctgtaacatggatgaatcatgggaatatcatgctaagtgaaataatccaatcacaaaatgagaaatactgcaaatttccacttttatgatgtatttaaagtagtaaaatttatacatgtaggaagacaaaaggttgttacccagagtctaggggtaaggctggaatggaaacttgtttaatgggtaccaaatttcagttgtgcaaaatgaagaagttctgaaaatctattttgaaacaatgtcaatatacttaaaactaccaaactgtacacttaaaaatgtttaagatggtaatgtttatactatgttttttaatcacaacaaaaggaatggggcatgtatgtgctgcttaataaactcgcagatttatatttaattcttttaaaatcaacatgagatagaggtctttattccaattttcatgaagaataaaagtggctctaggtgctaagtagcttgtccagaggttacagagctgtaataggatctaaatctctgtgtctgaaaccataatctgcattccattaccaaatgcttaataaataaaatgtacaaaactcctagccactctccacctaagtctactgactttgagctgctagctccatttatatggaatatttaccattcaccgaatagtcatactttctattgtcctagatacattatataattcagttttcaaaataattctatatgttttattagctcttaacagtgaaactgaggttgaaaagattaaattatttgcccaatttcatgttttaaatccaaagttttatgaagtcagagcttccttcacaatgatacgattctctcaagacctgaaagttacctgatttttcctatttatatcatcctatctacttaagaagcattaaaatcttataaattcctgcaaaactatacttttgctattttctttttcagtttgataaattttgtctcaaaataaagaaaatggcatcatgatttgcttgtaaaacatcctttcaataaaatgtatcaagtgtctactatataactggagttatagaaataaaacacaagtctcatacattcgtagagataatattctagtggaaattgactataataataacattagataatgctttgtagaaaaataaactagaataaagggttaaaatttgaagctgggtatcatttcttacataatagacaacggaatcagagaaagcctgtctcaataggcttttattaaagcagctaaaagttaggcacaattctaattatttttaaagtataatcagctattattttgaaaaggctcagtgtatataaactacttctgcagaaataaacaagacactgtacaattgatattccatgcataaatgttgataaccatcaccctcataaaacaatttacatgacaccaaaaggttaaatttgtgaactatcctgaaataattgttatgaatcatatatgcttttcttatgggaaaatcacatatgctttaatccgtgcctactgtattttatttggcatataattactaaaagtttagttatctgactctttaaagcttcttctggcaagctgaagtgatgatattttgctaaagaggcaaattgacagtgacgataattgacctctgtcaaactgaaatcaacagaagacacagaagaacaacctaatgcaggcagagcttaaaacctagacaacgggttgataggtgcagcaaaccaccatggcacatgtatacctatgtaacaagcatgcatgttctgcacatgtatcccggaacttaaaagttaaaaaaaaaggtgatatgtatatatatatatatatgtatgtgtgtgtgtgtaatgaaatagtattcagccataaaaaggaacaaaataatggcatttgccattattggagaccattactctaagtgaagtaactcaggaatgaaaaaacaaacatcatatgttttcactcataagtggaaactaagctatgaggactcaaatgcataaagatgatacaatggagtttggggactcaggggaaagggtgggatggaggtgagggataaagactgtacgttgggtacagtgtacactgcttgtgtgcaccaaaatctcagaattcaccattaaagaattattcatgtaaccaaaaaaagaaaaaaaaatttaaaataatggcagctaaattagggtaattaagggtaaaatagtaaagatattttaaacatcttttacagtatcaaaatataagaactgcagtttaataaataatcacaactagattggagttaactataacatactcagccatggtgagtctacactgttaaggaggcagagggacatgccacatattttacaataatttaaaacatatatattgcttaatattagtcaacttggttttaaaagactaagctctaggcatttagacacattgctttgagaaatgacatatttcctggactggccagactgctttttgagtaaattggagccacaaaatcaaggtatatattcaatccatgaatgttatgatttctcatatgcagcattttgaggttctgatacatcaaagcattctgaataataaaatctcacatctaatttttatccttatttgaagacactctcaaaatcttcacatatttccaattagactttgagaaaacagtaagctaaattattattaaaacactcttaaactatatgtttaatctgaacattgtaatgattaaaatgacccactcagattaaaattgtggttgttcaaatactgcatgttattatttataaatgagagtcaacaatgggtacatgcagacataaagaaagaaaataatagacactgagggctccaaaaggagggaggatgggaggggcatgagggctgacaaattagctattggctacagtgctcactatttgggtggttggcacactcgaagcctaaacctcaccaatatgcaatatatccatgtaacacacctgcacatgtatcccctgaatctaaaataaaatttaaaaaatacagttaaaaatcatggtcatataaaaataaatatataaggagacaaaatcaattactctgtaagatcttctatctttttttccactagagtaggaggcacattggaaacaatgacttgcatatccagctgattgaccacggagacctgaaagaagaaaaaacagaattcatttaatttttactcactgaaatttccataatcagaaaacccccacattacctcttccctactatgcatagacacagtggtttctgattttcaaattcaggaacaaatatatatacatttttaattatatgatctacacaaggggttggagactaactggggcagactgagcatgagaaactatttgttgtttacctagaaattaagaatcctgagtgatttcaattgtttttggttatgtgtttgttttattggttatttactgagacatgaagggtggcatttttttttaatttgattgttaaggaacacccaagataatgaaaaatacgttttatattttacaagtcttgagaaatcatttattcattataactaagaatctgagatatgactggttagaataattcattctatgaggtcatcacatatagttttcttgtctatttaaccaactttaaatttgtgtaggtagaggtatatatttagaactttacatatgggttaaatgagctaatttaatggctgttgataactatgtatcattcatttaaaatctactgaatttcttctatgttcttatatttgaaaaatagaagaaaaataaaaatatttattctgtgcttacaacatggcatttcatcttttcctcaatattctacaggtttaactcattgaaatctatcaacagaatcaggttgttattaatatcatttcgattttaaaacaaaaaaaataaattgaggatatatttaataacttaatcctaattaaatgcagtctgccttacaccagagcttgtgctctttactattatccaatactgatataaaaattctaaaaagccatatattatcatgcacatacatttatacactattaaaatataaatgcatttgtaccagaatcataaattgaacactctgagttaggcatatttagcaccgtatctcaatacaatctacagtagggagtaatttcacattgccacacatgtttttataggctccagattctttacatatagagaccccattaggggtcacaaactcaaatgccttcaggaaccaggcaggtaacttaaatgagaaaagtagccaaaagtatgaaatgatagaaagaagtgtaagtaacaaatccaagagcacataactctgctgaagaggtcagctactactcacctctaaggaatattgcagtgtgggaaacaaaatccagatttcctagatatttcagtttttcaggaaaaaaagaaatccaaaatattttgtaaaatgtttgcaactagttagaaatctatcaaaccattgtgtgagcatgatcaatcatgtctgaagactgtattaagacaggagtaggtctgattattacttctgagcaagcagtttatgctggcagttctaaccttgtacccctaacccgtcataggtgtctgggaccaaatgactaaatttcccttcaacatgtaaatgagtcttgattatctttttacaaaacactagctacttcactagcgaactagcgaaagggatcattacagtttttgtatcactttgtcttttcttattggtcttgagttaaagaggatatagaagttgaatagaaatattttttgttttattgtttttgagtttttagcagtaaaattacatgataaaaatttctagaagtatgtatatgaaacttgcataactgttccctccctccctcccctccttccttccttctttcttccttccctctcctcctttttttctttcttttaacattgggccagaaacggttaaaaaaaagttttgataaaaatcaaaccacccggaacaagtagtaactatagggtgttatcccaacgagaagtataatcactaggcctcattctctgttccctgaagctcccatcatctcctctaactgctggactcagaagtactggagtcctggcctcaggacagaggagcttttgcagtgggactagtgctgaagcacttcctaattccaccatctgttgggagaaagctcctggaccatgatgtgggttatggatagggtgagtagtagggaacattagcaggatactggaaaagagaagaaaatgagtaggagaaataactctttattactggttctttcagtggagaattgttaggactgtctgccctgtcaaactgtcctcttctcacatgtctgtctcctggtctggtaagcatgtgcttcaacccaccttttctggctgacagactgttacagatccgtactattagtatcccttgaattttccactgtctcttatttccctacattcatcctgcccaggccttcaaaaatagacccttcattaaactgtcttcaaattatctgactcttgcagcggagacttaaaattaaaaaaaaaaatgtttcacatgtgcatgaattttctgccaggtccttactgatatagatccgaaaaaccatacaatcaggtgtcaggctgtatataccagaaatcggtcacactttacaaatatgatatatgatgtgaacaaaaacaaaagtgggaaaggaactaagtagtaactagtggaggatagattcagcagcctcagaggaagaccaaacataagccttcctatcttagggtagaaacaggatttaatcaaggaaatctcctgctcccgggatggggatctacattatatatacccaacaggatttcagaattggcctggacaattccatatgtctaccattactgtcctcttcaaataggaatttctagtggatattctgtatttttccatcatctatactgggtgaatgtgtttgctggatcactaaaacatcagaagttccctctagacctgataaaaagaacagcatgacatctgagatccaggtgttaactttgataagactttgttctatttgtgtggaaaataatgaaataaatatttggtaatcagaagtatagactggttagctgttcatccagctctttctgtcttcccactgggaacacacagtcgatttctcagccttctttgtagtttagtggagccatatgatggagttctgaccaacgtaaacttagtggaagggaaggaatgaatgttcttaaatttgaaggatagtcactgctttctcttcatcagaaagataggttacttattcaaaatactttaagccaggcgtagtgcctcacacctgtaatcacagcattttgggagactgaggcaggctgatcaattgaggccaagagtttgagagcagcctggccaacatggtgaaaccctgtctctactaaaaatacaaaaaatagccaggcatggtggtgcatgcctgtaattccagctactctggaggttgaggcacgagaattgcttgaacctgggaggcagaggttgcagagagtcaatatcacgccactgcactccagtctgggcgagagactctgtctcaaaaaaaaaaaaaaaaaaaaaagtgagattttgtgcaaaattctgactgaaatagtaggagctaacatttaaggtatctagaatatatccattttaaggttacattttattaacaagattttatgatgttaatacattttgaaaatatacttttatattttattttaaggatataaaaataaaaaacatttaattctgataaattaacagaagtcgcactaccgggagtagttgtcccacacttacctctaaatcattactttaaaatttttaaatctcctgaatgtgctaatgtctggtttatgtagaacacacacattttgactatgcaaatgaagaaataagatattacagtttacatttggtctttgacagaaattctacatcctaactctggtttgttttatcatctataacaaggatatttagctgtttaagattagtagattttatttatgctacttttccagtatagcttctgcaaatatgcaaatatttccagaaatttgcatgtcagtttattacaccaaatatttaataattctctgtgaaattatttaattctgtagcttaataactaatgaaagctttataaatatgtttccatcatcattgagattgatatttgtaatggattcaaattactaggtattgttaaaaagaagagaaataacatttgtgaagcacaaaattaaaaaagcaatggttggaaatttacatgttactatttctatgtcctttccatttattctcataagtttcttttctttcttcctctatactctcataaattttaaatagtgctgtccaatagaaatacaatgtgagccacgaatacaaatcacatatgtaattttaaattttctggcacccacattagaaagataaaaataataagattaattcaataacacatttaacccaatatgtttaatatatgtttagtaaaatatcattttaacatgtaaagaacattttacatatttttatcaaagtctttgaaatctggtgtgtattttatacttatagtacatctccgtgtgacctagccatgttgcaaatattcaatagctacatttggctgatagctagcatattggacaacccaactttagagatattcatcatctcctgcttgaactgtctttcctaactaactaactggtctctgctgcaaactcacattttattaaataaaagaggtgttttaatagtccatttagataattatgtattttcttttttaaatactataccaaaatttagtttccacatgaaatctgaaaccatgttcagttatactacaatctatttgtctgtcttgtactttttttttcttttttgcgatggagttttgctcttgttgcccaggctagaatgcaaatggcgtgatctcagctcacagaaacctctgcctcctgggttcaagcaattctcctgcctcattctcccgagtatctgggattacaggtgcccatcaccacacctggctaattttgaatttttaatagagacgaggtttcaccatgttggccaggctggtcttgaactggtgacttcaggtgatttgcctgcctgagcctcccaaagtgctgggattacaggctgagccaacacacccggccattgtactttgaattgattttttacacgtgcataattttttaacatcctgcattggccacttggaaaatacaagtttactgaacactgcagatattgtaaatatcaacacacttcattacacaatatcaataaataaatcacattatttaatacaaccactgactcatcaagaaagtctaaatattcggaagctagtcaagtttacagtgacaggtacatttttttaatattctaatttgtgcttcaaagcttcagtattatcattagttggttgttttcaatgaaatgacaggctcccttcatccattttgtgtaaatgcctaccaaatatttaagtttgaataaccatattttgtctctaagttgctctttcatataaaaatgttagtccataaaaaaagcagcttgttcagcttgcatagtgcttttccttgaggcaaccatcttccacatacagcagatgtactctatgcatacttctcatttcatcaacaaaataatgaaaaggtgtttaggacactttcgttgataggttagctagctgcctagatagatatacagtatttactaagggaatgaatgtgaggtttaggagagaaaggagtcaagaaattttttgcctaaggaactcaaagtgatttggtcatcaaataaaatgaggaagactacaggtggaagaaatgtgatgaagaagagaaatccattaggaaacactaaataaacaccttttaaaaatattcgggtggaattgctacatgtacagataaatatgcaaatctggtgttcaggaatgatctttagtgtaaagatgtaagtatgagcgcttttactatgtagatgatattttaaagttatgggactaagtgagcttaacaagtcagtgagtgcagatagaaaagagatttaatgtctgagccctgagaaacctcaatactacaaggtcaggagaagaaaatgaaccagtgaaggagactgagaaggagtaaacagtgagatagtaggacaagggagtatggtgggtggtctgaaagcatagtgagggtaatagtcaagcattgctgatggttcaagtaagataaggactggcatcatcagtacatttcctaacatggaagtcattggtagcatcgacaagaatagtttggaagagtgtttggagagaaaacactcttatgattagagggtttaagagagggtttaagagagggttcaatagtgagaaataagtcaaatctaacatagaattttgctaaaaagaagaatagaaaaatggatggcagctagaaggtgatatagatcaagggatgttttataatttttggaagatagaaaaaaagcattgttgtgagaataatctgatataaggaggaaatttatattaataatgtagaaaagaaatgggagagctgctgaggcaatctcctagagctggcgagtgggaattgaatctactgcataagtagaggtacaggctttagataaaaacagaattcatctaaaggagccagaaagaaggcaaagaatgttggtctagatcctggagggtaggtaaatttagtggcaggagtcatagaagtgtccttctaaatgctttagtattatttttctgtgaaatagcatgccagttaatcaggccatagtgagaatgaggacaaggtattggagattcaggagcagagaagattttctaggacatcgaggcaaaatagagtgattactgaccaaagcaaaagctcatttggagggtttgttttagtcattaatttaaattgatactgatgcaggagaacagggtctggaggcagggaacctaaggccaatttgtgctgacttcctaaagctaaatcaaagggaaaacaccaaggtctggggtcagggaatctaaggccaattcatgatagttttctaatggtggattaaacaggaaactcctgggtctgggggcagggaacataaaccaattaatgccaacttcctaaagctaaacaaacaaacaaacaaaaataccatctccccacaccccacctgagtaacaaaggatcaaaggctactctccctaaaaccttcccccttcccccatgtctcagatggaaagggaaagtgccttggagtggctgtgggccaagcaggggccatcctttcatttgcttagggcatcaatccactcaggccttgggtcaattcagctcagcctttagcctcaggccaaatccttcatccagataaggggtagcccacagggacctcaaaaggagtattaaaacccagaaaactttgtaaccaggcccttgagtcacttgcttgagtccactcccaacttgtggagagctttcttgctttaataaatccctgctttccgaggttgcagtgttgcagtgagccaggatcgcaccactgcactccagcctgggagtcagagggagagtccgtctcaaaaataataataataaaataataaataaataaataaataaatgcccactttccttgctttgttcctttgtttcgttcctgtgttaatttgtgtgttttgttcaattctttgttcaaaacaccaacgacatggacaattcacactcaaagccgtcatgtaacaatactatagctaggcatggtggtgagtgcttgcagtcctaggtgctagggtggctgaggtgggaggattgcttgagcccaggattttgaggttgcaataagctttgattacaccactgcactttgacctgggtgatagaaccagaccttgtttcttagcaacaacaacaacgatactaattatagaattttgtatgtttttgcagacataatcagcatggatataggtctggagaaaggagacagttggaattaaccaaagtggaggttttgctaagtgaatatgacatagagaaagaaagcaagaaagttaaattttatatgatgtactgcttattataattggtaatgcattataaatccagtaaacaagaaagagaacatgagaggttctcatgagagaacacaatggaagttaaaattattcggctaattggactggacatcctggtaggaacaaaagaatgatgggtttagctgcaatgttaattaaatgttatggacaaagagtgggaggtttgaaatggaggttataaaggtaatggcaaggtaagccaagaacagaaagttaaacaccacatgttcttattcatatgtggaatctaataaaaagtgtttaccgatcttaatttgatcaaaaatttatgtcaaacttaatatctcctatgtcaaaagcttcttggcttagagtggccttcatttactctattgcagctttactgttaaaaatgagaatgctcctggaggactgttttggccacaatcatggtgattgttcttcaccattatctaagaagaaaaataaagcattgatgtctgcatgtatatgaaggttacgcttgtccagggaactaaatgagaagaactgcgaaaaaatgaaaatttatgatgtaaagaacaaaagacaacttattcttgatctgtttttatgtgacaaatatttctaatgaatatactttgtattagattcatcagacaaaactccaaataacccatgctttcaagttggtaaagagtccacaggatatatgcactggtgttaaatattttcaatacaagctaatatcaaacttccctttcaaatgatctatcactaaacttctgcactgcctaagtgaaaattagaacagtgatattattgactatagccaaatataacttagtcaaggctaaacaatgtcatcattgggaattttgatagaacaaagaaataaatactattggaacaaaatttgtccccaaacattttctttgttttctcaattacaaaatgctgaaagtaatttaaacaaataatttcatagtttaatttctatagtataactctgtgaagcatttaaaatttttatgtagcactggacaccctatattaaacatgagctttgaagacaaaatagaaatccagtgcttatacctttgctgttacaatcatattttttcaaatattataatgtttttctcaaaggtcaagaaaaataaacaccttacggtgtttttgtaaatatatatatatatatatatatgaacaatatatttacatattcctaaactatagtgactaacaatctgagtgaaaataataattatgtttttgaaaacccgttttaaattaatcttagaagttctataaactgaaaacactgacctatggctagtatcgtagctacttccctttcctgaagttttatctacttacgagtacatcggctttgccgctcagtcccttcccatagtcgtcagttgcaataacttgaaacttgaagtaggatctcctcatattatggaagagcatagcagttttgataagccctgtatatgtttccactacaaatccttcttttccctctttaattggtggtattatgagtctgtaggccatgacactataattgccagtatctttatcagtagcctagacggaggggaaaaaaaaagagattataattaagcaggaaaagataacccttatgaaatggcttacttttgtttgtaagaatgaggtttcttatgtaataataacacaataaagccctcctaaatgtctgttttttctggatatagttatgtagattaatagactttgtgtccacagtttcgaatggttgctattagaatgataataactgctgaagtatgaataaaagggacataggtataattctgtaccctttaacaaatttctccctacccctcctttccttttacccttaccagcctccagtatcttgtattctacactttatttttatgagatcaccttttttttagattccacatatgaataagaacatgtatgtggcatttaactttctgttcctggcttatttcatgtaacataatgtcctagatagggagaatatgttctagtgctctataccactgtagaataactacagttaacaatagtatatagttccaaatagctagaagaaggatatcgaattttcccaacacaaagaagtgataactgtttgagatgacagatatgctaattaccctgatttgattgctatgcattatacatatagaaacatctatgtacccaataagtaagtactattattatttgtcaattttaaaaatagattttaaaaaataaacagacatagacactaacagagtcaatgaatcaagacttttggtttacaggtttgttgagttcaactgtgtgtgctgatccaaattggttgaaagatgggattggttgtttacctaatgtttgtcttgctgtaataggcatacagtgtgatggtatttttgatgtagtatatagcctaaggaggataaatataaaagaacgtagtaaaatatctcgaatgaaataaaataaagttgagttataacaaatttagagatgcataaaaatattctaattaattaatgccataacataattctctaattagagttagaatactatccgacttcctttttaatcatcctgtatcccgattaaacatatttgttcctggtgataggtacttatgatccacatattaaagtttcctaccatttagaattaaaaaggactaacacattgtttagatttttttcatttgtttttaaatacagctatgagaatcatatattgggctggctttatggtgtctaattaggggtaattttttagaatgtctatttcagaaccatttcatagtgaaatacttggaaaataaatggtagataggagagttttagaggcttgataaaagactatatataccttattcatgatactagatatgtaagttatacattttcatttgttataacaatgattattatttttattatccgattattcttatttttacctatgctattattattaagtatgagtatgcatttatgatctgccattactaagaattgctaagaatcatacaaaatacaaaatacaatcacacaaaataacatcatacaaaaatagtcttatctaataacaatataaaaaactgaggaatatattgttttacttatataaattagtgatattcaataaaattttctgaaatgatagaaatgttcttaaccagctctgtcttatgcagtaggtactagccaaatatgacaaatgaaaagtggttgatgtgacaaagaaactgaaatttcaattcaatctaattttaatttaagttacataatgaaagactacataataagtagtaaagttgagacacaaatgattaaaatagtaaatcatagcaaatgtgtattaaatacagcatcaacttgatttagcttcaaattctatatatattgtgaaccatttaaaacgtttccagataatcatatctacttgttagaaaaggtaatttaaactactcaacacagataatttcacttcaggatcagctgtttcatgaattttctagggagttaatattctcttttctttatttttttctctgtcacccaggctggagtgccatggcataaactcggctcactgaaccttagtctcccaggttcaagctagcctcacatgtcagcctctgagtagctgggactataggcactccactacgcctggctaattctttgtagacacagggtctcgctatgttgcctgggctggtctcgaactccttgactgaagcaatcctcccatcttggcctaccaaagtgctgggattacagacatgagccactgtgccaaacctaaaattatctttagaagaggacaagctcaaactaccggctaatcactttagatagtttatatggcttacagcatggcagagctcagttttggtattagagtaatagtaattagttatcaatgttaggtcacattctcacttaaaggaaaaagaaaatgaacaaagaaagaaaaacagtatcaaaattttttgtacttaaactttgaaccacaggtttataatcactcaacaaaggatagcataagatagaaaaaggcatattcccagctaaaataagtcaaagtctgagtcaaggtatccaagacatttcttccacatagaatgagcaaatttgggcctaatgtcagatcagtcagatttggttacatattattctctatcttcttattaacatggatatttctatgaaacaaactttttattattaatgtaaactttataaaggaataacaaacatgcaaaaagtgtacaaattataaatgtaaagctcattaaaattttgcaaaatacacacatctacatgaccagcatttacatcaagaaacaaaacaagccaggcatggtgactcatgcctgtaataccaacactttgggaggctaaggctggaggatcacctgagcccaggagcttgaaaccagcctgcacaatatagtgaaactcttatctcttgaaaaaaaaaaattacccatattccagaatgcacttcatgcacttggagtcacaatctgagaccttcttaaggaaaaccactttcctaatctaacattgttgattagttatgcctatttttaaaactttacattgactgaatcataaaatatgttctattttctgtctgacttctttcattcaattttgcactgtaagattctaagcccttatatttaaaataaatactgtataacaacactatcacatttggaaaagaaaaggtggttaccataaaatcaccacagtgattgcttggtatattaagctactttacacagttctgactgattaacttccaatttcagtaagcaggtaatttcactttgcaatattcctaatatattaaattatgataactacaaaatagtcatattccatcttaaaatattaaagtgttctgttaaatgtgcctttcctgaaacaaattatcacttaatgcaaaagtttgggtgtggaactagacaatttaactcagaaataactattttcttttatgatttttcatataaatgccttaatatttgcagaaaatagtcaagaatgagataaaagtttttttaaaaatcttgtctactggaattaaaaaaaataaaaccctattgtcatatgtatgttatacagtaaggactctaatttttatttctttgaatgaatatgatagtctttgggatcttagagatcttatttcaggagatattcatcaaagatgattgccaggatcattagcatatttttcaaatctcccctcttcctcaagtatgttcagttgaatactagtaatttaaacagtgactgatgaaaattccaatgggtgccatacttaagagcaattgcatggatttttaatttttagtctccccaatttataacaaatacatattttaaaatccgaaacctctcctctaagatgtgactctgattgatgtggagcatatgcaataccatcatacatagataacaaccaaatgttctttctataaaatcaataacaggatacgatatctttaaatacacactgagtcacaccagagataccaataataaaattcagagcgcagttttaaatctgggtcaatatgtgaaaaataagtgagagtttcagcacagagtatattgtctctatttgttgttaaataattttaaacttacttttttgcttgttttttgcattatgttttggagtgaggtggactccaatgtcaggtgtgactttgaaaaattaataactcaaggccgggcgcggtggctcacacctgtaatctcagcactttaggaggctgaggcgggcgggtcacaaggtcaggagatggagaccatcctggctaacgcagtgaaaccccgtctctactaaaaattaaaaaaaaaaaaaaattagctgggcgtcgtggcaggcacctgtagtcccagctactcgggaggctaaggcaggagaatggtatgaacccgggaggcggagcttgcagtgagccaagatcgcgccacagcactccagcctgggtgacagagcgagacgtcgtctcaaaaaaacaaaacaacaaaactaataactcaaaatttcagatttctttattcataagataaaaataaggatgcccaaaaatagtattttaaaattttatatatattcatacgtgtgtgtgtgtgtgtgtgtgtgtgtgtgtatatacacaaaaatataaatatgaccaagtccagtgtaactattatagttacctaagttgtcataatggtgattcaaaaggtttaacattttttcatattatgtttatccatgaatatgtaaatttatgcaatcaatttagacccttattacttcagacatattatcacacaattgtaactcccttataactctacttttcttaattttcttttccagctctcctttattgcttccagttcttgttttgttttgttttgttttgttttgttttgttttgttttgtttttgagatggagtttcactcttgttgcccaggctggagtgcaatggctcgatcttggctcaccgcaacctccacctccctggttcaagcaattctcctgccttagcctccccagcagctgggattacaggcactttgggaggctgaggcgggcggatcacctgaggtcacaagttcgagaccagcctgaccaatatggagaaaccccgtctctactaaaaatataaaattagccaggcatggcttccccctcatttttgaagcaattttgcaaaacctcttcctcagttgaaatccatgaacttttgtacagtacacactctacccctccttgttgccaaacataatgaggatgttggtatcttgctctcagtctaccccttctacttcaacttcctccctctttacaaatttcagtattcattgagatgacacatccagcaacttatttttaaagtattaggcatgaataacattcatcagtctttgaacgacctcactgcatcgatttaattctacagtcacactttagtcttttgccttagggagatattccgcttaaagaaacactccatatttaatttatatattaaactttcatgtctaaattctgaccacaactttaatcatcatacttagttaagacctcttctttgatatcagtgaattttcagttctgcaaactgccttttgctcccattacttcagggtttatgtccctttctgctttatcatagaagtcagagttgatcacattgttctcatttctctctccttccacaacacctggatctttctcctcttggaccaaactaaccatcagtttactcctggtgactgaagagggcgcagagaaattaaataatcagtcagactagtgttactgtaagtccatggtctctgagtttcactgtgcctttgtctatttaggaaatccttgctatatgtaataagttctctttctcactccagaagtttgcctttttctttagttcacagattctttcagtcttctccagagataaggaagctctaattcccataaaatttgaggatatcaaatgtgagatctctcagcttttcatcacataactaaaaaagtacctatatctgtacttactttgactactttcttcaaatctcagaggagcagctgacacgtatctctcactgaaggtacttatgccttaatctgaatcactcccatcccttctgcatttaatgcttcatcagctctattgatctctgtccttttcacctctcctctacagactataaaacacgttatgtctctctcattaaaatgaaatgaaacttttcttttactgagtccacactcgtgacactagcccccaaacttccatacctatttttcacagttaagttcctcagaaaatttttatagaatcaccatctgtaattccttactttacaatcatgccttaaccgcagccagatctctgcccctgccatgccatttaatttgctaacatcagtgactgaggctggactccatctcagatcaacaatcagtctggtgttctttaaattaccaagtccatttatgttgtttgtataatgctgttgctgcttccgctgtttgctaacatttattgaacacttacaatttgccagatgctatgtaaatacatatattattacattatctcatgacatcctttccattgagtagattccattattattttataggccaagaaatggaggcacagagagattagtaacttgttcataatcacacatatggttgttagcacagtgggataagtctcactttaaagccactacattccacatgtgagactaaataccagggataaaactgcagtttaaaaataaaacaacaaatgttcgataaaatattctaagaaatcttcctagatccatcaagaagatggaaagacaataaatatgccagtcaaaaacaaagtgctatggactgattatttctccccaaatttatatgttgaaacataatactcaatgtgatgtcatttgaaggatgggcctttgcaaagcagttaagttcatgatggcagagcccccatgaaacggattggttcctttttgaaaagaggccccagagacttcctttgttccgttttgccatgagaggacacactagaaacgcagccatccatgaaccaggacggcctcgctaggcacttaatctattagcaccttgatcttgggcttccctgcctccagaactatgaggaaaaataaatttgtcttgtatataagcttccaagtctatggtattctgctatagaagtctgaatgcaaaagtaaaggtaagaatataaaaaccatagtactgatgggagctttcatttagaatttttttgttttttttactgacctgggtaaaattaaaatttaacttgtctggttttcagtagctcagacaataggaggcaaggccccaagcctactcatgaaagtgagtctattaagatttccctccccagaaagttaaattctcaccgtaagagtaaaggagaaatttacttttccccctgctaccactgctactatcaccccaaactgcaacgaaaactgtaaacttaaactttgctattgaggggagtgaagagaaaacttctttgagaatctaggacgaaatacagcccctcattttagtttgcagccattatttgccggccaccagtttgcccaactcaaggagaaatcataatattccattggtaaagtctaataggcctgatctccacctgaatggacagaaaaaccacaacctgagaatttaagagaaatcatctatgactgaaaatggcctggtctcctgcctgacagaagcaggtgctttttcaaaaacccctcctgcaagccatgcctaaaataattctaacaaataaagttccaagaaagatgaaaagttataataattatcaaaacaaacaagaaacaatcataaaaaagtccgttgagataaaaaaatcaaattcataacaacatagactttaaatatttgaattagtagacactgaatataaagcaaatatggttaatacatttcaataataaagagctttaaaatgcggaataaaaaatgagactcgttgaaaagaaatgaaaaagtatcttttagaaataaaaaaaaattagaattaaataccccaagatgggattgttagcaggttaagcgcagctgaccagggaattagtaaatgaaatgatagggcaaaggaaatgacacagaatgtttcacagagctacgaagatgaacaacctcaaaaaaaaaaagtttgagatatggagtttagaatgaaaattttggcaaatatctaatcagagtttcagaaagagagaaagcgagaatagaacagaattttccagaactgataaaagattgttatccacagatattaagaagcccaataaactgcaaacaggataaataacaagtaactcacacctagaacccacatgtcatatagaaactacagaaccacgtactgtaaatataataagtattgttttcttaatattttgggaaaattcatagagatattttagtaatggcataaataattcataaatatattctataatttattaatagtaataaggagatgtctaacaagttgggttaaattaatgcataaaaattaaaactgactcactgtggaaacgctaaatgaatacaatttactaaagaattaatatgatattactttttccaccaatttctctataatcaaacatttatgctcagttcacaacaaagtcattaatatctgggagaggtgactctggaagatttgattcactgacttttatgagtttcccttagtgaacaaaataaaaaaaaaagttagtctagagttcttttaaaagaataaaagtcagaaatgaatattataattatacttgctataattatattttaagtgaaagcttagatacaggaaaccacttacccatttctaagacctcatctggaaattttaatggatacagatgtacaacattaaaagaaaatcaccaaataattgcctctatcatacaggggagtaggggagaccattaattttctaatagcctaaataactgttcccctctgttgcctaaatgaataccatggatgcagaaatattagtgaaataattagtgatgtcctaagaactttcaaacccattaaagttcagtaatgccaagtttaactttagcttctcaattagacccattttaacatttaacggtattgaaggctcacttaccctgaaatagagtgaaagtgttttagactgtctggataaaaatactcaaatctcacatttccacctaccaaggtcactatgtcaagtttgcaaaaagcaaaaataacagagctttggcaggttagaaccactttaacttgagtcttgtttttttttttgtttttttgttttttttttgacacagtcttgctctgtcaccaggatggagtgcagtggcatgatctcagctcactgcaacctccgcctcacgggttcaagcgattcccctgcctcagccacctgagtagctgggactacgggcacccaccaccagatccggctaattttttgtattttaggagagacgaagtttcgccatgttggccacgatggtcttgatctcctgacctcgtgatccacccggctcggcctcccaaagtgctgggattacaggcatgagccaccgcgcccggccaactcttgtatttttagaaaccagaaagaaatctttattttaaagtccttaaagacaatatacccagaacatgataaaatatgaataagaaaaatgtcaggtagattgatctacttttagggctattcaaaacttttgcaaaaaaaaaaaagaagaaacaaggagagaaagagaaaagaaacattttaaatatgcaagctcaagtgtttgattttgcataagaatgtcaaacagtgactacaatgcaatattaataatttctaagttcaacatacctatttactttttgtagagttaagtaaaagtctaatataattctgagagattctaaagagtaaaatacaactcattgtagaaacagcaatgtaataatggaaacacgccagtgcaacaataatagagacatgccatcatagtttgaattacaaagacctttacagggctgggtttcggttagaatttatcaaaatttactcttaatttaaatcatggtgcaaaaaattacaggataacatctatttagaaaattaaagaaagaaactaaagaaaagccaaatgttccttttattattttaaaaaattatatggtaaattctgaaccatagaaggcttgagagtacaaaacaagcaggacttgcatgtatgttataattgaagtttccttttttattttttcctttcttttaaaaatgttttgtaaaataaatattaccctataaatggttttgctttttccgtcattattgctaataataaaatgattatacctccctcagagatgctttaaaataaactctgagctaattgttctaacttttcaaccatgtgaaaaagaaaaaaattgtgctctattatatagacaagttaacaaaagaaaacacacatgtaatttatgctttttacttgagaggaaacactagtttaaatgttggtttggttttgaatcacaaaatgctattaatttttaccgaaaatatccactcttaaacagcttatcttttacaataattctgtagttatacatcctaaatccttcagcattcaaagcaaattaaataacatacttgttatttttgaacttcctgatttttccttagttacattaggttcaatcagtccaaaccaaattcagctgctgcttcttggctcccaccttgctgtccctcttctgactatcatatgtggttctccttctgttttttctttttgcataggaagggcaacaccatctatgaactgaactgttctaaaaaatttcagcatcctccccctcggtttaatctcacctcctggctcctccctacttccagtccatcagcaagcattctgatttctacctatacaatatttctcagttctgtataatactttaggccaagcttacactggccaatttcaggctctcatcagatctcacttttaactctagcgatagcttaaaaattactgatagctcccacttgccagagatgaatgttaaaacaagtcctttaaatattctcaatctgattaaagttcatgattccaactttttgctttacatttattctacttcccagaaccatattattttgtttttctgaagaatgtgttctttcaggtttctatttctttgtatacattgtttcttctaccttaaatgaaatgtcttttgtctgctaggccaaatgatgttcacttcttggctatactatggcacacacacacacacacacacacacacactttgaatatatatatatatatatatatatatattctacatatacatacagtaaactatggcatacacacacacactttgaatatatatatagactatatatattctatatatatagtctatatagtctatatataatagactatatatactcatataatatattctatatatagtctatatatatactatactatggcgtacacacacgttgaatatatatatatatctccatatatataaaatgtgtgtgtatgccatagtatagtatatatataaatatataatatattatatatatacgtgtgtgtgtgtatatatatatatataataaaacactgaataaagcaatcaaacctcagcttaaatgaccccttttctgaaggtgttcttatctctactagggagtgctgcttctacttacatattttcattgttatgttacataaatgtgtgtgtatatattagcatttattatgacacgttttaattttgtgtgtccattatacgtcaaatttgtttcagttcatatttttcactgtggtaccacgtgcagtcagtggtcaaataatatttggcttaaatgtctatagaagactatcatagtggttgagacatcaataattagaattgaaagatttgagtttagttctaccacttattagatacatgagcttgggcaagtgattctctaaggctttgctcctcatttgtaaaatgaggaaaataggacatgctgaataagttggctgtgaatattcactcgggtgtaaaatgcagtgcctggtacaaagtaaacctaaatcaaggttagctgttgttttactattgcatttactactgagatctttgaatactttgtagctatcttcctgatctcttctatttgttctttttttttttaaatcactttttgtacacttaaacgtacctttcactttctgcatcgtgtcactggctataaattctttggaagcaggaccattttctgaatcgtctttggatctcataagtctcatggccagtagaatgtaattagaaaatatttgctaaagaataaatctgccactgaggaaagtatagttattgatgtctctttactgaatgctatataatttattgatagcaaagcaaaagcacttaaatagaaaatatttataatgatacagatataataagatgcttataaggagggtgggagccaagaagcagtagctgaatttggtttggattaatgaagactaatgtaactaaggaataatatagaagtttggaagtttgaaataacaagcatgttatttaatttgatttgaatgctgaaggatttacgatgtatacctacagaattattgtaaaaggtataccattcataaataatttaagtataggcatttttggtaaaaattaatagcattttgtgattcaaaaccaacattcaaactaatttttttctctcaaatagaaagatcaaattatacatgtgttttcttttgttaatatgtctatgtgcctcagcctctcgagtaccagggactacaggcgcgcaccaccacgcctggctaatttttgtatttttagtagagacaaggttttgccatgttggccaggctggtctttaactcctggcctcatgtggttttgccatgttggccaggctggtctttaactcctggcctcatgtgttccgcctgccttggcctcccaaagtgctggtatcacaggcttgagccatcgcggctagccgtaactttatattctatacttaaaatttgcttcatgataagctgataaatcctgtttgtaatttctgcattttgtatttgtactttttcattcattttaaatcttcttcatgtaaaacaaatattttgtactccaatgcagtgttcaatattaacttgtaatttctgaaaattttactgagaaaccactggaatatttagaaattcaaataaaataggtgttatgcatattacatataatgaagacttcacagttcataataaacatctattttaaaattacatggccacagattcaacccatgggcccaaaatttgcaacagagcaggaagacttgtattttaatatgctaacagtacaagtcatttgacctagagataaaacaatttaatattttaagaacacagggttcacgaagcaaacttgaacttactgtaaaatgaacttactgtaacatgatttcaaatatgaatagtgtataagaagtctattcatcttttaatttctaaatttaatggaaagtcaaaggaaagtaatagcagggcaattgaaaattaaatctgaatgtcgaatcctctgtaaattctgacaattttactgcctacctaataaatttacaaacagaaacaaaaagctctattacaaaaatttttaaaaaaacctttcttattgctttcatagtaaaagagtatgtcgaggcaaatataattcaatttataaatgttttaccttggaaaataaatttataattttcaaaatagactggatatatagggctatgatgaaagtaattattaccaaacaaaatgcctttagtattgttataatgacactaattgtaaagaagactgtatttatggactagaatggtactatttgtacatgggacaataagatctgtctcctcgaatttatataattgtaacatgttaatataaacaaccctcaaaaaaacagtgtctgtcctcagtgtccttcatttaaattgatggtattttggagctctccctcgtgctctctctctctctgtatgtgtatgtgtgtgtgtttaaaaacacacatatgtatatatcacatatgtatacacatgcacacatatatagttatttttatattttataacatgatgtattttgtgtcatgagtaccaacttacaagtttgctaaaaagaaatggctccaacaccagtaaaatttcagtgaaatagtcttgctgcatgcagctatactacctaaaatttcaggatttgttagccagactcaaatactgcatgttcttacttatacgtgggagctaaataatgtgtacacctggacatagagagtggaataacagtcactggagactcagaaaggtgggagggtgggagagggtgaaggatgagaaattacctaatgggtacactattagggcgatggttacagtaaaattgggaatttaccactacacaatacatccatataacaaatccacttgtaacccctaaatgtataaaaataaaaaaagtaaaaataatcattgataaaattttcttagcttaggcagcagaaagtaattgagcatgaccaaaaacgtttatgccaatagagcaaagagaaaaactgagtacacataataaaatttatcttttgaagttcacacctggactaaattattagacatacataatttttaatcattgaaaaaaaccaagccaccatgtatttatattcttaagaataatatttctaaaatgtgtatgctagattacttttgtctacataaaattatacatatttttaacccttgcgatgttttgatgtgaattgtggttcacaaaatatactgggaactaagtaaaaaaattacaacaggtaaatgacacagatctgatcaggactgagatgaaatattgtggaagcatccatggtcagagattgcagtgatttttatctgaagagttggccccaaaacaatttactatacaggatgattaacattacaattccattttgagataatttggtaaaatgttaatattatgaattgcccacttgcttttttttttttttttttaacatggagtttgtttctgttgcccaggctagagtgcaatggcacaacctcagctcactgcaacctccgccttctgagttgaagcaattctcctctgttgggagaaaagctgagtgttgggagaaaagctgagtgttggcagagaagctgaggcagggcttgcatgtctgtgagacttgctggctccttgcttctagcactccccttatctcaagcagacatatgtttctcattcacttgatacactgtttcctttcaacccccacatccacatcaccttttttgtttgtttgggcaccaataaatagcatgggctcccagagctcggggcctttgcagcttccacactcgtgatggccccctagtcccactttctctctcaaatgtctttttctcattcctttgactctgctggacttcgtcgcccccactacctggtgttgggtctgatcaccccaacattcctgcctcagcctctcaaatagctaggattacaggcacgcgccaccacgcatggctaatttttgtatttttagtggagatgggggtttcatcatgttggccagtctggtctcgaactcctgacctcaagtgatctgcccacctcagcctcccaaagtgctgggattacaggtgtgagccaccgtgcctgaccccaactgctattttttaaaaatatggttatttttcatgaaccactgatggaattgtaatacacgcatatctctttgcaaagttattagaatgtatttgtttttccctctgtttttcttttaaaatattcccaaatcatttacatctaattattaatgttctgtattatgtgtaaagatgaaaaattgtaaaaatgtaaatggccaatagtcttttataatgtgtttaatatataaaatgctttgtgcttcttgctttttagaaaaataccattaaatgcaaatggaccaaggaatacaaaaactttataattttatccatttacaggcatcattaacacattggtgtttgttcctttatgtttttttgatgtacatatgtatatacatatatgtacatacacacatatacatataggatattatgatcctagtttactgaaagaatacacatatgtatacatataaaaatacataagaatacacacacatatatacacacatatgcatacacatacatatgtgtgtgtattctatgtattcatatatgtatatgtgtgtgtgtattcttccagcaaactaggatcatgccatcctatagctttgtaatccatttttttgtcattagccagccattaagaatttttttgttttaaccattttctattttaaacatcatacaacagaaagagtaggataaaaatatcataatgatcaggtaaaattatttaaagagatatatttttttctttgcatcatcatctcctttttctcttttcttattcgttaaatctttgtttttacaaatccctgtgctaagggctgatactcggtagactgcagggaggaaactgctctgccacttaaaaaacactgaccaagaagcaggtcatctacactagttcctcacaaatgtcctttgtatggcaggaaggaagatatgtatgtttttaagtgaatacatacacatctataaattgttgtaaaataacccccagagaacaccaacattaccaaagcttgaaagatagtttctaaataacattcacatttaaaaggcttttgttttgtttgagatggagtctcactctcttgcccaggctggagcgcaatggtgtgatcttggctcaccaccacctccgcctcccaggttcaagcgattctcctgcctcagcctcccgagtagctgggattacaggtgtgtgtcactgcacccggctaatttttgtatttttagtagagacgggctttcaccatgttggccaggctggtcttgaactcctgacctcaggtgatctgccctcctcggcatcccaaagttctgggattacaggcgtgagccactgtgcctggcctgtttttgtaaaaaaacaaaacaaaacaaaacaaaacaaactggtttgtttttatttgatttggccaaaaaatagcactgctcaatctgtctttaacttacttgcctttggccaacttgctctaaaccaaattgttcttcagccaaatctgcaggggctgacactgacaactactggggcgattaaatgcaggttgagttttgtactgaaaaggagtaagagacagaagactatatttgaggaagatctgggaaatgtaagaaatcatctgaaagttgactcagtgccctgctctgttttacaccctttaacaaagagggtatcataaaaatttcttaattctggtagttagaaagaataaaagtcattccgtgggtgccatttctaaaccatggaagattaaattaatgaccccaaatcacacagttggtgagcagaacatatagtctttaactccaagcccccatgcagagttcgccaaaaaactgactgtactgagaaaagtatgtggtgggctgaagattattatcaggttccttggttcagaaacagataatacctgtactgaacagatagctttcattaaaaattacaatctaatatttctcacatttttccctctgtgtagatactgttaagtccagtaggaattagattaagacaagcagctttatctctacacctctttttcaggacaaagcagaagacaaaactggcaggacacagagttgcttgtatccttattagtgatgctacttcattaaatttcatgttgaaagataattcaatgatttaattgcatttaatgctaatcagacccttataaatgtaggtgagatacacattctcattgtattatttttcatttctcattagttacccctaattttcatgatgattactaacataatataccattaatactctcaggaggtggcagaaaagattatgtgtcatgctgtgattcattaatgccagagaaagagctgcttcgtttttcaatattttataggtaattcattctttaataatgaaaaataaattttctgccattcagaactttctatcaatacatttactttgaaaaatggcaatgttgaccatacctatatacaatggggtacttatggtctctctataaacattcttaacttgctggcctttcccaggctgggcttattttttatatagattgtgccccctccttctaaagaaaacttatttaataaatttcactgccttttcccttttttcctactttaattaagagaacttcaagatttatttccacttagcagatgtacattaattagtataatataatttcactccattttatgatatactgtggtataaggaccaaaaaaccttcaatatgccttttaaaaaaaagaaatattattttaaaaactgttctctggataaatttatactgatactgcttgaagactgtttgaagtgtttccagctgtgctgttagggtttgtttctcaggacttcatgcctgtacatatagagataattatttattttttcttaagcttaccatactcccagaaagaaaaatatcaagctacagataaccattgacaacaagaaaattctatgcaaaaatactttataacatggtgctaagataatactactcatttaaaacatataaatatgcctcacacattttaatctggtcagtattcatataagagaaccaactatctcatttaacatatacaaggatttagaaaagttatattgagtattcctcagtggaataatattttcatgtaaataatacactaaggtgtatctcaaagagaactcatctggtgacttaatggaggaatctattatgttgtattcagcttcttataattattccttattctactattaagaagacaaattagcattctatactaatgctgaaggtgaattctggaaagagaggcccagtattcagttttaagggcaaagaaaaatggctgtgtgttcaataaaactgtgtttttaataacatgtatgcactgtgcatgctgtttgaaacattttgattttgagattactatcatcttacagggaaaaagaacaactcaggtaacaggtaacaatgactattgagagatctattgagagaatgtctatttagagaatgtctaagttcagagagaggaacgaaccgtgctcagtgctttatgtgcattttctcatttatattcagataaaattcattagctagtgttgtcatcactctgcagacctgttgcttacagaaattaagaaacctgtccactcctggttacacagcccactcatggttaaataaaacctcacatttgtccttattatgcttttggaaaacggttagacttaaatatatcaaaactttatttttataatgtcctttatatattatattcattaacctttctttcacagtcttccgatttagcatacccataacatttggttaaactttaatcaacattgacttaaataaaatgttcttgtagtaattcctatcatgacttcatgtttttggggcaggagctgctagtcgtttcctgcccacatgtatgcctcttttttttttttttttttttttttttggcacctttgggctcagccgcatcttacactcatatcttagctctgaaccagaatattgagcccaaaaagagcccattcctcaaaagaggttgtttcagtatcaactggtcttgttctattcaaatgttacttaatctcaaagtgaatatgttcagagctcactgccttctgggtctggaagccacactgtttactttttcctatgatgtttgttctctgctgagtgtcgaaatccctccaactgccttttctaagatgcaggctgttccctttcacttatttttattgcccattttgggctctttatcaacgccctatattataaaacatcagcaaggactgtgtctgtgcttacgtttttgaaggatttatgaatctgtttttgacatgttggcatgattatgcaattttttcaggtccaaatgatactatactagctcatgatcctggattctgaaaccaagaaccaaagtaaacacatatgctagttcatactgactttcattctccctaccaccctgtctttcagatccaacctaaggtatttgattactggcacctctcagctactaccacctgtaatatagtatttcgtcttcctaaaacatgcattcttgctataaatgacaagaacactatgtggcattgttttaccaagcattaaatatcgagaattccttaacattaagtaaagagaagactaatatttagatggaataaactatgctaaccaataagaaaaatactagcttatccccttttgtcagaattattttatcttccatgaagaataacttaaaattaacagaaagttgaataatctttttccttttccttttaatttcaagcttgttaaacatttttagaaatgtaatatacatttctaaaattgtgtctctacagcttcacgtttcttctttgtttctacagtactctcatgaaaattcaattctcttccctgtatttttaaaaactcattaaacaggtcgggcacggtggctcacgcctgtaatcccagcactttgggaggccgaggcgggcggatcacgaggtcaggagatccagaccatcctgactaacacgggtgaaaccccgtctctactaaaaatacgaaaaattagccgggcgtggtggcacatgcctgtagtcccagatactcgggaggccaaggcaggagaatggcgtgaacccgggaggcgtagcttgcagtgagccaagatcgcgccaccgcactccagcctgggcgacagagcaagactccatctccaaaaaataaaaataaaaaacaaaaaacaaaaaaacaaaaactaactcctaaaacataggtaataaaagaatacaggatcttcaaaaaaagaaaacagtcattaaaaactacagaaatactataataatttgacatctactccttaatttggcagtgccatacaccatgggttgtaagaaagaagagaatatatagtttaaaaaatgctattaatacttttctccagcccctaacccaacccactcatgcagtttttcttcatagaagaagagattttgctggtttgtttaaacacagaccaaaaatatgttcacctctgctcaatattgtatagctgacattctctttaaatatatctgtagaccaattggatacaaataaacattccaacactatatatacatatatatatatatatatgtatatatgtacgtatatatatgtacgtatatatatatacgtatatatacatatatatatatattccatatcagttgtttggggtttcttaatattacaaatttgtcttacaaattacataggagtagaaattctaggtaaggagatatgcataagttcagatgtaatagatagataatatcaaactttttccaaaatgtcttactaatttttatcccctcagcaatatctgagaacttcagtcgcttcacaatttgattttgtctgttttttttttttttttttttttagtcattgtgatgaacatgtgttggtttcttatggtttgttttcaattccctagcagttaagtttgatatatatatatatatatatatatatatatatatatatatctcctgtggaaattgataagctgattctaaaccttatttggtaatgagcacacagagagagccaagagaagccaacaaaccttgaagacaaaaaaataagcagaagacttacactatcagatattataaaactatagtaattcagatagcagaatgatgcaaagacaaacaggtcaatgaaatagaataaagtattcagaaataagcctttacatccatgaccatttgacttagaacagagagaacacgtcaagtagagtggagaaaaaaaatggtctctttagaaaatgatgctggtcaattaaatatccacatgggaaataaaaaaaaaaaaatcttgacctcctacatcactccaaacacacaaaaaaatcccatatggactgtaaatctaaacataaaatatgaaataaaatttttggaaataaacttaaaaaagtcatgtttttgtgttactcaaagagcttttaaacaagacaaaaagttgctcaacatgaaaaaataataaattgtattaaaagtttctgctcatgaaaaagcataaaaaatagggtgaaaatgcaagccataccttgggagacgatatatccaatacatatattgaataaagatatgcaatccagagtatataaagaattctaaagacttaatgagaaaacaaaacaaacaacagaatgtccagagaaaaatgttagaaagagaccaaaatagtcgccacataaagaggatacaaatactggcaaaaaatatataaagagacatttgactatcttaactactagggaatggtaaacgaagcacaagaaaccatcacatgttcatcacagtgactaaaaaaaaaaatcagacaaaatcaaattgtgaagcaactgaagttctcagatactgctgaggggatataaattagtaaaacatttttgaaaacagtttgatattatctatctattaagtctgaacttatgaatatccccttacctagaatttctactcctaagtatatttgtaatattaagaaaccccaaacaacttatatggacagtatataggatatattaactgtaatatatttgtacaatgaaattctctagagcaatgaaaatgaatcaattattactacatgcaataataacatagatgaatctcacaaatatagtgtgagaaaatgaatctaaacaaaaaatacaattttcctaagtctataaaaatatcgtaaacaagaaaaacaaatttatggttggaagtcatactagttattcttacggggatgtggagcaggaactggtaatgctctgtttcttgacctgggcactggttacactaccgtgttcactttgtaaatatttatctagctgcacacttagaatctgtgtgattttgcatatgcaggttgcattatgtatgcagcttgtaataaaaattatacatcaaaaatattcttttaggctgggcacagtggctcatgcctgtaatcccagcactttggaaggccgatgcaggcggatcacaaggtcaggagatcgagaccatcctggctaatacggtgaaacaccatctctactaaaaatacaaaaaattagctagacttggtggcacatgcctgtagtcccagctactcgggaggctgaggcaggagaatcgcttgaacctggaggcggaggttgcagtgagctgagatggtgccactgcatgtccagcctgggcgacagagtgagacactgtctcaaaaaaaagaacaaaaaaattcttttgatatcagcattcaacatatcttggggtctattggcttcaggtgttgatagtctttcaaattactatgagcctcactgacttttgtccttttctagattactgggtttctaagagaccataaatgtctagggggagaaatcctggaaatgagtaaaatgaaacattattaaagagagaattatctttataaaaactagtgtagctaccacataaagtttctggatcaacttgatggagatgcctagtttagatgttatttttgttcactagaatgcatttttgtgaatccaggcatttcattgcctgtttttgaaaaaaaaggaaaaataaaaaaattttaaagtctctgcaattctcagattttcagtgaattacaactaaccagtgcaaattgtattctctttatgcataaaatctctctccaggcctgcgggtttcccttaaggtaaattaattgaaactaataggaagaatcatttatttcttatggcttatttggaactaaactttcttcataacgcattttaaggaactcttgtactttaccgttcttattggaaatattgatagacaattcaaaattaagatacatttatagaagtatgaataaacaatttttaaaagctcattttcctcattttttccccttatattcgtgttatagatctcctgtgtcaggtcagtacagcacaaagttaatggaggttcaagacattacaggacatcttcagacaaaagtaatttttatttgcccaatttatcttctgaattgtgccttgcaatgcagccttcactttcagaaaaattctgagattttcaaagggagaaccaaatgtcagtattcttgctctacagatgatggaggatgtggcctttgaaacataatataggagagtacacacaatcatcactactctaaaacttataaaacctcctaaaagtaaatgcaagcttacctccaaaaatagtattccatacctataccttggattgttacacatttaatcatctgagagatacaaagacatttaataaatttctaatactgctagagtgcactcaaactttaaaatatatgagccaccagcaagtttaggaaaggcaaaattatttggccatttaccaaataaactactttattttcatgtatcatgtccaatggctcttcaaattcataaaaagtccttaaactctctactttaaaaataaagtatccaggctggtcgttgtggctcatgcctgtaatcccagcattttgggaggccaaggtaggcagactgcctgaggtcagggtttcgagaccagtctggccaacatggtgaaaccctgtctttactaaaaataaaaaaaaaaaaaaaatacaaaaaagttagctgggtgtggctttcacctgtaatcccagctacttgggatgctgaggcaggggaattgcttgaaccagggaggtgaaggttgcagtgagccgagatcatgccaatgcactccaccctgggtgacagagcaacactccatatcaaaacaaacaaacaaaaaagtttccagttatcagagcagctttacatctatgttttttttttttttttttttttttccaagacagagtctctgtcgcccaggccggagtgccgtggtggcatcttggctcactgcaacctcagacgcctggattcaagcaattctcctgcctcagcctcttgagtagctgggattacaggcgcctgccactgcacccggctaattttttgtagtttttagtagagactgggtttcaccatcttggccaggctggtcttgaactcctgacctcgtgatccacccgccccggcctcccaaagttctgggattacaggcgtgagccactgggaccggcctcatcgattttgaaacatccaagcttccctcattcttcagataattatagtctgggaaaagtagtccgatttctattataagtaatacgaattaaagcaatttttaattaaattacattcaaattaataggcataaattgtttgctaggagaatgatattttttggtgtcccttctacaataacaaacaaactgatttgtgtggagagggggaagaagagtaaaacatatgcagaattatttcattgtatactcaactgacatctaaaatagacttcatcttgtccacttatattaaaagaacataacaagaatgttttacttgttcagactaataaggagaaatgctatgtatcagcaactggtaatgttttttatggttctcaactagtacaggagaaaatgcaggattagactatttgaaacggaatatcaagtttcagttatataggaggaataaggtaaagggatatattgtacaacatggtgactatagtaacagcgatatattctttaaaaataaaatacagaatacagtgtagaaacagaatagatttttttgtaatcatctgtctgcatttgtgccacagaatttcaaaatgaatgtgaagtattttctaaaaatatatgatataatctaaaaataattgaaagaaaagatgatagagagtaaacgtaaaatatataaaggaaatcagagaaagtcagtataccacaatttgtattgcattcatcttctaaaattgccaaagatggatcaaatatttgactttgagtgtcggtggaaaaaaacaaaaggaaaatattaagtacagtatagcctgtgatcatataacaaaaatagcccagttgttcaggaaaaaaaaaatcttcacatttgatgtcaccagtgaggctaaataaatgtaaaactatgatacatggataacattcataaagctgtcatcaagtctgagtttctaatttggcaagaagtgaaacccacagggaagtccagggtgatgttattctgtgttgtaatcagcccaaaagagtttaatgtaaaatgtattttactaatttgaaatgatcattcatgcaacatatgttaaacaggttaaaagacatgagtatatgtaaaaataaataaataaaattttaagaagtcattatatgaaaaaggtacttgcacacacgtttatagcagcacaatttgcaattgcaaaaaatctggaactagcctaaatgcccatcaaccaatgagtggataaagaaaatgtggtatatatacaccattgaatactagtcagccataaaaaggattgaaataatggcatttacagcaacctggatggagttggaggccattattctaagtgaagtaactcaggaatggaaaaccaaatactgtatgttctcatctgcaagtgggagctaagctatgaggacgcaaaggcataagaataatacaatgaattttggggactcgggggacagagtgggaggaaggtgaggggtaaaagactacacaatgggtacagtgtatgctgcttagatgacaggtgcaccaaaatctcagaaatcatcactaaagaacttatccatgtagccaaaaaccacttgttctccccaaaatacttttttgctaaactttttttaaaacccaggggtacaagtgcaggtttgctatatgggtaaacttgtgtcaggggggtttgttgtacccaaaaattattgaaataaaataaactaaattaaaatcaataaataaaattttaaacaaacaccaatttgaaatgttaagcccaatatataatgtctttaagttgatgggaaaacataatgtctgcttagatgaaatttaaattctagtaggaaaatcatgcacacagataaacgataacagtataattggtttaagtgctaaactagacatatagtgattcagttacagggtcatagtcaagaaggcaatgcaccctcagacacctacatatgtttgctttgttcaaagtacaaaccacacaaggtcaaacaccgtgccaaaacatgaaggaaaccagacgagatcgggcgcattcagggtggtatggccatagatggaaggaaaccagtgattagtaagaccttgtgaaaacacctctcccttgaaaccatgagagagtttcctcatacttggcaatggggaaccaaaattagtgttttattggacctttacttcaggctggttcttgtttgcatctgttctatatgtaactaggaagaaaattgtcacaaaataactcactagctttcaagtaacataaaccacaaatactgtaaaacataaatggtgattttgatttcagaactaagtaatctacgctatttgacctctaaaatgtggttctcaagtataacagttgtcacaggacacttgacattgtaacagtaaataacacataaataagcaaaccatcagcttaaagattttaaagggcacctgcttctacagcaatatttatgtgagaagatatctgtggcacagagtgatggagcataaagtctcacagagagataagagcatgcccagaactaaatccaggtgattagaatgtcagtccagtgctcttccactggaaacgtggttgagcttggtctcggaagcagaatgccaggctgtaaattgtagcctcactcccaattagctgcacatgttgggaaggttacttattgctcctgtgatgcactgttctctgtaaattaaagagatgctacttggggaaaatacattaaaaattcagaaatgtgctggagatgttttacctaagacccaggtgagcaggtatagggctagagaccaggagcccccaggagcccccaggagccctaacctctgtctagaaacattatgtattaccctacattgttaaccttgtacatttctataccttttgctactaaggaaatttgcatcctctgaccatgactgtggcttttttctatctacggcatcactctgctgaaacctctcatcaccagtttgtgcttttgaaaatgtaataaacaatcagccattaagtgttaagtcttttttcttgctgctttttcacaatattattttcttttagtccataaatttcttaaatttggcatctttaataattcaaaaatagaatattcaaaatctttttaactttcagtagagatcaaatcaacattataactcaattcttctgacactgtttttccatatgtgcaacttgtaaagaatgagattaatcctcactgcattaacttctggaaaatatcttcataattcagagttttttaaaattaatcttgatcacatttaacatctccctgtatttgcaataaatgctatttttgcagttaagacaacatgcaataaactggaaaaattagttaacaatttgaaaagtgtttttaaaatcaaatcttacttgttaccttaacagggggtgtcacaatttacacagttcatctcaagttgaaaagaaatcggttgcctttttacttgtctcctaatttttcacagaaagttagtatgttctcttattttctagcaggattctacgcctcatttctcctgggaagcaatgtaagaggttacaagaaaagttcttgaactgaggtagacctaactttaaattccaacttcactgggtatttggctgagtaatactaggaaagttatccagacttactgagcttcaattttcccaaaagtgcaataagaaataattgcatctactgcataaatcaatgtttaaatttacttgttttattttaattgatattattttatttattcattttatttatttatttaaagagtgtaggctaaaataagtaaatgacatttcacagttctcagaaaaataataatgacaaataaaccacagttattattatgaattagggaatatttatccattaacatttcttcaaagcccagcagaaacaaaaagttaatgttcaaaggcctagcttcaactttccttcttcacacaaaaaattacaaatattacaagtattcatcactttttctatttcttttttgttgactacatagttgcttttttacagttctttctatattctggatactgctcctttgagatatatattttttaatagatgtcgtgagtatttgcttttaacatattgcttcactcagtcatttatagcacccttgttgcaggagtctgctattctgatgtaaccatattcatcagtcatttttcattagtgtaggacaggggtccccaaccctcaggccatggacaactaccagtcggtgacctgttaagaactgggccacacagcaggaagtgagtggtgggtgactgagtgaagcttcatttgtattaatagctactcttcatggctcacataacctcctgagctctgcctcctgtaagatcagtggcagcatcaggttcttataggaacataaaccctatcgtgacctgcgcatgaaagggttccaggttgcacaaaccttatgagaacctaatgcctgatgatctgtcactgtctctcatcacacccagatgggaccatctagtttcagaaaaacaagatcagggcttccactgattctacattatggcgagttttatcattatttcattatatattacgatgtaataataatagaaataaagtgcataataaatgtgatgcacttcagtcatccccaaaccatccccctctgcactcctgtctgtgaaaaaattgttttccacaaaaccaggccctggtgccaaaaaggttggggaccgctggtgtaggacatttcagttaatgatgttcaactaatggcctgccctagagaaggaggactcagaattgtggggaggctttttcaacatacaaggtaatgcagattctatatggcctcctgacaggctgagaggattagcatgttcccacaatgcacatcactcccatattgttgcaactggtgttttatgaaataaaatgtttaaaaacgcagtacatagtcaagaaaaataaattgactaatataaatctttacttctgaatttgaacataagcttcacattcataagagcttcaaaggaatgaattaaattaaatatagtttaaaaaattttaaagtttaaaacattttataaattaaaaatagtttaaaaaaggtgttcacattctttcaataaaagtgatgccctctctcctctttttctttactgtggtaaaatgtacgtaacacaaaagttagcatttcaaccacttttcagtgtacagttcattgacattaagtgtattcacattgttctgcaaataccactgccattcatgctcaaaacgtcttcttcttcccaaacggtaacagagtagccattaaacaacagcttcccatttacctcctcccacttcacccctaaaccctggcagccaatattctgctttctgtctttatgaatttgcctactctaggtaagtagagtcatacaatatttgcccatgtctaggttatttcacagagcatgatgtcctcattaatccatgatgtaacatgtattagaatttatttccctttaggactaaataatattccattgtatgtgtatatcacattttgtttattcattcatctatagatgaacatatgtgttgtttcttttccctttttttttttttttttttttttttgagacagagtctcgctctgtcgcccaggctggagtgcagtggcgtgatttcggctcactgcaagctccgcctcctgggttcatgccaatctcctgcctcagcctcccgagtagctgggactacaggtgcccaccaccacgcctggctaattttttgtatttttagtagagacgggggtttcaccgtgttagccaggatggtctggatctcctgacctcgtgatccgcccgcctcggcctcccaaagtgctgggattacaggcatgagccaccgcacccggccccatatgggttgtttctaatttttagttgttgtaaatagcacttctatgaacatgggtgtacaaatacatgatcaagtctttggtttcaattattttaagtatatagtaagagttatattttaactgatattaactaattgttttaaagactaaagaaaaacgaattaccattggattttcttttcgcactcctcataattaaaatgactgattacttgtcactaacggaaatcaacttcgtagaaccagttgtgacacagatacccagcatgaaaccatagtaaatatagatcttctcagataactttttgttctgtgcacttttgatacaattcatgtacttaaatgtgacatgagccttcaaattattgagccagaaatcaagtatctacatgtctgtatatatctttgtcctagaaaatcctcaggagacctcccttaacaatcactgctcaaaaatgactcacatatccacgtgcaaaccaatcatttgcaaaggtaacaggacaggcatgattggctctgaccagccatttttcaccactttggaataggcttcacttcccctgaagcacatgatccccaaaaataatacctaaataaaactgaaattctgttaaagtgtgaggtaggagaaatagccaactaatggtgtctactatactcagacaatgtgagtatattaaaaccagagacttcacctaaattaactcagtggtacaaacagaataatttaaaactcaccttcacctaaatttcagataattatattattttccactcactatagtataaacatgaactgaaactaaattaggtattttgtccatctagatttaattataacatatgtttttatttatttactttttttcgggggggggtggtctagtttactagaatgtggcttctgtaagggtagagagagcctatttttgttgcttccatattttcagtacagagtaagaacacagtatatattttctttaaaaaaatgaacttagaacctaagtttttaagtatattaggtataccacttcagagcagatatacaattgtctttattatgttattacttatattggataattcacttcaacaatgtttttattgtgtcactttacctgtagcatattttaaaaataatgccccaaattcactactcatcttttaagctaatatagccttattcactgctatttcaaagtcttatcttactttgtcaatcttattctatgtcacatttcttctttcccttcttacacaaagcacatatttacatttaacttttatcattctgcgttatatcatggaccaaaaaaaattaacttgtatgcatggtagatgatctaccattacctaatattgtatagcaattggtagaaacacctctttcacaatcatgggctacttcccatttttaaaatcatctttccttccttcaaacaccacagctgaactggtcctgattcagtgctgtttgcattaatatttttgttgctctaagtataaaatgagaagaactgcttaactcatgctctgattaaattctggaaaggagatttcaggcttcaaggctaaaggcagcaactggaattgttaaacattaagtatttattactcccttccgctcgtaaatcccttgcctcctatcactcagatacgctctgcactttgtttcttctgagttttggcttacttagtttgtttcctctacttagactgtgtcttcctcacatatgtttcactttggaaaaaaaaatctaaccacccttcagtgctagtcttaaattcttcatcctccaggaaacctttatgttcattcaccaactgaaatgttttcttcctttgaatccacaagacaatttgcgctctgctacttgactttattattatagcatacacttgcataaacacattctttctctctctctctaaactttctctctctctctctctctctctccccccctctctctgtctgtctctctctcccctctttctctcactattgtataaagtacctagtatattatattgcatgaagttggtttcctagaaaggacccctttccctagtctgaattacccactgatagtttgaagggggagggttccttagagttctcagtagtctggagacacaatcaatcccaacactgtatacttcatctgaagaagtccatgcattctgtccagggcatatgtcctcaccctgatgcttctttcaatgcaatgtctttacacaccttattaagactcagtttctcacctgacttttacactactaccaaactttcgccagaatcccttggaaatcacagaccatcatcaacaaaatcccctaaatgttcaactttccctctgagtattacctatactttttgattccttctttctccctctaaccatcctcgacaaaagatgctgctttctgtagatctcccagtagtggctaccataatttacatagcacagagcccaggagtacagggcaagcatccttctgtctcctttgacactctgtcccaattcctctgaagtaaatcccatcagataatgccacccactaaatttccttgttatagtcatcacatgccttttgagtaatctcctttattaatggactagtttaacatttggcttatctttttttcctacatcacactataggattagtaacataagtggtgatgtaaaaatccacaagggcattctaatcacagtagcatctgacagtcaacgatcctcttttatcaatcttgttctttccatggttcagggaccttgcattttccctgtattcctgtcacctcatggcagcaacatctcagtatccccaaacccttcttctcctgatctctaagtgctgaaattcccaaagcttagtcttcgtattttttttgtcaaacccattttcagggtgatttcatcttggccccttatttctctctcaagtctagatcagcatttgcaaatgccttgccaagaattaggtttctgtattgaaaaagcctcccaaaccttgattactgccatcacaataggcagtggaggaggtatggggatctgttcaggacaaaaaccaccaagtcattcttgatttttcctaatgtcccatgtatgattcatcggcaaatcctatatgttctatcctttaacccccttctcaaggtctccatagcctatcaacgtcgttcaagctaccgtcaaatttttcctggactcgtcatgcattaaactctacttgtccaaaacactgtgttacccattcccaacatcccccatgcagcatctacaataatctttttatattggatgatgtcataactgtttaaatcattcaaaggctttctttccaacacacctagaacgaatcccatattctagccccaggtacatttctgatctcatttcctaccagactttttcattcacactagcctccagctccctgtctacctttagggctttacagagaaatcccagaatgctgctcacttaagaatccatgtcttgatcttttcctttattcaggtcactgtttcagttttatccaaaaagaactatcttaactttcttatctaaaattgcaccactctcattcttcccttatcaaacttttttgtttccttagaatttatcactacataacttactcatctattcatttcttcaactagtttgtctgcattactcgggtggaaactttgtttgtttgtttgctttgtcaattgctctatatcaaacttctagaacagtgtttagcacattataggtactcaaacatatttgactaaatgatagaactaaatcaattaagagttaatgagactaaaatataaaataagataaaaatcagctacaaaggattcctacttgtggataacaacataaattaaatgtaatgaatgacagatttgtggactacttttagttaaactggtgattcaggtcaggggtctgtacttagcatagtggaagagctattttgcaagcccaacccaattaggttgaattttttttcttactgagagtgtttgataggtgataaaactacacgtaagaagagctctaatcatggtgctcctggtaataggaaaagaaaggcaattactcatgtgcaaaactagaagcaatcaaaagctagatttgccagagatgtttaggttttatgtgcaatttacagctatttacaagttaaccattgaaatgctgtccaaaattaactccgcaattgagaatccaaaatgtttagcatctaaactttttcctcagtaaaattcaatctttaaaattttttcttagtaataaaacattagtaatacacagttgattagaaatagtcataaacatttgattataaactattataagagtaattagtaataaacatttgatgataaataaagaaaaaaattgaaaacttacaactttggtcttagatactgcatttttgaaattccaagtaagccaacattctctgagacatcaaggtttttgtaacttttagtaaagtactaaaactggtagtgttatttttttactttcattcaatcagcatttaaaattcacaatttcagaaaaaaatggttaatttattccactatttcttctattagaagtggtaattttatatttgtcattagagatttcattttgagaatcttttgagttatcctactggaggaatacaaaccattaagaaaagatatacatttcaacatcttattcaatgtaaaacatcgtaagtattttgttaccattttcatagtaaaatgaaactcaagaagttgcttagtgtttacctgatataatctgtattgagtttagataactaaactaatatagctccaagtttcaggcttttgtttatacagcataagtatgcagttaatgcaaactacaggcttacagcttatctgcaaaacctgagcttttactttagttctgtatattaacataattccgcataccttcactctgagtacagaagtaaacattcttgcatcttcagatacacctccgatgtagaattttttctgaaacactgggggatgattattttcatcctgaatctcaatgtatactttagctgtattgcctggaggacaagaaacgatgcattttttattggtggttattcatgggggaaaaaatgcactgaagtaaatatttgctgcacttttttttggaaacattgaaaataaatcaaaagccatttctagatgccatgcctagcacccccaaattcaggggacactgataatgatgcttctggtataaaaatgttaagttgctgttatttcttttaattacaatgtcctggtagttcactttacttgatttaatttggcactaaaatactgcaccctgttaattttaatgaaacaactctactgttcacgttcacaaacacttcacacacaataccagttataccaaagggacacaaatatataaaccccttatgaaatagtagaaactgccataaactattatatgaatatatatttattcttaagtataaaatcagcaatggcatttctttagcttaaaattgtacaataacttttatgttttaagactaaaagtaacagtgttcgggtgaggtgtttatttccacaaatggaaaacaagttttatcatgccttggaaactgtcaatgttagaggctaacattcattgaaaacaatggagctgaagatatgattatgactcataaatgctgcattttaccatttaaataacagtaaatgtaccataaatgatatgtcatcatcaaatgttagaacctccctcaaatcatcacacctttaatgagaaatgtggtacttgtcactagtccaataatgaccttttaaaaaacaatttaatatgtataaaaataacttataaaccaaataaaatgggaaataagtggctattcattttgtaaaaaaatagtcaaataagtattgctaatgtattacataagtcgacttttctgattcatttcagttatgaacaaacggcaattaacgtacatactatttatcaaggatgcccttattttggtgttttacctgtgtttaatgcctcctgtacaattttaagtaattaacaccagcctacttgcaggatacatcatgggtatacatttgtatttgttgaataaattaatgaatgaatagcttgtattagtaagaacttagaaatagtcttttttttttttttgcttgcccttggaaaggtcagacagaacagtgagttaacctcaagattttgctcctatcctgctgctactcattcagcttttctctgtttgtcatctgtgacctggaagaggtagaatcaagaggaaaatcatgctagcgcaacagattagagaaccaacagcgaaatagggctaatagcagattatgcttctctatcctgcagtgccagggctctgacttgtaccttagtcagccaccacaaatcagaattcacccaaaatgaaatcatttttagttcagtagcagaccacttttatctctagaataaaaaatgcgaacagctctaaatttaaaaataaaaaggaattttagaatatgtcacctttccaataacttctttgcactttcattcagaaacatatacaattcaaatgtgctatttcttttcagaactcttagagtgacagaggtctcggaaaaatactgatgacgtatattttcttctttaaatgggatgagtcatttaaaatgttatacaatttgcaaagaacaagaactttgtcatgacctgttcccttacctcccaaccctaacttcatatctggatggtaaccaaatcctacatgtcagcctcataagcaggtaaatcatcacctaataaatatatcttgtgtcatttttctctcaactccacagctgcccatatacttaagtctgttgttgtctcacctgagtgactaaacgtcatctgctcccctgtcgtgtctttctaatgtgtcctgcattctgatataacaaagacatcacaaaatacaaataggatacattaaatcaaatgttaaaccaaccaccattcatatgtacatttttttctttttcttgttttttgagatggagtctccctctgtcgcccaggctggagtgcagtggcacgatctcggctcactgtaagctccacctcccgagttcatgccattctcctgcctcagcgtccctaatggctgtgactacaggcatgcgccaccatggctggctaattttttgtgtttttttagtagagacgggatttctccatattggtgaggcttgtctcgaactcctgacctcaggtgattcacccacctcggcctcccaaagttctgggattacaggcatgagccaccatgcctggccgacaattcttaaaaataccatgtgtatattcatatccatacttatatgtatactttgtgcatataagtttaagattcaaataccaaattgttcctatgaaagctcctttgattcagtggcctgtatcagatattaagtggtttgtgggaaaaggcctatggataacccaaaatatgattatataacctgaacataatggggagagatgattatacttaattataatattttaattaaatgatatttatttatatgaaaactaatgactatacaatacaaaattccagaatacttcacaaccagcacacaaacaaaatctcaagaacattgtttagacttaaaagaacttatacatttatttattttaaaaagccacgatcatttagttcttttcacaaaagagaaacagttataatgcgatttataacaatactgtatcatgaattttgaaatttatgatgttagctatatagctaattatgtaggatagtttgtaatagtcaactaaaaataaatataaagttgtgaaaaaggtgttttcattaagtttgtgacttagatgttagaataaaaaaaattgttaacttttattttccataatgtaaaatagactagtcttcctttttttttgcttctccctgataactttaggcagttgttatgtatccctcctttgaaatgctatagtgcactaaaaatgtttctttctataaataacctttccagagcttggtttacattgcatttagttataagcatgattttattcttattagatttcaatattcttaaagatggaaattgtatctcctacatctatcagtactataatgcctcagtttgtaggtaatttttccgctcagatattattgtaacaaaatttcttaatttttgttgaacaaaaaagttgatattcaattaatttgttagctttctttgattataatcatgagattatgattaactgaaacaaaaagttaactcttagaaggatatgagggagctcactaaatcaaagtgaagtaagtccaaagaaggcttttggtaccacaaaataatcaggaagttgtagagcctttaaagcagcagatgtttgattttcttgcagatgaaataacagcaaactctcttcttttatgttattttaccccaccccttattcctctttttttttttttaaagaaacaaaccaaaaaacaacccactaggcttaagaatcataccctggggacacattacctgactgtcctagtttgggtcatgtgcttgctccttgtctcgggaaggagaagtcaccagattatccacttgagaagtcactgggacaattataagaaattgtagtgtgtctacttaaagaatgtaaaataaatgttggccagtaagaaaaggaaaagcaaataagtatacacctatagttaaatcactagaacagcgttctttttgacttttttattcatgtgtatacaatgtacatgacatcatcaatttccttggctcacgtgcttccccactaaggattgtaccatgttcttccaccaaatttggatattgattatttcaaggcagaagcttggaagcaactctgatttaaattcttttaagatagcctgctttttatctccttgagtacttacaaaaactttttttccatgttgtatcctttatttaatgtagacatcaaacacataacaaaagaaagatactagaaagagaaaggaaagcacagatagaaaaataatgttaagggaacaacgtgcgtgcctaatatcctagtattcccctccagtctcccttctggctcatctaaacaatgcaagtattggaaagagaaccacaaacagtgaaagaaattacaaagtaggcaaaaaagttatttggaaagtgttttggttaagagacattataatttttctgtgtgctttggggcaccctgccttatttttcttccattattaacttttttctccaattttctatgggacaatcttttctttggctagaacttttggctttagtaagccagaagttttaaaaatgactcctgaggtaagaaaatgtgagataccttcttgcaatgttttaaagaaagagaaaataatacttttatgtagtcaagctcaggggaaaatgtaagtcttagtatagttacctccttgaatagcacttctgttctattttagacatttaaacatggtagaaggagttcagaagagtgattttaaatacccattaacctcaacttgactctatgatttttaagaccaaatttagtttgatttttcccttcccttacttttaataatcaagactgtgatgctagttttttctttttaggaaggccctattatcctcaagatgaatccatttcatttatccacatgactaatctagtgcctacactgcactggattttcaaagaaagccttactgaataagaagccaatgagttaaaagtgttctcaactgggatcaatttggctgctctagagccatttttggtagtcacaacagtgtggataggggaacgtagtgctactggaattaaatgagtagaggtcaggaatgctgagaaatattctgtgatgaacagaacaggctcttaccccaaacgaacaaacaaacaaacaaaatatttgggccaaaatgccattagtgatgaggctgagaaaccccaagttaaataacaagagaaagaggaattagatgagttaagataaaatggaaagtttccaaatgctatagtaataccctctcctcaatccatctgcatgcacatgcctttaatgtggaacttatcaaaatatgctgtaattatttgatcacacattggttatactcttttttgactgtgtcctataaagtcaagggctcaagcctgtttacctccactcttgtcactgccttctggcctctgttcctgacattctctccatctaaaatattcttaattccaagccatttctctagtcattgccagtaaatatacatcacagaaatatttattcctgtacttgggaatgtagaagtttagtctgattaaaaaacatacactagactatattttcctcaaaccttaaaggaaaggactgtgcttttcttattgttacgtatcgttgcctaacacattaaatgatttttaaaattgttatcatgataaatgatttatagattcttcaaacagtcctattgcagagaattttttaaatgcttggaataccagatttatatttgttaatttgttggtatcaggagattgaagtcagttcctcactttaaaaacacacaaacaattttttatgctgtttttcttttaagacaatttttgtttaagctttacgggtatattaattatggaagcattgtgacttccacatagtaggtgatatggtttggctctgtgtccccacccaaatctcatcttgaactataatcctcacgtatcgacggaagaacctggtgggaggtgatcagatcatgggggcagttttccccaatgtgttctcatgtagtgagtttgcacgaaatccaatggttttataaggggtgcttccccctacactccctctttcctgctgccttgtgaagaaggtacttgcttctctttccccttccaccatgattacaagtttcctgaggcctccccagccatgtggaactgtgagtcaattaaatctcttctctttataaattacccagtctcggttatttctttataccagtgtgaaaacagactaatactgtaggtgttcaataaatgttaaattaaattgtaattgctaccacttcactactcccaagggtcctcttaaataaaataaattactctattttattcctgtaaattaaatgaggtaacagatttttaagcatttaaaaatcaaataacagacacccccattccaagacagctgaataggaacagctccagtctgcagctcccagcgtgcttggcgcagaagacgggtgatttctgcatttccaactgaggtacctaattcatctcactgggactggttggacagagggtgcagcccacagagggcaagccaaagcacggtgggacatcacatcacccaggaagcaaaaggggttgggggatttccctttcctagccaagggaagtcatgacagattgtatctggtaaatggggacagtgccacccaaatgctgcgcttttccaatggtcttagcaaatggcacacaaggagactatacccacacctggctcagtgagtcccatgcccacgaagccttgctcactgctagtgcagcagtctgagatcaatctgcgaggcagcagcctggcagggggagaggagttcaccattgctgctgcttgagtaggtaaacaaagtggctggggaagcccaaactgggaggagcccaccgcagctcaacaaggtctgctgcctctgtagactccacctctgggggcagggcatagctgaacaaaaggcagcagaaacttctgcagtcttaaatgtcctggtctgacagctctgaagagagcaatggttctcccagcacggtatttgagctctgagaacagacagactgcctcctcaagtgggtccctaccccagtgtagcctaactgggaggcacctcccagtaggggccgactgacactgcatacaggtgggtggctctctgggatgaagcatccagaagaaggaccaggcagcaatatttgctgtgctgaagcctccgctggtaacacccaggcaaacagtttggagtggagctccagcaaactccaacagacttgcagctaagggacctgactgttagaaggaaaactaacaaacagaaaggaatagcatcatcatcaacaaaaaggacacccacaccaaaaccccatctgtacgtcaccatcatcaaagaccaaaggtagataaaaaccacaaaaatgggaagaaaccagagcagaaaagctgaaaattctaaaaaccagagcacctcttctcctccaaaggatcacagctcctcacaagcaatgaaacaaagctggatggagaatgactttgatgagttgacagaagtaggcttcagaaggttggtaataacaaacttgtccgagctaaagaaggatgtttgaagccatcacaaggaagctaaaaaccttaaaaaaagattagacgaatggctaactagaataaacagtgtagagaagaccttaaatgacctgatggagctgaaaaccatgcacgaaactacatgacacatgaacaagcttcaatagccattttcatcaagtggaaaaaagggtgccagagattgaagatcaagttaatgaaacaaagtgaaaagagaagtttagagaaaaaaagagtaaaaagaaatgaacaaagcctccaagaaatatgggactatgtgaaaagaccaaatctatgtttgattggtgtacctgaaagtgatgaggagaatggaaccaagctgagaaacactcttcaggatatcatccaggagaacttcctcaacctagcaaggcaggccaacatacaaattcaggaaaaacagagaacaccacaaagatactcttattccaaaattgaccacatagttggaagtaaagcacccctcagcaaatgtaaaagaacagaaatcacaagaaactgtctctcagaccacagtgcaatcaaattataactcaggattaaaaaactcactcaaaaccgcataactacatggaaactgaacaacctgctcctgaacgactactgggtaaataacaaaatgaaggcagaaataaagatgttctttgaaaccaatgagaacaaagacacaacataccagaatctctgggacacatttaaagcagtgtgtagagggaaatttatagcactaaatgcccacaagagaaagcaggaaagatctaaaattgacaccctaacatcacaattaaaaactagagaagcaagagtaaacaaattcaaatgctagcagaaggcaagaaatcagagcagaactgaaggagatagaaacacaaagaacccttcaaaaaaatcaatgaatccaggagctggttttttgaaaagatcaacaaaattgatagactgctagcaagaccaataaagtcttgcaccatcacaagactaaaccaggaagaagttgaatctctgaatagaccaataacaggctctgaaattgaggcaataattaatagcctaccaaccaaaaacaaagtccgggaccagacagattcacagccaaattctaatagaggtacaaagaggagctggtaccattccttctgaaaatattccaatcaatagaaaaagagggaatcctccctaactcattttatggggccagcatcatcctgataccaaagcctggcagagacacaacaaaaaaagagaattttagaccaatatccctgatgaacatcgatgtgaaaatcttcaataaaatacccgcaaactgaatccagcagcacatcaaaaagcttatccaccacgatcaagtcagcttcatccctgggatccaaggctggttcaacatacacaaatcaataaacgtaatccatcacataaagagaaacaacaacaaaaaccacatgattatctcaataaatgcagaaaaggcctttgacaaaattcaacagcccttcatgctaaaaactctcaataaactaggtattgatggaacatttctcaaaataagaggtatttctgacaaatccacagccagtatcgtactgaatgggcaaaaactggaagcattccctttgaaaactggcacaagatagggatgccctctcttaacactcctattcaacatagtgttggaagttctggccagggcaatcaggcaagagaaagaaataaagggtattcagttagcaaaagaggaagtcaaattgtccctgtttgcagatgacatgattgtatatttagaaaaccccattgtctcggcccaaaatctccttcaagctgataagcaacttcagcaaagtctcaggatacaaaatcaatgtgcaaaaatcacaagcattcctatacaccaataacagacaaagacccaaatcatgagtgaacttccattcacagttgcttcaaagagaataaaatacctaggaatccaacttacaagggatgcgaaggacctcttcaaggagaactacaaaccactgctcagcaaaataaaagaggacaccaacaaatggaagaacattccatgctcatggataggaagaatcaatattgtgaaaatggccatactgcccaaggtaacttatagattcaatgccatccccatcaatcggccaatgactttcttcacagaactgggaaaaactactttaaagttcatatggaacaaaaaaagagcccacatatcccagacaatcctaagcaaaaagaacaaagctggaggcatcatgctacctgacttcaagctatactacaaggctacagtaaccaaaacagcatggtactggtaccaaaacagagatatagaccaatggaacagagcagagccttcagaaataacaccacacatctacaaccatcttatctttgacaaactgacagaaacaagaaatggggaaaggattccctatttaatgaatggtgctgggaaaagtggctagccatatgtagaaagctgaaactggatcccttccttatatcttatacaaaaattaattcaagatggattaaagacttaaatgttagatctaaaaccataaaaacctagaagaaaacctaggcaataccactgaggacttaggcatgactaaaacaccaaaagcaatggcaccgaaaaccaaaatagacaaatgagatctagttaaaataaagagcttctagccgggcgcggtggctcacacctgtaatcccagcactttgggaggctgaggcaggcgaatcacgaggtcaggagattgagaccaacctggctaacatggtgaaatcccgtctccactaaaagatacaaaaaaaaaaaaaaaattagctgggcattgtggtgggcgtctgtattcccagctactcgggaggctgaggcaggagaatggcgtgaacccgggaggcagagcttgcagtgagccaagatggcgccactgcactccagcctggatgacagagcgagactctgtctcaaaaaaaaaccaaaaaacaaaaaacaaaaaaaaacaaagagcttctgcacagcaaaataagctaccatcagagtgaacaggcaacctacagaatgggagaaaatttttgcaatctacctatctgacaaagggctaacatccagaatctacaaagaacttaaacaaacttaccagaaaaaatcaaacaacaccgtcaaaaagtgggcaaaggatatgaacagacacttttcaaaagaagacatttatgcagccaacagacacatgaaaaaaggcccatcatcactggtcatcagagaaatgcaaatcaaaaccacaataagataccatctcacaccagttagaatggcaatcattaaaaagtcaggaaacaacagatgctggagaggatgtggagaaataggaatgcttttacactgttggtgggagtttaaactagtttaaccattgtggaagacagtgtggtgattcctcaaggatctagagctagaaataccatttgacccagcaatcccatcactggatatatacccaaaggatgataaagcatgctactataaagacacatgcacacgtatgtttattgtggcactattcacaatagcaaagacttcaaacccacccaaatgtccatcaatgatagactggattaagaaaatgtggcacatatacaccatggaatactatgcagccataaaaaatgatgagttcatgtcctttggagggacatggatgaagttggaaaccatcattcttagcaaactattgcagggacagaaatccaaacaccacatgttctcactcataggtgggaattgaacaatgagaacacttggacacaggggagggaacatcacacaccagggcctgttgtggagttgggggctggcggagggatagcattaggagaaatacctaatgtaaatgtcgagttaatgggtgcagcaaaccaacatggcacatgtatacctatgtaacaaacatgcacattgtgcacatgtaccctagaacttaaagtatataaaaaaaaataaaaacaactgcatgttgtttcaattaaaagcaatctattacaaacaacagatttctctaaaaagtttaactttaggaaaatattgactctgaaaccattttggaatttgatgggctatttgaaaacatcttgaagattctggtttttatatcattattaattgtctttatgttcccctgttccagtttgtattctggataatatctggttctataggcaaattaatgtttaaaacaaaatgatcatctgagataaatgcttaagctgttcttactaaggggtttatagatacatatttttgaatatacaggtggaaatacatatttttactacaaatagaataatttatcttaatttgtgtatttttaagttattcactaaaaatataaagtagaatttgagagaaaagagagaaatatgttatagtgtgcccactagacagaattaacaggaacaaaatatacttacaaaacatttagaaaataaattattaactgtattagcatgagaagctcactggttcttctcagcttttgctctgcagagattatatttagctatatttttatatactattcattttcagtggctaggcagaaagatagattgatcttttgtggttcatttcaatagttttcaaatttagcttggacatttaattaattagcctttgcataatattaattgcttgtatctagaagaaatattttgtgtatgtgtttggctgataggttaataactgaattgagtaaataactgctgtcactactggctccaaaatgtgacattcatatttccttttttttgagacagtctcgctctgtcatccaggctggagtgcagtggcacgatcttggctcactgtaacctccacctcccgagttcaagcaattctcctgcctcagcctcccgagtagctaggattataggtgcccgccaccatgcctggctaatttttgtatttttagtagagacggggtttcactgtgttgtccaggctggtctcaaactcctgaccttgtgatctgtcgcttcagcctcccaaagtgctgggattacaggtgtgagccactgtgcccggcccgtatttgtataatatataatacttgattttggctaagtcttttcatgaagaaaatgacaacactgacactttgtcattcctcagtatctgtgggggattggtcccaggacccccttctgataccagaatccacatatactgaagtccctgatagaaaatggccatagtatttgcatataacatatacacatcttcccatatcaatcatctccagataacttataatacctaatacaatgtaaatgctacataaatagttgcatactatattgtttaaggaataatggcaaaaaattctgtgcatgttcattgtagacacaaccatccatttcttttctgaatattttccatctctggttgtctggattcacgaatgcagaacccatggatacagaatgccaactgtatagtcatgaggaaataatcaggaaaaaacagtaatattctaagtattacttaaattttggttttgaatccattttaacatttttttcctcctggaaagattttatgactaaatttatctgcaaattgtaatcaccaaaataggagttaaggatgcaaaattgtttgttttcattggtactgccaacattttgttattcctgagttcaaacggatacatttaaaagcctctgcaaccaaatgactgtgacttttagctcagtttctgtgagaaaaaaagacactattttaaatcatttttatttattaaacactagctctctacaaaaagcagctattatgatattacaggactataatgatcaacaaaactgtagtagttgtaatctgggcaataaaactttaagcataaactttggaagcagagcctgggtctaacctgataataccacatgtatgctgtgtgaccttatacaggttacttactctctctgaggtaaagtttcttattcataacatgatagtaattttacataaataaccagattaaatgagcaaatatatgtaaggcattaaatacatggtagctttactatttcatatatgcctcagagattcctggctctcaaggcaggagggagaaaatattagtaacattattactaataccagaaggaaaaaaaaataccaatagcatgaaattgaaacaaaatttcctagcactaaattttaaaagaaaatggtttttatatgagatatataggaatatagtacacatcaaataatgtagtggaaaatacatatttttagtgcaagtaaaataattttatgaaatcataatgaaataactattggaaaacatatgaaaagtactgtgtcctattaaatatgcatacttttgtttacacaagaccacaaatttatagaaaatttatttcaaaagctgagagttcaagaaaatcagacagtatataatatttgacctaagactattccactgataatacaagccgaataggaattattgtacactgaattgcaggatcatagctgaggaagacaaaattattatgtctgaatagaccattaaatgacctctgaattctttgacatataattaaaaataaaagcatatttatgccccaaaactaatgctttgtttaaataaaaaaagatgaataaatttactaaaataaataaacaagctaacagaaaaacaatcaaagatgcaaaaagattgtgttgtggaaatgcaatttgctaagcacttgaaaagatacatgggctgtagttattgtcacatgggcagttttgaactttcatatatgcacctaaacacagacacacacacaacagatattaacactatgttcttttttttcttgagactataaaggagctgtttctaaaagataagagaagaatccatcaaaaagaaatgaacacactgatacggtttggatgtttgactcccctgcatctcatgttgaaatgtaatccctagtattggaggtggggcctggtgggaggtgcttggatcatgggggtggacccctcgtgaatggcttagcaccatctccttggtgatgagagatttctcactctgagttctcaagagatctagatattgaaaagtgtgtggcacctccccctccctcttgctcctgctctggccatataacgcactggctctcccttcactttccaccatgattggaagcttcctgaggccctcatcaagagcagatgccagcaccacacttcctgtacagcctgtagaaccatgaaccaagataaaatatattttctttataaattacccagcctcaggcattcctttgtagcaatgcaagaatggcctaatacacaaaccaaatatggttttccatatttaatgggaggaatggaaggtgcgttactctttcttgaagagtttctctacattagacattttacttccaatatttctttaaaaaccttgcaacaaatccatgaaataggtattttcattctgctttgtagataaagaaactgagactcaaggagattaaagaactagtcaactattatacagaagagccagacttcattcccaggcatggttaaattcatgcccaggtttctctccctagttaaaacaagatttgtaataacagcaaaggtaaattccattagacacttttgctcagcttctagaatacaggcaatcaaatagtagtactgaataaagaattattgaataaaacgatacgtctatttcaaaagacagacaagtacagttgccccttctatatttggatatcaactgaagagttattacaaatgaattaaaggatttataaatgtctatggtattgttgaaggaagagaaaaaaatgcctttcaaacaatgtgctaaattatttaatgctgctcaaataggcgcctctgtcctttaatgcaaatacacaaacacacacacacacacacacacacacacacacacacacacacacacacacacggataccaccatagcttcctattgcttctgtaatagattacggcaaaattagtggtttaaaacaacaccagtgtattactgtatagtttgtaggtccaaatgggtctcactgggctaaaattaagacgtagcaggtctgcatttctttctagagcctctagggctgtatctgtttccttgtcttttctagcttctagaagctgcctgcttgcattccttaagcttagtgtcctttcatcagtcgaatctagcaatggccagtggattcttctgttgcatcagtctgacactgactgtcctgccttctttcacttataaggattcttgtaattgcattgagtccacccagatagtccagaataatcaccctatattaaatccttaatccaattacatctgggaagtcccttatcttatgtaaattaatatcttcccaaatttcagagattagggcatagatgtctcaagagaagggggcatcattctgcctacaagaggcatattattgtgttcttttcaatgtaaaattcgaaggatctactacatttaaaaacagaaatgtgttaggatgttcccaaatgacaaatttaggaaaaacaaaattctgttttaatacaaatatgggagctctcaagctctttttatgtgcaaacaacatcactgacagaaagctttaatggtaatactaatcactgagaagtttctggaccaagtgttttctgtgcattatttcaatttactcctgtaataacattgtacatattattgattgtccacattttatcaatgaagataatgaggcttggagggattaaataacatgtctaaaattactcaactaggagaaggcataaataagattcagactgaacccgtaacaacatatagatgtaactatttcactttatggccttaaatttgagtcattttttaaaaacctgaagtaatccttggatttgtgatttatggggagtggggagcaaggcggtttatttctatagtgaaaaaaataatttatttgtatttaggtattaggtatttaggtatatacttctatgcctaggaccacaagaaaaatgaacatttcactgggaaatttctaaaactttctaagtttttataaatacccaggaagccaagaatatagattgctagaatggggacagggaaagcaaacctacttctaaactgcatcaggaaaataatttaaggaatatgtagataatctggttggaattaaagcctcccagtggaagtatttctatatgccttcatttgaaaatatctctttcgctcacctcataacagcttgaggcaaagtaaaaacagtatggatacaagatgagaaatcccatttctataaagttgaggactttttcatcttgcacaaggcggttgaatacaagggcctgctttctcatgtataaactgtagacaaacaataagattactgtgatgattaaatgtcatcataaacaggtatatgtttataatcaccatacacctataaaacattagaattgtctataaaaagtgaaaagtgttatggcatatattctattttcaaaacatttgcatcttttaataaaaatagtggataaattatgtaaaagtgcatataagtgtatgtatagatactatataagtatatattaggatattacaatataattgaaaaagatatataatttaaaaaaatcaaaatcacgggatgatagattattttaattttcttcttttcgtattttatttttattgtatataatgataagtactgcttttctaatttaaaatagttaatgttaatgttatgatggaagactagaagtagagcggaaacagaagtcataaagcatacgtacacgaaactcttgaactttatctgttcctttctatgccttttctaaaatatctctttcatctaaagaacctgtggagatactatgtgcaaatcttcattttcttttcctccatcaacaagccctggcttacgctagtaaagcatacattttttttcctcctgaaataaaataagaattttcctgcttgtttgcgaaatatttccctaggtatattggatttactcgtgaagattcaaccaagaagcaatgaataaagagagaagtggccttgaaaaacacagtctaattattatttatctatatatctttgctgtgttcattagtcatatggtatacaacatattaaataattcattttttgcacaaattttagaagtaatataagtggaagcaatttaactacaactacttagtgtaatgaacattttaaattgagcttttggaaagtgcttaattaatacttgtaaaataggggttcacagttcttgcaatatgtcattaagtccaagcattatctttaatcttctcccaaacttctgagaggagaaaatagtttttgaagcaacacaaattgataaaccttcaaaagttgaggtaatcagctacttacatttttgagcactagtcacagtataaatggaaattaaaattccattatgacataaagtaaaaatttagcactgtaagtttcaagtaatatgccacccctctacaccaaccttaccaagcacttcattcaaccacatttcagccctaatatgactttttttttatttgcctaaacagtatcacttcctcctttattttggcctcagaagtccattttccctccttggtttactattacctccacattccatgagtccttaatagaaatgccaactattgtactcttcacttcacccctggccaaggatacacagctcaagccaggccaatcagattctctcaccttcagatgtgtgatccttgaactgactgccagttgcttgaaggtcattgacctcagctttcttaatggcactgcccaaaaaggaattgctacttgagtttctaagattgctgaagcctctccatgtttttgtttttccttagaccctattcaatttctctcttgctgtacaagccaccaagtattcttctgatatgattcctttagtataagccagtcagaagtggtttctgctgtttccaacttactaaccatgccaaaaatagtttggaatgaccaatttagttcatagcagagaatggacaccatacctccctatttatggaaaagatactggattttttcctcccaaaagacattatgaaatgtagatttttcattttgtgttgcaaaatttaatcaagtattaaattttagtatattttcttttttataatcatggattttacatcattttaatttttttttgaagaaagttgtctttgtttatgtatatacattatccggttgtcaatcaaggtaggtgtattcaaatctaaagccctcagaagatgcctggctgcttttctaacatgtcacaacctacaatccctggtaatacagagaattcagaggaaaatatgagatatctctctgtacacttatctaaaggagtagatgaagcatatttagtatgtgcttattataattttgtgtggttcgaacatatcacagctagcagtagtaataaaaaatacctttttatagagtatttcttatgttacaataagttaagtacttttctgatatgatagtccttaaaattctcaaatacccttatgaggtgtagacatatttaccctaagagaaagttgaagattataaaggttagagaagtttgtaaagatcagaactgggtatggaattcaggcctgtctgataccaaaatcatggatcttaagtaatttcatatatacaatttttatgtatctactttttctctgcttttctattaaggtaattttaaatgggaacaacttaatggtttaataatctgtgttacatagaattttccctagtatagatttttgataaaatttctcctttactgtttgtcctttaaactcaggcatatctgagcatttatgaaatatcatcaaatagggatcatttagaagcaaaactgaaccactaaactggttaaagtatccaactttcttgtgtattttaataaaacacaaatataggtcaggtgtggtggctcgtgcctgtaatcccagcactttgggaggctgggggtgggtggatcacgaggtcgggagatcgagaccatcctggctaacacggtggaaccccatctctactaaaaatacaaaaaataagccgggcatggtggcgggcacctgtagtcccagctactcaggaggctgaggcaggagaatggtgtgaacgtgggaggtggagtttgcagtgagccaagatcgtgccactgcactctagcctgggtgacagagcaagactccgtctcaaaaaaacaaaacaaaacaaaacaaaacacaaatatagcaatctctattaaacagtcttgatggcaagcatatgctgtaagtaaataactagtaacaggctttcaaaattgaaagtgacagcttttaaaataatgatttcctctaaactgcttgtctgtaattatttttaagatattacataggggactaattaggtacaagataccaaaagggataagaacaggaacaagattgattaattgaacttacgaaagttcctgggaataaaaaatgaattagattgggaagaactgactacgagacttgtgttctgaataatgattaaaaagaatgacaagctaaatttatgtttcttatctctgaatcataaaattctgtttttgcttttgcattgaagcaatgtgtacattaaattgaaatgcatgccttataaaatgtaaacattaacaaaattagggaatatttaagaataaattaaattttaaattgtgaagataaaaccaagaaatcttctacctacttaattcccatgttttcttccacatacaagccctttattatttatttggcactagctatagttattgttggcccaagttaactattatccaacatactttctttagtcataatttttctggagtatctgcaacatttgatgtttcagccatttttgacttttcttgaaaccctcttctcctttggctaacaggtcatcactacataaattgtactcattttttccactggtctcttaaatggctattcttttcctctcattcactaaatggaagagtttttctcaaactcagtctttcatttttctctcttgacagcctcagaaagacaaatgagatggggcctcaagggacaataatttttttttcttttgacagcttaatttggtcattgtgagaggttacagcctgctggcagccctcgcagccctcgcttgatctcagcacctcctcagccttggcgcccactctggccgcgcttgaggagcccttcagcccgcggctgcactgtgggagcccctctctgggctggccaaggccggagccagctccctctgcttgcggggaggtgtggagggagaggcgcaggcgggaaccggggctgcatgtggcgctcgcgagccagcgtgagttccggtgggcatgggcttggtggactccgcactcagagcggccggctggcaccgtgggccccaggcagtgaggggcttagcacccaggccagcagctgcggagggtgcaccgggtcccccagcagtgcaggcctgccagtgctgcactcaaattctcactgggcctcagctgcctccctgcggggcaaggcttgggacctgcagcccgccatgctggagtgtccccccgccgtgggctcctgtgcagcctgagcctccccaacgagcaccaccccctgctctgtggcacctggtcccatcaaccgcccaagggctgaggagtgcgggtgcacagcgccggactggcgggcagctccgcctgcggccccagtgcaggatccactaggtgaagccagctgggctcctgagtctagtggggacttggagaacctttacgtttagctaagggattgtaaatacactaatcagcactctgtatctagctcaaggtttgtaaatgcaccaatcaacactctgtatctacctaatctggtggggacttggagaacctttatgtctagctaagggactgtaaatacaccaaatcagcactctgtgtctagctcaaggtttgtaaacacatcaatcagtaccctgtgtctagctcaaggtttgtaaatgcaccaatcagtgctctggggttttggagaacttttgcgtctagctcagggattgtaaacgcaccaatcagcaccctgtcaaaacagaccaatcagctctctgtaaaacagaccaatcagctctctgtaaaatgtaccaatcagcaggatgtgggtggggccacatgagggaataaaagcagactgccccagctagctgtggcaaccagctggggtcctcttccacactgtggaagcttcattctttcactctttggaataaatcttgctgctgctcactctttggttccacgctgcctttatgaactgtaacactcaccgcgaaggtctgcagcttcactcctgaggccagcgagaccacgaacccactgggtagaatgaacaactcctgatgggaggaacgaataaccccagacatgccaccttaagagctgtaacgcttaccgcgaaggtctgcagtttcactcctgaagccagcgggaccacgaacccaccagaaggaagaaactccgaacacgcccgaacatcagaaggaaagaactccagacgcaccatcttttagaaccctaacactcaccgcgagggtccgcggcttcattcttgaagtcagtgagaccaagaacccaccaattccagacacagttggatctgagttagcagaatggatctaaacagcatttctccctgatacaagcttcactagctcatctcctcttaaagagatcattgcctcgacagggaatctcctatcattacactgccagtggatttttgtttgcctttatttccatatttcctttatatttgtagagtaatagtgtttccagtccctggtttctagtcttgagccctttctatggtgtgttcagatgtgtgcaaattaagtttttttctttgtgcttatgggaggtcaagagatactttttcctttgatgctttctttgcctggttttctcacttaagcctcattattttacatttgtaccacgtgagactagcgacgcttggcataacaattccttgacttaagtactcatgctatatgattttttttcaaaacctacctgtcagtcttgaacacctttggaagtccagttccttgtttcctgcaagtttttatttagatcttattcatgtcacccaagatcaaaagtataaaatcatccttgatttcttcctttctctttataaccagtcatcaagtcctaccaacttctcttttgcagttgtcctatattttcctcctctcactggcccaatcctagttctagtttgggactggcctatttatccaattctttttagcattcattctatctctctccaagctattctacatactgagctaactttctcatgttaattccctgctttaagaaacaaaacaaaacaaaaaactgcaagcagttaatcttcctatcagtatttcaaatagttgtgaagaaacaacaacaacaataaaaacagtaaatattcagatttccattttccatttccagatatcttaattaagtaggtttggaaaagagatcacaaaaatatgtattattaaacgagtatctcaggtaattatcaccaggtagttcaaacagttgctttatgagaaacactattttatgattcttttacttatctacttcctttttctcttcactaacttttgtttaccactagggcaattcactgtcttctgaagccactttcaaccaattgccaattagaagaattttaaatttatacaaccaagctgcacctcaaccaccttgggcacatgttctaggatctgagggctgtgtcaagggccatggtcactcatatttggctcagaataaattgcttcaaatgttttgcagagttcgaggtttttcactgacaaagctactctaatttcaaatcatgcatgtctatgtctcttgtatatcaattagtcatgtacttcatgctactacttattgtttatacctatgttatagcttctccaccaggatagaaacttctttaaagcgctaatctcaccttgtggatacgtatccccttacagcacttagaacaaatatgtgatatatatttgttaatttaacatacttttcattatctctgtagcacaaaaataatgtttcaggggccatgtgacaaaaaaacagaatcatattagatgtgcctcaaaaataaagggaacagagttgttgaaagtgaaataataacttaaaaagtactagtctgtttggaagttttgtttatatgtaaatgcaagtgtgtgtgtgtgtgtgtgtgtgaatgttaacattagtcaaagagtaagaagaattacaaggggacccacaaaacctttaccaatccatgtaatgttgtcaaagataataagtaatatctaatttcaaaatcaaaggagcattgtcccagtcattctttaccacttttaccttttaccttggaatacactaaattccattgtttgcccatgtatctattattttattaccactttatatgtttaactcatcaaatgttcttgcaaatctgatacaattcacaattcactgtgaagaattataaaattatactgttattaattagtccaggtcaaaatcagatccattttggacaaaatcaatcatgaaaatatatggttaattataatgtgatcttttatataaacgataaatatcaaaaaggtggagtagtacaacaatagatattataacagcgtttctttgaaagcattagaacatggcatcaaacataatttactagacaaattctgtattgtgcaggaaaaggagtatttactattttctgaaatacatctttcatcttcatagtgttatctatactattctcttctttgggatctatctcacatttttatcttctctgctatcatccacacagcacctgtgataaaatctgggacaaaataaaattgaataatactacatctttttatttgaggagaactcacaggccagatgtatttgttcttgtatgacagggacaatgaatgattaagcaaagtctcaaaaatgagatgacctttaaactgacccttgtagaataattgagttgatctgaaaaacaatgtagaaaggacattttaaaaagagagacttgtgcaagcaaagacatttaggtatagacattccttgaggttaagtgaaaagaatgcaatgaatatagaaattcagaaaagcagttacataggatatgcccagtagaacttcagagactggtgaagttgagacaatgaaaccttctgaatgttcactcctatgtacatcttttctatatggcacttttccccatatttctttttattatgtaagcataatgctgaatttattttcgtctatttaatgagaagctttttttttcttctttcgatagtcaaccagtaagatcagctacttgttaaagttgggaaaataaatattttactaacagaaaaaattgcattatccataagtgataaaaataaataaaaaccaatctaataactatgctaaatctttagcaagttattactttaagtgcagacctgaccttgattatattacaacagaatggggatagccaatgcctacaaccataatcaataatgaagaattaattctgataatttccctcatatctatcaatgttaaactacattttatgcttatgttattcatgtagttgcatctgttttctatttctgcaaaggttgttatttctgtaacataagtgacttaatagattccagttcttctgtgcatagtttcatttgcatttaatagggcttagtgtgcctctactgaaataggagtttttctaaagcaagaggtttagagtgactgttgtatcactttggggcctcattattaatcagtaattaatactctctggaaagcataagtttgccaaaatatttggcattcaatgaatggcattttgaatcccaatttaaatttggactaaaaaggcttagaaaaaaaatctaaattatttactatattaattataagtacgtttccaagaatgaagaaaactgtatcttctctctttagttccaggcttattcttaggtataagaaggagaactattttatgcattcctagattcttaaatattttaattttgcttgcccatggcagcaatatgtttccgtcatgaaatatatattttttctcatatatgcagaaatgtaatatttttctattttgaaaagtctgattatatatcattgtcatcagttcagcaaaccaatttgggatcaatggaagagcactgcctcaatgcatttggtttcagaaatgtattaataatagtgtataccatgtttcaaatcacatttccaaggaaacctattgtgcacaatgcaattttttcttggacagacaattttatgctatgagtccactggaatacatttttgtttcattgaaaatataattttttcaaccatatatttatataagatgcctaaaatttctgaaagaaaaaatgctgttaatgatattatcgtgttaattttcataaactcctctccatattttaaagtaatacattattaatatagtttctaaaacagtggccatatatttgtactataaatataaggctatgatcattcctgggattttaggactaaaaaataatatgtgacaggctacaatattgttacccaagttatagcagggatacttttgttttaagtcagtcaatcataggtaaagagtcattagcattatttgtcacagaccttctgttagaaaccacaaaagtcagaagaatgaaatgtattacaagcttgtaccctacagctaaaacataaaatgaaatcaatagcatttgagttgttttaccctcagtttaaagtttatcttaattgtcttgtaatttattcctgattgaaagtctagttattgaatcaaaacacaatgacatatttatagaaagctatggctttcttttttcatgtttaaagataattataattttaccataaagcaaaaattgccacttcaattatggagttacataaatcaatctgtgctgtaaacttgcatgttactgcttttgctctacataaaagaatgggaatgactctgtggcacaaatattaacataagcttctatagatgttctgggtacaggcttcttgaagcttctttgggaccaagtaacattatatcctaaaaacccaggagagtttgagtttttctgcaaagaaagagactatggataggaagaaaagatgactcataattttgaaataatgtattagaaatagcaacgcattcggctgggcgcggtggttcacgcctgtaatcccagcactttgggaggccgaggcgggcagatcacgaggtcaggagatcgagatcatcctggctaacatggtgaaacctcgtctctactacaaataaaaaaaattagccaggcgtggtgtcaggcacctgtagttccagctactcgggaggctgaggcaggagaatggcatgaacctgggaggcggagcttgcaacgagctgagaccgtgccactgtactccagcctgggtgacagagtgagactccctctcaaaaaaaaaaaaaaaaaaaaaaaaaaaaagaaatagcaacgcattcacatttgtctttccttttgaaactagtccaacagtcccacagacagttgttttcagataaacacagagattggctcttctgctgctaaagcttaaaacttttatttgttttatctgagctctttcctcagcaaaggaggaccttcaggcctctgaaaaaagtttcagttatttgaaacttaccagatcactgccccagaggcctccttgctcctccccagttcttgttttcttacactcttacgtttcttccctactacataaaccccctagctttagtcaatcagggagatggatttgaaactgaactcccatctcctcagcttcaacacccgattaaagccttcttccttggcaatacttgttttctcagtaattggctttctgtacagcaagcagcaggacctagaccaaactcctggtgtttcattaacactttgtaaaaggaagataattatttgatcaaattagtggtcaatatgggagtaaaggaagaaaatacggatgcttaacagaatgagacaggaagaagagataaaatgtagggagtctagagggccagaaagtttgagtgcaggaagaatgaaaaatcaacacctaatttctaactgaattgaagagagagaaaactccaaagcttttcagattccctgcaatttcaagtactgggaggaagctcctaagcacattcccatgattaaaacagtgtactgtctccatctgtaataatgactaaaccactgttatgaaaaggctgcaaatcaggggtggtgaggtgggagtgggcagaactggagcttagttagcagtcagccatcaggtggattgtatgagtggtatgtatgctacaaatttgcatactgttagcttgatatttaaaacgcttcacaatctggccttaattttccagactcactcatgcattggacaaatctttattgggggtatttatgtgccatgcattttaggctattgggatacatcaataaacaaaacagatacaaacttctgtcgttgcgcagactaaatccattttaacaatatccactaaattctgttctacagtctcactgaaacaatattcttaatatgaaaatatagaattataaaactctattattttctttcatactatctctttaatcctgctaatatgggctaatatctttcctgctgttgaataaaagctcaagaaattttataatttttaaaaaaattgttaatagtactatggtaaaggtaactttaaaaagaatttaaaaatgattctctagttcaatatatgaatctaatactccaaatttcatttaaaggtaaaatgtccttccccagcttagatatgttaatggaagttcctctgcctttggggaagaggctgtaagagatttctttttacttttttctttattaactaccaccacctccttcattcactagcagttgatttttatcactcagacttctattacctgaccttggagattatggagaaaaggcatgtaaggtaggtagcgaagttcctacttcaatattactgttgtgaaatggctgaatactctttgggtcagacctgggtttaaaacagacatggtcaatgagagcatcttcagcactggtatgcttttcttcagcaacttcagtttgccagcatacttcagttaattccagtttgtcattttataggaattctgcggtctatgtccagtttttgccttttgcagtatcatcactccttcaggtaatcctaccgaacaggatttaagaaaactggcattcacctgtgtcccaaatctggtcctttgggttggtttgggtataattatgcaggcaaagaacagtcacaggctctttgcctgcatacttatagaagcacagacctttctagatgtagctgtaatataatgtaatactccagtcattgtaattgcttgttgctctttttctgtctacatttatctgatatgtctcaaacatggatttgctgtgctaggccaacataagggcagcgttttttactgtagttgccaatgttaaacttgagaagggaaagcatatatttccccagccattgtattttggggaaaagtatactgttgaagtgaattcaagtacaactttacaacaaccctcccctataaaggaatactcatacaaagtcacttctaaattttaattcgcgtgaccattttcaattctcctcgagagtaatggtgttcagagtgttaaactctgttactggaacatgatggttttggtctaggttctgctgcttgccacacagatgggcaatcactgagacaatgagtattgctagggaagaaggttttaatccaatcgggtgctgcagctgaggacatgggagatcagtctcatggagacagatccctcatggcttggtgttgtctttgccatagtgagttctcacaagatctggttgttgaaaattgtgtggcaccttcccccaccactctctctctcccttgctactgcttttgccatgggatgtgcctgctctccctttgacttccaccacgattataagcttccggaggtctccatagaaccagagcagatgccagcaccatgcttcctgaagagattacagaaccatgagccaattaaacctcttttctttagaaattacccagtctcaggtatttcttttttttttaaattttattattattatactttaagttttagggtatatgtgcacaacgtgtaggtttgttacacatgtatacatgtgccatgttggtgtgctgcacccattaactcttcaattagcattaggtatatctcctaatgctatccctccccccttcccccaccccacaacagtcccccgtgtgtgatgttccccttctgtgtccatgtgttctcattgttcaattcccacctatgagtgagaacatgtggtgtttggttttttgtccttgtgatagtttgctgagaatgatggtttccagtttcatccatgtccctataaaggacatgaactcatccttttttatggctgtatagtattccatggtgtatatgtgccacattttcttaatccagactatcgttgttggacatttaggttggttccaagtctttgctattgtgaataatgccacaataaacatatgtgtgcatgtgtctttatagcagcatgatttataatcctttgggtatatacccagtaatgggatggctgggtcaaatggtatttctagttctagatccctgaggaatcgccacactgacttccacagtggttgaactagcttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatatcttcttttgagaagtgtctgttcatgtccttcgcccactttttgatggggttgtttgttttttcttgtaaatttgtttgagttcattgtagattctggatattagccctttgtcagatgagtaggttgcaaaaattctttacagtaatgtgctctaatacaaagagatgagcgagaaaatgatgaaaagataagagaagattcaacacttgtatactaggaatctcccagtgagacagaggagggatagaactttgggttcagatcacctctactagagcattatttcatgcagtcacactagtcaccagaccttgcaccactgtaaggtgatggcagcatcacctcactcatgccatccccactgaccacaagactgtgcaagctataagttacctagagaaactaagatgagggacattctaccatacatcttactcaaggaagttggcccccaatacccacatgcacagaaggctaaaaaaatgactgtggtggcaggcgcctgtagtcccagctactcaggaggctgaggcaggagaatggtgtgaacccaggaggcggtgcttgcagtgagcccagatcacgccactgcactccagcttgggcaacagagtgagactctgtctcaaaaaaaaaaaaaaatcacacggagatgtaacatgttaatgagacgtgtgacacatgaagaagcaagtcatcaaactgtgcaaatgctataaattcccatttctacatgctttaatgtcactcctttcatggctaggcctgttaaaattactctcttggctatctccagggaggcagcaagagcactttctcttttccgggctgctttccttgtgctccagcataagttccaataacgcctggagtctgggaaattttcttagccttctgtcagtttctattgcacaagagcataagaacttgtggccagtaacaccagaatagatgccacattaataaaaaaaaaaaagtctagaattaaaaaaaaaatccctaaatgagacttgaacagttatactacatatatagaaaatgacccagaattgccaacatgtagaaatacattgacaaaaatactgaactctaaagaaaaaataaaggcaattatttggaaattcagaaataagaccagtttgtcattacacatttttttacagtaatgcttcaaagaataagaaaatggaatgaaaaatttaatttaaaaaaagaaaatgagtcaagttatccagtcaaattggtcttcaatgttaaagccctaagataagcttttcttaatgcaccaaaacataggaaatagtgtctctataatcctgcatcaaggactttacttgggaatgggttactgataacaaaatgactgaattgtgttattaagagggataaaacaatatcactttcaattagatgtgtgggaaaatataagagatgaagcagaagcattgctcacaacaggaaacatatgagcagtgcaaaaaaaaagtgtaccatgtaatgtaaaagtaagtcgtagaacaaatgtgggcaaactacagccctttggtcaaatccagcccacagacagcctgttttagtaaaatgaattttatgggagcatagccaaaccctttggtttacgtattatctcttcttgcttttaagctacagcagagtagagtagttccgacagagaccatatgacccagaaaactaaacatatttgtcatctcagtattcccattttgagtatgatagtgaatcaactcattattttgaaaatcaataataaaaggaaagaataaagtttttttttcttgtttttcctatagttggtggacctcagggttactgagtatttgctatggagacgtttttctttataaaaatattttggctaatgaatatagaagtaataaaaataaaaaaataatggatttagaaaattactattggtggttgctactatctatatcacaaaaagagaatcaaagagatttaatgtttaaggaaggagtgaatatcacctatgatttatttgtttaaaaacaaaccaaaaataacctggatatgatcaagcctccagatctaactacttatttcctggaaattaaggaagcagaaagaatatgaaatgaccacttggagagacagtcatcaatccaggcttcagaaatgtggtttcttgcacaaataaatatcaaggtgaataaaagagcgtagtggtgaagcctacagattaaaagagacttaacagacctatcaaccaatggcaatgtatagaccttattttgattctgatgtaaataaatgttcaatgtgaactggatatgtttaatatgaactatgtttaataccaactggatatatattgatatcaaataatttgttacttttggcagcagtaatcatgatattttaattgttttaagagtccttaagatatacatatcaaaatatttacagattgaatgttatgactctgacctgcttcaaaataatgcaatagtgggtagttgagagcatagaggaacaactatttcccagggcgtgattatgttgaattagggagttgatacatggaggttcaccgtaatattctctgtaatttttgtatgtttgaaatgttccaagtaaaatgttaaaatatttaaatattcctagtgttaaacttatgaaattagctctaaaattttacattttaattaatttgcatttaaatattaaatctaatcacatcatggttgcacaatttactttgaaaataatttcattaacaaatttttggtaaagaagtcacaataaaatacttctttaatgaattacacttctgatttttattatccttattcaaatgatatgtggtagggcaactaattctgctgcagagatgaatatttagctaactaattaacctcaatttacataatggttgtatttgcataactaatgggctggggattgactataggccattaacagttattaattaatgagattgaattagaaatatatgggtttttatttcaaacttaggaggcaaaggtcaatcataaaaggttaataacaatattcaaagaatcaggcagtaaatattttagcttttagacttcatgcatttctgacaggataattcaggaattggtttcacctctacatgcatactggggcacatggaagtatacacatgtgcattagagaaacttttattagcctcagatttacatgtaaattaaagtaatgggagctagttgtattcacatataagaacttaatgcacctctattcataaaaatcacaggtatcacttgagaaagttctacaacctaaaatttttctttcttaaactgttcatttgtttcaaggaaagagtgcaggtacacttttcaattaatcttcctcatttttgcatttgcaataaaataggttacattatataatttagagttactccaacctttccactcctcatttatccaattcagtttacaattggaagcatcctctatatttttaaaaacataattgcctgtagtttaaagattttagaaactcaaagaattcatctgctatttttaaacaatttaattatgtgagtgatgcataattattgaggacaattcaattcctttaatttcaaagacacctgtataatctgatttttcaaatgatttggttgtatctctacaaggaactgagcagctctctacactgaatcagtaaatgaggttcacgataaatgaaaaggagtgatttctttttatgatcaactgccaaactgatacagaaaattctgtcctgcatcttctgcctgttgctcctgtcttgctttcttttctctcacactgcctgggttcttgctttatgcctctgccctcttctttttccctcttctcccttctaagaacgctcgcttgctgaaatgccttgaaatgatgtccagggatagtccctgggtgaatgtttcagatcctgtttctcatttcacactctgtctgggcctctattctattaatagttaacttaaactggattatcttgagtcttctagattttaaaagggttgctctgattacaaaaagatgattgcttaaatgcaaaagagtattacctcaatagatgggaaaagaatagcatttattgcattattgataacatctttaaatctgtgtcagttcccttcacaaattggcttttatatgcttctctgtgggggtaaactatatgccacagaaatgttgaagttcggagtcacagaacgtgggcttaaatctgtgacgctttgtttactgtcatttaaaaaaataacctttttaattattaacaaaatcttgcctttgtaaaacagggtagtaattctcatttcatagattaaaagtgtaggttaaaaagtgtaaattaaaaatgaaaaatgatgctacatataaattacaataaatgttagtcgctaattttaagatgattttttcttttctcgaagaaaatatgtaaatacaagaagccacacaattcaggcaatttctagaagtcattcattaaaaatatctatttcccaaggtttatccagagcttcacagtgggactaagttttattatttaacatacacagacaatggtggtattttaacaatattggatacacaatttgaaaacggtgttttattatctcgacatttcaggagtatgaaatcactccctgccttgtcatatattagctgtttaaacgaataggcaatcatctcagagtattaatgatctttctatgttgtccactgagaatgatattttagacataggtatttcatttaaaaaattagcagagacaccatacaattctggtaaaagctttaagtagtataacttactttttgaaggaactcggagattggcaaggaccacttccagggaatcagcttggactcgaagtacatagcttgtcctggtctcataatccagaggtccattcacatagataacacctgtgatgttattaattccaaatgtatctagaaattaaaatacaattacctggtcattgtctttacgctataaggaaagaaattctctttaaaaggcactgtgatttcaaaaacactaaaaatgcctatttataactagagtgatgcatgaaagtgacaaaatgctggcttttggaaactgttccagctctttgaatgatcaacatcaatacttcgctaaagtctgccttgaaattgtagggtttttttgtttttgttgttttgagataatcctggaaaacaaagttctatggtcaattacatttgggaaacactgaataatatattctttaccttagattcagatggtcttctgtcacactaaaggctttcagaagttgtttcaaagaaaaccatctaattttgtttaaccaaaattttctgaacttactggattattatactctttgtaatttatgaatattattattttgtagatttagtgttttgctaagaacacttgagagaaaataaaaaaatggataatttaatgttgccctgtgtctgtttatttaaataaatttgaatgaaaatcagggcactttggtaaactttataatatctccccctcttatgctctccatattctctccttactttattttttcatgtaattaataatcccttataatactatatatttctttgtttaataatttttattattaatctccgcttactggaccattaacttccatgagggcaggaatctattttgtacattgttctatctgtagtggctagaagagtagttaatacataatagatgctcagtacatatttgttgaataaataaataaatgtacaacagtcactgtgggggacagacgttaataaatatagccactctgctgtcttcaaagaaaaggacaaatagaatcaaaagagaaagtttcgggacggaacaggttgagaaatcatagctttagtcagatgttcgaagtccaaggaaaaaggaaatttagttatttttagggaggacacatagtagcacagtaataatgtagaaagaaaggcaataaaagtaagatattgaccacttgctacactacacgggcagcaatacctagtaatagtttgtcattaaaaagcttaacagggcctttataatttccttgcaaactcttttacattcactcatttctttaatatttactattgattaacttattacatgtatattaactatttcctgactacctacaatatactaggctatctaacataccaaaagggaaaacagaggagaacttgtggagaacaggtaaaacaaaaattaatgcgaaagattgagctatgaccttattcccagaggcctgcaaattcctatgattcttaaattacaaaaacttatatttttatttttaatcatgaattgtatgtctaatttgactattttgggaatcatataacatgcatagcttttaacatggatgtgactctttttaaaattcacaacttatttacaaccttgaagttccttcaggattagttaaggtatgaccaacatggagtaagggtcatggatggttcagacactggggcggacgaagctactgtaggcaatgatcatggccaaaagctgaaaatttcatgatgcattaattttgaggaaatgtcattaaaatattaccaaatgaggaaaagggcaaggtttcattaattagatacttaatatttcttaaggtacttaatatttcttaagggaaaaaatcactttagctaacatcactggatttttaatcgagttcaggatacatggttaacaattacatttaagatgggcacaattttattagaaaacaatagaatagataataatttcaattcaatctgaaattaggccaaatctaagtttactggttgatggtgagaacacaaactaaaagtctactcaccttcttcatttcctgaaacaatggagtacacaatactttgattaatggcagcagcagaaattacaccaaccatggtccctttggtggcaagttcacttactggaggaggtctgcaggtttagagaagatgatgtatttatttttaaatataatttttgatgtaactttacgttcacagaaaaattgagagaaagataagagatttctgatataccctctgccctcacacattcatggcctcctccatgatcaaatcccccacccaactgctacctttgtgataaatgatgaacctacattgacccattatcactgaaagtccatcatttacatgagggtgcatattgttgttgtacattttatgagtttggacaaatgtgtaatggcatgtatccgctttcatgtagtatcatatagggtattctcactgttctgaaaatcctctgtgccctgtatattcatccctcccctcaactcaacctctggcaaccactgatctttgtagtgtctctatggttttgccttttccagaatgttgtatagctggaatcacacagtatgtaaccttttcagattgccttctttcacttagtaatatgcatttaatgctcctcaacatctatggcttgattgcttatttcatttttagcactacataatatttcgcggtctgaatgtacccacagtttatttccataaataaaaaacatcttggttgcttccaagttttggcaattatgactaaagccactataaacatctgtgtgtaggtttttgtgactctaagatttcaactcttctgggtaaatactaattagcatgattactggattttatagtaagactgtttagtcttttaagcaactgccaaactgtcttccaaactgactgtaccattttgtattctcaccaacaataaatgagagttgctgttgccccatattctaaccagcttttggtgctgtcaatagtctggatttcagacattctaataggtgtgtggtggtatttatttttatttttttatccatatttatgacagagttttgaacttaatagaagaatgtacacggtagttcttccaagctacattatgcaattacattgtgctttcattgaaaccttttacaaaaaatcctgaaatacaaatttagtctgaagtataggctttataaatatctggtccaaattgctttgtttttggtactgctgtccatacacttaattgactaggttatctaaatgtaaagcagtctttctcacagatactctagcacctaatggtggtccatatattcattgcatgagcaataactgcttcttgctgaagaataagaaccaatctgtatcattttaaaatgaagtgtgtaaagtagatatttaatttactagtttatttacttacttattttactgtcctgcattttctttttgctttcttttgataacatccaaatattgttttcaataatcttgcctctttccttctctgtacaagtgctttgggtaaggctttgccaatccccatggtacatgcataagcacattaaccaactctggtcaatgggggcattttatcctttgctcagtgttcatgtgatgtatacgtctcatgtaaattcaatggacatactacataagattatgacttgactagattctcgctagccaactttttgggtatatccctcactggatttgatgaagtaagctgccatatggagcagtcctcgtggcaagaaactcaaggtgatggctgactaacagccagcaaggaatcgaggcccttagtccaacatcccacaagaaactgatttctgccaacaaccacatgtacttggaagtggatctttctgcagttgagcctcagatgagaccgtagccctggatgacaccttgattaaaagattatgtaagtccaaaaaggagaggacacagctaacccatgcctggattcctgacctataggaaattcaaaatgatatatgtgttgttttaacccattaagttcatggtaatattattatgccacaacacaaaactaatatttgaacaatggattgttaatttatgacagatcaagatacatactacttatcaaaagtttaatacaagaaaatatgtcagtcatattaggggataattttcaaaaactgaattcctatttgtggaagtagacattacttaaattgtttacttgtctatcttgttactgcacaagatagaagctaaattttatactttccataattcatctgtttgctattccttatacagtatggaaacaagacgtctgcaacttatgcacctttagctttaacatgagaaaaatgctatgtcgggccgggcgcggtggctcactcctgtaatcccagcacttttggaggctgagccgggtgaatcccctgaggtcaggagttcaagaccagcctcaccaatatctctactaaaaatataaaaattagccggttgtggtggtgtgctcctatagtcccagctactcgggaggatgagacatgagaattgcttgaacctgggaggcggaggttgcaatgagccaagatcacgccactgcactacagtctgggcaacagagcgagtttaaatctcaaaaaaacaaaaacaaacaaacaaacaaaaaaaacaaaacagaaaagaaaaatgctatgtcttctttcaaatattaaaaaatgcacgtgtacatttttgctaaccttaactgcacaattaggatagaaataatactaaaaaaagtaattggcataatttaagaagacatttaaatcctatgcataccactaaaagcatttaaaattctatttgttagtaaatgtttacaacagatttacttctagacaaaatttctcctcattaacctttgtcttaattgttccagtacacttgtttctatcagaactaaaacactatacaaatacaatcttctcccaaaaagaattaaatgaacctccatgataatgagcattagattaaaaatatcaattattttctattttttggcaggattacaatgtacaatattaataaaaataatattattttattattgttttaggttgtggaaagtaccagttacatgatggaggcaaattgcatactctctttggagtcacatatgtcttgaatacaaatgatggagttggtataaatcaggattcattaagccagatggacagagaaggtaggaacataaccaaattgaataaaatgggctgaatataaattaatagggagaggaatggaagttaggaatgagagagtatgtaactactgtacaataattcaagtctggtgtgatttgtaaatcaataaaggaaattgaaaattttgtatatgtttatgaacgatcaatgggaatttatttttttaaagcatcaatgactacatttgatctatgggctgtcagtttacgatttttaaagcagattaactatctctaatgtcttttctagttctaccattctgaacctgatataatgtgagttatcattcactcttctttctgttgagtataatcaaaatctattgctcaatttcagaagcaatgaattatggccaaatgaaacatttctcagaaggttttctaaaaaaatattttctctattaaattcataaatcttcaattcatccatttatgaaaaaaatgcatcactagctctcttccaatttaagcttttcgcacctgatttataacaaataattgtgagtgtctgaaatggaagaatactatctttcaaagctaaatttactgccaatacaactgacaaactgcactcttaaaagaaacacttgaaacagcttcagtaatggaactatacagcttactgatgtagcttgagatagataccaactagatggccattttccaaagatggctaagaggatgctaaaggaaatggttatttagcagatatgaactggaacatgggagaggctagtggtttcatgttttcataatggccttcagtaagggcttcctcaaaggccctttcacaaggcttgacctgaattgggtttgatgtccttgcatatccatgatggcagtgttggttcctatttactccacaacggcaatgcttctaactttcttggccgttttaaacaaaatctacaggctttgactaaaattccaaaatcacctcaactaaaactgaaatagaatccgaaataatatttgttttataaatatatttcctcattgttactatttgcattatccttaccttctaaattttacatgtaaaacagctgtgtattttcaaaattaataatatttttgtttttaataaaaatgttattgagaaataaattaagataaaaatactggcacaatgcctatgcatttcagtatatttatacttcctcccagaaaagttcaatggtctcagaattttttgtattcttatttattttttaattggcaaatagaaattttatatacttatggtgtacaacatgatgttttgaaatacgtatacactgtagaatggctaaattaaactaccatttgactacctcacaagtttattagtggtgagaacatgtaaaatctattcccttagcaatgtacaatattgtacattgttgtcaactatggtcaccatgttgtaaaagaaatctcttcaatttattcttctaacagaaattttgtatcttttgacaaatatctccccaatccttcccttcctacccagccccatgtaaccatttttttacgctctactttcatgagttcagctgttttagattccatatatattagctttattagatcactattagaacatgcagtttttttctctgtgcctgatgcattttagttaacataatgtcctccagatttgagacaaatgaacgtatttgagacaaaatagaatactaaagtctaggttcattcacattgtcccaaataaaagaattcccttcatttttaaggctgagtaatatttcattgtatatatatatatatatatatatatatatatatatatatatatatcacattttctttatccattcattcactgatagatattttgtttgactccatatcctattataaataatgctgcaataatcatgggagtgcagatatctcttccaccaatagcctgatttaaaaatggaccaaggagcagaatagatagttccaaaagaagacatacaaatgaccagtaaatatgtgaaaaaaatgttcaatatgagtaatgatcagaaaaataaaagttaaatctacaatgagatatcacctcacatctattagagtaactattaataaatccacttcatataacttgtgtgtgaatatgtctctcaccaggttcaggcactggtaatactgcagcccagaatgcagtggagggaagcatttgagttcctattccggctggttcacatagtgacactgtgtgctatcttccacacggtgagagttttcccttaggatcagttattagtgaacttccttcacactgacctaaaatgtttctgtttttcgtctactcatctcacttttcacctgaacccctggtaaccaatgatctttttactgcctctatatgtttaacttttctagaatgtcacatggatgaaatcatacagtatgtagtttttttggactggcctctttccttatcaatatgtgcttaagtttcctctatgtctttttgtattgtgatatctcatttcactttattgctgaataatattacaatgtattggatgtatcacaaataactgcacttttgtaagaagaaaactgatcaaaataactccaaaatggtttaaagtaaatatttgcagattaaatgcaaaccgaaaaagttaactgctttggaattcgcatgcacaatacttacaatataacctcatgaagatataaactaattcatacatatcctttttgttttgtttagacggagtctcgctctatcgcccagactggagtgcagtggcgcgatctcggctcactgcaacctgtggctcccacgttcaagcaattctctgcctcagcctcctgagtagctgggattacaggcgcccaccaccacacctggctaattttttgtatttttagtagagatgaggtttcaccaccttggccaggctggtcttgaactcctgacctcatgatccacccatctcggcctctcaaagtgcaggattacaggtgtgaaccaccgcacctggcccatatatatccttttaatatttctaagtgttttttgaaaatatagattacaataaatctttcaactgagtatatattaactaattttctgaataatgactatagtagaataacataatttgcaatgtctaaatgttagacccagtttttaccgtataaatatagatgaaacaattacaatttaaaatctacttttattgttgagttcaagaagtaacaataaaagtaaatgttgtatgtgtcaaataaagcttctaattattttaaaagccaggcaatttaggatataaaagtgtttgtaaatagatgctataaaatttcactaggattcaatctggctctattgctttctttgtactaagagacaaatctaatttattttgacatgtttgagttcaatatatttgcaaatcagtaccaattaagatactgtttttctacctactatgagaggatttaataaaaatgggaagggaagaataaaaaaaaaacacccactagaactccgattatttataatcttggagtaattgcatcagagtgatctaattttacatatttaaataagaaaaacagtttaaaaaagacatgaatcaggagagagatgctagttcttccagaatacttaggatggattttagataagaaaattaatgaagggccaaaagactagacactgctttttacgtatgttccaaagaatgcgtgctttctgtcactaagagttttgcttctattcagttccttaaagaatcttcatctggaggatacaaaaactgaagtataaacaatttatccaaatatttgaaagcaaaaactgcaatctaaggtgtttggtttttcctttgcttaaattattatattgttctcattaaaatagtgtgttctaatctctcatagtcattggctcttaaagcttaaatccataagaatgcgctggagaaattttttaaacttactaaagtacagaagatccctgatttatgatggtttgactttcggttttttactttactatgggtatgaaagtaatatacattcagtatgctcctggacttacaacggggttaggtcctgataaacccatccctgtttgtctactgccctaccttaattattatagagggcccttctcactctcaaaagtgccctgctttggacaataaattatatggtcttacctatgctggaaactatatggatatattaaagtagcaaatttattcctctcgcttgaaaatttacaatttttttttagtgagaccgagtgtacaggtaatcagaattctgttttgaattatacattatttgacattaatatagtaatttctgctttcccttgtttgtaattgccagatatacattttctgttcactctatttttgtgcatgtgattttggtttaagtacattacttaatggcataaaatcatgtgtgaaaagtttaccagaggtaaaaagcattcttagaagattaagtaaatggcacagctattaagcaccggaggagttgggaaatgaatgacttatccattataaattggtgataaaaatgtgatgattttgaatcaagatttaaatagtataaaattctactttccatggagattgtggaagcacaaagtgacttccattaagaggatatgcatatgtcatttgcctgtttaacaccattcaatgtcttcaaatttctctgtgataatgaacaaagtttttagtatgactcagtaagtcccttcacagtccaactctccctacttctccagactcatcaccataggactccatttagtatgctattttgtctcaaatatgtttgcattgattactaataaaataaaattaatgtatcctactgtatgttttacttggatcaaaatttcccatagatacaatacaatgaaataatgggacgtataaaatcactctttgtattgaaaagtttgtgctaaattctaaacagtggatgtaagttgaactgtttggacttgagtcctttgttgaaggaagacttgcttcactctgctacatgagcaaatgccaaaatgtgtataaccttggaaatgtgaaagagaaattaaattccatgtaggtgcacagggaacctatcaaaactgtaatgaaagattgtcagaatcattttgtcaatagttaaatgggcgaaacctattatgtttgaggcaaggttttaatagtgccataaaaagacaggaaaggctatcttcaggtaaagccagctcttacattggacaacaaatctaaattaaaatagaaaacaattttagcaatcgagttatgctctctgcatatgcatttgttttacattattttaatagtcttcagacagctttcattaacttatttgcaatcaagacaaatcattctttccaaactattgttcatcttattaaaatcttttctcaaaatctgtaagtccaaacttggaaggttttataagaatgatagcctgggcaatatagcaagacactgtcactacaaaataattaaaaaaaaaattagctgggcatggtggcatgcacctaaagtcgcagctacttaggaggctgagggctgagatggaagattgcttgcagtgagctatgaccgagccattgcaccacagcctggaagacagaatgagatcttgtctctaaaaagaaaaaaaaaatgatggctatgttcctcaacataaggtaattttaattctctttaataatgaaatgttaactagacctgctcacttgctatttctttggccactgtgataatattacttgcattttcatagtttacaaaaatgaatgccttgattataaattatactttttctgttttgtatatcaagaggtataatgctaatcctttgttaaatatactctaattttattctttaatataaagcttcttgagaaacttattttaagtataaattgtgtaaaactttcaacctgtcatttattacaaaactaattcgtatgaatcaaccaactagcaattttttattttaacagagaaagtggtaagattatcttttgaagaagagttaaagtttttcaaaatttcagaatgttcacatgtataatattctgattttgaatttgatatattaaattttaataataatagaaattgaaaaggacttatagtatattctctgagtttagcaatatatcaacttaagaggttaacaaatataacttagggatatttgcccttattttattatatatataccagtataaattttgaatttaggttgttatggaaattacacttgcaaatatacaaatcttaaaaattaacatgaatgtgacactaaatcatgcaatggttaatattcaagttgatacatttccatttttaaataaaaaacaaaggcctacctatataggtggcatatatctttgaaaattttgcaattaattgtatttggcaaattttttgataaattgtgtaatataatgcatttcccactcaaaatcaatattcacatttagactctatgatctattccagacgtgttgaccttttcatgatatttacttttaaaactgatgacaagtgaatttcagtgtgtataagtcttagtccatcatcctgaaatgaaggtcaaatgtcattctcattcttcagaaggctaacttacttcacctatgggagtcaatgtaatctcaagtagtatgtgtttgaactactattaggattttgctatttctgtagggtttaaatgaaagatatataaaaggaatttaatgactctgacattgtaactaatttctaaaatatataaagagataattgaccgaaaatctcttagtaaatatgaacatgcagtgacaatgagagtatgcctctcagatcttcaactacaggaagcacaattggtcaaggtcccagttactgtggactgaaatctgtttatgtttgtatgaaggacatagttcctaagggctgcttaaggagtcaagtattgaaatgattattaggccaactaaatgatctctatagtctatttcattcattgcataatgtgaatttgagaaaagaatttttatgaataagattaacacatttttctcaatttctaatgaaaaacaaattgtagaaaatgatttaaacaaagatatgcaattgtaaatagatatgaagaaactacctaatcacttgaatggttaaaaaatcaaagtttataattggaatatttctgtgtaatagggatattacccggacttaattcatttccctcccacccccaccaaaaaatgaagctagttggagataattttgagaaagagaggtggaggatgtttcaacaataaagaatgaagaaatgccattagctttttaagaactctttgtttagctctttgttcaaggaaagatagtagagcaagaaggaagaatgatcacatggggcatgcaaattctaagacactaatatcattgttatatctttgtcaaaaatagaaactgaaggaaccaaataaaagagaaacaatgcatgtggaagatttgttacaatttgagatttttggtcgtgtgtatgcttctaaaatatacaaacgtttgtttacagttgtagaaaatgtcacaggatccttgggatgttgcttttccagtaggaagcctctgtggctggtggcacctttacatgaatttttttcaggcctactgggcttgtttcacccactcagcctggcaggcttcacttggcttcttctaccggcccagatcccatgcctgccaagggtgagccaggtgcagagcagcaaggtggggatgagagtgagtgtggggtccaccactgtgcacagccaggcacgctggctgctgtggtgggaagggtggccccaggtgccagcacagatgccagctccatacaagccagtggctggatctggtgcactgcaagcagattccactgaaggcacccatgtctggatgaggagaacgtggtggcacccagtagattggagacaacagaaaccagagtcccaaagacggtgtcatagccctggctcagggagctcctaggtctgggatccctgaagggccacttcgcttctcttctctccttctcattgcccacaatgtggcaagcggggaggcatgtttcagccctgctggtattactgctctttcagtcctgccattcagcaggtcccaagttcttgtcccacatctaggaagaattaggtatatagccatctgaagggtgagcaaggcaaagaggtgcttcattgagcaacagtacatctctcaggagacctgaaataggcagctcctatatgcaggcaggctgtcccgatgtctgcagccctcagtggcgaggagacccagagtgggtagctcctatcctcaagcaggttgtcctgatgtctgcctgagtctggttgagactggggtttttatgggcttcagaagggagaaagtgatattgctgattggtccatgggcagccatgggcagccataggcagcctggagaaagcaccataagttctcactccagtccagggaactggcaggctgggcaccagccttcaggcaatccttggctagaaggtggggtttcaccagacccatccctttccacccaggagcctgtctgccttctgctgccattcatggcacccaggctgtttgtgcccaagaggttcctgcaggcccgctccaggccacccccagccccaccttggcttctctcccatgctcattggtgcccaaagtccagagtgggctgaggtggcaaggggctggtatgtcagcaccacatgagtgtgggaacacacagccaggtggtgacaatgctcggggcttgatgacagctttgctctgaaattggagcaggccctggaagcagggagaggccaggcattgggagaacacactttgagcatgcagcaggaggggggcccaggtccacagtctcagctgggtgattgcacctgcacctgagagctctgggctccagcccctccaactcagaagtgggtggggcccctgcctgttctcagctctcactgactctgcagagtgcatagccccagctgtgtttccctggttgcagccagcgtctttgcagcaaatgctccagacaggtcgctgttgtcatcaaaaggaatagtatacagtatgaagagatatatatttcaaaagttttaagaagaactcattgttttctggatagaacaattgatcattaatgacaaatgaagcacacaatgtcttgatcctccatttcacctaagtgactccataaaagattgatgtgaaaaggtcaagaaattaacaaaatgagtctgtttcaattactataacagccctacaaagcaaagagaatcaagtgtatagtaattcttatctactataactctggccattataaaagtaaacatatgaggcaattttcttgccattatgtgattactcctacccttaatgattattgaaagccagccaccaggaaataacatcagttcacaggatttgaaaaaaaaaatcaaatcttttcccaatacatataaaatatcttaatattataaattataaaccagaaaaacatcattttccttgagaaatgtgtttttaaataatgacaacctaatttattttattgagtatagggttgtctttgtaaaattcttcaataattttcaaacttcattaagggagcattagcagaaagtaaagaagtaatttttttgttctgttttgttttgttttgttttgttctgagacgaagtcttgctctgtcacccaggctggagtgcagtggcgcaatctcagctcactgcaagctcagcctcttgggttcatgccattcttctgcctcagcctcatgagtagctgggactatgggcacccgccaccatgcctggctaatttttttgtatttttagtagagacagggtttcaccgtgttagccaggatggtctcaatctcctgacctcgtgatccgcccatctaggcctcccaaagtgctgggattacaggtgtgagcaactgcgcccggctgtaaagaagtttttaaatatgcaaatgaaacagaggcagagcatgattaactatgtggaagaaggggctggttttttattatgttgttacttttacataagtcagaaagcctactaattatctgtcatcaaaacttcacaggcaaaccagtaggtttttcctttagtaaatattaaagtacttactgtggtgtttattacttgtgtctattattttgctattttacaattttggaagaagacaatgataggtctattgttatattccagcaactaatcaattaccaatagaacaacatagaagtgctttcaattctaaaaaaagaacaatggattttgtttctctgtctagctagaactggtatactgaaaaacgtatgccaaatagtaaatgcgaactctgaaccatttttgatcaaggtcttcacaatgctagttttcagctcataactcaaatttacactttgccattatgctttcatttttattttctttatattttacttctgtgaccaagacactgcaacttctcagaaaactggagaaagtaattcattgtataaaatattcaacctttagcttgaagtccagaaaggtttggcttggaatatgtaatgttaatactcattaaactgaaatcactaaaaatacagatttttaaaacaaccagaaatgttaatctgagatttgctttgaattaagaaaataaatattcattctcttgatattttaagaacaatttacttcactaacgcatatttaaatgtaaaaatgtttctattctatcattagctcatgtaccccatggtgcattctaactaatcagtcattttaaaatcactgtggcaattaaaatctatgaatctgtaaattgtttacaatcacatgtttaatgtgctaggtcttcacctacaccatttcccctttttcctcaacaactgaggttgaactaggacacagttgcctagcaaggaacagcattcctctcccctagttagagctaaatgtagacccgtacctggattctcacaacgtaatgtgagctgaactgaaatgtgcaattctcacctcacttggttaaggaaatctctagatgtggacttctgtctggtttcccctttctgctgactaaaatggtaataatgagttattttgaaatagagtgttgaagatggtgacccctgagttgtcccaggtccctgaactttaaaccattgatatttggtggtttcctattacagtgacctaaactaccctaactcagtctgattaccctgagatttaatgatttaatgactgtctaatagaaataagtcaacggagtcagtgacagaacggggacgtatgggtcaataattcagttaaacattctacgataaataaatactttatctttaaaatctctcttttatacctaatcatttgttaaatgctaatttttcctatggaattcaaacacaagtattggaacgaagacattcctgagatgtaaaagccatgtgtacctcagcttacagtgctagattactgctttccatttgtaacacattaccttcccctacaccctacaaagaacataaatcttgagctatcatttttatatttcccccaaatttgatcacaagaagtagaagttttttcactaggagcaatcccaacacgaaagaccatcctaataatcaaaaattaataatgtcatttagcatctctgggaataatgtgcatccagttgaggcagtaaaatgaatttgaaaaaattagagaagaatgaggcatatgaggttggcagaaaccattctgtgcttcactttttttcattaagaaaggaaagtgtgttggcctctaaagcagcctgaaatggcataggcatattgccaaagctagcaattgaacatattaaaagaaaataccatacagaaataaaaatattctaccatgaatattttcatatttccatatattcatattttgcaatatgaatgagaatgacttttaaatatgattaattaattatgcgattagttgttggaaactaataaaatgttgaacaacttatattagttgaaacaacagtagctaataggactaagcctgctcaggaaatgatgcagaccacttagttccatatttttttggccagaaatcagtcaaacggcagaattcagaattcatccctagttaataaggagaggaaatgtaatccagctatatgcccgtgagaaaaaggatttaggaggcatccagatactgctatgtatttcctcaatggtcttcaaaaagaatgaagagataattgaagatgataatcattagccttaagtttctttatagttcagttaaaattttggttcaaatttagacctatataaacatttatattcaattatttgcatttatccaaaaagtagtgtccttgttcatatttggcataacatttatttttcaaattttctggttatttgataaaaaattaatccttttaagtactcaagtactactaaatgcattatgatcaagatactgattcttagcatctctgggagttatgtgtgtacagttgtgtatattattaatacacagtaggatgcaacaagattaccaaattctctttataactcagaataacaaatgaactgggataatcaagggcaattttgtaattgttagaattctggaagatcaaaattctcccacatgtacccatgtgactgttgttaattttagtaccatataattggctaacttttgctctctaagttaacaacaactttattaagagaatctatttgtagttaatagttctatgcagagacggtatgaaatggtaaattatacgttgaacaacacattcgcatttttaaaacatggcattaagcaaagatacttaataaagaaagttaaatgagcaatgccctgtttcaatttatgaccttggcctcaatgccacaatattttagctaaaagagaagtctagaggcatatttctattgacaaggaaatgagctctaaatgaaaacctagagaaacagtacaccacttaagtttatttaaagaggaagtttaagcaatatatcactttcttctcttggagtttccaaagataattagacttgccgcaaggggctttgaagaacacagatgggaattttaagttaaaactgtgagcgtttttttggatccacttagaagactaagtatattttttgagaacacctgatctagataatttagtgagaaacaaagtgagtttatatccgtcctgttcttgagaactccaaaattaacatgttcagagaagttcttccaaaacagaaaactgtgcataggagtccccctttatttatgggggatatactccaagacctccactagaagcctggaacttcagatgacaccaaagcctatatttactatgtttttttttttttcctgataacccagacagttactaagtgactgatgggcagcctggatacaatggacaaaggaatgattcagctccagggcagagtgacacaggacagcacaagatttcatcatgatactcagaatgccatacaatttaaaacttacgaattgtttatttctggaattttccacttaatattttctgaccacggttgacctcgggcaacaaactgtgaaaaatgatactgtggataaggaggggactactgtattccatagcaaagaattggaatccaatccaaaggattggaagcacaggttactgtgtcagaaaaaaaaggaaaataatagataataatgtacatgtgggtgagaataaccttttaaaacagattaaacaagaattcttatttgttttacatatggtttacatctcgatgatttacatacatgctatggaagattttctggtaattatattacataatttaattttgtgtagattcttctaaacgcagctttgtatgagaggatgaaactgcttggttcagtgggttaagtgcttgcagatgtatccctcacctaccttattcctcagtaccttagctgctgttctagcttaaaattattaattcattctaagaaagtaaaaaacactaaagtcatcctagaacatgatcaagttctccattacctgaaatattcatttttcattatcctcaattattatcatcatccaactttcaatttttctttggatagactaaactactaaaatattctggaatttaatgtagactcccacaccccttatttatatttctgcataggctgaatatttggtgtggaatatccatctatatctttttggattgactaaactctacatttccttcaatctacaacttaaaactgtgttaatcatgttcaaatatagttaagtgtcccttagcctgcttcctcaatactgtgatcttatttctaccattgtgttctcacagtgtattatatttttcatatagttatttgtttccagagataccagagagcttgctttctctctctctctccagataaggacatggcaaaaaggcagctgcctattaagaccagaagagaccctgaacctgaccatgcagacaccctggtcttaaacttggattgtcagctaccagaacaataagaaaataactttctgttgtggccgggcacagtgcctcacgcctgtaatcccagcactttgggaggctgaggcaggtggatcaggaggtcagagatcgagaccatcctggctaatgcagtgaaaccccacctctactgaaaatacaaaaaattagccaggcatggtggtgggcacctgtagtcccagctactcgggaggctgaggcaggagaatggtgcaaacccaggaggtggagcttgtagtgacccgagattacgtcactgcactccagcctgggcaacagagcaagactccatctcaaaaaaaaaaaaaaaaaaaaaaaaaagaacagaattttctgtcgtttaagccacccaatttatggtattttgttatggctgcctcagttgactaaaacagtatatatactaaccataaactataatatataatattggtgtatatgcatatagtgtatatatataaatgtatatgtattatatatgtgtatatatagtgtgtatatatatatacacacagtatatatataaatttatgtatacacacagtatatataaatacacacactacatttatatatatatatacacactatatatatacacatgcactacatatttacacacacaaacgtacacacatacacacatacacactgattagatggaaaatatgattgcagattgcatgccaaaattggaaattgaatgaaatgttccacctggcaataatgagaaactaaagatctatttctcaccattcagatcattaattagaattgaaaccccaaaatataatgttgtattttaataagtttgcactaattttttaaaaagtatccattattcattaaaccattactaaaacatattttatactaaattgtcatattaaccatttaaaaatttaaactatattttatgttaatttagaaacgcctaaaccaaaattggaagtctactcataaattcatattacatcaattttgagagactcctttcaaaaatgccctaaacatttcgtgtatttcaaaatcggacagaaatcaatacctatattcctcctgtgtgaagcgtgggatctcaccaggatgtaagacaagaatcttcactgtggcactgctggacatcacaggctccccatcatcaaaagcaaccaccaccaacttaaaaagcaataaaaattcatgttaaagattataagtaagaacagcgtaacagcacaatttttatatgtatgtttttacttattggattgcctggttccagaaggggaagcaatgatcatttcctcactgcctaccaggtggcagacactatgctagaaaatactacgttctcacttaatctttacaataatccagccagataaatgttattattttcacttgctagatgagaatactcaaagaagtaactaactctatgattaaaaaacaactaccagtaaaacaagtgtattatactatatctctccaattaaagactcatttctataattccactgaagcccacagtaaatacacatgattttatagcaccaatacacttatttaagaagtgttaaattcagacacataaaaagctaattatcttgctcaaaaaagaaattaattttcctagtgaattagttgtttttgagattatagggcagaaatactttactctagaggataaaattggaaatctttatagtttaacactctttggtatactatctcttaaaaacaaattataaggccaagttcatttggtatagcagaaattgttcaaatgatgaaaactaagaaaaagctttagtgttgagatgtgatgtctgacattatttatcactgcaataggatttataattgattattttctttaataacctacattacatcaaagtaattctatgtttactttaagacatgttaaatactttcagaactatgtgcttctttggaatataaattgttttggaagctgcaggttaacaatgtaaactaattcaacctagatcacagaagactgtaaccaaggatcatcctgagagccacaattgacctttgggttaatgctaatttacaaactgatcagctgttccaaacagcggtaaaatcatgagagacatagtgctcactgatccttacgtggttaactgataaagctatttccctactgtagagtcaaagactttattcacagtgacaaaaattattctaagtaactattaaaaatggaaatgttcaaacacttaataaaattgtctacttatggtaatgcaaattattgttttaataccttgccaggtagagacaggcattattttgtcaaatatatttttaaatatgtaaaaaacaaaagagggaatatgttctgtttcattagtatttgaagaaaagtaaaatttgacaaaaaatcaaatagatacagatattttcctagatatatgcaaagattaacataacaacaatcagtattgagtggtattaggaaaatggatactctcaggaaagatgaagaatgcatacaaggggtatttttttcaaattttctaggattgtaatatatcaatcttatcttaaaaaagtgagtaagggaaaaatgatattcatacaagtagttgcatgatagcatttattgtaacaaaaaatggaaagtctaattataaagcaactcagtattatattaaaaagaaaaacaaaatgttatatagtaaaatactatgaaaccactaaaataatagtattaatgtcacttattggcatagacaacatcatattgaatttaaaaaccagtatgtataagactatgtgatttgaaaacatatatttatatatttgtgtttgtatgaaatgtcatcatgaggatagagatcaaaacgcaaattctagctatttccaagatgtgagataccaagtggttttctttttactatttttgtaagtttctaagagaaaaaaaaattgtaatttaaaaaaattaaaaaggagaaaaattgaaagaaaaaaatgtgctgtcatctgttaagccaaattctctatcaaaaattaaacatcaaatagaccacataatgaaaagagacactgaccttaaaaattgttgtaggttcttcattaagattgactcgtgttattactcttccagaatcttcttccacttcaaaaatactggcagggtaaggaaactgtacatcatctactctatacctcacacgacttgcaggtaatccctaaaataaaattattaattattaatttgctgttaccaagttaaaacacagtgcaatgataatattaaatggatctttaaaattcatggtcttttagaagtgaaaatcatatttccatattttcattctttcagagctgaaatgtagccagatcattatttcttcatgataactcaatctgaatcaatgaagtatctctactacaggttattttaaaatgatttatatgagagaaaaattaatggttgctttgggcatcttctctaccactttcctttaattatgtgaattacatcttcctcccaaaacacccaatatctccttttttaaattcagagacagggtcttcctttgttgcccaggctggagtgcagtggcatcaccatagttccccataacctcaaaacttctggtttcaagtgttcctatcccactttagcctcccaagtagctgggaatacaggtgtgtgcaaccatgcttggctaatttgagaggactgtagtaaagtgcaggaatggacatgaaagctaaaaaaacaaaaattatttaccatctacactgtgttgattaccatgctaggtatttctatacatcattaggttaatgctcaatcttttaagatgacattaataatgaagatgatagtaataatggtaagttaatgacgctaacaattgctagatgcttaccacttgccggaaccacattaaagatgatgtatgtgtactctgttacccattttagagctaaggaacttgtggcttacaataagttaaagagtgctgaaatattccagagataggccaagataagttgggacaccaaacaaagtcacttttaaagaaaacaattaaaatttgataagtttttaaaagaatcaaagtgattgtaaaggaacagtcaaaattttgctggctgtcctcacttatattaggtttcagattggtttcctttggaactatgtagggtgacattgaggtgagcactgtaacatttacagtgcttaggccttgtaaatttcttaaaacctagaagtcaaataaatatcttgagcagagaactagtatgtggtaaagttttacttcaaacctaaacactaaattacaacattaacttcttcagagaaagaaacactcctatttggcattattctgatgaagaagaagtaagaacattaccccccacagggtgttgatttggctggacttgacactttggtgtaaaaactgttctgagaacattgctttttatatttccattttcttcaagactgtccttgaaaataatctgttgctcatgttggttcctgaattacagttgggctatgagataaatatgagttttcaggatttgtataattccctattttctgttagttcagtcctttcatatactacacgtcaccactgatgactgtctccttgaatacattctttatttaacctttttccactattctgccttttctccttcccatctggtgctctgtctcagactctgcttgttcccactctttctggctactaaatgttggagttttccaaggctctgtttcaagaacttctacattttctacttctactctcggcccctggaacctctcccagtctgatagcttcaaatatcttctatttgttcataaatatcaaattttaatatctggctaaactctgaacattttaagtccaaactagtacacataattgtccacagatatgctattttcaaataaatgtattcaaaaccagaatgatttcatctcccaaatttataactcttctactatagataatggctctaccttttactaaggtgttctatctgaaagcctaggggtaatcattgatcctttctcttaagccccatagccaaatcatcatcacatcctgccaatacctcaatgagtataggccctaatgtcttctcatatcctctgtgttttctgtagtagactcttaattgactttctgcttccattgtattaaaattatctcatgactcctgcttaaacccttccaatgattttgcatcacacacaaaaaaaataaatacaaagttgttagtaagggcaatctgatcctaaaaacatttcttttttgcctactcatctgatttcatcttgttcatttccctttcacacattttccttgttcctgcctccttggctttgccaaggcaatagtcctttaccaggaaaataaggtggcaatataatacactcatctctcagatttttggctaataaatttaccttcctcttctccaggcgttctctaatactccctttaaattatctttcttcagcaaccctgtctgaaattatagcatatattttatgtatttacttgtttactgtttgtctcccacataagaatacaagctttattagggtagggactgtagctgagtaccttgaatgttacctgacccataatatgtactcaaggagtatttgaataaataattttttatttataaaaaaatttatttataaattttatttattcataaaatttttataaattttatttattcataaaatttttataaaattttatttattcataaaatttttataaatttatttaaaaattatttataaaaattttatttataaattttatttataaaaaatttatttgcataaataagtgaatggataaccacacatcaagggtgcccagacacttcaactgatatctaaagtattcatatatttgaaggtttgggaaatagagaacattgaataaaccttgaaagcatgttagggaactgccagttctgggataatatttttatataaaccactgatttcacctagtggtggatggtcagttcacccactgaagatttatagaaacaaggacacatttttttagaaaaactttggcctatatggacagaatcagacttattataatcatatacaatggcaaaccttgtatatgatttgcttgtgaaagagtgggggtttagcagaagacatcgtaggacttggggcacagtgtcatgcaatgtcagcaactttgcttgcatttgaataataatgataataacaagagttgttagctatcagtttgagtattttactatgtatcagactgcatgtattacatgcattttcatacctacaataagttcagaagttggtattaatagtacctacatttttttttttttttgagacagagtcttgtactcttacccgggctggagtgcagttgcacgatctccgctcactgcaacctccgcctctcaggttcaagtgattctcctgcctcagcctctcaggcagctgggactacacgagcccgccaccatgcccggctaatttttttctatttttagtagagatagggtttcactatgttggccagccaggtcttaaactcctgacctcatgatccgctcgcctttgccttccaaagggctgagattacaggcgtaagccaccgcgcccagccctactacctatatttttaaaataataaaatctaggctttaagaattatcttctgaaattttcttagctggaaaatgccaaagttattaattgaacaaacttggctcacactaaaaccgaagtcttttaataacaaatcaacttaacatttttcagtactatcttaaaggcaatagtcctttaccaggaaaataaggtggcaatacaattgagcaaaagtgcttggcaaagatactatagaatttgataccctagtaaatctcgccttagaacactttctaagaggttatgcagcacataattcaagtcacctccagaacaggaggtcaatgatgaaagaggataattatagcaccaactgcttcaagaacaaatttttagagtttttgctagcatgaggacccattcagtctgtaggacggtgactaaaattacttatgacaatcagattggctctcaaaaacataaaataagttaattatacttagaatcttctttttaataaagccaaaatttttttttgcatatggaattatgcctgtaattgataaaatgaaaaagaaaacatgctggtattatggaatgttatctctcagatgcctaaaatagtttgctatccagaacatcttagaacttcctggatgatttttacagataagattgtatgtatataaatatgaacatatgactaaaatagtttgctatccagaaaatcttagaacttcctagatgatttttacagataagattgtatgtatacaaatatgaacatacatgttacatagtgactacatcaataaactttttattctaagattgcaattattctatagatataccacaccatcatgaaagtgtggccctgagaggactcatttagcctgcaagaaacattttgattcttttatcacccttgttatcaaagcacattttattttatatcacatattatgataactatactaaataactaaaatgatgtagactttcctctcaaaacatttaaaagtttttttctctctctgtcctttcctaaaatcttccttcccttcttcccttctttttgctttcccttcctccctcctttcctttctttacttctttccaaagtctttttaaaatagttgcataaataagctatataataggtaaaggtaataggctttgggaaacagctctaattcctaatattatttctgggaaatttacaaaatgaatcaagtcaaattcattgttttaagaaattataaaaatagctgtggctttaatcttggaaaaaattgtcattttgaaacccagaatttcaagtactctaaaaaagttataaacttgatcacttaaaattatgaattagcatttattaagtatcttttaatactttattccactaaaatataatagatatgatcgaagtattctaatgtataaaactcacccttattagttatgttttaaaaactaaaataatatagtaaatgagtttatgaattatatattttaattattatatatgtgacaattaaatatttaaataatcattcatatatatatgtatatatattttaaagacaggatcttgtgttgtcacccaggctgatgtgcagtggcatgattatagctcactgcagctcacacaatctttctgcctcagcctcccaagaggcttgatatggtttggctttgtctccacccaaatttcatcttgaattgcagttctcataatccccacatgctgttggagggacctggtgggaggtaacttaaacatgggggcagttaccctcatgctgttcttgggacaatgagtggcttctcacgaaatctgatggttttataaagggcttttcccccttttgcttggcactcctccttgctgctgccatgtgaagaaggatgtgtttgcttccgcttccaccatgactgtaagtttcctgaagtctccccatccctctggaactgtgagtcaactaaaactctttcctttattaactacccagtcttggacagttctttatagccatgtgagaatggattaatacatagctggaactacaggtgcatgccatcatgctgaactaattatttttaattatttgtagagataaggatttctttatgttgcccaggttggtccagaactcctggcctcaagtgttcctttcagtttggcctcccaaagtattaggattacaggtgtaaaccactgcacctggcctagacaaacattaaatttccaaatatttgcttttattttaaattgtattaggaatagacagaagtctcttttatatatacccaataagttaatgtttctttcaattaaatacttcaaataatcatattttttaaagtaaactatagaaaacatttaaaatcaatatgaaaattttaaatattaatttctacttcattcatgataatatagtatgtatattctaccgtatctctctatgcatagctgtatatatgtcaagaggaattttttggaccatgaataatgataaaagctatctatttacaagtaaatcaatatttggaggaggttccaagatggccaaataggaacagctccagtctacagctcccagcgtgagtgatgcagaagacaggtgatttctgcatttccaactgaggtaccgggttcatctcactggggcttgttggacagtgggtgcagcccatggagcagggtggggcattgcctcacctgggaagcacaaggggttgtggaatttcctttcctagacaagggaagccatgacagatggtacctggaaaattggtacactcccactctaatactgcgcttttccaacagtcttagcaaacggcccaccaggagattatatcccacgcctggctcagagggtcccacacccatgaagcctcactcactgctagcatagcagtctgagatcgaactgcaaggcagcagtgaggctaggggaggggcatccaccattgctgaggcttgagtaggtaaacaaagtggacaggaagctcgaaccgggtggagcccaccacagctcaaggaggcctgcctgcctctgtagactccacctctgggggcagggcagagctgaacaaaaggcagcagaaacttctgcagacttcaatatccctgtctgacagctttgaagagagtagtgcttcccccagcacagagtttgagatctaagaacggacagactgcctcctcaagtgggtccctgacccccaagtagcctaactgggagacacatcccagtagaggccgactgacacctcatatagccggacgccactctgagacgaagcttccagaggaaggatcaggcagcaacatttgccattctgcaatgtttgctgttctgcagcctccgctagtgatacccaggcaaacacggtctggagtggacctccagcaactccaacagtccagcagctgacggtcctgactgttagaacgaaaactaacaaacagaaaggatatccacaccaaaaccccatctgtacatcaccatcatcaaagaccaaaggtagataaaaccacaaagatggggagaaaccagagcagaaaagttgaaattctaaaaatcagagcacctcttctcctccaaaggaacacagctcctcactagcaatggaacaaagctggatggagaatgactttgaggagttgagagaagaaggcttcagaccatcagtaataacaaacttctccgagctaaaggaggatgtttgaacccaccacaaagaagctaaaaaccttgaaaaaagattagacaaatggctaactagaataaacagtgtagagaagaccttaaatgacctgatggagctgaaaaccatggcacgagaactatctgaggcatgcacaagcttcagtagccgatttgatcaagtggaagaaagggtatcagtgattgaagatcaaatgaatgaaatgaagtaagaagagaagtttagagaaaaaagaataaaaagaaatgaacaaagcctccaagaaatatggaactatgtgaaaagaccaaatctacatctgattagtgtacctgaaagtgacagtgagaatggaaccaagttggaaaacactctgcaggatattatccaggagaacttccccaacctaacaaggcaggccaacattcaaattcaggaaatacagagaacgccacaaagatactcctcaagaagagcaactccaaggcacatgattgtcagattcaccaaagttgaaatgaaggaaaaaatattaagggcagccagagagaaaggtctggttacccacaaagggaagcccatcagactaaaagtggatctctaagcaaaaaatgtacaagtcagaagagagcaggggacaatattcaacattcttaaagaaaagaattttcaacccagaatttcatatccagccaaactaagcttcataagtgaaggagaaataaaatcctttacagacaaacaaatgctgagatattttgtcaccaccaggcatgccttacaagagctcctaaaaggaagcactaaacatggaaaggaacaaccagtaccagccactgcaaaaacatgccaaattgtaaagaccattgatgctaggaagaaactgcatcaactaacgagcaaaataaccagctaagatcataatgacaggatcaaattcacacgtaacaatattaaccttaaatgtaaatgggctgaatgctccaattaaaagacacagactggcaaactggataaagagtcaagacccatcagtgtgctgtattcaagagacctatcttatgtgcagcgatacacataggctcaaaataaagggatgaagatctaccaagcaaatggaaagcaaaaaaaaaatagcaggggttgcaatcctagtctctgataaaacagactttaaaccaacaaagatcagaagagacaaagaaggccattacataatggtaaagggatcaattcaacaagaagagctaactatcctaaatatatatgcacccaatacaggagcacccagattcataaagcaagtccttggagacctacaaagagacttagacttccacacaataataatgggggactttaacaccttcaggtcttcagagcagaactgaaggagacagagaaacaaaaaactcttccaaaaaatcaatgaatccaggagctgtttttttttaaaaaatcaactaaattgatagactgctagcaaggctaataaagaagaaaagagagaagaatcaaatagacacaataaaaaatgataaaggggatattaccactgagcccacagaaatacaaactaccatcagagaatactataaacacctctatgcaaataagctagaaagtctagaagaaatggatgaattcctggacacatacaccctcccaagaataaactaggaagaagttgaatccctgaatagaccaataacaggctctgaaattgaggcaataattaatagcctaccaaccaaaaaaagtccaggaccagatggattcacagccaaattctaccagaggtacaaagtggatctggtactattccttctgaagctattccagtcaatagaaaaagaaggaatcctccctaactcattttatgaagtcagcatcatcctgatactaaagctggcagagacacaacaaaaaaagagaatttaaaccaatatccctgatgaacatcaatgtgaaaatcctaaacaaaatactggaaaaccaaatccagcagcacatcaagaagcttatccaccacaatcaagtgggcctcatccctgggatgcaaggctggttcaacatacgcaaatcaataaacgtaatgcagcatataaacagaaccaaagacaaaaaccacatgattatctcaatagatgcagaaaaggcatttgacaaaattcaacagcccttcctgctaaaaactctcaataaactaggtattgatgtaacctatcttaaaataataagagttatttgtgacaaacccacagccaatatcatactgaatgggcaaaaactggaagcattccctttgaaaactggtacaagacagggatgccctatctcaccactcttattcaacatagtgttggaatttctggctagggcaatcaggcaggagaaagaaataaatgatattcaattaggaaaagaagaagtcaaattgtcccttttttcagatgacatgattgtatatttagacaaccccatcatctcagcccaaaacctccttaagctgataagcaacttcagcaaagtctcaggatacaaaataaatgtgcaaaaatcacaagcattcctatacaccgataacagacaaacagagagctaaatcatgagtgaattcccattcacaattgcttcaaagagaataaaatacctgggaaccctacttacaagggatgtgaaggacctcttcaaggagaactacaaaccacggctcaaggaaataaaagaggacacaaacaaatggaagaacattccatgctcatggatacgaagaatcaataccatgaaaatggtcatactgcccaaggtaatttatagattcaatgccatccccatcaagctaccaatgactttcttcacagaattggaaaaaactactttaaatttcatatggaaccaaaaaagagcccacagccaagacaatcctaagccaaaagaacaaagctggaggtatcacgctacctgacttcaaactatactacaagtctacagtaaccaaaaacagcatgatactggtaccaaaacagagatataggccaatggaacagaacagagccctcagaaataataccacacatttacaaccatctgatctttgacgaatgtgaccaaaacaagaaaaagggaaagcattccctatttaataaatggtgctgggaaaactggctagccatatgtagaaagctgaaactggatcccttccttacaccttatacaaaaattaattcaagatggattaaagacttagatgttagacctaaaaccataaaaactctagaaaaaaacctaggtaataccattcaggacataggcatgtgcaaaggcttcatgactaaaacaccaaaagcaatggcaacaaaagccaaaattgacaaattggatctaattaaactaaagagcttctgcacagcaaaagaaactaccaccagaatgaacaggcaacctacagaatgggagaaaatttttacagtctacccatctgacaaaagggctaatatccagaatctacaaagaacttaaacagatttacaagaaaaaatcaaacaaccccatcaaaaagtgggcaaagcatatgaacagacacttttcaaaagaagacatttatgcagccaacagacacatgaaaaaaatgctcatcatcactggccatcagagaaatgcaaatcaaaaccacaatgagataccatctcacaccagttagaatggtgatcattaaaaagtcaggaaacaacaggttctggagaggatgtggagaaacaggaacacttttacactgttggtgggacagtaaactagttcaaccattgtggaagacagtgtggcgattcctcaaggatctagaactagaaataccatttgacccagccatcgcattactgggcatatatgcaaaggattataaatcatgctgctataaagacacatgcacacctatgtttattgtggtactattcacaatagcaaagactttgaacaaacccaaatgtccatcaatgatagaccggattaagaaaatgtggcacatatacaccatggaatactctgcagccataaaaaaggatgagctcatgtcctttgtagggacatggatgaagctggaaaccatcattctgagcaaagtattgcaaggacagataaccaaacaccacatgttttcactcataggtgggaactcaacaatgagaacacttggacacagggcgaggaacatcacacaccagggcctgtcatggggtggggggaggggggagggatagcattaggagatatacctaatgtaaatctcgagttaatgggtgcagcacaccaacgtggcacatgtatacatatgtaacaaacctgcacgttgtgcacatgtaccctagaacttaaagtatattaaaaaaataaattaaaaaaacaaatcaatatttaaaattgcgttactacggcgatatatttcttttctatatcattttgaaattgtgataaaattgctttaatatgaacactaaaagcagtatacagaattactttcttaaagttcttactgaccagtaaattacttttttggttccgtactctcatcaaccaaatatagtgttctctatttaggtttagaaaaatcttgaggtcattagttatttccctgtattcacacagtattaccactagaccacagcatttaaatagatttttaaaagatttttagaaaaaaaaatcatagccattgctccttcactgctgaagacagaatgagatttggtttcaacaaatacttagatatgaggaagagcctttctaattggtaaagtaacatagtctccttcagaaggatacatgtattttagaaataaaatattcaaaataggagcatgctattacaggaaggttactaaatcaaagtgagctgaaaacgttgccaacatagaataataactgaatttaatgacaattttatatttgtttatttgtttattttaccttatttttcttgagacagagtttcactctgtcgtccgggctggaaggcagtggcgtgatcttggctcactgcaacctccgcctcccaggctcaaatgattctcgttccttagcctaccaagtagctgcgattacagggacgctccatgcctggataatttttgcatttttagaagagacagggtttcaccatgttgcctaggctgctctcaaactcctgagctcaagtgatccacccaccttggcttcccagagtgttgggattacaggcatcaaccaccacatccagccagaaattaaacacaatttaaaacaaatctctaggggctttttgttttccattagataaaatatacttaactttaaagattagtatcatacaactaagtaataatatacttatttatataagatatatttgtaagagaaatttaaaaattgtctaaaatattagaaattaaaaattttataaactactaacctgtcatcatgctcatatgttttatttctatttatttgtgaaatacagcattttttcagtccttgtttatatgaaaactgtctaaaggtttgatagttaatcactctatctttcctggaacactctttatatgggttatagaatatcatattccacactactggctgccttagtgatcactcttcattcttctatttagctgattcgtttacctattcacaactttcaagtgatggcgaccacaggcgcctctgccctttttcttattttttttttaaatttcaacttttattttaggttttggggtacatgtgcaagtctgttacacgatgtttcataatgctgaggtttggggtacaattgatccagtcatcgaggtagtgagcatagtactcaatatgtagtttttcagctcttgctcccctccttcccccacctcctctaatagtctccagtatctattgttcccatctttttgtccaggtgtacccaatgtttagctcccacttataagtgaaaacatgcagtatttggttttctgttcctgcattaattcacttggtataattgtttccagctgcatcaatattgctgcaaagggcgtgctttcattcttttttatgtttgcatagtattccatggtgcatatgtaccacattttctttatccaatacaccactgatggacactcagattgattccatgtcttagctattgtgaaaagtgcagtgatgaacatataagtgcatgtgactttttggtagagcaatttatttttctttggttatatacccagtaatggaattgctaggtcaaatgatgattccattttaggttaattgagaaatctccaaactgctttccacagtggctgaattaatttacattcccaccaacaatgaataagtgttttttttccccccataacctcaccagcatctgttttttgactttttaataatcaatactctgactggtgtgcggtggtattttactgtggttttgatttgtgtttctctgattattagtgatgaacattttttcttatgtttgttagttgcttgtatgttttcttttgagaagtgtctgttcacgtcctctgatttttaatagggtgtttgttttttgcttgtcgaattaggttctttatagatgctggatattagacttttgtcagatgcatagttcataaacactttctcttattctataggttgtctgtttactttgttgatagtctcttcgctggggcaaagctctttagtttaattagttcccactcatcaatttttgtttttgttgtaattgcttttggtgactgagtcaaaacttacgtgccaagagcaatgtctagaatgatatttcttagatttccttctaggatttttatagttttatgtcttaaatataagtaatttattcatatcaaaaaaatttttgtatgtggttgaaggaaaggcctagtttcattcttctgcatatggctagcgagtatactagcaccattcactgaataggcaatttttctctatagtttgtttttgtaagttttgtcacatgtcagatggttgcaggtgtgtgactttatttctgagaactctattctgttccactggtctatgtgtttgtttttgtaccagtaccgtgttgttttgattactgcagtcttgtattaataatatagtttgatgtagggtagtgtgatgcttccacctttattctttttgctttgctcatatgagttatagtaccatgcttaaccctaggtaatgtggggttcattcattcattcattcatttaacacgttcactaaatagaaattactgagttgtgagagtataaaaaatgaaaaagctcacaaggagatggagttgatctcacacccccttctcctgaatgttctttagaaataattcatccatattgaccttatcaaacaccaacctccttcctacctcaagcttttccatttgcttttgtctttgcctgtaagactcttgcatcattatcctcttttaacattctggtctcaaatgacacaaactcctctgcatatactcatccacaaactactctatcactattatttttatagcacatatgcttatgtgaaattatgttacatatttacttgtgtatggttttgcagcctgtctctgtccatcatctgtaagctccattcgagtagattttttttgtgatttgccattatttaagagggcaataataatttgttaaatgaatactacaactgatttaaactgtcccatagaagtgatatttacggtgtcttttaaataaacatagaaattaaccttctcagtcttaaaacttgagagagctacatttgttttatctgagttattttctaaggacaccaaccatcgggcctcccagagagtatcaaggaactgaaacttactagagcactgcatctgggcaacgagatacaagacccttcactgtcatgactggctaactgagtccctgtttactgttaaccaactcatcttctttatctgtccctaattcctgttttcctgcatgtagttacatttcttctctgcaatataaacccctgattttagtcagtctgggagatgtatttgacactaacctcccatctcctgggctgcagcacctgattaaagccaaccctggcaatgctttttgtctcagtgatcggctttctgtgcagtgagcaacaggacctagaccaaggatgtccgatcttttagcttccttgggccacattggaagaagaattatcttgtgccacacatataatacactaacactaatgatagctgaaagctttaaaaaaaatcacaaataaacctcataatgttttaagacagtttatgaatttgtgttgggctgcactgaaagctctccttggctgcatgtggcctatgggccatgagttcgacaagcttgatcctagaccaaacccctgacatttcagtaacacttacgtgtatgtgtatcatgagctgccaagatgtataacacatggggattatgagaaaaacagttcaagataagatttgggtggggacacagccaaaccacatcattccaccctggcccctttcaaatctcatgacctcacatttcaaaacacaatcatgccttcccaacagtccctcaaagtcttaactcatttcagcattaatccaaacgtccaagtacaaaatctcatctgagacacagcaagtaccttctgcttatgagcctgtgaaatcaaaagcattgttacttcctagatacaatgggggtataggcattggtaaatacacccattccaaataagagaaattagctaaaatgaaggggctacaggccccatgcatgtctaaaatccaggggggaagttaaatcttaaagctcccaaatgatcttctttcactccatatcatatccaggtctcactgatgctagaagtgtgctgccatggccttggacagcactacccttatggctttgcagtgtatagccccctcttggctgctttcatggctggcattgaatgcctgtagcttttccaggcacacacagcaaactgtcagtggatttaccattctggggactggaggacagtggctctcttctcacagctccactaggcagtgcaccagtggggactctgtgtgggggctcccaccacacatttctcttctgtacttccctagcagaggttctccatgagaattctgcccctgcagcacacctctgcctggacatccaggcatttccatacatcctctgaaatctaggcagaggttcctaaacttcaattactgtcttctctacacccgctggaccaacaccacatggaagctgcctaggattgagaattgcatcttctgaagcgatggcctgaactgtaccttggcccattttaaccatggctggagtggctaggatgcagggaaccaagtcctgaggctatacacagcaggggggtccctggacccagcccaggaaaccatttttccctcttaggcctctgagtgtgtgatgggaggggatgctgtgaatgtctctgacatgcccagcagacatttcccccattgtcatggtgagtaacatttggctcctcattacttacgcaaatttctgctgccaactggaattcctctccagaaaatgtttttttttttttttttctactgcatcatcaggctgcaaatttttcaagcttttatactctgcttccttttgaacactttgctacttagaaatttcttccaccaggtaccctaagtcatctctctcaagttcaatgttccacagatatctagagcaggggcaaaatgctgcgtctctatgcatagcaagtgtgacctttactccagttcccaacaagttcctcatctccatctgagaccaactcagcctggactttattgtccatatcactttcagcagtttgttcaaagccattcaacaaatctctatgaagttccaaactttcccacatcttcttgtcttcttctgagccctccaaactgttccaacctctgcctgttacccagttccacagtcacttccacattttcagatgcctttacagcagtgccactctacctggtatcaaattactgtattaatccgttctcacactgctatggggacataccagatacttggtaatttataaagtaaataagtttaattaactcatagttctgcagggctggggaggcctcaggaaacttacaatcatggcagaaacatacaagacatccttcttcacagggtgacagcaaagagaagtgcagagtgaagtaagggaaaaatcccttataaaaccatcagattttgtgagaactcactcactatcatgagaagggcatggaagtaacctccccatgattcaattgtctcccactgggtctctcccactacacgtgaagattatgggaactacggttcaagatgagatttgggtgaggacacagcaaaaccatatcaccctctaagaatttatttatctaagaatggggatacattgttggcaagttttcaatctataacctataaatatctgctaattttcgcattgacagcttctcatattcgtctctcaagatggtggacaaggatgagaaacataggtatgcttttgtactcatgggcctcacaattggacaggttggagagacaaaatgtacacataaaaacacaattatttcccaacatttctgattaaaactgtgaaaaggaaacatgtggtgctattaaacggaggtgctacaactagagaacagatcttaagatttatagtaaactagactttaaaactcactgcagacactcacaaatcacaaaatacacaaaatgtattttagttcatagagcgtatagtaattgtgttatatgtacagtctaatttagtatatcatttgagtattaaaatgataaactaggccaggtgcggcggctcacgcctgtaatcccagcacttcgggaggccgaggtgtgtggatcacctgaggtcaagagttcgtgaccagcctggccaacatggtgaaactccgtctctactacaaatacaaaaaaattagtctggcatcgtggcgggcacctgtaatccaagctacttgggaggctgaggtaggagaattgctagaactctggggcaggaggttgcagtgagctgagatcacaccactacactccagcctgggtgacagagtgagactccatctcaaaaaaaaaaaagaaaaaaacttaattttattaggattttgaacaaggggtaaaagtagacatatatcagtaggaagttacataaattaaagctgtcttttaaacaaaaagtcttcctaatttttggtaagaacgttattaaaatatgtatattttaaaaatgtgtgggattctaaaggccctgtcagcatattttcacgaaaactttcttctcgaatattacagtgccatggatgacatcagagttacttcaagagtttaggtattaatatcctaaagtttacagttgatgaggatgtaagcactgtaccaaactagatgcaaagttgtgtttttccatcactctggaagtgaggagaaagaggaggaaaaattaactaacatcaatgtgcttcacatgagctaagtgtgtcattctccatcaagcccaaacaataatccagcaaaatagttcttcttattcctatatgattacaaggtttaaagaggttaattaactgctgtacaatataatttttatgagttaaacaaaaacaacaacactagtgacatcagtcaataattttcatatactctagagtgcccaaacctaacggcactcaggaagaacatgatttatgacatctattataaaggaatcaattttttttggttcatgatttaggtatctttctaaatatgattgggggtagtatgtaacttatttaaatattatgtggtttccaaaatatgtaacaaatgatatcagctttgtgatgtccttttatctgctaaatttgaaatgtgtaaaattcaataattatgagtatggatatttactcatatctgtattaacatgaataacacatggcagacaaatcctgcattggtgatgctcacattagatttttaaaataaaaatgtgatataattctacagagtaataaggcgagaataattaatatagcagaatgaatgtaaatttacaccaagaaaatagaataataagatttcaattattttcttcattattcagcacattttctacttttgatttctattcttacagtgtgtgttaaacacaatatgtttcgacttagttatcatgagaatataattaattactacagaaggtaattgcatacctgtatgaaggatgtttcaaacttgaaaacttagggaatttcagtgaggcatcacgctacctgacttcaaactatactacaaggctacagtaaccaaaacagcatggtactggtaccaaaacagagatatagatcaatggaacagaaaagagccttcagaaataacgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaaggcaaaattgacaaatgggatctaattaaactcaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaaggtggcaaaggatatgaacagacacttttcaaaagaagatatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacacttttacactgttggtgggagtgtaaactagttcaaccactgtggaagtcagtgtggcgattcctcagggatctagaactagaaataccatttgacccagcaatctcattactgggtatatacccaaagaattataaatcattctgctataaagacacatgcacacgtatgtttattgcggcactattcacaatagcaaagacttggaaccaacccaaatgtccaacaatgatagactggattaagaaactgtggcacatatacagcatggaatactatgcagccataaaaaatgatgagttcatgtcctttgtagggacatggatgaagctggaaaccatcattttcagcaaactatcacaaggacaaaaaaccaaacaccgcatgttctcactcataggtgggaattgaacaatgagaacacatggacacaggaaggggaacatcacactctggggactgttgtggggtggggggaggggagagggatagcattaggagatatacctaatgctaaatgacgagttaatgggtgcagcacaccagcatggcacatgtatacatatgtaactaacctgcacattgtgcacatgtaccctaaaacttaaagtataataataataaaaaaatataaaaaaagaaaatataatggactaaaataattaggtccttagtatcaggggaaatcttgatttagtcatttttcttaaacacataattatcaagaaattacttactcaggctcacattgtttccttcataatttcttcatagttatagcaatcacattgtagcagggaataccaaacttattattatcattaaaaacaaatattaagtaatttgttttcaagaacacaaatattttaccccgacatggtttccaaaattctttttcccaaagtctttgaggcaactactctgactgattttgtaacagtgcaattcacaaaatctcccaagtatgatttaacatcaggaattactataaaggaattactataaagtggtttgggtgtgtgtgtgtttgtgtgtgtgtgtgtgtgtatacatatacacacacaaaatatatatatacgttttgcaggcatgtgacttagtcatattttagtgaatttaactggatgtcaaggtatccttaaaggacaaaagagaaagaaaaaaaaaaaaacagcaggcggaactcttcatgtaaccactgagaaagtcctgtgctttttttacttcttcctccctcttccctgtttttaacacctggaatgaccaatatgttttgacaacatgttggcaagttccttatgcagtttgacacttaatataaggtgtttgtatagttcagtttctacagataggatattgacacagctatttaagattgtaaaaaatacttgctttagggctatttaccactaaatgttttgggaaatgtgcttttcaaaggtaaacgtaactcgacccttaaaggtatgaaataacacattccttgtaaaatttatttatttaaacacagttgttaagtttatgaagttgacatttggcacaccgtcagactttcctaatacaaaaaattcatgtagccaaaggaacttagagatgaaccttatctgagctagtaattagtgaccctatattctatgccttaaattcttaacactgtcttcacaatctacaagattaagcaggatccaacttaggtttccctctccatcctcctgaaaaaaaaatggccttggtttttgaaacttactgttcttcctcatacttcagggcctgattcttttgttacgtgactttatcttggcataaccttcagacctccgctcagaatcacttctagaaccttccttgactctctagatacaatcatgctccctcttatctggtttcatagaaccctaaacatttctaagtgcttttctttttttttttttcttttttcttttctttttttttttttttttttgaggcagagtcttgctctgtcctccatgcttgagtgcagtggtgcaatctctgctcactgcaagttccgcctcctgggttcacaccattctcctgcctcagcctcccaagtagctgggactacaggcgcccaccaccatgctcggctaattttttgtatattttagtagagacggagttttaccatgttagccaggatggtctcgatctcctgaccttgtgatctgcccacctcggcctcccaaattgctgggattacaggcgtgagccaccgtgcctggccttacttgattgactttttaacttttatcctttcaagtttgaaataccaaggcttggaaccatgacagttttcccttatgcttaatctagcatctcttatataatagaatctctttaaataatattcaatgcacaaacatatagtaaatcttgaggaatttttattgtgtttggatctcaagggcacagatttgagttaaatattacctatagtttatgaaacattatcattgatggatcttcaaggcatatttgtttattcatttctttctcttcttttattctcatacctgtttttcctatctctctttgccaccaatggcaatctttttaatacatttaaggagtatcttttaactagaccatttatggtacattgtattatagtttagcaaatatcccctcccctttcttctacttcctattctgattttttgggctaggccatgtgacttgctttggtcaacagacatgaagaactgtgacacgggagcagtctttacatgtcatcatgtggttaggcaagttctcttaggattctattctcactatgtgaaaagcaggcctggttagccatgcgtccctgcagaaggagatatgtggaacagacatgagcccagacaaggtcagccaactcctagctgcctcacagacccataaataaaaatattgatctttgctattgcagaacagtgagattttggtgttgtttactaagaattgtttttgtaggaaaaactgtagaagcttctgtgtgcttaaaaaaaaaactttatataatggtattgctttctttttctattttcattgagcactcagttcttacacttcattctttttgctatgtgttaatcaaatcctgctgcaccagaagttcacagggtacttcacactaactaatgatcacagttgtataggaatctctggtatatgttagaaagttcataatatgacatacaatgttcctgacagtggcattgtcttgaatgcttttaaattatttgactctgtagtaaagatggcttgaggttggagagaggatggggtggcaggctctccattaccatggtgagtggaacagccaggtgtgaagccaaacaagctgtagcatttagccacaatggtagtgtagtcaaagggaaacttcaaaacagaatacttgggtccagtccttagattataaacacaccccgagaaaagatcaagcagggaaaaaattgtcatggtcatgtttcagaggcatagcaccttcctgactccctactaccttatgctacccacttcttctctacaacttatgctcaggttcctggacctctgacctttacaggattttccagaatgcaggggaaaagcacaaagagaaggaagcagatcacaaaatataaatatggatgacagatctcatagacttaaaccataaaaaaggtcagagtaaacataaaaaaaagatagttaatatatattatttactatgtagtaggcaccaactgttccacataaatgacatcatttcaacatcacagcaaccctataaagtatttcttttgtttttagaacacatgaaatatattctttaaacaaatttttaagtgtatcacacagtattgttaactacagtcacaattttggaaagcagatccttagaacaataccagaaaaacaaacaacaaataactcaattaagaaatgggtaaaggatttgaataactttttcaaaaaaaaacaacaacatacacactcgacatacaaatggccaacagtacataaaaatgtgctcaacatcattagtcataatggaaataaagtcaaaactacaatcagatatcgcctcatgctttgtaggatggcttttatttaaaacaaatttttttaaagttagcaagaatgtgaagaaattgctacacttgtgcattgttggtggaaatgtaaaatggcactgtcaatatgagaaacagtatggggtttcctcaaaaaaattactaatgtaactaccatatgatccagtagttccacttttgggaatttattcaaaatatttgaaatcaggatctttaagagatatctatctgtactcccatgtgtactgaagcattattcagagtatccaagatgtggaaacagactaaatgttcattgatggatgagtggataaagaaaatgtggtatatgcatacaagtgaacattactcagctttaaaaagaaggaagtactgccatttgtaacaatgtgaacgaatcttgaggacattatggtaagtgaactaagccagtcataggaccaataccgcatgattgcatttacatgagatatctaaaatagtcgtcaaactcaagaagcagaggtggttgtcaggggctaagggaaaggggaaatagggagtagctgttcaagggttataaagttttaattgtgctatttttgttctcattttccagatgccagaactgagggttacagtaaattaagtgacttgaccaaggccacagggctagtcagtgggagtttttgaagttgaaaccagacattcttgctcctgagcccacacttttgaaaccacttaaaattttattgagctgataaactatataaatttgcatatgaggggccatcatacaccagacacaattcatacaaagaaaagaatatctaaatatatactagtaaaaaactttaatataaaaatggagatttttttaagcagataaagctaaaatatctaaaaatgaagaaaaattaatttggcttcacactttataatttattaaataataaaaacatagcgaaacatcatctatatagctttaaagggaaaaacttttgacccaagactctagtagtctttcaagttttctaagtataagcaaaaaaaaagtgtcatataagaacttacaaagtgtatatcctcaataaattgaatacataaataaactaagagatgcagcaaatgcagagcttaagagtggatgggtcagaatataaaaggagtgttgcacgtcatacataggtttaaatatggaaaatataaatggctgtttaaaaatgcctaggaaatataattaaggcaccataaattatttttaaataaaatgtatgtgactaattcttcaaagaaaatataatgaaaataaacttacagagttaaaaacaaaaaggtgagtcataaataaatgtcatgtccccagatgcctcagacacatgaaaattaaaagagtaagaaggcagcatcaggagaccagaggccaatttaccatgaaggccgcccatgggttcctaatcaacagaactatggtccttcatttaaatttcattgtccttaccctgtctgcaaagtttttcaccattcatttccttctctccattgaaaacttcttttcacctgtaccacattactagcaggtttcccttccatcttgtcagtctttaatttctctggctctttccactaatcagtccttgacatatccccaaattctgagagtctatttccaggtttttctcttatctaattatgttttcattcttagagaatggatttactttcagagtttgaacctcaactcaggtaactcctgtgttcacgtttcttttttaagctcttagtctgatattttctgcccgatccatcccaggctctttaaatgcaaccacatcatccccgcgtcagatcaaagcaatcaaagcagctgcggcaactcaatacctatcatctagggtccttctcacggagttgctgatctgtgtgaaggcaaccttagcctcacactgccatctgcctctagcctcccctcagcattaggtttcatgtactccttggtttgataactgggcaacagataaggtttctgccagccccatggtacagctccttcagcctccatcctccacacctgaggccgaggggatgggggagggtgtgggtgccaatttttctcattctatagatagttgcactcagatgttttgaaatcatttaaaatttaatttgtcctaaaagtgacctcaggctgtgacacagtctctaggctatgttaggtctgtgtttgattgtagggctacggtccaaacatagccaccatgcaagaaaatgaacgaattgcaaagaggacaaagataagaccaggaattatgagtggcttaatttagagggtgttaaggccaagaatccaggtcatgagaagccaagataccctttcagagggtctgtttccatttcccctggcaagacactcagaataaagaatatcatttaagccataagggaggtctgtgggccagtcccagagaaagtctattatatttcactcaattttcttggaaatctgtcttgtttaaagtatgttgggacccaggtcctgtgaggtatattcttattccccactcccgaaatatgtgaattattgatactgttaaaagaaaagctttagacaaatttaagagtttaattgagaaaagaaaaaaaacatgatttccaaatcagcccctagaatcaaagaaaattcggagagactttggcactgtcacaaggtcaaacatctatgggaaaaaaatgtgatgtgcaaaaactaaaactgagatacagaaacagctggattggttacagctcagcatttgccttatttaaacaaagtttaaacagttggccgcctatgagtggttaaagtatacctactggaattggctaagactaagctgtcattacagggaaacatactactaaagttaggcttttagtctgtttacctgctaagtatctgagtatggacattttccaggctagattttagttttatttagtaacacattatgggatctgaaggacacttttttaaaggttgaaacaaacaaattttacgcacatttccatttataacaaaagaaaaatgcccctttagctctggtaagtatgacaatttctaaattaaaagagcattatttacatctgaattgttaattctaatattaatttcaagtattattaataatataatcatttttcactaagccttcccttttatacccgtttacactttcaaatctaattatattccactgttgttttaaagatcaagccccaactgtttcatggtgtaccttctttctaattaagtatttgagacaaatgggagtcaggctgggactatagcatgtcaattttcacaagctgacattcacagtaaaagtagttcttgattatttccctaacagctttgatgttaaggggaaaaaaagcaacaacaacactgagctgtgtatattccctcctcatgctcctgggtgagaaatcatagttagtagctgctgatcttaaaaatcagagtctctgctacattgttagcaataatctaaatcaatacagactaacaacacaagccagtatgtggtgagtcatgaaaaataaatcagtagtgatatcaattgaaaatgataccaaaaaactatattatctggaaggaaaaatacaattttataacactcttggtcctgaatagttttgactatggcacacaaagcaagcaagcagcgaattacatgactgttactttctttctactgttagcaccctccgctaatagattgtaacagaatgactgtttggagggttaagcattgggaaatgtccataattacatagcatgtttggtaacatcgtgacattttaataaaacacagatatacattatagaaaagaagatctagccatctttttacactctctagagatcaataaatgtacccttgaatgacagatgggtgttgaaacccctttgcaaataattcctcaggtagctcttctaagctctgaaacgctacaatagttctcaaaatctcaacagagggaaataaaatacttcacagttgtaatgattttctctttatatatatactttctgaaaaagtatagtgagaatactaagtatttgggaactgattttaaagtccataactattaaaaattgcaagaatttttatggagcatatttatttcataaatcagtattaaagcctgaaaaaagaagtcttaaaagtctacataattctcacaatgttatatatatgttatatatatatatgttctatatatgttttatatatgttatatatataaagaacatatttctcacaatgttatatatatatgttatatacatatatataaaagaaagttggtcaaaattgttcatattgagaggtgacaacatgctggtggccctcacttgctctcagcgcctcctcggactcggcgtccactctggccacacttgaggagccccttcagcccaccgctgcactgtgggagcccctctctgggctggctgaggctggagatggctccccctgcttgcagggaggtgtggagggagaggtgcaggtgggaactggggctgtgcatggtgcttgtgggccagcacgagttccaggtgggtgtgggcttggcgggccccacactccgagcggccgtctggcgccaccggccctgggcagtgaggggtttagcacccgggccggcagctgcagagggtgcactgagtcccccagcactgcccgcccgcccacgctgcactcgaattctcgccaggcctcagccacctccccacggggcagggcttgggacctgcagcccgccatggccgaaccccccccacccccgtgggctcccgcgcagcccgagtctccccaacagggtgctgccccctgctccatggcgcccggtcccatcaactgcccaagggctgaggagagcgggcgcgcggtgcgggactggcaggcagctctgcctgcagccccggcgtgggatccactagccaaagccagctgggctcctgagtctggtggggacttggagaacttttatgtctagctggaggattgtacatgcaccaatcagcactctgtgtctagcttggggttcgtggatgcaccaatcagcactctgtatctagttaatctggtggggacttggagaacttttatgtctagctaaaggattgtaaatgcaccagtcagtgctctgtgtctagctcaagtttgtaaatgcaccaatcagcaccctgtgtctagctcaaggtttgtaaacccaccaatcagtgctctgtgtctagctcatctagtggggacttggagaacttttgtgtctagctaaaggactgtaaatgcaccaatcagcactctgtgtatagctcaaggtttgcaaacacaccagtcggcactctgtgtctagctcaaggtttgtaaacgcaccaatcagtgctctgtgtctagttaatctagtggggacttggagaacttttatgtctagctagaggattgtaaataccccaatcagcactctgtgtctagctcagggattataaatgcaccaatcagcaccctgtcaaaacagaccaatcagctctctgtaaaatggaccaatcagctctctgtaaaatgggccaatcagcatgatgtgggtggggtcagataagggaataaaagcaggctgcccaagccagcagccgcaacccgctcgggtccccttccaccctgtggaagcgttgttcttttgctctttgcaataaatcttgctgctgcttactgtttgggtccatactgcctttatgagctgtaacacttgctgcgaaggtctgcagcttcactcctgaggccagcgagaccatgaacccactgggaggaatgagcaactctggacgggaggaaggaacaactccagacgtgctgccttaagagctgtaacactcactgcaaaggtctgcagtttcactgttgaagccagcaagaccacgaacccaccagaaggaagaaactccaaacacgtctgaacatcagaaggaacaaactctggacacaccatctttaagaactgtaacactcagtgcgacagtctgcggcttccttcttgaagtcggtgagaccaagaacccaccagtttcggagacaatattaaacatgttccaattactactctactttaaacaagaaccttataaattcctaaaatatataaaatataaggaatggtacaaataatgcttcacttgttggagatgaagtgaagatgaaacataaaccctatttatttatcccaattattccatgttcacatactcacaaaagactattctgtcacaatttaaccctgttccccaaaatctcctcataaatgcagtttcaaaaagaacaaaactatgcaaataaacattacacctgtagttttgttctgtcaaatttgggaatgaaacgtctctggtgaaaagaaataaacggttagccatttttaatttcaaaaatgatcagtcattcactattcatgtctcatgtgaactacataatgtcaacgctgtcacgaaagcacggtagaaaaaagagatcctctcagcttcaatttagtagagggaaaagttcctggaatatgtttttcctccctctggagcacttcagttttgcaaaacatgtattttataattcttattttgtattcaacaatagtgctctctctggctttcagagtttttccagtttctctgatatttcaaaaagttatggtgttgtcattttatagtttaacatgagtggttctcacttcattcaaaagaaacaggataccttgaaaacgatgtggccaacctctagaaatgaaaattattattgcttaataatagtaatacctaatatatgcaggggcagaagcctggttgagcatgtatatacatcaatcatttaattctcatagcccttacatggccaaactaagtcttggagatattaagaattttttctacagtaatacaaaattaaatttctggaagtctggcacattttgtcaatcctgaagaatacagaataaacgtttatttattcacctattcaattattcaacaaatgtttcctggcagactagtaagtagcaggcttagagttagacatgagaatacaaactgaaataagttttgattcctgtcctcaaggaccttacattctagtttggaagagagactattaaataaacctacagtgttaagatagatacttacagccccaggtagtggtataggatccctgaagagtatgaaattgaaactattttcttctaattaataaacatttataacagtaacagagtagaaaacacttggcaagcctatctgaataataattattctgtctttatggtaccaacataaaataagggtaaaaagcataacatttaaaaaaaagtaattatgtaatatagtaatttcaaaaacgttcatggaattgagcttttacttaggattcgtgtaggtgcaaccaaattgcaactatgctcacttaagggtcccagtttgcaacaatgattcaaaagctcaattctgatcatagctatatcaaaagattgttggtgtttccaggggcaaaactgagtctgataaatatatactcaataactgaaataaatagattcagtatttcaatggaatgactggcatccactttctatctaatgaaaggccaatatcaattattaaacgctaaaaattactactgggagtgcaaaactgaaaacctcttccaaagaaatatgaaatttaaatctggcaattttatttaaaagagcttcaaagtgtaaaaacagagctttctctttacataaatacttacgataagtaatttatcttctttatagaacagacaacagaccaagacaacttttcgcaccttggtggatgcgctctgaatgccaagccaggcaccacagtcattactaccaaaggggaagtaataaatttactgtctatacgaagactttcaggtctgtcccatgtaggtgaaaaatagcgcgacttttaatctctcatcattaacgccattaaactctatattaaattctgtgctgatgaaaattttttttaaatgtatgttagtattgtgtttccttacactcatttattacagagtgttatggtttctatttgcaattctgtcttttctataaaattttcagtttcttgagagcaaaaactggttgccacaatgaccagtatatagttggtgctaaaaacacatatgttgaataaaattgaatacatattcctaatttcaaagtaattgtacatgttacaatgtacttaaaaaacagaaaaattgccagtttcacattcactatctttattgatgggttcaagtctatgaaatttttgcctatcatatatcccaaagcacaataaagcagtttcaaagacattttaacacacttaagaaaaggagcttctgaattaaagcccaccactttcatattaacattaatacattttgattccatatagtcacaatagagtttataagacttgtccaaatcgaagctgaaaaatgttatgatggccattcacttttaattaaatacaagcattaaaagaaatactatttatattagcaatagaaaacagaacttctaaatcacttataagattcaggattttattttcttactcttctaaaatagttcatttaacttttatttgtatttttctaaaatttatcagccaccaacttacagtgtgagcccactcagagaaaaatttaaatcatcaggataataattaatatttataaaacaaggtatttatagaaagcttttttatatgtatactattaattatacatggtattttatcactctcactataataatattttaattaaaaccttgccttgaaagataatttgggatatctcaaaaaagtaaagttctatatgataaaagaatgttaactattttctgtaagcaatcttaagctttttaatttaccaaaataaacacattcaatataagtttcatgtgatatgttgatttggagtttgctaacaaaatagtcatatatgcatacagtggaaaatacataaatttaaaacatatccagattaagtgaagcttacaaatggagacaattcatatatatttatcattgttagataaattagtaattagtacattgtgcattctagaaaaacaaaaagcatattctttgtctaggttcaataatagtcatctgaaatatgctctgtacctgtggatgaaataagtaaaagaacataaaatgtatgaataaatagggtgaaatttacagagactacttttgctgtcttgtgattcggtcatttatgagtgttaaggatttttctcagtacagttcagaatattaatcaatgccttctacttacaggagggtctgcatcttcagcataaactgttgtgataggtgtacccttgactgcatccggagccaccatccctttgtatattcgtttactaaagacaggaggataatcattcatatcctgtaaaacacaattaggagtttagtacttcagttgaaaccaggttagggatacagttactagattgactcccagtcttcatatcacacaacttatttaccactgtcagccttccatcctctcaattccattactctcatttcagactggcacctcagaggaaactgccagagttctcatacaatattaatgtgtggatatcaactgaaggccgttccactggaataaagtctttcaccctcaaaaacatgccttttggagactgaagtgaccctggaatttttttctaacttctaatggtaagaggtaaaattttaacatttgaaaataagaacaagtttctttaaaagctacattctgtgaagcaggcgtaaaagattttttttaaatgctctttatatgtttttatagcaatgtaaattattttatatacttagcataatactgactagaacatttcagatacaaactgtgaaatatcctttgttgccattttacatgataaaaggagattttctctgcagcgcactaaaataatgacacttaagattagatatatttatacacagaaaacaatgttaatttactgaatttttttcagagcaacttatatgtatcttatttttccaatttggcgctatatatgcattgttattcatgcattgtcaagttcattaaataaatagttatcaggtatttcccactttcatcagatatttagcacttcagtgcgaggcactgaagatactgttgtgactcaagaaaaagatgtccctgtctttgtgtcacttaactgccattaggctagtaaaaatactaatctgcagaaaggctagtaactttgactaaattaatctacttatcagggccaaaataataaatcaagtcccctgaaaggaagaccatatttttctgaatcattttatcttttagagataattgtatataatcttttgtcaataaataatgcttattcatatggcagatttatttatttataatattttaataatccttaccctaccgtgttttgggtagtgtgggtcaaacatatttgaactgaaacctaaatttgttaattatctgctcttctcctccaagtcccctttttctcacttgctagtaaaaacaaaatttaaaaaattctacatattctttgatatttgcttagacacaacaattttcctgtacagtattaagctggaaacacataaattaacagatctcaaacttctctttttgcaaagaagtcagaataattatttcttactatcaaacaatgcttccttttatattcgccatagagttgagttctgagtagtcaatatgaataaacctgcatattctaataggagaacttgaactgtacacaaaactgaaaaataaaaaatatcatttcttctgttttgaaatacagtattcaccatctcttctatgaaaaatatttttacaataaattatggactttagaatctgaacaagtaaatgaaccgagaagttttagttctctataatgaggactgtgaagggtattgatcttgaggctccatgcagggagtaaatatataaaacattagcattcacacattttcgtgccctttccaagagtgccaattaacttaataagtggatgtggtaactaagggtgtggaaatcctttagcacccctaaattgtaacttctgaaggttcgaaaggaaggagcccaacactgcaatgtttccatgcatgagtttccaatgagctcattatgttcttaaaaattttattctttattttattctcaggggaaatttaaaaccttaatgtcacaaggtactttttggaaaatttgattcttcagaaacaaaaaaaatgtatatacttttccaattatgtcaacacagctgttcacagtgttgaatatgatgaactttttatttgcttgggaagtattcattggattcaccttctaacttgaatgtacagtgattcacaaactgattagacacacacctaagactgtaaatgactgaagcctatgaaaagattggttctcttccccctttattttctattgacaggatgaagaataaattaatgtagttattgtagtagtatttctttttatggcacgttgtacatactttggggttataatctttcattgtggttacaaaagcagctagttgcatatagtttttccacaatgcattatttcaagaggagaaatgtattgaaatgcaattccaacaagcataatcaatagttcactgtatttatgctcagggacatctgaacaaaaatgtatataaatcggcttctgtgcaaatgttctcttgtgcagtaaattaaggactcgctcagcactccaaaaccatgctcttttctcttgcccattattccactagagggtagtattagcaaaaagaaatatttcctcctctgtagttaagaattgtatcactaaaacccataatatttgtttcttttggtaaaaatttttattggtctcaacaaaaaatagttttaatgcttcaaaagagtattctgaatgttatgatttacaacttgaaaaaccttatggtttttttcttaaggaaaactttaaaaaatggttatactcataaagcctgcaatttgtttccatgtgtcaagcaaataaaattatacctgaaggtgtaggtagctaacaggagaaaactatgttttatttatttatttgctacattagagtctgtaataatcacagaaaccttttctcctttagcagactaccaagaagatgtaaggaatctttttaatgatcatgctaggaagataagaacttgctggtaagtttgtaaatgtaatgacaagttgaagttctacacacacaaaaaaaataaaaataaagagaaaaagatgataaaatttttgattttctggaatcacaggcaaaaacctatagaacagtttttatttagaagataagtagaaagttctaactagttggaacttgatcatctttttaaaaataacgtgtaggctgggcacggtggctcgcatctgtaattccaacactttgggaggctgaggtgggcggatcacccaaggtcaggagttcgagaccagcctggccaacatggcgaaactgtgtctctactaaaaatacaacaataagcctggcatggtggcgggcacctgtaatcccagctactcgagaggctgaggaagggagaattccttgaacccaggaggcggatgttgcagtgagccgagatcgcgccattgcactccagcctgggtgacagagtgatactcagtctcaaaaaaaaaaaaaaaaaaaaagatatgtatatagcaaatgccagtccttaccatactaaagctaattcaggctctatgaggagacacagacagtataagccaatgggcggaatgactttagttgtttctgtcttatggtctagcattagcattatccttgttgagctatatggctgctctataatgccttgaggtttatggagccgatacctacttttacgtgggtgtatggttgattgtttgcctcttaccagttctgttttccactactagacactttctatttgctgtccaagttgctgtttctcatatttctcatattattagcattctgctgggtttttttctctctcaatttctgtattgtctccttgtctttactgacttatttcccttcttttatgcttctgcataaaaagtcataaaaggctacatctgcagctaaagaaaatatttgatatttttactgccaggctaggcatattcaccacaagctgatttaagaggccatgggccataagtgaacattggtggtagcctggcagtactccccaagggtctttgatagtggcacagggtaaggctcctctgcttgtggagaaggactgtttctcataggttgagtgcctgctcagccacagtacacaagaacacaaggtagaattctaaggttttgacttccagacggtaactttgaacctgttcagggcctgggagatttttgccaccctgaagggaaagacacaggtctggctggctttgccacctgctgattatagagacccatggccttgaacaaacttaagtggtagccagggtggttacagcaggtcttggacaagacccagtgctgtgctgggtttaggtctgacccactgcagtcccagcagtggggtccacaggggtgcttgtgtcaccccaaccccagctccaggtggctccaaacagagacactctgtctgggagagagcaagggaaaagaacaggagtttctgcctggtaattaagggaattcttctggatcttatccaagaccattaaggtagtaagagtctgccaagaaccacagtgttactgggcttgtggtgcctcctaaagcagatacagctttagcaacacctacatcctttcaaatacctgaaaagctttccaaataacaaatacgaagaagtccagactgtgaagaatacaataaatacccaacgcttaaatgcccagacacagacaaacatccacaagcatcaatatcatccaggaaaacatgaagtcaccaaatgaactaaacaagccaccagaaaccaatcctggggaaacagagagagtgatctttcagacagagaattcaaaatagttgttttgagaaaactcaaaaaattcaagataacacagagaagaaatttagaattctatcagatacatttaacaaagagattgaaataattttaaaaatcaagaagaaattctggagttgaaaaatgcaactgacaccctgaagaatgcatcagttttttaatagcagaattgaccaagcagaagaaagaattagtgagcttgaagacagcccatttcaaaatacacagtcagaggaggcaagagaaaaaaaagaacaaaatcaatgaaacatgactacaagatctagaaaatggcctcaaaagggcaaatgtaagtgttattggcattaaagaggagacagacaaagagataagggtagaaagtttattaaaaggaataataatgaagaacttcccaaacccagaaaaggatatcaatatccaagtacaaaagattatagaactaccagcagatttaacccaaagaacactagctcaagttatttaataatcaaactcccaaaggtcaaggataaataaaggatcctaaaggagtaagagaaaagaaacaaataacatacaatggagctctaatacatctggcagcagacatttagcagaaaccttacaggccaagagagagtggcatgtcatacttaaagtgctgaaggacaaaaaaaattcctagaagagtatatctggttaaaatatccttcaaacaggaaggagaaataaagactttcccagacaaataaaagctgagggatttcatcaacaccagacctgtcctataagaaattctaaagaaagttcttcaataaaaaaagaaagttcgtgagtaataagaaatcatctgaagatacaaaactcactggtaatagtatgtacacaggaaacacagagtattataacactgtaactgtggtggtgtataaaatattcttatgttaagtagaaagactaaattatgaaacaaaaataactacaatcacttttcaagacatagtaaaataaggtataaatagaaacaataaaaacttaaaaagcatggagatgaagtatagagtttttattagttattttttcttgtctgtttatgcaaacagtgttgttatcagcttaaataaagggttgtatgatagtatttgcaagcttgatgataacctcaaaccaaaaaatgtacaatagatacataaaaaataaaaagtcaacaaaatcaaagcaccagagtatactaccttcacttaaaggaagacaggaaggaaagaaagaaagaagacaaaccataagacaaccagaaagcaaataacaaaatggaagcaataggtccttagttataaaaaataacattgaatgtaaagggattaagctctctaatcaaatgacatagagtggatgaacggattaaagaaaaaaaagacaaaatgatctgttgcctacaagaaacacacttcacctataaagacacacatagactgaaaataaacacatggaaaaatatattccatgctaatggaaaccaataaacagcaggaatatctgcaattacaggaaacaaaacagatttcaagacaaaaactacacagagagacaaagaaggtcactatataatgataaatgtatcaatttatcaggaagatataacaattgtaaatatatatacatatatgtatatatatacatgtatatatatacatatatgtatatatacatgtgtatacatacatatgtattcagtgtgtgtgtgtatatatatatacacatacacacacacatatatattttcaacattggagagctcaaatatataaagcgaatattattaaagctaaagagccagatacatccccaaacaaaaatagctggaaacttcaacatcccactttcagcactggacagatcttccagaaagaaaatcaacaaagaaacatcagacctaatctccactgtagaacaaatggatctaacagttactcatagagcatttcatccaacacctgcagaatacacattctcctcagcacatggatcattctcaaatacaggccataccttaggtcacaaaacaagtcttaacacattaaaaactttgaaataatatcaagtatcttctctgaccacaacagaataaaactaaaaatcaataacaacataaattttggaaattatactaacacatggaaattaaacaatacattactgaataaccaggggtcaatgaggaaattgataagaaaattgaaaacttttttgaccaaatgataatgaaaatacaaagtatcaaaaccaatagtgaggtgtggagttggcaggacttcctgggttgatttggggactttcacaaaagacccctgtgactcagggttttgagttcttaatcaataaagtgaaggattcaaagttaaccactccaagggaggattgaaaaaagagccactctcaatggacaaaaagaaagaaaggggagggggtaacacagggatataagtcctagccaccacagccagcagtggcaacccttccaggtccccttccaccatgtggaagcttccctttcgctttgttcaataaactgtgctgctgctcactctcctggtctgtggactctttttgagttgtaacactcactgtgaaggtccgcagcttcattcttcgaagttagcaagaccacgaatccatcagcaggaaaaactcttgattcaataggatatactgaaatttttactacgtgggaaatttatagctataagtgcctacatcatgaaaggaaaaaaacttcaactaaacaaaacaacctaatgatgcatctttaaaaactagaaaagcaagagcaggctgaagccaaaattagtagaagaaaataaataataaagatcagagcagaaataaatggatttgaaatgaagaaaacaataaaaagatcaatgaaacagaaagtttgtttttttaaaaagttatataaaattgacaaacctttagccagactaactaaaaaagaagagagaagacccaaataaataaagtcagatatgaaaaagaaaacattacaactaatactgcagagattcaagggatcattagtggctactatgaacaaacatatgtcaataaattggaaaatcaagaagaaacaaataaattcctagacacacacaacccatcaagattgaactatgaagaaatccaaaacattgaacaaactagtatcaagtaacaagatatagcaaataacaagtatcaagctgtaatgaaaagtcacctagcaaaggaaaagccagaacctgatggttttgctactgaattctaccaaatatttaaagaagtactaatactaatcttactcaaactattccaaaaaaaaaaaaaaaaaaaaaaaaacaggaggagggaatactttcaaactcattctataaagacaataatactgataccaaagctagacaaagagacatccaaaaaagaaactataggcaatctccttgatgaatattgatgcaaaattcctcaacaaaataataacaaagaaattcaacatcgtatttaaaagatcattaatcatgaccaaataagatttatctcagggatactaggatggttcaatatattcaaatcaatcaatgtgatatatcatcaacagaatgaaagagaaaaaccatatgatcatttcaattgattctgaaaaagcatttaataaaattcaatgctctttcatgataaaaaccctcaaaaactgggtgtagatggaacatacctcaacataataaaagtgatatatgacaaacccgtagctactcccatactgaatgaggaaaaactgaaagcctttcctgtacgatctgggacacaaccaggatgcccactatcaccactgttattcaatatagtactggaagtcttagcaagaacaatcagaaaagaaaacaaaataatgatcatctaaattggaaaggaagaagtcaaattatccttgtttgcaaatgataaaatctaacacttggaaaaacctaaagactacacacacacacacacacacacacacacaccacacaaagtattagaactgataaatttagtaaagttgcaagatacaaaatcaacacagaaaaatcagtagcatttctatatgccaacagtgaacaatccgcaaaagaaatcaataaagtaatcccatgtaaaacagctacaattaaaataaaatacctaggaattaaccaaggaagtgaaagttctctgcaatggaaactataaaacatggattcaagaaaatgaagagaacacaaaagaatgaaaagatatctcatggtcatggattgcaataatcaatattgttaaaatgtccatactactcaaagcgttctacagattcaatgcaatccctgtcaaataccaatgacattcttcaaagaaacagaaaaaaaattctaaactgtgtatggaagtacaaaagacctagatagccaaagctatattaaacaaaaggaaaaaaaaaaacacctggaggaatcacattatctgactttaaataatattacagagctatagtaaacaaaataggatggtactggcataaaaaaaaaaaacacacatatatccatggaacagaattgagaacccagaaataaatttacacaactacagcaaagtcaattttgacaaaagtgccaggaatgtaaccagggaaaggacagtctcttcaataaatgatgccaggaaaactggatatccatatgcaaaagaagaaattaggccccatctcatgccatatacaaaaatcaaatcaaaattgattaaagatatgaatctaagacctcaaactatgaaatgactgaaagaaaacatgcggaaactctccaggagataggactaggcaaagatttcttgagtaatacctcacaagcacaggcaaccaaagaaaaatgaacaaatgggatcacatcaacttaaaaagcttctgcacatcaaaggaaagaatcaacaaagtaaagagacaacccacagggtgagcgcaaatatttgccaactacccatctgacaaggaattaaacagaatatataagcagttcaaacaactttgtaagaaaatatctagtaatctgattttaaaatgggcaaaagttctaaacaaaaatttctcaaaagaagacatacaagtgataaaccggtatataaaaaggtgctcaacatcattgatcatcagagaaatgcaaatcaaacttacaatgagacaccatcttacaccaggtagaatggcttttatctaaaagtcaggcaatggcaaatgctaataaggatgtggagaaaaggaaccctcacacactgatggtgggaatgcaaattagtacaaccactatggagaacagtatggaagttcctataaaactaaaaatagagctatcatacgatccagaaatcccactactagatacatggccaaaagaaaggaaatcagtatatgaaagaaatatctgcactcccatgtttattgcagcactatttaccatggccaagatttggaagcaacctaagtgtccatcaacagaataatggagaaagaaaatgtggtacaggtacacaagggagtactatttaaccataaagaagaatgagatcctataatgtgcaacgacataatcaatgaaggttaaaagtatatgagagaggcactttctggtgtctcccagaaaccagtgggtgatatttatggagccatgggagagattctttactacgtagatatactatttttaatcctggacatgcacattttctttgttttctctggtttggatttttataggaaatatgttatatcttagtcctaaaactctagaatagtagaattaaagatattttctcctgctatcaccaagttcactgacaaatataatataaagaacacaccaataggaatctgaaaatgcggactagaagagagggaaacatttgaaagccatacttcaaagcaaccccaacagaacaattagcaagttgtaaaaaacaatattaaatctgaccatacaccaactagctggttcacagaaattatcatttattcaaattcccacctccagacaatacctcttacctccatacaataggtatgctgtagatgaaatgtccagaatttctgttttgtttgagtctgggacaacctcctggtctctcaagcatcagcttttctgatgaaatcaaaagcaggaccctatcaacactgtcatgatggagcatcagtagcacgtaactgcctctcaggtgtccacggtttcacaaatgctgccttggtactgggcactgagttttcatctagaaaagctatcctttttcttctattctatggggtagcaatatttctttctggagaagaaaactcctctgaaaggtggaaatcttagcttcattttccaagactcactgtgtttaacaacaacctcagcccttgttacaaggtgaacctgatgatacttcatttctcgtcatttcacccctccctgcctactcccacacctgcacactaagacaggcaaacacaaccaagggtcaatctagtctcccgtcttcacagaagcatgtctccctctctcctactcccatgcagccattctatccaaaattataatgagcaaaatgacttgggtcatctgtttatctcagacaagttctttatactccttataatgctgcttagtataatatatccatttacatattcagcttttcagattcatattcagttttcagtttgctgtagaacagcccttttctttctgtgtattttctatattatgttacaacgcagactctaagaccaggtttctattataacttagtttgtaaggctagttatcactctggatcttttaaaattgtttagaattttattttcactttccagagatttgcttatatcatctaatttactatcatcacagattcagttcttctaaatatttagtatatctagaaatatacaagaaaaatatttacaagtaaaatacacaagaaaatatctctaatttactatcatcacagattcagttcttctaaatatttagtatatctagaaatatacaagaaaaatatctacaagtaaaatacacaagtaaatatcttgtatatacaaggaaaaagccttgttacattgatgttctataaaatcttttcaagaaaaaatgtatgttatttgtttgatcatcacaggttttgttttggattcttaaaacttgacactaagaaagctgtgtgcagatgtcttgataaaaatttttatttatactgtggaaatattgtttttccaaataatacttgaattttcccattcttgctccaattttaaacaggtttgatggactaggcattaaacacttcatcttttattttttcctcttgtttacaaaagaaattatgtttctgctcattttgaaagaaagaacttcaagatgttttcctgtggtgactttttgggtccaagtatctcctagcgaataccatacaattatgttatcaacaaaacagcttttcagtactgcgagtaattagaccaagtatagacaatttgaaaagctggtaaagactacatttgtagagaactgagaattgtactccattcttctcttaaaaaaaggataataatattttatgggcctcagtagtatatactagaattttaaagttatatttgtgataatccccaccctgagttatcagaaaagaggaaagcaagtgtcagtctacatttgggagaatttcctacaaattttattatgcttagatgaacttggaataaaaaagtggtattacatatgtctagagttaaatgttaagttttgctttaaatgtataataaataggcaatgactttgcatgagtcaggacgccttgaccaaaggaatggtgtgatttctctaaataagataaagcaattgatacaacacgaattaaaccaacactcttctctatctgaggaataaattatcttccagctgctgatgtagaagcgttaagtaatacccccatattgaaataaagggatgttgaggcaacattaagaacttttttaaagaggtatgaggcccagatacagaatgagggttacttagggcatatcttgctttttgaggtgataattttggacataatttaactcccctaacattttccatcaaaacaagccaagcaaatatatccaaattgaatccagagctgccaagtcagaatctatgagtgtttaccataactgtctgtcatcaaccacaccctcatcagagaaaaggccacaccatttgaggatctatttttcgatctgggaagaaaaggggaaatgtcattaatagcaagtcttttttttctcttctttgtccaaaatcatcaataaatgaattatttttctatttttaatgttttaactgttcaattccaccaagtcatatgagtagacaagagtaaaccaaggcaaatttttcacctggtccagaagatattttgctatttagtctatatagatcactctcaccttagtctttttcatctgcttacatattatggcatcttcataaccaccaatattatattccctaaatatttttgtaacagatttctaaatgttataacacaatagtgtgacaaaatcatatttcaaaatacaatacaatcaaagccctcccttcaggcaatccataattttgtcttgtcccttgatcctttttccagaccactagagcactgataattattgtctcgggaaagagaggtatgaaaagaaaaatcaggttaccccagaaaagattttgacagtttgagttcctatttccaaagaaaatttagtactgaataaagttttaatttcctgaaatagacacatttcttacctcctgaaataaatatcttaggacagagagacacaagaacggaataattaagtatatagacatgtggacccccgagaaataaagaacccagatcctgataaaactctcccaacaggtttagggtgtccgaggatggaaggagcttacgatctccattccaaggtagtttagaggtggaaacagtatccatagaagaaatggcatcaatttgtgtgctagcagataatccaggtcaagtgtaaaaaaagacagcgaaagaggtgggggccaagagaactaactagagggagctggtgtgtgtcaatctcattgagaaaagaaaggctggcgagtggacactagctcatctgaaaaatccaggtggagacacactggaattcatcaggaaacagcataacacatagagaacagaggagagcaagacaagacaactgcccaccctggggtggcacagagtcaggggagtcctcccactgtggagaaacagtgagtaagtgagtccctggggacccaccttctgccatggacttttgcatccctggactcaggagatctcccccatgagctccccaccggtgcctccaggctgacacggagaaccatgtggagtcttggcagagccatactcaggcacacagggagtcccaggagacttgtatccccagacactctggcaccagtggctgtagctcctgcagcagtggaggccagacttgcatgcctccagtaaaggggccaaatccacgaggctgagcagtgaaacattgcaggcctcatctcagctgcaccttgcaggataaggcctactgtccattccagccccacctgagttcctgggtcgggagcagctctgtacttctctgggacggagctcccagagggagaggctggctgccatttttgctgctctgcaaccctccctgtttttgctcttaggcttgggagggacagggattagggactaatgccgacccccaacacagcgcagtttccttacagaaaagcgggtaggctgttttccatgtgggtccacacccttgctacttctcaccgggcagggcttcccaacctaggacctcggcaacccccgacctgggctcttgggccagtagcagctctgtactttcctgggacagagctcccagagggcaaggcaggtcaccattttttgctgctccacagtcctcattcctgttgccctcaggctcaggagggaatgtggtggttggagactgatgcaaacgcccagcacagcacggcagcattacagaaaagcagctagactgctttctatgcaggtctctgcctctgctactctttactgcccagtgcctctggacttgggcccctagcacaaccaccttgtcaatgcctaacacttcagtcagtggtgagaaaaccccagagacaatccacaacctctctgtgactgcagctacccttgggctggggaggaacaaagggcttggccactatgcaggaactccagcacaccacagccacaatatggacagaagcccagtgtctgtttcccgtgagcccccacctctcactctttaccaggcagtgcctaagctcgggagcacggaacagccaccccatctccagctgagcattctcactgctagtggctttgtgtttccttaaggaggggctcctacagtcaactaacagccactctgccactgccacagcagtagttctgcccctgctgcccttggactggagaagaaagaaagggccaaaggttttactcactcttccaggaggacacagtcatcatatagagagaagcccagactgtcctccctgtgaatcctcaacctcccgttctttacccagctcaggccagcagtgcagccaccccactccctggctggacattcccagtaggagcagttttgagtttccctcaggttgagcacccagggacaaccgaaagcccctctaccactgctgctgcagtgatattgcccttgctgccctcagactgtggagggagcaaagaccctgagtgctttagccacacctccagacagctgcatcacccacaagcttggtcctacaatgcagccaccacaccccaggctgactgtactgattagtagtggctctgtatttttctggggtggagcaccaagagacaagtgaaaggccatctgccacagccacagccaaggtcccttcccttgttgtgtctaagctggggaaagaacataaagcctgagcttgccccagagctacaatgtgtagcctgggagtgccaaacagatatacagccagcagtcaagtgcaaaaggagccgacactttcagatcactgagaaggggcacaacaatccttaggaaatagaggagactgacgaagagtctacctactggccattccagttaagtgccatctgctggatcacagcccaaactttactattaaaaatattttgctaatatattcttctgtgaaaccaaggacaagagctcagttacaaataaaggtcatgcacaaaacctcactcctctgaaaacatctaaataaaccaactgactgtactcaaattagacagttgaaagaacatcagcgaacacagatgagaaagaaccagtgcaagaactttggcaactcaaaaaacaagtgtcttctttcctccaaacaactgtactagttccctagccaggattcttaactcagctgaaatagttgaaatgaaagaaatagaattcagaatatgggtaggaatgaaaatcattgagaatcagggaggaagtcaaaatccaaaccaaggaaactaaggattacaataaaacaatacaggagctggtagatgaaatggccattataagaatgaaccaaaatgatctgatagagctgaaaaacacactacaagagttttatattgtgattgcattaacagcagaagagaccaaactaaggaaagaatcagagagcgtgaagactggctctctgaactaactaagaaggacaaaagtaataattaaaaaaagaataaaaaagaatggacaaaacccctgaaacatatgggattatgtgaagagaccagatctacccctcattggcgtcactgagggaaatggggaaaaagcaggcaacttggaaaacatatttcaggatattgtccatgaaaacttcccaacctcactagagaggccaatattaaaatttaaaaactgcagagaactgcaagatactatataagaagacaatccccaaaacacataattatcagattctctttcattctttttaaaatgaaagaaaaaaatataaaggcagctagaaagaaagagcaggaaacctacaaagagaacccatcaggctaacagtggacctttcagcagaaaccctataagccagaagagattgggggcctatgttcagcattcttaaataaaagaatttcaacccaagaatttcatgtccagtgaaactgagcttcataggcaaaaaagaaataaaatacttttcagacaagcaaattctaagggaatttattacaaccaggcctgccttataagagctcctgaaaggagtgctacatgtgaacagccactacaaaaacacacttaaatacacagatctctgacactataaagcaatgacataagtctacataatatccagctaacaatatgatgacaggctcaaattcacacacatcaatattaacactgaatgtaaatgggctaaatgacacaatttaaagctggataaagaagcaaggaccaacgttatgctgtctttaagaggcccatctcacatgcaatgacatccataggcccaaagtaaaggtttggagaaaagtccaccaagaaaacagaaaatagaaaaagctgaagttgctatccaaatttcagacaaaaagagactttaaatcaacaaacatcacaaaagacaaagatgagccttacataatggtaaaggatacaatgcaataagaagatctaaatatcccaaatatatatgcatccaacacaggagcacccagattcataaagcaagttcttacagacctacaaagagacttcgatttccacacaatagtgggacatttcaataccccatggacagtaatagacagatgatggaggtgacaaagtgaaaaagatatttaggacctgaattcaacaattgaacaaatggacataatagacatctatagaactctccacccaaaaacaacagaatatacatacttctcatcaccacatggcacatactttaaaattgaccacacaattggacatcaaaacaatctgtaacaaattgaagaagactaaaatcataccaaccacactctctgaacatggtgcaataaaaacagaaatcaatactaagaaaaacattcaaaaccatacaattacatggaaattaaccacttgttcctcaattatctctgggtaaacaataaaattaaggcagaaataaaatatttcaaactaatgaaaacaaagatccagcataccagaatctctggggcacagctaaagcagtgttaagaaagaagtttatagcactaaatgcccacattaaaaaagtcagaaggatatcaaatgaacaatctagcatcacatctacaggaactagagaaacaagagcaaaccaaactcaaagctagcagaagacaagaaataaccaaaatcagagctcaactgaaggaaattgagatgcaaagaccatataaaagataaatgaatttaggaattatcttagttatttgaaagaattaattagatagatggatgaatagctagacaaataagaaaaaaaaagagaagatccaactaaacacaatcagaaatgactgactgaatgaaaaaagacattaccactgaccccacagaaatataaaagaacactcagagactatgaacacctctgggtacacaagctaagaaacccaagaggaaatggatacattcctggaaccattcaacctcccaagtttgtgttaaaaagaaactgaatccctaaacagaccaataatgaattttgaaattgaatcagtaaataaagagcctaccaactaggaaaagcccaggaccagttagattcacagccaaattctaccacatgtataaagagctggtaccatccctactgaaactattccaaaaaattgaggaggaggcatccctccctcactctatgaggccaaaatcatcttgataccaaaacctggcagagacacaacaacaacaaaaaagaaaacttcaggccaatatctttgatgaacacagatccaaaaatcttcaacaaaatactggcaaaccagcagcacattgaaaagctaatccaccacagtcaagtaggttttatgcctgggatgcaaggttggttcaatataggcaaatcaacagaagtgattcaccacagaaacaggactaaaaacaaaaactacatgatcatctcactagatgcagaaaaggatttcaataaaattccacatactttcatgttaagaacgcttaacaaactaggcattgaaggaacatactttaaaataataaaagccatctatgacaaatgcacagccaacgtcacactgaatgggcaaaagctggaggcattctccttgaaaagagaaacgagataaggatgtcctctcttattgccactcatcatagtaatggaagtcctggctagagcaataaagcaatagaaagaaagaaaacccacccaattaggaagagaggatgtcaaactacccctgtttgcagatgatatgattctacacctagaaaaccccatagtctttgtccaaaactccttgatctaataaacaacttcagcaaagtttcaggataccaaatcaatgtacaaaaatcagtaatagcattcctatgtaccaacaacatccaagctgagggccaaatcaagaatgcaatcccatttgcaatagttacacaaaaaagtacctaggaatacaactaaccaggtggtgaaaaatctctacaatgagaatttaaaatattgctcagtgaaatcaaagatgacagaaacaaattgaaaaacattccatgcttgtggatagaaagaatcaatatcattaaaatggccatactgcccaaaacaaagtacagattcaatgctattcctattaaactaccaaaggcattattcacaagaaaaatgtattctaaaattcatatcaaaccaaaaataagcttgaatagctaagacaatccaaagcaaaaagaaaaaagctgaagatatcacatttcttgacttcaaactatactacaatgctacggtaaccaaaacggcattgtcctggtacaaaagcagacatatagaccaatggaacagaatagagatcccagaaataatgctgcatacttataagcatctgatgtacaacaaaataaataaaaacaagcaatggagaatggactccctattcagcaaatgatgctgggataactggctatacatatgtagaaaaatgaaactggaccccttccttacaccatgtacaaaaatcaactcaagacggattgaagacttcaatgtcaaacctaaaactataaaaacacaaagataacctcggaaatatcattctggacataagccctggcaaagatttcataacagagatgccaaaagcaattttaacaacagcaaaaattgacaagtgtgacttaattaaactaaagagcttctgcatagcaaaaacaaaacaaaacgaaacaaaaaaactatcaacagagtaaacaggccacctacagaatgggtgaaaatgcttacaaactacgcatctgacaaaggtcaaatatccagaatctataaggaacttacaaatcaacaagcaaaaagcaaacctcccacttaaaaagtgggcaaaagatatgaacgcacacttttcagaagaagacatacatatggtgaacaaggatatgaaaaaatgctcatcatcactaatcatgagagcaatgcaaatcaaaaccacaatgagataccatctcacaccaatcagaattgctattaaaaagtaaaaaagaaaaaaaaaaacatgctggtgaggttgaggagaaaatggaacaaagcagtttggtgatttctcaaggacctcaaagcaaaatgaccatttgacccagcaatcccatttttaggtatatacacaaagataaacaaattgttgtaccataaagacacatgcacatgtatcattagtatcatgctattcacagtaataaagacatgaaatcaatcaacctaaatgcccatcaatggtagactaaataaagaaaatgtggcacatatatgccatggaataactatgcagccataaaaaagaatgagatcatgtcctttgcagcaacatggatgcaactagaagccattatcctaactgaactaacataggaacagaaaaccaaatactgcatgttctcacttagaagctgaaggtaaacgttgagtacatagggacacaaagatgggaacaacatacattgggggctgcttgagggtggacagatggaggagagtgaggataaaaaaactacctataaggtactatgttcattacctgagtggcaaaataatctgtacagtcaaaccctgtgacacacaatttacctgtataacaaaccacacatgtatctatgaacctaaattaaaagctttaaagaaagaaaagtgttggaaattactcagaatcatttgaattactcacccgaccattccctaaaccttttgaattaaaataataatatgttttcagttacaagagacaacatatgttaagatataacatttattttattttattttttgagacggagtttcacttttgttgcccgggctggagtacagtgctgtgatctcagctcactgcaacatccgtctcccgggttcaagcgattctcctgcctcagcctcctgagtagctggggttacagttgtgtgccaccatgcccagctaattttttgtatttttaatagaggtggggtttcatcatgttggccaggctaatctcaaactcctgacctcaggtgatccacccaccttggtctcccaaagtgtagggattacaagcatgagccaccatgcccagccaagatataatatgtatttatcaaagttttatgagttacaataacaaagacatggaatcgacctagatgctcatcaacagtgaattagataaatacaagggggtacatatacaccatggaacactatgcagccataaaaaagaataaaaccatgtcctttgcagtaacatagataacagcttgaggccattatcctaaacaaattaattcaggagcataaaaccaaatactgcatgttctcacctctaaatggtaactaaatattgggtactcctggacataaaaatagccactgaaaattaatagacagaaattgggtggggtaggaagtgaagaagcgggggttgagaaactaattattgggtactatattcactatctagttgacaaggtcattcatatcccaaacctcagcatcatgcaatacacttatgtaacaaatgtgaacatgtaatgcctgaatctaaaataaaatatgaaaatgtaaaataagacactaaaaaaagaaaaggtagtggaatacttccgtgtttcactgtgactgaagaattatcttaaaaaaataaaatccataccccaaaattttatggtcaagaacattaacctactggaaaaatacagttatactaattatgtattggtgaaatcttttttcacatcattactttgttgtctaagaaaaccactagcatatggctagctatttagcaggataacaatcatactgcaacctaagaaaagtgatgatttcttcttccatcatttcaaataaaagaaaatcttatttgtagtccctataatatgagaattgtagaaaagttgcctatgaccttcttttccttaggaccctggatacatatagtcttctactaaggtccctcagagacatttgtgttgcacatgcagaatctgaatgatctcacataatagctttgctattgtagtactggccactaaacaaaataaaaataaaaataaagaaaaagggagtaatcctcaggaacttttatttttaggaataaatgtatctgcactttcccacagtcttcaggtaaccaacagaatccaaatgatatggaattgtcagtaattatcataggtaaattctgctaaacaattcaccttaaacacataatggactttaactataatcacttcaaaagaacaaatgaaaaggcattcatgggaacaaaatacaacctgaaaatataatactggcaaagattaagtgaacatagatgcctagagttatctgcatgatctccaggattagataacctaacaaagttggtaagtcatgtaactttgatcccactcagctcttacacattttagcgactatatgaagcatgaatagtatcaccatgtagtagacaatatgtggttgccaatatttcattccaatcctatggtatgatcctgcaactaaacatttattaaaaatgtccacatctttccacatttttctatctaagcccatagatttcattgttttttaacatagaaacttgatatctatagtcacttggtaaaatctgagccataattatcaattatatttttgggggtagaacatagatacaactgtgaataaaatataaatcaaaacatgtatactaaagttaaattgtttattcaactaattactcatattcatctattttattcatggtcattgatatactctataggcttctttgcaagtgcttcatttatcttatagatcttctgtctttttcctccctccactgcccttgctctgtgcaggtatctctattcctttctgaccagccctttttcatcattccaagtctattcaggaagcagaaaaaaacactttaaataagacttttttaagtttctattttcttcccttaccaaaacaaaaatttttacaatgtaccatgatagtgaatgaacttttactttatattgcctaagaaattattgtcatgtaaagtcattttttagtaatatactcatttagtaaagtaacttgaggatttttgtatatgtatctttgtaattgaagtaaatttctcaatatgggattcagatgtcttgtataagaaacatctgtgtacttttctcaaatgctgatgtttatgatggtccccatgggacaggtccttctttggggaaggagtagagaaatctgaaagtttaagatgacgctcagaggatcacggtatgtactactatttgagaactgatcaacttacagtacttcttctcatatctacttttgtctcttaaaaatcactagaaattcaaaaagttaaaaatgccatgctctttcaggcaatcatctggcacatggtattataataaatgggataacaaatccagagaggttaacaaagtccccaaggtcatagagcttaaaaagggttgagccagaatttaacctcaattccatctaacttggaagcttatttcattccagaggtttgggccctaaattaattttagggcctaagaactcttggcccttcagagtcatatataaaatttttttagttgaaggatttgtaccaaataattatgcctgatgctgtggaatttgaactaaaatctagtctagagaggttaggacttgatggaagtcacagagctgatgcagactcaaatttccatggtctttgtacacatatttactgcctctttcaaatttatcttttatagtcaaaaatatagttatttcttatgtattcataaatatttccattggaaaatctatgttatgggtctggtaccactgtgtcattaggaattgttatcaaaacatattataggtataatagaaggaacaaaacctacatgtagagagagcaaagcaggcaaccagaagtcatctctagcccttacctttacaatcactgtgacagtagcaataccaggtggcattgttccataaatatcaaaggcctctaccagaaaagtgatacttgcttcttggtctggaaatgcctcataatctaaactccttaaaagcgatagttctcctgtaaatggatgtagtgcaaaaaagtgcttcacttctgggcttcttatccggtaagacacatttgctccaaggtcgacatctttggcctgtaataagcagaagaatagttttattagtgacgttaccaaaataaagaaatgcaggaaggatggaagtcatgcgttagtgcctaggacagcatcaatttaacgaggacaaaaagacacgttttttgtttttgttttttaaaaaagcacattatttaataatttaccagggaagagaaggagggatgggggagagaaagatggaggcagggaggaaaggagggagacagtgagagggagagtcagagagagagagagagggatctttctataagattttgtcattgttgacgttattactgtatctgtttaacttgaaaaatcactaaatgaactatatcacagtaaaaaaataaatattgtcttaaatgactgtttcttattttctactgatttgataatcatgaacaaatattttaaataaaaataaatactgagtgatttccataaacataatagatggctaaagtactataagaaaactgagaaaatataagtagtaattatttgtcacagggatcctataatacatttctagagatcactctaccatacttcctttgatttaactaggatttgagtagtagttacgcacaaggtgctgtagagagcaccaaaatgaatccagacacaattactgccctacaggttatggtctcagagaagaaacaagacacaaatactaaaatagaaaggaaaaaaatgtgacatgctatctaaaagatgttctaaattgggaacgatatcctttagctgaaaggatgggttttcatgggagtcttgtagaatggctatttcactcagcagtacagactggcaaatgcacctcaggtacagaaaaccgaatggagcaagaatgaaaatggggaagatccagagtatgctataatgtgcatttttaaatgcaaacacctcctatggtgaacctcagccttggtctcctccaatcaattattgacttaacaatcagaaagatgctattaaagcatacattttattatgtggtttttcctgcttaaaatcccctggtttttaattcaattttcaatcaacgccattatccttaacatggtaagagccactacattttctagacctttagcccctcacccctcacactttcccatcttccatgattttgaccaggctttttccccccaactactttgaacaatctttcttccttttctgcttggatagctcttacttgtccctcagttcaccatttagaaataagtttctctagcaaatattctctttgccttaagattaggttaggagctccacctctattacctaggccctttgtactgaggacctacgttttaactactaattttcttgactgatagctaaaccagcctgaaaactcgaagaaagcagtaaatttgttttgttcacctttgtatccccaaagtctttgcatcccctaggacagcatgaatttaacaacaccagcaggagacttggcatactatacatactgaagacatgtttgttaaataaataacttaactaattaattaattgacagatgaatggtggaatagatgaaggaataattgttctctccctggccagtatttgccttatttagatttgttaatgtttattgctgagttcaattatggaagggatacagagtctggaaaagtatgctaaaaacattcaagttgtggactgcaggtggaaaaatggctacttttttttttttccaaaacataccttatagaccaactgagtcagtattaaatgaggtggttgcttaaaaatgcagatttatggatcagcctaatctactgaatcaaaatgttcaggactgtgtaatttatagttaaaaacttaaaaaagaggcttgatacagagatgtcattaaaaaggagagttagattactagaagatggcttttgtgtattgaatgtgaaaacaatacagaataatgggtataaacaatatttgtaaaatagaggggaaaccaatttgtaactctctatattttttctgtgtgtacacatttatgttatatatgtataacccacacaaattcatatatatatatgtattttttgacatttgtgtgaacacaaagataaatgtgaaataaatttaatgctgagtactctggaggcacaatgtgggagattattaacttttgcttcataaactattgtattgtcaactgttggaataaacagaatattacttttgtaaattaaaaaactattaaaaagtatatttttaatttcttacaaatagatctttctgcccttaatttttgggatatctttaaagtaggcttgccacataaaatacaatatgcaatattggagaaataataaaaatttattcattgtttatctgaaattaaaatccaacttggtatgttgtattgttacttgctaattttggcacacaaaccctaatagcaaatctcctaatgtaggattcatgtaataaatgctttttcccacacacctctatttgaaggatggtagtcccagctggcaaattctcttcaacaaggacagtgtatgttgaattggtgaacacaggactgttatcatcaatgtccaaaaccttgatggccaaggttagagttgaatgacgagggtgtactgctccatctgttgccacaacaacaagttcatagtagtccctgacttctctgttaagcttcactgctgtgtaaatgctcccattggatgtgatacgaaaaagattattaaagttacccaaactgtagtgcacttgaccatttattccagcatcagggtctgttgcctattaaataaaacaaaaaaacaaaaaaattcacgtaagttttgacgggctactgtaaatgaaggtaacagttaacaaattatggtatttttctaaccaaaaattatttggccctctaaggaggaaatgacaatgacaatacaatgcaaaatttaaaacatgaaaaatattatactttaatattcttcatttaaaattaacataacaaaaacggataatgtcattagcaataacaatactatgttatgacagaaaactcataaaaatactgaatctttgtcttatgattttaataggttttgaattctaaagtgagaaaaaattttgtttgtaattcatttaacataatctgccgagtgacaatttaagattatgtaggtttttgctcactgtatatattcattttatatttatatatgtttagtaataatgttacacattatgtttgtttataataaataatattttattatgttatgctgttatttatgtgataatgtttattataataaacattaatcatatttaccataaataatatttataagtataacctgacttaatcctcatgatgttgttatgagtaaatattattaatctcattttacaaatgagaacactgtggcttatggaaggttacacaagaaagaaatatctcagtgtcccagttcttaacacaatacttcatatataaaagtacttaacaaatgcttgtggaattaatgaacattagatgaaataaaacagatttgaaactaaatctgttccaaaagtcaaataggattaaaactacagtaactgtaatgtatgtgcaagggactctttttcaacattagaatatacatctctgcataagtaagaatgtttgataccataatatacctatatttactgaaaatttgaagtcatgtaaaatcactttgcatcaaataaaatgagaaaatattgagtaaatattcatcgaatgaaatgtaataagaattaatcttagctaaaactcaattgtgatactaattatgaatctcactatcagctactgtatattttgttttgaaaagttccatgtaaaagaaactgaaataaatcttagaaactgtaaaatattatataattatgccccaaactgtcaacaaggaaaggaaggaaaacaagacacttggctgccttatgagccagggacacaaaaatcactcgaggtccataaagcgtggaatgcaatatgatgtattttaacagcacatatgcagtggtatatccagttttacaggcaatggtaaagcatgcagaatggggatgctgaatatttgcatcttctttgaaacaagaatgtctaagatgtgaaaatcatgtttacaacagtgctcctatatgtcataatgccaagcatttcagcaggatttgtctctttgactcatcaaaacacaactgcccctgggagtttgacatctctgaggtttaattctgagaaaagatagaagaattgcagaaatacctgaagagaaaaaatacggtgacagagtagaatagtttctgttgatatagtttcttttacttttatactttgcctagaatttgtcttacgaattattgacaaatcagtcaagctgatcattctagtgaaaacaaccaacactgccttctccctttttcaccaaaaaaagagggtgatctctttttttggtctgaaattactcatcaagtaaatagataaaattgtaagccaagaacaaaatataaatatgttttgtttcataataataatacccttaaaaatttcagtcactttttctgtctatggaatatcttaagatcaaaaaaactaatcatttatgcaattagaaatttaaatgactcttgttcaagttgtttttattgacccatataattgaatatttattatggtagaatggctcaatttgactgatgtggctgtgtgtccgtgtgttttatacatgtccagctgcttaactatacatccactaggaaacatatctaaacatatctaaattagttttgtttttgctcccatagcaaattatcacaaatttagcagctgacacaaaacaagttcattattttaaagctctataggtcaaaaattcaagatggtctcaccagggctatgtttctttctggagactctaaggagaaacaacttctttgctcattcaagttgttgacagaattcagttgctagagtttgtagaactgagatccccacttccttgatggttgtcatgtgaggaccaatcccggttgctagaggtccccatatcccttggttcatgacacatttccaccatttttttttttttttttgagaccaagccttgctctgttgcccaggctggagtgcagtggtgcgatctcggctcactgcaacctccgccttctgggttcaagcaattctcctgcctcagcctcctgagtagctgggattacaggcacctgtcaccatgcccagctaatttttgcatttttagtagagaccgggtttcaccatgttggtcaggctggtctcaaacccctgaccttgtgatccacccgcctcggcctcccaaagtgctgggattacaggcgtgagccactgcgcctggccatttcttccatttttaaagccagcaatggtggtcaagcccctcacattttttgaatccctccctccatctttttccattttatctttctgacctactcttcaggcatcctccttcacttttaagggcatgtaagattacattatgctcccttggacaatccaggatagtatccccatctcagaatttttaaccttgatatatgtgtgtgcacatgtgtgcaagtgtgtgtatactgccatatataaatatatagcaatctatattttaggatgggatttttttttttttttgaaacaggtcttgctctgtcacccatgctggtgtgcagtggtgtgatctaggctcactgcaaccttcacctcccaggctcaagcaatcctcccacctcagcgtcctgcgcagctggcactacaagcacatgcccccaggcctggctaattttttgtatttttatcagaaacggggtttcctcttgttgcccaggtcagttttgaacttctgggcttgagccatcctccccctttggcttctcaaagtgctgagattacaggcatgagccatctcacctggccggataggagtttttagagaaaatatccaagcagatattcattaagcagactgacagtaaatgctaaatggggcatcctcaccaatagagtttcagaattttaaataatcagtttaaattggtataaattacgatatgtcaagtacacacacattttgactgaatctatgacaacttaattcactgaattcaaagctaccatgacaagaagtatatttgatgcttatggaaaaaaagactacaatatctttggctctgtttatatgctggattacatttactgatttgcgtatattgaaccagctttgcatcccagggatgaagtccacttgacagtagatgcagaaaaagcgtttgacaaaattcaacgacacttcatgctaaaaactctcaataaattaggtattgatgggacttatctcaaaataataagagctatctatgacaaacccacagccagtatcatactgaatgggcaaaaactggaagcattccccttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagaggataaaatacctaggaatccaacttacaagggatgtgaaggacctcttcaaggagaactacaaaccactgctcaaggaaataaaagaggatagaaacaaatggaagaacattccatgctcatggataggaagaatcaatatcgtgaaaatggccatactgcccaaagtaatttacagattcaatgccatccccatcaagctaccaatgcctttcttcacagaattggaaaaaactactttaaagttcatatggaaccaaaatagagccttcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgctgcatatctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagacttaaacgttagacctaaaaccataaaaaccatagaagaaaacctaggcattaccattcaggacataggcatgggcaaggacttcatgtctaaaacaccaaaagcaatggcaacaaaagacaaaattgacaaatgggatcgaattaaactcaagagcttctgcacagcaaaagaaactaccatcagagtgaacaggcaacccacacaatgggagaaaatttttgcaacctactcatctgacaaagggctaatatccagaatctacaatgaactcaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaactacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactagaaatcatgctgctataaagacacatgcacacatatgtttattgtggcattattcacgatagcaaagtcttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattgtcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataataaaaaaaagactacaatatcccccagaaagctactctaaaaattttaaggtgactgagacacacatctaatggaaacaaagggaacagaatataaaatgcagagctatttccttatctattcctatgtccccattaaattaaggagcataaataaggtgatgtaagttaagcaacatgagctggctaagcaaggcagttttacttctttactattctagatgaacatgtagatgttaaacaagataaccaaacatagaatcccttattatcagcagtactgtcaagaactttgcattgatgtttaatatttagtcaagcagctcagtgtatgatgctataatgaaaatatatattttcctagaaatcaattaaaagttaattaaatttgttaataagaaaaataacacatctcttttccccttgtactacatcaaagcaatgaacagtaatagctgcaactttataatcatctgtccatggttaacacatttttgtaatatacaccttactatggggcctgatttgtggctactaatttgtgaatgcatattgctgggaaattggctgatagcctgtagtcaaataaagacctcactggacagaactttgaataattgccagaaacaccacttgcaaaccttattcattaacaccaaagttagagtatatgaaagacaaccaagtaattacttaagaaaaaagtcaagggaatttattgaaccaaagttttttgtataatttttgagaagcgattttatagcatgccacttgaaaagggaaaagggaaatatatttcttaaacactaaattcattccccacccctttttttctcattatcttcttagaatggtctgttacacaattctttccatccataaaagtggaagtccattactgggtttgctaccctgggggttaccagtcctgtagagaagaccttaaagcatgcctgtatgggtggaatatactaggataaaacctcaaagaacaggttgatgtttgcactccttccactgagaagtccctgggtaggttacttgtgtaatttacaatgattcatttccatttaaaatatgtcaaatatccattcagattaattatttagatagaaaattttatgacaaaaatcagccccaaggaaataacttgaggacaaaaccaaaatgttatagctattataaaggtgtgaactaccatgtagcacctaattggcccagtgtgaagctgagagagtgctttgctctaccttttgcttgtcctttacagcgatttaagaggtcgtgtacatctttctcactttgaagtgggaaccataaaagctgttgatcagggaggttgggcagtgcatccttcatgacattattagtgaaaatacatttttaaaattattatctattaacttcaaaaagatgtacaatagttgtctttttttttttttttttaaggagctgagctatttcaagggctgtgattattagtgtaaaaggagacaagcaatttaaagactcataatgcaggtaaattttttcactctccacacaaatgcctcataatcattattgaacaatggcaagtagacttactggccagaagataacttgcataacttgaattaaaatcactaaaaacataaccagaatgaatagcttttcattctagtccctagaaatctagtccctagaaaacacatatttaacacaaataatttctcaaggggtcagctattattctaagatacacaataaactacattttatcctagcattcaaggctctacctggtcttgttctaacctatctttatgcatttatatccctcagactaactctctgacacaaactctgtgttttagtcaaaggagtctatttatggtatgaatcaccaccaagaaactctcaagtgtcagtggtttgttaccactgatgtttctttctcgcctatacagcacccactgtgaattccaaatccagctttactctatcttgtctttactcagaagagaagctaaaggagcaggcttcattggaatatgaagctcatgtggtgcaagaagaaaaaaagacatgagatagccaagctgcagcttttaacgcttctgcttggaggtcaacgtatcacctatactcctgcttcatcgttgaaggcaaatcacatgacaaggccgatgtcaaggggtgcagaaattccattccctcacacagtgggacagtgataaatcagaaacacttttacaatgtactaccctggttttccttgaaatgaccatgctctccctcaccttccctgatataggttttttttttgtttgtttttattttcccccaatccaacttaaacgttcaaaacctagcttcagttctacttcatctgggaaacctcttctttccatccagccttctggtccctcttgcacatagcaaaactcactttttattgctatttaagtatgctacgcaattaaataattggcctaaaaatctgtggtgtatccatgtattatgtaataggagacactgttagagaaaagaatctgtaaattgttttgtggagtgtacaatgtatgagaagtggaaagttggagcacagatggaaatatggtagagaaggaaaaaaaaaagatagcaagcaaataaaaataaacaatattcctgtagttgggtgttatttaacgcaaatgaactgaaggtgtcaaattaaataagacagtttaagctgttccaacataacctgcaggcctcttactaagtaagcattaggaagaaactttgcactaaaaacctttacatattcagttctcatgttaatggtaaacacttgaagattatgacatcaatgcttcaggaaaagagttgttgtcatgttcacgctcatacagcaaagaaagaaagtaatgttgtttcatgttcattaaatgtatttacatagtaaggctgtcttttccctttttcaaatattccttatagtgctgaaaacgaagaggaaaacctgggaggactcatttcatatttccccaccattgcttagtatttgataattatgcagtataggttgagtgtgtatatacctctttatgtgatggtaaaaaaaattatatattaaattatatttagttttccaacctcttcttacttctatttctccaacttcttcattctcatctttttctctgtgggcgaacatattcttaccactaaatctaagtgcattttgccatactaaccatgctatttcatgtctgctttatccagtcataaaatcttccccttatttccaaaactgattattcttcagccctagtatcacctctcagaagcatctgagtaagctaaatgcctcatcttcatgctcctgaagctcattgtatgtttctttaccacatgccctattgctttttttctgtcattttttaatagcccacatgaaattaagaattcataaggacaggatggcttatttatatcatacaatgcctgctttatttttctttttgcaatgacataggttagatatgcaataatttctgccaaaatttcttctgaagctatttccatttttcaattacatatcattcccaccccaaccacccaaacacatgaagaaataaaaattgccaattagtatttataattttgtcttaaaagaaggtatgttttctgtttattagaagaaatataagaaaataagacacattttgttctttaaataaaacttaagtgatcacataactacttattaaactttgtccttttgttacattttattgctttcttgttttcaattttgtcactatattagtcagttttcacaatgctataaataacttcccagaaactgggggatttataaatgaaagaggtttaattgactcagtttcacatggctggggaggtctcaggaaacttacaatcatggtggatggtgaaggggaagcaggcaacttctttacctggtgacagaaaagagtgaagaaggaactcccaatcacttataaaaccatcagatctagtaagaactcactcactgtcataagaagagcatgggggaagcctcccccatgatccagtcaccccgctccttggacaagtggggattataggtccctccctcaacacatggggattacaaatcgagatgagatttgggttggtacacacagccaaaccatatcagtcacctagaattctttaaggaaatctatttctaggtcagttttaaagtaagtacaatatatatacctatttttgtataattaaatatattagtttaacttttaacagtctattctagcattgcttaacctttttcattatcaactcctgtcaaaagaggattttaagatttttttctttctaatagaacccttataaatttgtacttccacagatatatttatgtatatatattatccatgctttatacataagaaaagtaaggttttcttgtctcccaaaacctgattttccacattggaaatgatctaccaccgttgagaatgcatgctctagccaaaagagagtcctctgtaacttccttatataccataaacatttccacataagcattgttctttcagcactcattacagtggcatcactttctaaaatgtctgtccatattactatatggggcaactcagggtatctctgagcttgtactcaatactcatcacttcttaagtaatgaaataagggaaaaataccatctccatgaattgcattttatgtgataatctgcttagcccaggccttcctatttatttgattatgcttacattttctgccaagttataacacaaagtattgtggtttgttttctgaataactattttaaatagtcttctctatgcttattgaatatgtgacattttgcttatcaggtgtttttataggtcctatatactaatccaagttttaattttcttttttctagtattctgttgggttcaatataaacatgcccatgcccttctctgaagagtcaagagtaatgtataccttaagcattgtccttctgtcacagggcttttcattatattacattgtctcacaaatcattttcttgtatcatttctagaaaaaaaattcttaactggaaactgaaaagaatgtgacagccagattggattctctgtgaaattctatacaattaaattttctggataacattcaagtaaaggattaacagaattgtaagtaaaacaagagcaataaaaatgcctctggctaatataataactatttaatgagagaaaaatatctcttaatttcccaatactatcaatcatttcatttgctgaatataagctcacgtttttcccaaacaatacccataaaattaaaggtgtttttctctattttacacacattgtcacaatttgacctaccttgataacatcacagggatagagccagatataggttccagttttattttatcatcactcattccttgagctagtttagtaattttcagctgtttcattaccttaatttgggatgtctccaaattggttgatttaaaaatgtatgttaggtattcattttgctgacaacaattcactgaagtaactgaggatcatgttttctaatgtcttgtccaacacagtaatttaaattaggaaaacagaattaattggaagaaacaacttatgtttctctatctactccctgggactgcattcaaagagctaagatgtacacaatgtgaaactgccttttgaattagaagttatgaactcagattctgctgtgtccttccttttccagctgccttccttcagatatactttcctagtaccttcctgtgtgctactatgtaaatagtaggtaactattttagaatcattcctcagcagcaggctttatgaaaagtgctgtcagtttgttttctttaattgtggtgtaaacagtactgctgcttaccttaatattaattatatacacacatttttagaagttacagatatataaaagggccaggtactttattaacatccttttttctttctggtaaaggtaaaataagccagattggagattaaaaagtgtaggaaacttcatttggatgccattcctttgttaattgttagcatgtaggcaataagaggaatatttcaatatcaattggccaagcagaaattttcctgagaataacagaatgttttcaatgacatgttatttatggagtgtaactgttccacaggagcagtctagtcagtagaattaaatgatactgtatactagaactggaatctgagataaaatagaagtggtaagtttacaggcacactctgtttcattgcacgtggctttattgtgcttcacggacgttgcattttttacaaattgaaggcttctgacaaagatgccttaagcaaatatattggcaccatttttccaacagcgtgtgctcatttcatgtctctgaggcacattttggtaattctcagaatatgacaaacttttaaattactactggatctgttatggtgatctatgattagtgatcttttaagttactattgtggttgtgttggggtgccgcagaacacaccatatgagagcaaatttaattaataaaggttctatgtatacatttttttgacacatggtccaagatgagatggtgtatgtgttctgatttctccacccactgaccattcccccatctttctcactttccttgagccttcctattctctgagacacagtgaaattaaaattaggccaattaataaccccactatgtatgggctctaagtgtttaagtgaaagagttgtgtgtctctgatttgaaattaaaagctagaaatgattaagcttagtgagaaaggtaggtcaaaagctgagaaagcttaaaaacttggcctcttgtgccagttagccacattgtgaacgcaatggaaaagatatttcataaattaaaagttctactccagtgcaaacacaaatcataggaaagtaaaacaacctgatgtgaagctgatgtgaagaaagtttgagtggtctggatagaagatcaaactagccacaacattcccgtaagccaaagcctaatctggagcaagaccttaactctcttcctttctctggagcttgagagagggaaggaagctgcagaagaaaagtctgaagctagtagaggtgggttcatgaaatttaagggaaaaataaaaagccatctccataacataaaagtgcaaggtgaagcagcaagtgcagatgcagaaggtgttgcagctagttatccagaaaatccagctaagatatttgtagagggtggctacgctaaaaaaacagatttccaatgtagataaaacagttttctattagaatatgccatctagaacttccgtaacttaaaacagagaggtcaatgcctagattcaaggtttcaaaggatgggctgactttcttgttaggtgctaagagctggtgactttaagttgaagccaatatttattgaccattctgaaaatcctagtgcacttaagaattctgttaaatttactctgtctgtgatcaataaatggaataacaatgcctaataaaagcatatatttatggaagcataaactatgtttacagcatagtttagcaagtattttaagcccatggttgagtcctactgctcaggaaaaaaaaaagacttctttctaaacattactgctcattgagaatgcacctggtcactcaagagttctgatggagatgtaaaaggacatcagtgttgttttcttgcctgttaacacaacttccactctgcagctcatggataaaggagtaaatttgaggttttcatcttattatataagaaataaatttcataagattatagctgtcattgatagttattcctctgatggatctgcgcaaagtgaactaaaaatcttatggaaatgattcaccattctagatgccaatagcaacatttttgattcatggaaggaggtaaaaatatcaacattaatagaagcttggaagaagttgatttcttccttcatgaatgactctgagaggttcaagagaggtttaagacttcagttggatgaaggaattgcagatgtgatagacatggtgagaactagaattagaggtggagcctgaagatgtgagtgaattgctgtaatcttatgataaacttgaacagttgaggagttgctttttatggaagagcaaagaaagtggtttcttgatatgatacctactcctaatgaagatgctgtgaacattgttgaaatagcaacagataatttagaatattttatatactttgcagcaaggattaagaagattgactccaattctgaaaaaaacttatttagctacaatgctatcaaacagcatcactagctacagaaaaaaatttaatgaaagcaagaagtattcaatgcagcacaattcattgttgtcttattttaagaaactgacacagccatcccaacttcagcaaccaccctcctaatcagtgagcagccaccgacagtgagacaagaccctctatctgtataaagattaagacttgctgaaggttcagatgattgacagtatttttttaagccataaaacactttaattaaggtatggacactgtttttcagacacaatgctaattgcagtatggagtatacttaatggagtatagtatagtgtaaaaataatatttatatgcactgggaaacctaaaaccttatgtgactcgctttgttgcaacatttgctgtattactgtggtctggaagagaactctcaatatgtctgaaatatgcttgtattaaaaatgtgtattgctttgagaaacagaaactctacaacctatctaccaagaatctttgcagataataaagaaagaagttattgacttatttcaaacttaaagtctgaggagtctaaatggagactgaagttacgtctaacatgacaagtgtgaaccactttgatttggtttgcccagaggaaacattactcctgctactttcataaagactgattgcttttgacagaaatctgtctgtgcagagttggatgagtatgatactgagaagtcataaaaccattagaaaagactgggctcagaggatctcctcataaaaatgttcacatagaaggaataagacagtgaaaaagaggctgtatttgctatatatccacgttttgaattatgacacacatagggaatatttccagagcttggtttcagaaatcccaatgaactaattcttctgagatatcataaactaaatagtgggaaagcaagccaaagaaatactgtctgatttatttattttgcagactgcacttagattttttaaaaaagagcctctcactttgattcttgtatgacttgaagaaaaagctatactgtataaaggtgtttgcaggtgggttctctggcaagcagacaatgaggcagagattagttgcaagagttttgttggggtatgctttgggggtcaacatttttggagggcaaaggacaagaccagaattggattcagggagaaagtcaaactactgtgcagggtcaactacagccttggccaacccaaggaaggagctgcagaattgcaattgcatgtcacagtttttctgagctggggtaaaatgtccagcattttacactcaggcatcagtcaggatatgggctacactgaaatgggtgtgactatgggcaagggaaccttctgtagataaggtcatctctgaagtggctagcagctgtacatccctctttactccttcatccctacatcactccaaaaagccaagacattcagctctaccttcaagggagatctgcttggcacacagtcttcataacaagcctctatcttggattggtttttttcttagagtataaaatccttgcttaacagaatatagcaaattttatacacatacacacatatattaaattattacaatatcattcattgttttcaaatgaaacagccagctacattattacctcaaaggtgaaaaagtctagggtttgatttttttgatccaaactaatatttgtcattttccacccctgtgcccagagacgtaactcatattttcctgttgaatttgtttcccaagtagaaacagaagtcttaaatatgatgaactttaggttttttcttttagttcttataaacacccagtatggcagttattattgtccatattttacagccaagaatatttcagaaaaacaaaaaataagttcattttcctttagctagcaaataagagtatttggatttgaatttagagtatgaatgtgccatctgtttgtaatttttgtgcaggtaggggatgctgctataactagtgtagcattattaattattctagctgcatgatagattggagtccagagatagaaagatgagctggacataatttagaattcactctgaattattttcatgatggggattaagggccatatcacacaaatacacacttgaaggttatcattacatagcccctcagactttacatatatttcattagaaaaataaaaatctaagttacagagaattgtcagtgggttccctcaatgtctcccttactctgtggcaagctagtctgacatgatatctaacagaaggaaaaacatacttcagataagtcatggaagtcataccatgaagtcatgagaattacagtatatagtgtgcccagagctgtgaattccactaattattttgaaacattgaaatattcatttcaaaataaatctataaaccatccaacatctgtacttatctttatcattctcctgctgctaaaattgaggaaaactccacttcctcctaggttctcaagggaacatatgacacttgagcttttgggactctgttgcctctctttctggcatttctacatccctctttactccatctattgccatcagttttcaaacctgctgaagaatttatcattacaaaataaagagaaatgagaaagaaaatataattgcttcctactatgtctgttttcctacaatctcttcacatcccaagattctatgtgagggcagtgggtgggggaagaaaaggacaacatatatatccattgcactcatttattaatgagttattttgttatttagtcatgcaaatcatgcactatacaaaacatacactatgtttcctaatactgtttacttaattactcttaaaaagtcataattagttctttaaaatgtaaaactaaaatatgacaaatgatgccatctttgctattgagatggtttggctgtgttctcacccaaatctcatcttgaattgtagctcccctaattcccatgtgttgtgggtgggacctggtgggagataactgaatcatgggggcggtttcctccatactgttctcttggtagtgaataagtctcatgaggtctggtctgatggttttataagaggtttcccctttgcttggctctcattctctcttgcctgctgccatgtaagacgtgccttttactttctgccatgattgtgaggcctccccagccatgtggaactgtgagttcaataaacctattttttctttataaattaccctgtctcaggtatgtctttatcagcagcgtgaaaatgggctaatacatctatattcagttactaaatgtgttctgtgaatgaagttggatgttgaatgcagatgctaatgtactgccacatgccagttagacacaattatgtatgtatggagatatatataataaagggtacttgtttaggaatattttacaaaagcatggcctgtcagtgtgcaccatacatttcagagacatgatgaaaaaacattaccactagagtgtcacactacaaatgtgattttttgaattctctataaaaatgtcaatttcccaagcttagcatatatgtgtgtctaaatgtaatggcaagcttcataaatgatgagcatgccaatatacgaagatttggatgcaattatttactctaaaacttcatcaatattatgtggttgcaggtaacttttaaataggcccttttggatctcacatgaattgaaataggaaaaaaatctatttaaagaagtcctgaagtagacgtatatgcttaatattaaacattgtttgaaattgaagagtctggcttaacacactaaattaagaaagaagaaagaaagcaagaaagttggatgttgaatgcagatgccaatgcagtgccacataccagttagatagcatgtggcaagttctaatgggcacaaaatgtgccttgttcacattaatgctttagtgtagcactgaatttgcctctcagtaaatgttaactaaatttaaaaaatagtattattttccccaaatacatcaattcataacattacaaaataattatgctataagtttgatttgacttaaccatacatgttttcatccatcaattcattcatttattcacccacatttattgttgactttaagctgaacaacattttcagggctggggctctaactaaggacaagagtaatgtgttctttgatcttatgtcacttgaaccaaggtgaaaaagtagatattaaaaaataattgccttttaaaaattattacagtgataaacctaagtaataaagtaaatatgcattgcataataagagcatacagcaggacttttaacccggcctcctgaaaattacattctaatgggaaagacaaatgtcaaccaaaatattaagttacgaaaataaacaacttcatattttaatggacattatgaaaaagtaaagtgaactatgagagcacataaatataggtacttaaatccaatattgtgggttcaaaaaggaaatgacattcaacagcatccagaactcttaaactttagttttcacactgtcaggaagtttggaatcccaacggtgactttcacattacttgtattaaataaaagtcatgacaaaatgattacatttttcccattagtttacaatatttgtaaatacaggaaatgacaatagatacagtacctcttgatgttagtaacattcttgagattatttgatattagtaacattcttgagattatttttagtaattaagatagaaaaaaaatgttttctatataatggcataatgacttagattcagggatgactgaagaatcattctcaagttgaatgtcaaactggggaggctctgatggcacgaagcagctttctataacaatttcccatggatgaaatattgccagacatttttgtaacgtcttgggtgatggtaaattctctcttttaagttttagggaatcctattaattaggactactctctccatttcatagctaaggaaactgagtttcatatggattagatcatttgcccaagtcaatagttactaagtgatgcagctagaatttgaatgcagacaacctaaataggaatatgctatatttgcaggcagtcaaaaatgctgtaaagaaaatttaatgttggtaaagggaaagggggtatacttgtttctggaggacagggagagtgctattgaaatggggtactcagtgaagtcatccttgcaaaagatgtctttttgaatgaaagagtgaatcacacagagagttagagaaagagtgctccaggcagaggtaacaacaagtacaaaatccatttgaaggtttggtaagcgtagctgtgttcaagaacagcaagaagcccagtgtggctggagtggagtgatgcaaatgatgttggagagagcaggaggagccaagtcatgtggagatatgaaggctatgaaaaaggagtttggattctgttctaacacaatgagcatccactgaaatgtctgagtggcaaaatggtgtcatctaatttgcatttttaaaatatcactcttgctgtagtgcagaaattgactgtaagaggggtagcacaggtcaaaaagtaagatactatttacataatctaggggaaaaatgattgtggtttagaataggtgaggagtacttgcctttggaatatgtttcagacagatttactgataatgcaagaatcagaagtggtcctaggaagcagatacttaagatgagattttggaatttgctaatttgctagccaaatggcatgcttactgtacaggagttcagagtaagtcatgattcatttgaagccttcacctgagatgaactgatatggtatatgggggaatggggagcctggtttaatgccatatctgtataatttcagatttatcggtgaacattaattcataaaacttacagagttgattggttgctaaatataacaaaggtgttgaaaaagaataaatgaagctcagaaccagcaatatcaattcagaggtaaagagtaaaaaccaatgacctccattagcacgtttaaagaagctccatatccacagacaatgacagactttactcaaaatcatgctcaagatgtaattacaacctgctctctctctctctctttctctttctttcttttttttcgagacagggtctcactcccatttcccaggctggagtgcagtggcacaaccacagctcactgcagctttgactttcctagctcaggtgatcctctcacctcctgaatagctgggactacaggtatgcaccaacatgcctggctaatttttgtatttttttgtacagacagagatttgccatgttgctcaggctggtctcaaactcttaggctcaagcaatccacctgcctcagcctcccaaagtggtgggattacaggtgagccactacccctggtctcaagacataattacaaggaaagatgcaatcaactccctgacaagtcttccacaccagtattggtagggaaggagagctggtctgggcacatgtggctacaaacacttcaaaaaaacatactgattctctggaacttctagactgaaaacttcactttcttttcatttttagatgagaacagtatccctcgcctggagatcaggtaatgacttcatctgaattagataccttaccatcttgtaagcaagatgatagatgtcctctgtacctatgtccctgcattgcttttgcaccaataactaaagtcaagttgcagcatgttctaactgtccctgctatgagtagaaaaggattattcccaaaaagaacagcaggatatgccttatagtattggcagcaccaggaggacatgactgaggatagatcttgattatgttggaaggggttgaagggagaaaagtacatcttaccaagagtttagtggtatggagatactttgtcataattgtggccaggacacctggagttgattctaaggtactgctggattattccccaaaggttgtgaaaaacagtggcctataataaacaaggtgtaggtagtgaaagtgcctggacagggatttgaagttaaaggtatatagaagtgggcattttagcatggatttcttatgtatgaccagagaaaccatctattagttttgttcctcaggagagcctaggtagcactcccaattctgaagcaatatagaaaggtgcaacaagaggtgctctggtatcattgaaaagttcagtgatggctctcctcaccaggccagagtagagggtagtgaatgttgctatgaaacttgtgttccttagtgtcaatgtgagtggaagaattctggattcagaatccaggtggaaatactccaatatcagaggcagatggatgaaatgtatcatagcaatcagcaaaaaacaacgtcaaataagctgctacgaagtgcaaagatctataaggatggctatccaaccacggtgttcccaaagcaaatacagaaaggcagccaagaaggctattgctggatttatataatctaaaaacatcaaaatcaggtaaactaaagccgcatcattgtgttctttcctgtgattaatacacatttgaagtatgagttgcttttttattgctgcagtgatttggccaatattaatagctgaggacactgactattctgactttgtccagaaaattgcacataacatcaattccaaccaagaagttcatctcatggcaaagttaggtgcaatcatatgcataggaccactggatctgttggcactaatatacagtaccacccagcagtgctgacctagtagaatactggaaaagcctcttaaagatagagctaaggatgaatttgggaatgaaatttttcagggccacagaaggaatgaccattgtatggtacatttttcttgataagaagactagatggaaatgacaaatcaagggttcagggtgggaatggcctctctcatcatcatcttgactaacccatttgggaaaggcatactttcgtccttgcaaagctaggctctgctgcactagagatcctggttttctgaagaccggggtgatgttttcactgagatgacatagtaagggtcccattaaaccaatatttatggttagtcagtagaaattattggctctttatgccaacaaatcacaaagtacagaaagaaatcactacacctatgaaaatagctaaaatttgatgaaaaagatgagagagcttgctctgctaggtatcaagactgtatgtaaaatcactataattgagacagtgtgctattgctgcaagactagactaataaaccaacacaatagaatagagagcccagaaacaaaccctcatacacatgtatatgggatttatgataatatgtattgcgagtcagtgggaaatatatatatttatatagaagaaaacaaattatactcccacctcactccacacacaaaaatcatttcagatgataaacctattacgaataacaagacaataaatctttaaaaagcaggtccttcatgacctgaggaagtaggctattttttaagcaaggtcaaaagaatagtaacacttacaaaatgatggataaatttgataatcttaaaatttaaatctgtgtgtcaaaagatatcttgcaggaagtgaaatggaagctcgagaatgggagaaatgtttgaaacatatataacaaaggaggggctcatttctataataatcaaagaactcccacagataaaaaagaacattcaagaagaaaacacatttactccaacagataaataagaaactcaaataggcatttcggaaaagacgaaattcaaaatagtaagtaaatatatgaaaagattctcaatgccattagcaaaatgctaatcacgatcataatgcgatatcactgaaaccgtaacaaggtggctcaaattagaaagactgacataccaagcacacagacaggaaccatgaccaactctcatatacaactcttggcatagttactatggaaaacaatttcgcatttccaacaaaattgaatagacacatgttcataacatagagaaactcaggcacatgagcgccaggagaaatgatataaacatattcacagcagcactgaagataacatcctcaaactggagagctctcaaacactcatcaacatgagaatgtgaaaataaattgtggcatagccacaaacagcaaataaatgaatgaacaggtagaaatgtggctgaatagtaaaaagttaaatatgaatgaaagaagacagatactaatgcacacacactctaaaattctgtttacaggcttcgaaaaaagacaaaactaaactataatgtttataaatgcttacttagatggtaaatgtgcaacaaaaaaacccaggaaattaacatagtggttaactctaggtggaggaaagcaattgcgcctgagaaggagcatgaagaaagattttctggtgatgcattctatacctgatttggacttacatttatgtttactgtataataatatactaaactgtacatttatctttaaatcacttttgtgtattacattttttttcttaaagtttaaaggacaagagttggtcttaataaaaatctccggatatagctggaattctttctgtaaaaccaagttggttgccaagcttattcctcaggtaggcaataaagtccacgtaagtaattgtagtgagttataatatttgtagagaaggaaaactgaactgaactaaagtgaataggtcatgaattttcatcagtctataaaacagaagtgcaatttgtataaagtaggatctcataaataagtaatgtagcattaaaatatatagctagatagatgtagcaggggtttgtgaggcaaaattacttggtattgcttcttggatatacattaaataatttaaatggggaaatggaaaacacaatttcaaatacatgaccaaataggctgatagcatgtctgttatacttttcttccatgtagtttttacgcctgggaaatgccttcattatctttgcctgtcccatgagtgggtaaagagatgtgctattttttccagtaccaactataaatttcaattgttctttgcattcacactgctgtgtgtggtggggggtgggggtgataatcacttttttttttttatttcaacttttatttagattcatgcatggatggtacatgtgtaggtttcatagaagggcatatcatgtaatgctgatatctggggtactaataattctattgcccatgtagtgagcatagtacccaatggttgtttttttcagttttcaacccttgtgcccctcccccagtctcttctctagtagtccctagtgtttattgttcccaactttatgtccatgtgtacccagtgtttcagtcccacttacatctgagaataggtggtattcggttttctgtccctgcattaatgtacttaaaataatggtctccagctgtattcatgttgctgcaaatgacatgatttcattttttatgactgtttagtactccatgctatatatgtaccatattttctttatcaaatccaccattgttgggcatctaggttaattccataagtttgcgattgtaggtagtgctgtcatgaaaatacaagtgcatgtgtctttttggtagaatgatgtattttcctttgggtatatacccagctataagaatgttggttcaagtggtagttctgtttttagttcagccactgcagaaagcagtttggagatatccacatttacatttccaccaacagtgtatatgcattcccttttttccacacctttgcaaacatctgttatcttttgactttttaataatagtcattttgactggtgtgagatggtatctcattctggttttgatatgcatttcttgatgatttatgatgtggatcattttttcatttgtttgttggctgcttgtatgtcttgagaagtgtctgctcatatcttttgccaaatttttaatggccttatttcttttttgtttgttgaattattttaagttctttatagaatcaggatattagacatctaaaagctgcatagttagcaaatattttctcccattctgtaggttgtttactctgttgatattttattttgctttgcagaagctccttagtttaattacgtcccacttatcaatttttgtttttgtggcaattgtttccaagacttagtcataacttctttgccaaggctgatgtccagaatgatatttcctaggttttcttccaggatttttatagttttgcatcttacataagtgattagtgcatcttgacatactttttatacatactgaaagggaggagtgcagttttattcttttgcatatggatagccagttatcccaacatttattgaataggaagtccttttctgattgcttatttttgttgactttataatcaaatggtttaattctggggtctccattctgttccgttaacctatgtgtctgtctatgtgtagcctatactactgtaggcttgtagtatagtttgaagtaggataatgtgatgcctttggttttgttctttctgcttaagatcgctttggctattcaggttcttttttgtttccatgtaagtttcagaacagttttttttttttctaattcagttaaatggtactggtagtttgataggagtagcattgcatctacagattgctgtgggcagtatggtcattttaatgatattaactcttccaatccatgagcatagaatgcttttccatttgtttgtgccatctatgatttctttcagcagtgttttgtaggtctccttgtagcaatcttccacttccaaatttagatgcattcctaggtattttattttcacttgtgactattgtaaatgtaattgcacacttgatttggctctcagcttgactgttatttgtgcataaaaatgccactgattttttttaccttgatttttgtatcctaaaactttactgaagttaccagtttcagtagccttttaatggagtctttagggttttctaggtatagaataataatttcagtgaggagagatattttgacttcttctgttcctacttggatgtcttttatttctttctttgcctgatttctctaactaagatttctggtaatatgttaaataggaggggttagagtaggcatccttctcttgttccagttctcaaggtgaatgctttcagcattttcatgttcagtatgatgttggctgtggatctgccatagatggatctgattattttgaagtattttctttcaatgcctagtttcttgtgggtttttatcatgaggaaatattggattttatcaaaagctttttctgcatctattgtgatgattttttttttttttgagacggagtctcgctctgtcacccaggctggcatgcaatggcgcaaccttggctcactgcagtctctgcctcctgggttcaaacaattctcctgcctcagcctcccaagtagcttgcactacaagcacccgccaccaagcctggctaatttttgtctttttagtagagatagggtttcaccatatttaccaggctggtctcaaactcctgaccttgtgatccaccctcctcggcctcccaaagtgctgggattacaggtgtgagccatggtgcccagctttgtcattttgagatactttttagtatgctgtgaaattcagttaggtagtattttgttgaagatttttatgtctctgttcctcagtggtatgggcctgtagttttccattttaactgtgcatttaccagattttagtatcagaatgctggcctcacagagtgcgttagggtggagtccctcctactcgaagttttggaatagtttcagtaggactggtgccagctcttctctgtatgtctggtagaatttggctgtgaatccatcctttcaagggcattttttgatcggtagatttttcattactaatttaatttcaaaactcattatttttctgttcaagcttttgatttcttcttgattcaatcatgggagcttgtgtgtttccaggaatttatccatttcatctacattttctagtttgtgtgcatagatgtgttcataatagcatctgaggatcttttgtatttctgtgaggttaattgtaatgtcatcttttgtcatttctgcttgttcttaattggatttcctctctttttatttgttaatctagctataggtctataaatcttgttcatcttttcgaagaaccaacttttggtttcattgatcctttatatagattttggggcctcaatttaattcagttctttctgattctagttatttgttctcttttgctagacataaggggttttgtttgtttgtttgtttgtttttccctagatcttccaggcatgatgatagagtattaatgtgagttatttctatatttttgatgtatgtatttagcactatagactttcctcttaatgctacttttgctgcatcgctgagattctggtgttgtaacactgttttttaaatcaactgtattgatatggtttggctgtgtccccaccaaaatctcatcttgattgtagttcccataatccctacatgtcatgggagggacctggttggaggtaattgaatcatgggagcagttacttctatactgttctcgtgatagtaattgagttctcaaaagatctgatgttttacaagcattttttctctcccttcactctgcatttctctgctcctgctatcatgtgaagaaggatgtgtgtgcttccccttccaccatgatcgtaagtttcctgaggcttccccagacatgctgaactgtgagtcaattaaacctctttcctttgtaagtatccccgtctcgagtatgtctttattagcaatgtgagaacagactagtacagtacattggtaccacagaaagtagggttgctgtaaagatgcctgaaaatgtggaggcaaatttggaagtgggtaacaggcagaggctggaacagtttggggggctcagaagaagatctaaaaatgtgagaaagtttggaacttcctaaacacttggaaggctaggaagacagaaagaagtgggaaactttggaactctctagagacttgttgaacggctttgaccaaaatgctggtagtgatttgtacaatgaagtccagctgatgtggtctcagctgaagatggggaactcgttgggaaatagagtaaatgtcgctcctgctatgcaaagagactagaagcattttgcccctaccccagatacctgtggaactttaaacttgagagagattatttaaggtatcttgtggaaatttctaagtgccaaagggttcaagagaaaacagagcattaaagtctggaaaatttgcagcctgatgatgtgatagaaaataaaaactcattttctggggagaaattcaagcctgctgcagaaatttgcatagataacaaggaaccaaatgctaatcaccaagacattggggaaaatgtctccagggcatatcagagacctgcacagcatcctttcccatcataggcccagaggactaggagagaaatggttttatgggtcaggtccagggcccactatgcagcctcagtacatagttccccatgttctgcctgcttcagctccagccgtggctaaaaggggccaatgtataggtccaggtgttgcttcagagggcacaagccctaagccttggccgcttacatgtggtgttggtcctgtgggtgcacagaagtcaagaattgaggtttggaaacctctgcctagatttcagaggaaatatggaaatgcctggatgtccaggcaggagtttgctatagaagtggtgccctcatggagaacctctgctacggtagtgcagaaaggaaacatgtggtcagagcccccacacagagtccccactggggcactgcctagtgaagctgttagaagagggccaccatcctccagactccagaatggtggatccaccaacaccttgtaccatgtgcctagaaaagccgcaggcactcaatggcagcccatgaaagcagttaggaggggggctgtacccgccaaaaccaaagggttgaagcttcccacggctatgggagtgtcactcttgcatcagcatgacttgtatgtgagacatggaatcaaaggaggtcattttgaaactttaaggtttaatgactgccctcttggattttggacttgcattgggcctttagcccctttgtcttggccaatttctctcatttagaatgcatgtgtttatcctacgcctgtaccctcattgtatctaggaagtagtaacttttaattctacaggctattaggtggaagaaacttgccttgtctcagatgagacttaggacttggacttttgggttaatgctgcaatgacttaagactttgggggactgttggaagggcataattgtgttttgaaatgtgaggacatgaggtttgggaggggtcaggggcagaatgatatggtttagctgtgtccccacccaaatctcaccttgaattttagttcccataatccgcatgtgttgtgggaggaacccagtgggaggtaattgaatcatgagggcaattacctccatgctgttctcatgatactacgttttcacaagattgatggttttctaaggagcttttccccgcttcgctctgaacctctcctgcccccatgtgaagaaggacacatttgcttcctcttccaccataattgcaagattcttgaggccttccaaactatgtggaactgtgagttaattaaacctctttcctttataaattccccagtctaaggtgtgtctttattagcagtgtgagaacagactagtacatgtaagtatactcttacacatactgaaattctaaaagtggacatatatccaatatcaaagctttttatttatttgtcaagagaacttatttatgtgtttgtatgcttgtgaggtaagacaaatatgtatgtttagatgctgacatatactttaccggttctctttttacatttaggaatcttcattacaaaactttacttttagataattttatgtcattaaatttagtttcatttcatgtatgtacatacattatgcaagggctaagccaagcgttgggctatgtagtgaaatttctaacatcaatctctactttcaagatgtttagataaatagacaacataaatatactctagcaattactatcaaaatttgtacacagtattacatgagaccatgaatagaaaacaccgagggtataggaaagttcacaaaagattttctggaaaagattatagtggctaaattttcaagtatctgagttatctttaaaaaatggagaaaaagaaaatcaaggtgggggtataaacagatgcaaagagacatatattagcaattgtgagcaagtgagtatggctagagataaagttgtcaaagtaatagtgtgaggtgggtactgtgttttgtttgttctgtgggtaataataaccatattgtgtacttaagttatttgttagttagagacataattccagaatttacatcacagataattataaagtgtcaagaccagtatcaggataactaactcacaggctgtagcaatagttcaagtgagaaataataagagcctgattatggttgttatgagagagagaatgtgagaaaaatttgtaacatgtaaaatgatcaatattggtgattacttggatatggagagtgagagagaaagaggagacttagatggctccttagcatttggcttggggaatagttaattgaggtacagaattcagaaggagccctttctggggaagacgaaaataagacttcaatcttaaaaatgttgaaatttagatgctttctggaaattcaagtggatattttacagatatatgtctatttgaggctgtagcttaaaggagtagaaggaaaataagcatctcaatgtaagtaaagctgtcggctttaatgtaattgcaattgataaaaaaggaatacatagagtcaaaagggcaacttagatgatactttcaaaatccaaagtttaaggagcaaacagataaggggaagacagaattagatgtgcttaaacatgaaaactagcagcaagcaggtagtagaatcttaagaaaaaagagagacagagagagatcctatagcaatagagcagtaaagtgacttagataaagataacatttaaaagcacagtggtcatttgtgaccataaagtggacacagatatcattcattgtatagctgggatttcacaactataaatatttacacatacacacacacacaataatgtgtatttttctaatagctgatattaagcctaaacattgctaaaggggtaggccctaaataaatattgtaaaaatatattcttaaaattttctaatctatttatgagctgctaattgaatatctgaaacatgaccacatttcaaaaatagtcacagacattaggtagatttctattgtaaatattattatgtagcacatttatattgacataaccaatttttcaaattgtgtgggcttttttctttatcagaatgagttacagggtttgcattatatagtttggcttaaaaagagaactcataaaattccccacttgcagcccacttaaaaaagaattattacagttttaggcactgttgagtgtcatactgagctacaaaaaataagaaatcaccataatgctctccaccttcattttagttttagaaccccacacagggagacaactatagtaatcagagttaggccactgaggttcagatttattttgtttaatattaaattgtatagttgaaggaaacatcatttttttaatgactgtatcactacccttccaaacactgtagtttactaatgattttaaaacttctttaagtgcttaagacagaaacattcctacaatatcttagctaagatttagcatgcaggtctcatactgggaatacatttgtgttttaagttaaataaattcagcctcttatttagaactggaagaacatgttgtagacttatggttctatttttgttacctagacctcaaagaagtcagttcagtagaaaaatttatacaaggtattacatggaagtttactgggaatcagcttactctatattatacaatgctgagaacattgtttaatctttgtttaaacattgtttaacaggcagtatagtttccaagtgtgccttctctaatgcatttgtgcaagcatttatgcccagggttgctatgaaaaacagagataaataatttagtccttaaacttgagaattctgaccttagcagactcctcaatgagatactcctacaaaggccagacacctctgatattagctgaaagccttcctacctccacttccctcccccctcaacctccatccacccatgtctcacatacagaaatgcactaaagcatatagtgtgataagtgtgctgaagtaaaaggccacctctttttcttttatgctgaattatgttaataagtacaaagaagtttttctcatgatcatgtatcttagacagaatttactgaaatagatctttatcttctcactttctaacccagactgatgattgaattcacagaacattagttgagaaaacaaatgaaaatgacagaaaccatgttgaactatgcatcatgttctcctacttctgatgacatcaggtttataatgagaccagattcatctgtctgactgttacacattagcataaattattcccaggaaatccttcaattctcttttaggaataaataagattctgagaggcacatccaagtccattgttgggattatgccatttttaattgatatataatatatgtacatatttatggggtacatgtgatattttgctggaatgtgtaaaaatcaaatcagggaatttggggtgtccatcacttagagtatttaccatttctgtgtgtggacattccaagttctctcttcaagccacttgaaaatatacaacacattgctgctaaccacagttgctgtattagtctgtcctaatgttgctaaaaaaggcatacctgagactggataatttataaaagaaagaggtttaattgactcacagttccacatggctggggaagcctcgcaatcatggcagaaggtgaatgaggagcaaagtcacaccttacatgatggcaggcaggagagagcttgtgcaggggatctcccatttataaaaccatcagatcttgagagacttattcactaccatgagaacagtgtggggaaaactgcccccatgattcaattatcttcacctggcccctcccttgacacatggggattataattcaaggtgagattttcgatgaggacacagccaaaccatatcatcccatccccagcccctcccaaatcccatgtcctcacatttcaaaaccaatcatgccttccaaaagccacccaaaatcttaactcatttcagcattaactcaacagttgaagtccgaagtcttatctcagacacagctagttccttccgtctatgagcctgtaaaatcaaaagtgagttagttacttcctagatacactggggatacaggcattgggtaaatatacccattccaaatgagagaaattggccaaaacaaaagggctacaggccccacgcaagtccaaaatccaatggggaagtcaaatcatgaagctccaaaatgatctcctttgactccatgtgtcacatccaggtcatgctgatgctaaagatgggcttccacagctttgggcagctccacccctgtgactttgaagggtaaagctcccactcctggttgttttcatgggctcatgggctggtgttgagtgtctgcgacttgccaggcccaaagtgcaagctgtcagtggattactattcttggggctggaggacagtgaccctcttttcacagctccactaggcagtgtcccagtggggactctgtgtgggggctcccacccacatttcccttctgcactaccctggcagaggttctccatgagggctctgcccctgcagcataactctgcctggacatccaggcatttccatacatcctctgaaatctaggcagaggttcccaaaccttaattattgacttctgtgcacctgcacgatcaacaccatgtggaagccgccaagacttggggcttgtaacctctgaagccctggcctgagctataccttggccccttttagccatggctagagtggctgggatacagggcactaagtcatgaggatacacacagcagaggggtcctggacccagcccaggaaaccattttttcctcctaggcctctgggcctgtgattggagggcctgccatgaatgtctctgagataccctggagacatttcccccattgtcttggtgattagcatttggctcctccttacttatgcaaatttccactgctagtttgaatttctcctcagaaaatgaggttttctttactactgcctcatcaggctgcaaatttctccaacttttatgctctgtttcctcttgagcactttgccacttagaagtttcttctgctagatatcctgaatcatctctttcaagttcaaagttacacagattcctagggcaggggcaaaatgccaccagtctcttgcatagcaagagtgaccttaactccagttcccaacaagtttctcatctccatctaagatcacctcagcctagactttattgtccatatcactatcagcattttggtcaaagtcatttaataattctctatgaagttccaaacattccctcatcttcctgccttttgagccctccaagtctctaggaagtaccaaactttcccacattttcctattttcttctgagccctccaaactgttccaacccaggcctgttacccagttccaaagttgcttccatatttttgggtctctttccagcagcaccacactctactggtacccattcactgtattagactgttttcatgctgctaataaacacatacctgagactgggtaatttatcaaggaaagaagtctaattgactcacagtttcacatggctcaggaggcctgctttcatggcagaaggcaaatgaggagcaaagtcctggcttacatggtggtaggaaagacagcgtatgcaggggaactcccatttataaaaccatcacatcttgtgagacttactcactatcccaagaacagcatgagaaagacctgccctgatgattcagtcacctcccacctggtcctttccacgacgtgtgggaattatgggagctacagttcgagatttgggtggggatacaaccaaaccatatcggtcatatccccaaaccatatggttggggatacaaccaaaccatatctgctatctaacattagaacatatttctttctttctttctttctttttttttttttagaccaagttttgctcttgttgcccaggctggagtgcagtggtgcaatctcaactcactgcaacctctgcctcctgggttcaagctattctcctgcctcagccttcctgggtagctgggattacagagatgtgccaccatgcccagctaattttatattttcagtagagacaggatttctccatgttggtcaggctagtctcaaactcccgacctcagatgatccacccgcctcggcctcccaaaatgctgggattacaggcatgagccaccacacctggccagaacttatttcttctaacagtatgtttgtaacaactttcttcatcagccccatcctccaccaccaccactcttctcagcctctggtatctatcagtctactctctatttccatgagaacaactttttcagctccagcctatgagtgaggacatgtgatatttgtctttctattcttgatttattttacttaacataataacctccatttccattcatattgctacaaatgaaaatgattttcattatgccacttttaaacatgaacatttgacaagaaattgacttatttattattgttatgtaaagtaactagtttaggctaaattgggtctactgttgggagtatgcacaataacagtaatacaataataattatgcataaccccaacaacagacccagctttaccctatttatcttatataacaataagtaaatacataatacataaaagaattttatatttttcctctaacacataatatttctttatctcccttttcctttttctctctttcttacatatacacatgcgcttgtgcatggcacaggttagtataaaccagaatcaatggcagagctcactaaaacacagatttctggccccaacactagggtttctgattcaatctctgtggtatagagtatagcagtctgcatttctaaggtgtttctattggtgctgatgctgatgctgatgctgcttttccaggaacaacactttgatagccacctaacgcatgtttgtattttttcagttcagatacgcatgagcaagtcacaggaagcatggtcattggagaatcctgtatagtagagtggttaagaccaaacatttgaaagtaattcaaatatgtacaatggaaagcatttagaatagttcgtggcacattgtaagaattcaaaaattgatagtcattattactgattttttactagagctgtcagtctatccaatatgcttctttcaatgcaagctccacatatcccactagctggacttattttaagatgaataaacaaaaatacaaaaatcaggatcgcaaccatgagctctattttgataataacaaatatctttcatttcctttaaatttctaaaatatcctacaaatgtgactatatgcatatatatgttcatgtactaaatgttgatttgtacatttgttattatcaaagaccaagctttggctaacacacttaaaaaggataaacgctgtttataatctgactgactatgattgtttgtagtgatgcagtagaagaaaatcatttatcaacttaagattttatagtttcttaagaacagtacttccattaaaatgttctctaaatatggtaatattaggcaaatgcaagagtgcaactaccgtatttcgaaaaatcataaacaattgtttgcatttagttcatagtgttgtaaaaaatattactttctataatatacgtagccatactttataaattatttagtatttaacataattataataaaaattaagtgcatattagcttcattccttattttaaacctgtacatatattatgtgtatgtattaatccttcaaatcactacttgagatgaattctattattatctccattttgcgatagcgaaatccagtcccagagaagctaaattagttatccaagattgcattagttattttggcaagtcaaatttgaactcaggtagttttattccatggcccatattttaagctgttcattaagttctccatcttgttgggatgctgggtctggattcatggagtcacgtgatctagtgacaggatgaaccaagtgaccagggagtggtcgtctcattaaagtatgtaaggagcataagaggtgagggttgttaggtaagatgagaagtccgggatccctgtgtggtgagtctagaagtcacagtccagtataaaacaggcttttaaaggtaagtggctggaaagctggacactgatttagtagactggcttagagtcagtctatctaaaggctgaatggaccttcacagaagttatatcatgctctgctgttgtatattcccaaatgcctattcctttgagacttgaggggtccaggaccaggcctgcagatttgatcagaatatgactgcatttgggggcttctactggcatctgctcccccaaagacttgggatcatctgagagttctgcagttgagtatgaggcctctagtaagaggcctctcatatctgagacccattctaaagatcaattatttgcatgcttgtggtccacagtcaagatatgcatacaaatcctctagattctatctcctgtgaaatactctcaaggatactaggcaaaatattacactaagtcttcatatcattcactatttcattaggccccatctgaactcaatgtatttttaatcatttttccagaactcctttaaacagctcttccattattgtcagaatactgacttagagtcctcaaattgcttcttcagctggattatatttcatattacatttttttggctggtatttttatttccttttttttttaaatttccaacaaagatttcactaatacattgaaaagaaccaagaataatctgcttttctcatgaaccctaacctggccacctcagtctattataatgtctctttttccttgcagtaaagaatttatagcacccatttgacacttgacacagagtatatacttactgtatttactaggttttgagtatatcttttcatacatattgttacagttttcaattctaaatgcacaaggtataatatgataccttgtgaataaaaagataaacattaaaaattgttgattggtaggttattttttaatatgctggataaaactttttgctatgtataatccataaatttgcttcaaaagtattccttagttattatttgttactacaacactacctttaaaaactaaatgaggccgggtgtggtggctcaggcctgtaatcccagcactttgggaggccaaggcgggcagatcacctgaggtcagaagttcaagatcagcctggccaacatggcacaaacctgtctctactaaaagtacaaaaatttgctgggcatggtggaggttgcctgtaatcccagcgactcaggaggctgaagcaggtgaagtttgaacctgggcggcagaggttgcagtgagccgaggtcactccattgcactccatccagcctgggtgacaagagtgagattctgtctcaaaaaaaaaaaaaaaaaaaaaaaaacaaaaaacaactaaatgaaaactcccttcagcattttaattcaaatattggattattcatattaaaatatcaatagaatataaacacaaagttgataactcaaattcagtatagtaattaacaatatgtatcttggttttaagtcttaatagtttttgatgacaattaaaattaaattttacaagcagagcatgagtaatttagtgaaattaatatatgatataattatcattaggtagcaaccattatgagcatcaaaattccatcctataaacattacactgtgcagaatcagttagatgcagcctgccttggatgtcttcctcttcctttttgctttcaacatcgttttagtttttatgaaaacaagttattgcctaaagaccaggctaaggtccatatttcaattttaaaaactgaaataaattatagaggccatttcttatcaaatttaagaaccaggagacaacaacaaggttaacacaataattcaagaacaaagaatcactaggaaaagcgggaaaaaaaaaataagaaaaaaaggaaaagaaatttaactaaaaactaatcatcatgttgatgtctacttgtgtgtttttagttatatattccatctgggctttatctctccaagctaaataaattaagaaaatgggaaagatcatttttgtaaataatttcaatgcttgtttgtttttaactgaatagttaatatatatatggctaagtgaagtttttcagttttcagcaatgtggcattttaaactgacaactgtaatataacttaattatcattaataaagacgattacattagttcaagcctcatatgcctggtttattacaattgcctcctacttctgccttctggatttagaatctcccatttcaatatatcaggagtaatttttataaaatacaaatcagatgttgccatacctcagaccctttagtggctcccccgtcaccttctacaacatggtatagaaaagtgtttatgacatggtacgtcttattcattgtaactatgctatgtcacactctgatttctctgtgcctttacttatacaactaactttccctaacagattccaacttctctcaacttctctcttacctgtgttcttccttcttgagtcaacttcagcatttctcctttgatgataatttttgcacatgcccctgttatagactttattaccttgttttcttggtgtagccaaacttgtcagtgtcctatgcatgtccctcagagcatttggtatgctttggccaacttccacctcctggtattgtcactggatcctaagggtgttgcttttccagccagaaacctctgcgggtggtggcgcctttgcccaagttttgctcggactagctgtgtttgtatcacccactccacctggcaggctgtgcttggctcatgctactgggctaaatccgacactttgccagggcaagccaggttcagagcagcgatgggtgcatgagcgagcaagtgcagggtcttgtcactgtgcatagccacgcacgctagctgctttggcgggacgggtagctccagccgccctctcccagcaaaccttagattgaatcagatacagggcaagagccttctgctgtgagcacccgcgtctggatgaggggctccctgaagagccgcaactcttctctcctttttgttgctcgccacatggtgaggggggtggcagctaaacaaggttttagccctgtttgtgttaccgctctttcattcctgccatttggtgggtcccgagtttttggcccacatccaggaagaatgaggtacgcgcacagctggagagttaaggtggagaggaactttacaaagctacagaacagctctcaagagaccgaagtgtgtagctcctatccataggcaggttatccccataagtgtccagctctcagcagagagaagacccggaataggtagttcctttctgcagaaggtggtcccaggagacacgaagaggaaatctcctccctgcagctggtattcttgatgtctgtgtgaggctggctggctccagggtttttttgggctcagaaaggaggaagtacatgttgattggtccacgggtggccatgggcaggcccggtaaaagcaccgtaagttttcactctgggccacggactccactggaactgatgggctggtccccaggcttcaggccatccctggcttgaaggtggggcttcaccagggacaccccactttccacccaggagcctgtcttctgctgccatcaatcatgttgttcatggtgcccaggctgtttatgaggagaagtgcctgcaggcccacagtgagcagccctctgtcccctcttggcctccctcctatgttcattggcgcccaaagttcacaggaggctgaggtggcagggggctggcatgtcagcaccaacccaagcacgcacacacccagcctggttgtgacagcacctgggctcggcctgaactttgcttcaaaattggaaggggtgccaggagctggaagaggtcaggcagggggaacaggcacttccgactctgtgggggcaggggagcttcctggatccctgagagcacagagatgcctaggtctgcagccacagctgggcagctggagctacacccaggatggcagggctcccaccctgccaacttggaagggggttaggttcctgcctgctccttgctcccaccggctccctggagcatttagcccaggtcatacctcctctgctgtagctggtgtctttgcagtggctgctccagatgggccactgctgccatcagtatctacagcctgactcagtgcccttctatcagattatgctgagggaatttgactacttgcttctactggaggcaagaaaatccaaaaacttggcagcccattggccaacattgcagctaattactctcaggatttagtgtatatgttttccagttccataacctctcaggaactggacaattaaaactatcaggacagataactctgatgcatgagtttgcatctttttctagagtttgcccttggagtgaagtttcagttctccttatgattgctggtttaatagcaatcttgttactggctaccttctcttctttgcctcactttctcacttccttatcactgttatctacacttctcaaaaaatatttatacatgaatattttgtgtccagattttctgttggagaatccacagtaagccattggacaccagaggtactacagtgtggggagcagagccttcagatgggatgctggagttgaatcgcttgttggccagttggtatcaagaccagttggcattttataacatcacaatgaccaagattatcccctatgtgaattgggatggcataaacatataaggttatgtatgccttatgcagtatttccagaatttgagatagtgacaatgataatgataatgactgtggagttggtagttgcaagtattgtcagtgatctaaaggaaaaaatgacttttaaaaaagcttcaactggtcaatcaaaatctcaggacatggtgtgaacatcacaagatctctataacaccatttaaagcaaccctctccttttgcagtttaaaggagattgagctaaaaatcagatcttgtgcctggttataagaatagcagaacagtagagaagcctcacttgaaagcaccagcacgccttctgtggaaaagtcagaaccttcacagggaaggagtaggaccctgaactctgggtttggaacatctgggtggctcacacctcactaaaccaagattctttcctcccctgaagaccacataaacacctcatctgaggttgatacttcaaattgtgcacatcttcctccaatttttttcttctttgtgacttctagaccaattattatgttcaagaccaagaatggcccaaatgaggaagtactgtctctgttttaacaataaaggaattattcatcaaatgaaccacagacaccggctaatatgtccaggtagatccagaagcacttagaagaacactaagagtaagtttactacgagtaaatcttctgagtgctggaaaaggtgtgtgtgcaaaatattagaaacacacggtagactctaaagatagtatttacctaatgtaatgaattcaaatctaaatatatatattttgaggtctaaatgtccacatccatacctagtagtatacctaattacatgtttctgtaaaatgttttaatttcagaaactaaaaatatatattaaattagcatactatcacattaatcaatgtttaaattatacaataattataaaatgtaaatctgtatccttgaaagttaattaaaatatataggatatgattcattttttaaagtcttgaagaatatccagcacagtcatttaacagattacattagctgagtttcttttgagaattaaaatgtaataaacttacactctttgaaaaactacatataagatctatataaatattccacttacttttacttgacccacaaaggcattggcttcttcttccaccacagataaatttcttggcagataaggatcaaacactggagcattgtcattgacatctgtcaccactatgtttactgtggcagttgaggtcttaaagaaaaacacaagcattaaatgtgagaggagctatttttacttagaattcatttaagtagtcattctggcatttgtctatctgaaaagcatctcatttttctttctaatccttagctttccaaaaaataaaaataaaaaaataaaaaaattaaaaaaaagaagcttgcaaagaagcttcccacctcaaaaaacagatgggaaaagcaaatgatgatattaaagggcaaacatctttttggaaatgtcaagtatttcctggaggaaaacggttttacctttatcttgttcacattttatgggtggcaagcttttgtttatacacacgtacactgctttatctctgaaatgtgccatttctgtagtttttgctgcttgtatgtttgactgtttaaaaataaaaccagtacattataaaatagcatggtacatcaaatgagcattttctggaaagctcatgctatcgaaaaatgctaccttaataattttctaggtgtacatttaaaccaagagtttgagtaccatatactaggcatgaaatgattatcttataagcatacagcttacggaaatggtatgcaggtaaacctaccagtagtgtgtgctacctagttaaaagttaaatccctggcctgctgcagtcaatattatgtaggtcaatgacttctgcacaatcaatgactatcttcataagtgattcaagctggaaactgctctctctaatcaaagcctgagtacagcacagaacctctacctagctctgtcacagtgtggggctgatcacaaaaggctgagagcaaaggtacagagagaaagaatattaacctggaaagtaagaaacctggtatgctatggtattaaatatttagtaactataaataaaaaggaggaggaaaaagcaaggtgatactgtcatgagagaattatccaccttttgtttaaaaaaatgcaagttccattaattagtaagtgatttgtagtgagaggctaaaatcctgagcactaagaagtgacttgagtgaagctgaaaaggttttgcagcagtcatggggctaaggagtcaagtgattttttttattttttatttttttttatttttttagctattaaagaggacagatcttggtaaatacccaatgctttctgttggggtcacagaagttctataccatgcaagtcatggtgcttgggaaaaagaccaaacctccctcaaatgtaaacccagtattgaaactctgattggatttaggtgatctgcccttattttaacagaagcaaaagcaaatactttttttagtaatgtaactttatcccaagcctctataaattttttcatgcacagtgttcagtagtcacttaataattaccatgcatagcagggaattcctgggtattagtgatggcttatttctttatttgtatgttggcttaccctttgaaaatttatgttgctattcatatgtgatttgcacacatttttgtatttaaagttaaataaaatttttatttaaagacacgtacaaagatggtcagaacatcattatatagtcaaaatctggaaacaacccaaatgtccatcgatagtagatggttatacaggattgtgttttatatatgcaatggaatcatatgaagtactgagaatgtacgaactactgctataagtaataacatggattaatttcatgaacctaagtttctagaacataaataacacatactatatgattccatttatataaacttcaaaaacaggcataatccctacatggtgataaaaattagaatacgggtcactttgaagaagaagatcgaatagcgacagaaatgatcacaaagctgagcttctggagtgctgattaatttctgttttttgttatgagtagtggttacataggtgtgttctctatgtaaaaattcattaagctgtagaattattgtttgtgcattagtctgtgtgttatattttcttaagattatttactttaaaagatgcacacacacaaacatacacatgtgtgtcgatatatgtaagtatgtttaaagaaattcaagtgctacttgactagatggaatccagatcatttcattttcctcgttacttttatatattttctaaatgttctcccaaaaggctaccatgctttcatgacaaaaagtattttaacaaatattatttctttaaaatttgccttagaattgaaagcagtaaagaagatgtgttttttacagttgcggtagttcccaatttgcctgagggttaacaagacattgaaatttacagcctggatccaaaatctaagaatggtgaccctggagtttgctggcttttcttcaaattgcctgaccccctttacaccagcctgtctttacctgtcaatccactgtttttctcatcctattctttaaaatttatattcatgttttcagagtattctgtatcctcagtttaagactgtaactcttaagtggataatgaagaatacaaccagatcactaagtaaactaagaagtcaaataacaattccataattttgtgctaataggggatgatatttatgggacatgcaggcattttcttcatttcttactgaattttatatgacatgaaaaaaatccatgtcttacagaaatgtacagtcacatctatacatagaataatttccagtttatatatttcttgaagttttttaataccacttgcttcagaaatacttatgtaaaaatgaggatttcagggctatccattaggtctattgactattgttctgaacctatggaaatatttataaattagttaggtgtaaatcatatttatttaatttttcttgattggttcagaaggatggcaacaatatgcttcaatgtggatctgtgccatagagaatgtttatgtcttattaaggaaagacttcttttcattgttcaagcttaaaaattagcaaatgaaaacagatcactttaattaattgttaggaccatatgtcattaacacatgttcacaattaattttaaatatgaatatatatataatgccagttaaattaaaaagatctcaaactaataaacctaataaataaaaagttacgtattttccatcaacggagtttgctcactgattatttcctcaaaagttgtattaacttataattccactagctggaaatacttgcatgttagtactaaatactgtaattgaacactttcatgttcattatttaatttaaatgtgtcttagaatttccttttgtaatatcatagaagaattttcaaaatatatgtctcattctcaacaatgcaagatatttctgtttttgtttgtttgtttgttttgagacaaggtatcactctgtcattcaggctggagtgcagtggcatgatctctgctcactgcaacctccgcctcccaggtttaaacaattctcctgcctcagcctcctgagtagctgggattacagacatgtgccaccatgcctggctaatttttgtatttttagtacagatggggtttcactatgatggccaggctgatcttgaactcctgacctcaaacaatctgtccgccttggcctatcaaagtgctgggattacaggcgtgagccatcgcacccagcttactgttgtaatttgaatacacatttatttttataaactagtatggctctgaaagaaggatattaatatagcatctttttttattttcattgttgttgttttttttgagacatgtctcattctgttgcccaggctggagtgcagtatgtgatcatagctcacagcagctttgaactcctaggctcaagtgattctctcacctcagtctcctaagtaggtgggactacaggtgcacgccactatgcccagctaatttttatttctttattttatttttgtagagacagagtctcagtatgttgcctaggtggtctcaaacttctcatctcaatcccaccttggcctctcaaagtgctggggttataggtctgagccgcgatatccagctcatcttttgttttttgttgttgttgttgttttttaatagtataaaaaaagtgagttataaagccatagtcaaagaaagtagtgtaaattcatctatcaatacacaatgcattatttgaaattcgtgagaacatacattaagagtatcttatttattctcttctagtatttcctatctcaggaaatgacatggcaaaataattaactaattttctaagtcactttatctcatacatgcaatttattagtcaccaagtcctgttaatttgaccttgtaaatgcgccttgtattatacagttttgagcaatggataaataatacaattttcatttcctgagtaaatagctggaagtcagataactgggttttctgattagcatatgtttagctatgtaagaaaaccagaaatgtgttttgctcaataatttaatgaataatttttaatacattttcttgttaatcaacttaatgaacacttttaagggcagtgtgtaatactacgaatttaataagcaattttggctttaatcctagagaggataagagaagggatgtttgttttttatttaatcacaaaaaaatgcatttttttatcatttaatttttacatcttttgacacaaaatttgttaaacatttcatggctagaaaactatttctttatattttgtgtgcatctcatagcacagccatttgttttgtgctattacatttatattagatgattgaaattcaatgacattcaatacatggtttaagaaacatgtatgcttagaatttatctgagcagagactcatggtatgtataggaatcagtcaggaatatttcaatttgttcattaagaaagcagaaaacattatcagaggtaaggtaacactataattatggagcacttatcatttatctatttcttaaataaaaacatgagtgtttaatttcaaaggtgcaatttcttttctatagtcaacaagattcactatatattctcagaaataataaagacattattttattaagaaatgtgtctaacgtgtttactaatagaacacacaatgtcagctcaatgaatatttttagatactttaaatatctatttttattataatttgtactacatgctgaaataaattaccttataacttattttatttaaatgtctgaaaaaagaagagctagaaagaatattgaaaatttccatctgtgagaaaacacaagaaatgttatttatagaacacaaagttttcctatctgaataaaaatcttcactactatatctaaaattcttttcaataacaatgggacaatgaggatttatagtttagaattcaatcattttttgtttaggccaataaaacaagaaaaatacatattcaataataagtatagtatttagagaatattaatttaaaacattttcatccttaagcgcaagtcatcttgttgctacacagttcagagccaagccaacttcattcagattgtagagtttcattcatgatgtagagtggaggtccttcctaccattaaagattagccaggaggctttctttccttctgaaggaaaaaaatatacataaaatctagaatttctttgagaaagagaaaagggaagttccttctattatgaattacgggaaggagaaagggagacacagaagagacatgaaggcaggaggcagaggtcctcctcctcatcccctactgccactttggacccctccttaagtgaagaggcactggagaaacattttggaagaagggggaaatgatgactgggaaactaagagaaatttgggtgaaataatcacagtagttttcaggagtatgtaagcctccagaaaatttccacaggttccatgggaggtcccatctaataggttatggcactgaatatacagcaatggcagagagaggtgtcaagagagagaagccatactaccagcataaaggactggtaaatacatgttacatctagaccacaattttagaatgaagtcagggaggagaggtttggttggcagcttaactagtgagtatttatattgtcttaaacagataatgctgaaatactgttctaagaaacttaagtgtgacccagattacatctattccctacctgtccaaacacatatttatacattattgtctaagtaggaagattgcatcaggtataaaaaataaagaagcttttttttctctgtgcacatctgagtgtagtgtgtaaagattatatatgtatgtgtgtatgtatgtatacacattttatgcaatcgtgcatgtttttatataaatatatattttcaaaaatatcagaaagtatttatagtatacctgtatactatagtatatataatatagaactatagatataaatatttatatatttgtacataaacattttgcatgttacatatattgtaaagattcacatatatgacttaaatgtttaaagttttactattctataaccatacgtattgtgttctaaaatattaaatcaactattttgaaattcaaagttactttaacttcacacattttctcacgcatgtatttttgcttttgttaaagtttcctatttgattatgaagttaaatgctcaacttttaaatgttaattgttcatttatattgccatgtttcaaagaaatttaggaaataatattgcttcaagacaaaaacaaagatgctaagtcttctagcaatctgaaattgtgaaatattacaagtgttcagactgaaagccataactgagtaattcaatccagtaattcaagagcattttacagaaatcaaaccatgatggaatcaagttacctattgtatcaattaaggaggaaaataatattgctgaacacacggaatctggtcagaaatatctaggctacagaataacttcacattttaaatgaaaaaaattactgatcactgttcgcatatttatttatatctttcactgtgttattggttgattaacacagctgcaatccataagccctacttcctagctatttttctacccactgttgctacttacagataagaatatctaaaaggaaatctgctagatggggtttctgaaaaaactttggtgctttgttaaaataaagcaggggtgcagactcttctggcattcatctttatactttgtctggtatagagaattgacgtctagagttgcagaagatgggaatgaaagtagacaataaaaatggcaaagcagaaaatagccagcaggcatcctcaatggcactgatgtgcacctgcaccatctcttcactgtccacctctagattttttttctgtatttgtttgtactatctcaatttttaaatgtaaaatgttgtggtattaagtatattcatattcttgtgcaaccatcatcactatccatctctaaaactcttttaatctagcaaaacaaaagctctataacattaaacaataactccccatttctcttttctttatcctctggcaaccatcattctactttgagtctttgtgatttttgaccattctaagtaccaaaatataagtggaatcatatggaatttaacattttgtgactggctaatctcacttagcataatgttctcaagatttatctgtgatatagtgtatgtcatactttcttccatcttaaggccgaatgatatttcattatatgtatataccacattttgtttatatattactctacataaacatggaaaactgggttgcttttacatcttagctattgtgaataatgctgctatgaacatgggaatacaaatatctcttggagactctgctttcaatttttttgatatataaatgaaagtgtgattgggggctcatatagtaattctatttttaattttttgagaaactaccactgttttccacagtggttgtaccattttacattctcaccaatagtgcacaagggttccaatttttccacatcctcatcaacatgttatgttgttgttgttgttttgttttgttttctgtttgttttttataatagcgtctctactgggtgtgaggtggcacctcattgtggccttgatttgcatttccataatatttagcaatgctaagtgttttttcatatgtttactggtcatttatatatctcctttggaaaagtgtctattcaagtactttgccaattttgaatcagtttgtttatttttgttttctttaaaaaattctcgggctgggcgtggtggctcacacctgtaatcccagcactttgggaggctgaggcaggcagatcacgaggtcaggagattgagaccatcctggctaacacagtgaaaccccatctctcctaaaactccaaaaaaatagccaggcatggtggcaggtgcctgtagtcccagttactcgggaggctgaggcaggagaatggcctgaacccgggaggcggagtttgcagtgagccgagatcgcgccactgcactccagcctgggtgacagagcaaaaatccatctcaaaaaataaaaaaaaagatctatatattttgaatattaatgacttatcatatatatgatttgcaaatattttctcccatttttatgttgcttttttattctgtgtctttgacacccctttacaaaatcacaaattccaacttgtctattttttgttgttgttgtctgtgtctttggggtcatagccaataaatccctgacaaatgcaatgaaatgatgcttttgccctatgttttcttctaagagttctatagactcagttttcattttaggtcatgaatcacttttgagtttgtttttgcatatgatgttagataaggtccaacttcattcgtttgcatgtagaatgatcatagcacccatcttaaaaattatctgaccaattaagtgaaagtttatttttggattttctattaaattacattggcctgtatttctgtttttatgctagtactactctgttttgagtattgtagctttgtagttagtttgaaatcaagaagtataagttctccagctttgttatttatttttctttttggctatctggggtcccttgaaattttaaagataagttttagaataagtttgtttttttaaaaaaattatttctacaaataacatcattgggattttaatagaaattgcagtaaatctgtagattgcttgggagagtattaacattttaacaatattaagtcttcccatccatgaacatgggatatttttcaatttagttatgttttatttaatttctttccaaaatgttttgtagttttcattatacaagtcttttatctccctggttaagttaattcctgagtattttattcttttggatactattgcaaattgaattgttttcttaattaactcattcattttcaatctatgaaaatgcaaatgattttgtgtgctgattttgtactctgatactttgcaaaatttcttagttccaacatttgtgtatgtgtgtgcaaacatgaaacatgtgtatggaatcattaaagttttctatatgcaaactcatatcacctctaaacagagataactttacttcttccttttcaaattggatctttctctctttctctctctctcttttctttctttttttgcctaatagctctggtgaggacctctgatactatgttgaacacaaatggtaaaagtagacacccttgttctgaatcttcaaaaaaaaattagaatcgaaaaagtatagttttatctgtacccccgatagctaaaaaaaaaataaattacatgacacatgcaacttatacagatttttcaacaatcattaacaaagaaaatttagaaaaggacagtcaaatcaaacttcctccatactgtctacaaataaactcacaatgaccaatagaatgtgacctcttatctccatcatccccattttgagatggtagaaaacgtgtattctcatgatcaaattttcaaactcatcctggcaatttgtttcacacaaattgcttgttaacattttcatttcaataaattccatccatctgtctgtgtttattaaatatctgttttaaaccacatgattcttaagtttaaaaggttaattttactgtaattactaaatatttagataagaaaagtgctattaagacgtgagaatattattgttatataatcactttttttcttcaggaacccactgtgtatgcctacatataagtatatccgtaaaattatataaatgatggaattaactgaataaacttttgtttgaaatctaaatgctttctactctactgatattctcattacaaactttacaaatgaacacaaaatttactcagaaaatcagaattttaaagcaaaatgaaacctgagtgattatatgaggaaacgaggacctagaaatgctaagtgtcctgtccaaggagaattaaaatatacaaataaattactgaacaatgaactagaaagaacaaaactactgattttagcccagaacttattttggttttaagtagtcaaaagtattattagtagattgtgactattttccttccatctgtttccttgtctaagaaactttaaggacagacttaaaatgttctagctaatattactgccattagtttctgatttataatgtggcatatttcaaagctatgtattatcctttctttttttcctattttattggttgacctgaatgctttcttaatttcacttcactgtaattatacctcttaatctatgctaaataatttctccttctcctccttagaatattttctctcacttattgcctagccgagttaccctctaaactttcatcataagtcaagttcttcaattacttcctccagaaactctcactgacttctttacatacatctaacacagacatactgtaataatttagggcaggctgggcgcagtggctcacgcctgtaaccccagcactttgggaggccaaggagggtggatcatctgaggtcaggagttcgagtccagcctggccaacacggtgaaaccctgtctctactaaaaatacaaaaattagccaggcgtggtatcatatgcctgtaattccagctacttgggaggctgaggcaggagaatcacttgaacccgggaggctgagtttgcagtgagccgagatgtttccattgctctccagcctgggcaacaagagcgaaactccatctcaaaaaataataataataattaggtggattgcttatataaaaattagccataggttttatttacttttctatcatctaagtacctattatcctcactgtttactacaactgttctgtatattttattatatgtataagtatgtttatttatgtaatgtctgaaaaatgttaaatagcttactatggacagactgcaattaccaaatttaattatttctatttatctcacttttagttaagatgagaaaactattcaggtatcaattttatatttttattataataaaatctcagaaatcctcctaaaataaatgtgaagatacatttattttacatttattattacaataataaatacattattattgtatactttcagccaatgtagtatatagattaaatagatcatttcaaggagccaggagatatgttgatatttaaattgagtgagccttgcttatcaatctgtaatgggtttgaaattatttctagacaatagcactgagttgacacataagcacctgattgaaaaaaaaaagagaatcacctaacacatggcatagaaatggtgaaaataattattaacaatggtaatattacaatacatagaaagcgggatgctggcagttgtgaatgagatcgttcaaataacacagacaagtgattttaaagcagttcagaatgtctaacaattttttttttttaaagtgagttttaggtccaaaggaaatagaatttatcttctttggaattataagcccatttaaattatttagataaccaagaattacttatgattcttactgctacttacaaatgcctgtggaaacaagcaaatcactttcctaagtgcttaaagatatttatccacaaaatccactcttcctccctgacccttaaaaaaatgacgctaagtgtaacaggttccaacataataaactgccagaacacatttcatggtgcagtgcaaatgacagacacaatggaatacctgttagaataaagtagatttcattttccctacaagttaggtgagaatgctgatctcaagtatctgttctgtcaagtcaaaggttgcagcacaatagcaaattcagagtataggtgcatgtattaatagcctgttgaagaaaagagcaacacttctagtaattataagaagttgctccagatgaaaaacattaattcatgtctgtgatacattgtttaagactctctcagttgccttaatactatttttaaaaccccttcacagggagcatactcaccccatctggcctgccatctgaagctgtgatgatcagaatgtagcgatcagtgctttccctgtccagtgctttccctaaggttagaatccccgtgctagtgacaaaacaaacaaacaaataagacaaaaagagatattatgtcacaaggagagtcttcttagtatagtgaattacttttgatagctttttttcccctctcagtaatcacagcttgagtattttagatgtataatactaagattcattctgaaaattgaaaacagcttttaaggctgtcaaatttcttagcagtatccatgaaactgacactgagctgatttcctaccttccaggaaacaaaacataacaaaactgtgcttaattcattccaagaagaacagtatctatcttgttttcgattatttcaagagaaaagacttcattattccttagcagtctcagaattctttgaaacaaggaatggtttcctataactaatgtatatcacctcccaatttatgtcatatgtatgtccattatgaaaatgcaaaaacccatctaaatgttatctctgacaaactctatggataaaagtttttcttttttcttacttttaaaataacagagacccattgtacaaaattagaaaatagaattttttcaaattacagaaattatgttttttgtaatgtttctttttgtactttattataaccacatttaaatatatgattgtttcagaagaggaatcattctgcatattttacattttttaagaaaatataattgtattagaattcatgttctcattttataatttgtttaaaaccccttttgtggctacactaacaattttagtattttgttattctttggaaatttagctgtttcttaatttaactgatgtataatgggagattaacagcacttgggaaaattattgcacttacaatatttttaatacctactccttatcttttcactgctcagaataaatgtttccaaatatttaagactttattcacccatgtaatttattttataacagtttggcttgctctctaatgtaggttctacatttatttcttaaattttacatctgatattgtacacattttaatcgagcctaacaagtatccactgtgtagaagagtttatctgaatataataacacattaaaatatatgtaccaagtccaaaacataaattgtttctaatggataaaatgctttcattttaaggtaagtgcttttattgtaaagaaaatttaaacaattcatatcacatatggtagttgagtacagagagtcaaagccgatgaatcaaaataagaatcacagttactcaatttgcttattatgttgtaatggttgacgtggactttttaaaaagttctgaacatatggcatgcccatgaaaaactgactttgcttcctgtacattttaaaaatgttttgtcaaaataattgaaaaccagttcccagagcatgttcacaacaattaagtttggaccagcttcctacagtacagaaggtccagataatcccattttaaaattacattaaatgagaaaagtaagacatgtatttcttctgaggcttattcacaagtatcttaagaaacaggaaagctgaaaacctagccatggtataataagagaaagaaagaaaattgagttaccattttcattttgtttcttccctcagttaattatctatattcctccttgtacattaaattagaaaattactaaaaagtatattgtatatttacgatgaattacaaaactcacgtgataactgagttgatttcctaccttccaggaaacaaaacataacaaaacttcgcttaattcattccaggaagaaaaatatctatcttgtttttgattatttcaagagaaaagatccattattcctcagcatgttcagaattctttgagacaaggaatggtttcttataaataatctatatcgcctcccaactgtatatagtatttggaatatatatgtatactctatatatactatttaggatatataatactatatgtattattccaaaaatactatatgccgtgaacaatatagtatacagtatattcatacttagggccattttaaacacaaacagctaattgtctatggtctggtgattattatagaggtagtttttatgtaatacgcgggccttgcgactcagtgttgtaggcagttgtgtggtatatttgggcaatgcagaaggggagaaacacaggcagtgtattttgggattcatagctgaaagactagtttatgggtttacctgtgcatccttttattaaatccgagaaatagctcacaaaaagtcttattaccagctagatggaggctatcaggccaggatacattggggtacacttagtaatgcaatacaccttataagttcacatattaaaaatacataagcttcttcaattgataaagcatcaataacactgctacttatacaggattgaaaatacatttcccaggagtgatgtcagtggaaatggagaagacagccccaagagatggtctcgccacaaaacgtcaaaaaatcacaattaagcagggaccttcaacagcaaatttgatgaaactctggaaaacagtcacaggtttatagcaaccagatgaaggcagaatttgttttaaaaaaaggtaaatcaaatctggtagaagaactctgtggcattttgacttgtctttatcctaccatctcactggctcagagtggccttgaaaacatcagtgaacattcccagtgtgacactatggtctttgtttctggagggagcgagctatccttattcataaagaactgtgggggtctattctagtctgtctggagactgcctgaaggagtgattcatggcacttatctttgtttcatcaaacttggaaatcactcaaagcagaaaagcagtgggcattcctcagaaatattgtaaggcaggggatagcccacaaacacttgaggcgtataatagagtgccaaaaacttgccaggaaagtctgggtaaatagtttcatggaaaattcaggcactcaaaagtgtactggggaatacagaataataaatataattgagaattcataaatatacccacacatctacagtcatctgattttcaacaagaatgccaagaccattcaaaaggaaagaatagtcttgtcaacaaacggcactggaacaaatggaaatctatacgtaaaagaattaagttagactacttcacttcatacacagctattacctcaaaatggatcaacaatttttctaaacacaagaattgaaacctgtaaacaactcttagataaaaactagaggtaaatattcataatcttggatttggccatggattcttagatatgacaccagatgcacgggaagcaaaggaaaaaatagatatactgaacttcgtcaaaataaaaaaaaaaaaaccttttgtgcatcaagggacattatcgagaaagtaaaaaaaacaacgcatataactggagaaaatacttacaaatcacatatctggtaagagtcttatttccagaatatataaaggattacataacttaacatcaaaaagaaatcccaatttaaaaataggcaaaagactcaaatacacattttttccaaagaagatatacaggatatacaaataatcaaaaagcatatgaaaatatgtcattagtcatcaggcaaatgcaaatcaaaacccacaaccaagtatcacttcacactcactatgataattatatttaaaaaaagaaacaaccaccattactaacaacaacaacaaaaaataattgttggcaaaaatgggaataaatcagaatcctcatatatttctggtgggaatataaaatgcttcaatcactgtggaaaatatttgacagttcctcaaatggttaaaaacacataattacactattccctagcaaatctattcagtatatacttaaaaaagccaaacacaggtacttaaatacacgtacatatatgttcacagcagcggtatttgtaataccgaaaggtagaaaaacagcttaaacgtctatcaatttatgaataggtaaacaaattgttgtatatgcatgtaatggaatattacgtagccatgaaaagtagggacctacttgcacatgttgcaagacagacgaatcttggaaacattaggctacaaaaaagaagctagacacaaatagtcacacattgcatgattccatttctgtagaatattcaaagtaggtaacttgatgaagccagtacgcagattggtgtttgccaggggctaagggaaataaggaatagggagcaattgctaaatgggttcaggtttctatttggagtgatgaagctattttagaactagacagagttggtaggtgcatgagttctgaatctcctaaacaacactgaattgttcactttaaaatggttaattttgtgctatgtgaattttgcctcaattatataaattatattgcagagtattttccatcaccaagcttttgggctacgttcctgaaacatattatgcttggcatactcaattattatagaaaatagggtttgcctaactataaaaatggtgttcaaacataatttaaaaatttggccaggcgcggtggctcacgcctgtaattccagtactttgggtggctgaggcaagaggatcacaaggtcaggagatggagaccatccatcctggctaacacagtgaaacactgtctctctctttttttttaatgtgcacttttttttttttatttttttgagacagagtctctctctgttgcccaggctagagagcaatggcatgatctccgctcactgcaacctccacttcccaggttcaagcgattctcctgcctcagcctcctgagtagctgggattacaggttccctgggagcttatttaaaagctctgtgccatcagttttcccttctgtcaaatgggaaagtgaaaccccatctctactaaaaatacaaaaaattagccgggtgtggtggtgggtgcctgtagtcccagctacttgagaggctgagggaggagaatcccttgaacccaggaggcggaggttgcagtaagccgagaccataccacagctctccagtctgggagacagaacaagactccatctcaaaaaataaaaaaaataaaaaaataaaaattatcacctgtagtcccagctacttgggaggctgaggtgggaggatcacgtaagcctagacttttgagactagcctgggcaacagagtaatacccagtcttaagaaaattcaatgatgtaaatagaaagtagcagaggatatctacttccaaacaaaacaagctaccgaatttaaaacctgcttctataagtaactgtttttcaaaattccgttattaggaaataccgatgcagcatcattataaactattatctcacatatttcatgatgtataggctttgcttatttaaaattttgttaaaaattctacagcttgtgactgaacatttacacttggaggtgtctgagcctttgacagatttatcacattgcttttgggcactgagtttcaggctttacaatgatatttaaagagattagagtatactttaaaatgtacagttgcttcaagtttgacatggcatttcatattaaatagcaattagcaattaacaaaaacctactaataaagggagctaggtattgacagcagtttggggaaaagatgatggtggcatgaactaaggtagtagagtgaagtgtgagaaatagtttgatttgggtttaatattttgaaagtagagctgagctgtcagggaataaaataaatatctttcttatatattatttaattttcaatataatcataaaattcaaactgatatgaaaaatataattgagcattacatgtaatgtcaaaacaaattaatcaccaaagaaaaaattaaaatgcaagtgaagaaaaaaaattttaatagaatttggaccagagatggagataatttttgaaattctcttatttagcactgattttaagtgttggcatcacagaccccatgcttcagtgataacaatccataaatatttgagagatggcatttcctcaacctcccttaataaataactataccattaggccatcatatttataagggaagttgccatatatcttatttaaatgtgtacttatttgtggatgattgctgagtgaatatttgctaaatcatatgccactatcaagacagacactatgaaaagatactagaaaaatgcattatattagaatcatacagatatggccacttaatacatgacactgaatgatttgtattaccaatgtttgtgatttttaaaaaaccaaggctttttctttaaagacccagtttctttcttggctgtgtgactaagccaatttattaaaataataattcagtactttgtaaaaccctactgacattaagatgattattcattactactaattttttaaaagaaatacaagaaaattttggcatacttttatttcattaaaggaaagtaatggtattataatgatgcgtattgagagaatttgcattatagcataaaataatatggtatttaaagtatacaatagacatgtaaatattttttcattttgctttaagatataaaatataacccaaatagcatatattgaagtgtctgatgaggtagaacattgtttatttttttagcgtacctgtcttagtccatttgtgttgctataaaggaatacttatggctgggtaatttataaagaaaataagtttatttgtctcacagttctacaggctgtataagaagcatactgccagcatctgcttctggtgaggggctgagagtacttccactcatggccaaaggtgaaggggtgctggtgtgtgcagagatcacatggtgagaaaggaagcaagaaaggaggggtggtgccaggctccttttttacaaccatttgttgtgggaactaataaagcaagaactcattcattacctctggtaacaagccattcataagcggtctgcctccatgacccaaacaaatcccattaggccccatctccaacatgagggatcgaatttcaaaatgaggtttggagtgtcaaatatccaaactatagcagtacctggattgttcatatccttgaaagttatagagaagtggtagtgcaaagttttgaacatgaatctcagaagtttcaaagaaggtggcagttgaaatgtcagttattgttctccatttcaaatgcattgaaatgtattgctagtggttcaggctactctataaatatcaatgagaacaacagcattgaggtggtggaaacaaagtgaccataggatagaaggcaaagggcccagtgtacaggaccctgaatcaagaatgatcatcaaaagggatcacacaaccattatagggacatgttctgctttagctttcctggaagcagtttgtgtcttaaggagatgtctgtccaggttgacctaagagctttaacattaagaatcatggtcaatttagactaaaaggattttgcattgacataatttacacctttaagaacctctgtgacccagccattatctttttcattccaaatgcagagatgagaggagcactagagatataggaaagcagtgcatttagataatttatttggcaaaactagtagctcactggatttcacaatcagcaattgaaaaatctcttggcatcaagggaaaaacaggaatagaaattcttaagagacctgggcttcctgcttaccagagcaggtgaaaacttcattgttgtctttttcttttgttgacagctttgttaacattttaattcagatatcataaaatccaccaatttaaagggtacaattcaatggtttttagcataatcgcagagttgttcaatcatcactgtaatcaattttagaacattttcaacaccatatctattaacagtcactccccattctctcccactcctcattttcaggcaatcattgatcaactttttatcttatagatgtgcctattatgaaaattttatagaaatgaaataatataatacgtgctctttttgcaactgacttatttcacttagcataatattttcaaggttcatacatgttgtagcatgtttcagtacctcattaccttttattgatgagtaatattatattattacagacaggcaacattttgtttattccttcctctgtagatggatatttgacttgtttccacttttgtaccattgtaaataattcttttatgaactttctttgtgcaaactattatgtagatgcacgtcttcatttctcttgcatatgagcagaatgctggcttatgcggtaattctgtttaccatttggagaaaaggccagttctccaaagtgtagtcatagtttgaatccatgtccttgcccaaatctcctgtcaaattgtcaccaatgtaggagataggacctgctggaaggtgattggctcatgggggcagtttctcatgaatggttgagcaccaccctccttggtcctgctctcttgatagagttcaggagatctgcctgtttaaaagtgcgtggcacttcccctccctctctcttcctcctgctcaggccatgtgaagcgctgactccccgctttgccttcagtcatgacttttaagtttcctgaggcttccccagaagcagagcaggtgccagcatcatgcttcctgtatagcctgcagaaccgtgaggcaattcaacctcttttcattacaaaatactcagtctcaagcacttctttatagcagtgcaaaaacgaactcacacatgcacattttacatggccacataaatttacgcagatttcagtatctccacattcttagtcatacctggttttgcctttctttatcactacagacacaaagtatgtatgaagtcaaatctctttacagttttaaattgcatttctctaatgacaaatgaacagtgatcgtgatcatatttccatgtgcttgttggccattcacatatccttttttaaagaaatatctattcaaatattttgcccattttaattagattatttctctttattaagttgtaacagttctttatgtattcttgagacatgtttcacaccatatacattattttaaaatattttctctgattgtaggttgtttctcactttaggatggtgctccttgaaatacatttttaaaaattgacgagacccaatttatcaattttatcgttaatctttgtgcattttgtgtcatatctcaaaatgtactgactaatccaaataatgaagatttacttctgtattttcttctatgtggaatgcagttttatctcatatattgcaatttatgatccactttgagttcatttttgtgaatgatgtgagataaaaattgaaattcattctcttgcatattgtcccagcttcatttgttgaaacaaagttctttcctgattggattatcttgacccctttttgaaaatcaattgaccataaatactagagttatttctggattcttaagtctgtccaggtgcttatatatctatctttatgctaatactacacagccttgcttaaagtttttaacatttttattttctttaatgatgattgtaaattgtagctaatttttgatttctacatccctatgagataaaaatgaaaacagttaaggctttttatttttcaaatagaagtttacttatctgtggaaaacactgttcttgtctatagtttcccaggcattactaactcatgtttgtaaaattctatttaacgtgaaatttcaggtatttctgggaagactaattgaccagcacatggttctcttgttttggcattatgccccacatgttcctgagtctgatgtggcaatgtattcatttgtcaaagttttaactttataatcattggccaagtttacatttctattccttctgaaagtaaaactattcacaggtacacaggaaatatcagggaagagccaagctctttagaaaccagccacatgtgacagcagaacagctaccttgctattgcaaaagggaagcatacagtctctctgaagccctaaatgcctccttttaatgcctgctcccagttttctcaatagttatcattagcaatatctcagatgtattcagagagataagtagaatgacactgatctagacctcaaagaagtttggcatgaacacgtattttatttcattgtgctttttttcttaaatatacctatgttaatctgaaattgaaggatgtgtttgtaacacatcttgcctacaagcctccctttgaatacacagtttggtgctaagtaaccctttgtagtaatgtccttgtcattatcagtagctgacaacattaaaaggatctaattaatcccagttgtgccttccaatgaaatgtttccacctcagtagattttacctagtaaaaatgttaaaaataaacagtctcctgggtaatatttctgggctcagaattatcctcccagctaccattagcattcatagaaaacagaaagggaagtacaactacaaacagctgaaagcctctgattagaagtctgctttcttactaacagtacgttgctgtacatttttttaaagtaggaaatcatttttaacttacgtttctgaaagattaaaaactctctgaggatctccattctcaatggcatatgttattgagtctccctctcgatcagttgccttcagagagaaaacataattcaattatcaagtaattgatatggcgcccactcattacagagtaatataaaagcttgaaactaatagcacagaatgtccatgacactgttaaagaataaagattaaagcatggcctaatggcaaggtgtaaaatcaaacatttcgtatctgatccatttctgaatatgtaatcctacctgatgtggaaataatcattttcccaaggtttacttatttaattaacttaattaatgaatttaatttcaatgtctgtttataatttaaataaaagctgctggctgggcacagtggctcaagcctgtaatcctagcactttgggaggccaaggtgggcggattacctgagatcaggagttcaagactagcctggccaacatggtgaaatcctgtctctaccaaaaacacaagaagttacccgggtgcagtggtgcacacctgtaaccccagctacttgggaggctgaggcaggagaattgcttgaacccgggaggcagatgtttcaatgagctgagatcatgccactgcactccagcctgggcaacagagcaagatcttgtctcaaaaaaaaaaaaaaaaaaagtgctaaactatgtttacagtgtcgataaagtgtttaatgtatattcttttctttttctgttcagaatatatcaagacaataattcaaatcagtctaactttctggttaaaaatcctgaatttatagccacaaagcatgacttcaaaaccgggctccaattgtcctatgtgattatttctgtgtatccatttctaaaacgaggactatacaacaatacaaatgttaatagatgttgagaggtttaattgaaataatatatatcaaggcacatagactaatatctggtacattgtaagctttcaataaatattaacctttttgttggtttttcttcccttcaacacccaagtcggagaagaaaacatatagtttgactttgagttccgagtttctcttgaccaaaataaagatgctcttgttttatggcactgaggtctggagttttaccttaaaaaacatcaaatcagttctttttccagtgagtcattcgatcctcttataaaagacatggataaagaaagaaatttggatgctatcagagagttgacagaatgatctgcctaagcatgatgctacagggggggatatatctgataaaggttcagatgtattttatttttaggtgactagcctggcagaaacaccagcctctccacagacaggaactgccctggagtcagcaggattctgagagaggaataagtatgtgagtttctgtcagtgactacataataactgtcccagccataagaggctgagtgtgaaattccctgtccagacaggcaggaacgtattgttcttagtggtagatcagttggctttgacatggattacacagtcctgctcacagaacgtccttatcagctaccacaatggattgatggccagaagcctctcttggaccacaaaaactacagaatcaagggaaactgaaaataatatttcagtcagtaataaactactgaatattgactatgtgctaggttctgtaagaaaatctttgcaagattatttaatctgtctctcataaaagtgatatacttccttcgcatggctcctatgacatcatattgtcctgctttcaatcctcacattatcaatggtagttcctcattttcctttgctgatttctcctcattttataagacttattttatattggattgttccaaaggttggtccttgaacttcacttatttagtcaactcattcaacagtgtagctataaatactgtctatctgctgaagacggtcatatctctaggctagccctttcctctggatttcagatgtgtatccaattgcctacatggatccacattagatgaataataataagcctccccaatttaaaaggttaaaagccccaaatctagatctcctttccatcttgacgtacctcaaaaaataaaagaaattcaaacaataatctattgttttcactgcttcatcatctcagtaagtacctgcaactccatcctcctactttctcagggctcatagctacactttgagggctcactcttacattccaatgcaacccatcagcagatcccaccagatttacctaaaatatctgctgtatctggctgtgtctgaatttcttctctgccaccaccttcctcatggattatggtagtaactattttactaacgtgttgcttcttcccttgtatcctcacaatagtcaattttcaattcagcagacaaaagtacttgtttttccaggccaattcttttatttctttggggtaaagtctattgctttctcccccagctccccaccctccccatgccatacacactaaaataaaatggaatcaaaaaaagtaaatgaagaagaaagtaataaattagccagggtaaaatatttttgaaacatcccatgttagtcaaaatccaaaattttatatttcattgagttagtcataatggaagcctaggagtagaaaaaaaagaagcaaacaaatttctaagaatacactcaataaaatggatagtagacgcttgatatttttcccttgcattctgttctttgctagataggaaccacaaataatgatactcagctaacattttgaagaatcagagaattatatctggagactatatcttaaccccaaaaagcttacagtgaactttttctgttgtttttctctcggtcaataaatttttcttattatgttgttatagatatgatcatgttcttttggtttgtttattgatatgtggttgctgttttaatttttttcttgagaaacattttataatcttgtgtttcataaaagccagaagaaatgcattctgaaacaagatagcttcatgtaaacaattttaagaccagattaatatcgaatcttttattatatcagatctactctaatatttaatatcctttatgtaagatgagaacactgtatttatatttattatttttatgttaattcctttcaatcccagaggtagcttgaaatatttcttcagttttatttgaccactcaaatacctcagtcttttaaggattgtgaatgtcaacaatttgcctacttcattcttatgtgaggttatgcccatattggaaactttgaagacttaggatttaaaagaaaattcttatttgattcctttcttcatttttatcttttcacacaatcctttattggtgttccagggtcgagggtggtataataattaggaagtatttatagtttttcagccaagaaagcaaaaggaaatggtgtaatctgtatcaaagttctgcaatctatgcattacatgagttagcacttgtatagacaatatcatctttctttgtcaatgtccaaaggtgagaaataatccataaaaagaaaaattggaaatatcaacagaagcatttacccttcaagtattaggatttgattatgtgtgtatatgtgccctaaacatatttctatcagcaatatttaaatgttttctatatataaatctaaccagccatctcaaaataattgcttataatgtgtcagaaactatattaaaattttgcatgtcttgtctcatttaaacctaatagtaactttactggtaaatagaaaatgcatatgacttcaattatattactatttctgccatcattccaaccagatttctctgtactttaattaattgaaagatgcatcttttttatctagagatagtaataactgtatcatcttgaaaatgggagcatagtgttattcagtattttccataatataagagatataaattgcttctttttagtgaaaaaacattttatgtgcttatttttgataaatcaagtcatatccgagtcccttcttcaaagcctgagaaaagtatgacagcagttatctttctggggcttattttgagtttaacgggggagattctggagccagctacctggattcagcctcagctatactatctcttctcagacaatgcactcaagtacaaaatgagaatactactactactacttaatcactcattaattcaacaaatatttattgagcatctacgctgtgttaggcactgaggctgcagcagtaaaccacacagacaaaaatcctgcccttatacaatttacatggtagtggaggaaaatgaagttaaaaattaattagaatattttgttttcagatctttatacgcgttgctcaactacaaaatatttcacaaaggacatatatggagagcagggtgaggatttacacttatagaagtgatcatgacagacttactgaaaatgtgaaattttggcaaatgcttgtaaaaggtgaaagagtaagtcacgtggggaagaacattccaggaagagggcagagcaagtgataaaggccgtgaggtgaaaacaggcctggtgagtttcaagaacaacaacgaggttgtcaggtctggaggcaagcagcatgtggaagaggagctcctcagtgtacttcgaccactttaatacctcaggttaaacgaataaatgatgtgtattttggatagctggcaagtaatgcactttagccactggtttgctaatatatggttaataacatggttaagattaaagccaatctttcctttaatttttatttaatttaatataattttaattttgcctgaagaacaaatgattcctttaaaaatcaaagcaattactctttccagtccactcaaccagattacttgcagcatctgacttagagtccctgatttttcagaagcaccaatagggaaacaaaagtatttatccaaggaagcagtgttcttagacactggcaaatggaaaatttggaaaagaaaacaaattttctctaaactaatcttctgttcatgttaaagatgaatacagccatcaaataccgtctgatagagtgcattttatgtgcaaggaatgattctacacatttcacaggacattaagacaaagtaactgcccttagggattctaaaatagataaaaatcaatggatttggatgattttctcacttaggcaaacaagttctgatttatgttattaaaccacttgagagcaacaaataaagctttcaattcagtacagcagtgtttcaaaaaatgtatacattcattcctggtattacattttttggcctttaacaaaatgttataatatttaaataaaaattaatgaatatattttattcatgtcaagtactgttattttgtcattcataatgataatataaaatgttattttgaagtaagtgtaagtaaaaggtcagttcattaaatattccaaacaatataaaatgaataatattatatagaatatacatataacatatatgaaacttggaaatgtagctaaatctacaatgacaaaaatataaatatgctcaaaaataaaagaatgttggaaaactgcacacaggagagccataaaacagctctttttcttacaatattggtatggattaatgatcttttgcccaggaagcaaaataaaatgccttatgctaagaaggcatagcagaatcactgctggtagtgttgaaaataaatggcatttggaagtgagcataaatttatttgtcacatccagagaagtgtctgtaaattaagaagtccttaataggaaaaatacctagacttccgttagatttagggatactctatgaaggcttagtcttaaaaaaattttgttgtacaaaatgggtaaccttggaatacaaagagatttaatcaattctaaaataagcctgcaattctaattttgtctagggctcaaggaacaatcaacaaaataaacttagaactaatgtaaatattcaaaatgacgcatccaaataatggttaccattatgtattaagcacttttaatatcccatctcatttaatcctcaaaacaatcttctctggagagcactacaatccctattttacacataataaaatcttaagcttaaaaattaaataatttgccaaagtttacaaactatagaatcataattcatattctatgccttttgaaactcattttctatcactagcaaagtcccctatgtcctaaacttatctcgagtttcccttcacctgcttgcttgaaccaacaccaagttcttcttaagaaccctaatttcccagtatcccttttgattggtgagcctcagagtagccttcttgtttctcaatgtcactgccagattattcttctggaaatgcatcagctttaattcttataccataagcattatactgcattaactgctactcttcattgttaaagtcatactctacactatttatcatacttcctgttttttgctcattgtcagtctctctctttgcctgtcattgctgtcattgtcaacttaatccaatatcaaagtttcaaataatatgtaaaatgctaatgacttcaaaattgtatttcagttctggggctgagagattcaagatcatggcactagcagatcccatgcaccttttgtggtctgcagacagctgtcttctcattctacacttacatagtagaaacagagagctctggtttcttcattccccataagggcactgaatgccattcatgaggactccactctcatagcctaagtatctctaactaccaaatgtcctacttctaaataccatcacgttggggattttggcttcaatatgtgaattttgggggaacacaaacattcagtccatagcagatgtcaaaaagtcttttcaaatacagtatggccaatattgaattactctttctctaacagtcttttaattttggctaatgacaaatcaatgtttccagttactcaagctgtatcttaatacctattcttaacttctatctccccttctatatccaattcattaacaaatcatgtagtttttaaccaccaaaatataaccagattgaaatgacttctcattatttctggaaagatcactccaggcctagaatgtgctgacagagcatatcaacaactctccataatttttcccaggcttcttccacagaccattttcaatgcagcatccaggattatcctttgttaaatttggttgattatgtcactgctatactcaaatttttaactgtacctaatttcgtgcagagtaattatatctatccctctcctattactgaatgatttcatctctactactgtctgtttcttttactttactctgtaaggaggagtatttttcttcttccttaaacatatcaggtgtgtctaaacttcggggtcttacctttgcacctgaaatacttttcctcagatacaaccatggctcatcctctcaccttattcaactatttgctgtaaggtcactttctttgtgaaataatcactatcaaattgtattttcccatgcacttcctctctagctttccttctttcattttccccataacatcttctaaaattccacataactcacatatattttgttaattttcttctctattagaatggaaccttcataaaagcagaaattttgtcttttttatttactattatatcctagcatttttagttgtgacaccataagaagttaatatttacttgtcatttggtccttgcaaagttataagccttaatgattacattataatgagaaaaatgaatgaaagaattttggaaaaatgaaaaaggaaggtattaagtggacacaggtctctccctgctcctgttttcactgggaggcaggaaaatgcacacctcaggaggggagggcatgggacattctggcttctccctgatttattagactgcaaggataaactaagtccaggaaactcagtcagagctctgttctgtatatgcacattcttcctcagtatcataaagggccttcctttgtacttcctatgactgggagcctaactttaatatactgaaggaagtacagcatttcaattgtatctggtacttgaagcaactgaatttacagtaaaacaaaacaaaacaaacaaaaaaagaaaccccacatgctttttacctattgtatatactctgtgtgtctctattaattgcttccaaacttgacagagaaaataaagttgtgtgtgtgtgtgtgtgtgtgtgtgtgtgtgtgtgtgtgtgtcctattctacattttcagaatacctgtcctaggttaaacacattccaaaagactgttagggaacagtttgttctgggcacactgatataaatatttcagttatctttatttataattattaaaaaatttgctatcaccttcatgaatattggacatgaatattcattgctaacatgaatggctcaagataaaggaggttatatgaataaactatatgaaaccaggaaggcttttgtcatctggaatgatgctgaaaagatgattccataagtatgaatttagcccaattattcttagtttttattgcccaatactaactgtaacattaccctgagagctgtctctagaatagtgtttggtttgcctaaattgaacttaaagaaaaatgttgtcaggcctctgaaaggacaaatcttacttgctaataaatatactgtgcatagtagtatttggcctgagacaaacttttccaacctttctatgaaggttgtgacagagaatcctagccctcttttactactacttattcgtggctattgatacttagaatctaattattgtggaaagacaattggctttggtcagtttacagccctcaacatttaatgacaaaccaaatagaaaaaaatcagaatcaacatttctgtcattaaaaaaatttcttcatgatacagctcttgtccagatttatataaatagaagtttatttgttctttgttttagaactatgaaaaactggacacctacgaagcaatttacttaaactcttagaatttagttcaaggttttctcaaagctttcctcagagcctactcacttttctaactagttagatttctcagccttcactagataaaaaccagatatgtaaaataataaagttatccggacacaggcaaacagtgaatgaaatcagtacacagtgaatggcttgacagctgtgagagaagtagacagaaagtgcaccttaaaaacaatagacacaggctgggcgcagtggctcacgcctgtaatgccagcactttgggaggccaaggcaggcagatcacgaggtcgggagatcgagaccatcctggctaacatggtgaaaccccatctctactaaaaatacaaaaaattagctaggcatggtggtgggcgcctgtagtcccagctactcgggaggctgaggcaggagaatgtatgaacccaggaggaggagcttgcagtgagccaagatcactccactgcactccaacctcagcgacagagcgagactccatctcaaaaaaaaaaaaaaaatatatatatatatatataaaacaaaaaacaaaaaaacagataaaacaagcatagttatcaaagatcaattgtccattaagccccacacatcacagcactacttatagataaaaatatgtaatccaatttaggaactattaatcacacaatattctgaattaaatagacaaaaacaaagcattaatttgatgcccattataaacaatatatgtactgctagaaatgagaaataatataaaactattcaatatagcccctaccttgagaaaatattaatctttgtgaaataaacattgagaaatagtgttcactatatgctggttaactgtgcatttgtaaaagtaatccaggtctagtatctacaagattaagaacctagtcttaattctctcacttttagccacctagggtctagggaactagcatgtatccctagacatctattctaaatcataaaatgaaataaaaaatacttcaagcatctactttatgtagtagatatagaatcagatgaggtaatagatatttaatacacttcagaattccattcaaatagaaggtattgctcagtggtcgggcatggtggctcatgactgtaatcccagcactttgggagcccaaggcgggcagatcacgatgtcaggagtttgagaccagcctgaccaacatggtgaaacctgtcactactaaaaacacaaaaatttgccgggcgtagtggtgtgcatttgtaatcccagctactcaggaggctgaggcaggagaatcgcttgaacccgggaggcagaggttacagtcagccaagatcacatcattgcactccagcctgagtgacagagcaagactccgtctcaaaaaaaaaaaaaagtattgctcaataaattaatttaatagttaaaatcttaggctttggagtgaaaagaaataggaatgaaatgggactctttcacttataagccacatcctctttgagcaagatttaaggtatttatatctcagtgacatcattctgatactcagataaaatggcacaaggctgtcatgatgatagaatgaaagagttcatatctagaattcagcatagtgcttagcatgcatttactaaactcttactattgatgttaatatttagaaagaagaatgcacaatagaattcaggcaaaaaaaatcgatttgtaaagcagtgtttcttaaagagactacaactctgttatcaataaaactctcacttctggaatactcagcaacatatagtaagtgatatgataccatattagcagagatagtacatcaaattcccggcaaccacttaaggtggggggggatttttttttttcctattcttagatacaaaaattttcatctgcaaggttacatgtatactttaagcactgcttgctcttcatgtccactttatatactgataaacagaaagaaagatctccagttaaggtctgaaaatgtgtctaagataggtagatattggttgatatggcttgtctgtgtccccacccaaatctcgtctttaattcccacgtgttgtgggagagacctggtaggagacaattgaatcctgggggcaggtcattcccatggctattcttgtgatagcaaataagtctcatgaaatctgatggtttgaaaaatggtagtttccctgccccagttctctccacttctctgccgccatgtgagacatgcctttcaccttccaccatgattgtgaagcctccccagctacatgaactgtaagtccaattgaacctctttcttttgtaaattgcccagtctctggtatgtctttatcagcagcttgaaaatggactaatacattggtcaactatattggcagtggatggtggggaggggaacataaataaatgtttataaacctggccatcaacactttgagctaaaaaaatgacaaatgagtgaaatacacaattcacaactaatacttagcatgtattattttgagcaaattaatagatcaaacactaacataaccccttagtatattttcagttgatacatatatcaaaaagtaaaaataagcaggattggagcatacagcagagacacttctccaatgacaaagtgaggagctacactgaccatctcccagtaaaacaatcacaactgctaaaaaagaaaccttaaaaattaaagtctcagctaggcgcagtggctcatgcctgttatcccagagttttgggagactgagaccagaagattatatgtggataggagtttaaaaacagcgtgggcaacatggtgaaactcatctataccaagaaaaaaaaagataagaaaattagctgtgtgtggtgttgtgcaactgtagtctcagctacttgggaggctgaggtgggaggataacttgagccctggaggtggaggctgcagtgagccatgaccacaccactacactccagcctgggcaacagagtgagaccttgtctcaaaataatattaataatcataatagtaatataaataaagttttaaaatagtctctaaatactgttctaaagacatatggcaagtggaaaaaatatttattcaataaaacctactaaatctcactaagaattgtgaaaactgttcttagtgagttcactaagaacagcctgtctttctccctttccaaaaacctattcagcacagcataatgcaggcatagtcaagaacatgggaattcttcctcacagcttcagtctgaaactaggctatctgcccatgaaggcaggccacacaatttcttatcacccccagcaatgtgctgcagtggctgagaagtctgatgtttccggtgggccttatggacaggaatggagaaaaaggcatttgccaagtcaatggctgtatatcaggtaccaggagatgtgttaatttgctcaagcaatgaaaccacatctggtacggaagctgcaattggagtcaccacttcattaagcttacaatagtccactgtcattctccaagatccatctgttttatgctcaggccaaataggagagttgaacagggatgtggtgattaccacccctgtagctttcaagtccttcatagtggcattaatctctgcaaaccatccagggatgtgatactgtttttgatttactatttttctaggtagaagaagctctaatggcttccatttggcctttcctaccataagagccctccagtcagggagccaatgtgggggttctgccagcttctaagtatgcctatgccaattattcattccagcactggggaaatgaccacagcatgagtccaaggacccactggataaccactataagacagatccgagctgaaaccccattaattatctgacctctataagcccctactttaactagaggaccacagttttgggtccccaagaatcaacgtcagctcagagccagtgtccagcagtccccaaaatgactgataatttccctttccccagtgcacagtgaccttggtaaaaggcccgaggcctccttggagaaggatggaagaaagattaacagcataaattggtgggtagtgtaatgggattcttcctcaaggggacctggcctccccttcattcaaggagttctgggtctgtaaactggctcaactctggaaattgactgaggggtcatgattctctgtttttataattcaaattagtcttttgtccattctacatagaagttttctgcttaaattaagtaggaatgcagtaggcttcctattaatttcacttctaggaacaccctgattaattagccaatgtcagagccttacatgagtcagactactctgatgctgctttgcctctgctgtccattatggtaactacacccaccttgcctttgatggttgagcgccaccacttggcccatgccaccttgggatccaattactcctattgtatttaaattttgtagttgagtgactgtggttcacactgtttgatctgacatacagagaagagcaattatagggctcttcaaagatgcaggtgctgccctcataaatctcttttgcaaagcactggtcaagggtatatcttcaggacccacccagcagggatgagtaggtctaaagtgactagtccactccaccatcccaaactccctaagcctttagatccctttctctgcattaaaccaagagagatccggcatttccagcaagctcagagttggctctcttttaatccatattttagctaaccagacaaataaattattataacctttttttaactcctgaagctgcaacattaaatgcagaatccctacttggtgggcccagatcaataaattcagcctgattgaactctatgtttcttccaccattatcccatacccataatatccattcccatgcctgttctccagatttctgcttatataaattaaaaaaacataacaaaacaaaataaactcgagcagttcttttcaagtgtagcacacttcctcatgggtcacactctgaacttacctctaggggcccacaaggactttagtctagttatagattcagaagcaaacaggagtgttggggctggctcctgaggagaatcaacattatttttcctggcaactgccttaggggaggccatcactgttgcttcaggcagtgcaaggtttctctcctcagacaaaagtggaaaggctgatggcagcatggattagagagaggaggtttccacgactaggaatggagaagccatttcttctgacaaaaaagtttcatcagagtttacaagctcagtgtccccagccttatcagggtcctcccacacatccccattccaagttgcagggtcccattcttttccaatcaatgccctcactttaacaggggacacctggcgaggctgtgattacacctgttgttgcaggtcagccactagcatgataagagtttgtgtctgattttccacaattttagctctttctctacaggagctaagactctcactcgggaaaatcttagcagatttgaggctcagtatctgcttctgaagccaggagttagaatccctgagttcagccgggcgcggtagctcacgcctgtaatcccaacactttgggaggccaaggcaggcagattacgaggtcaggagatcgagaccatcctggttgatacagtgaaaccccgtctctactaaaaatacaaaaaattagctgggcgtggtggcgggcgcctgtagtcccagctactcaggaggctgaggcaggagaacggcatgaacccaggaggtggagcttgcagagagccaagatcgcgccactgcactccagcctggctgagagagtgagactctgcctcaacaacaacaaaaaaaaaaaaaaaaaaaaaaaagaatccctgagttcatccttttctttcatcactttgtccagtaaacttaggagcaaccaaccaacttcatagtcaaaggtattatgtatagagtcactaaactctttgcctctcacaagtggtgaatcaggagtgtcaaatgcatttattttgcataactgtctaaataattcagagcaaggactatcattgttcaccatactattagaagtaaagtacttagcattttttgatctaatcatattaaacagccaactccagaaaccccaaaaccaatgaaagaactccatccttaatattcagttcctctagaaccactcctggcaccaaaatctgtattagtcagagttctctagagggacagaactaacaagagatatagatatagatatagacatatagatggagatatatatatatatatatatatatatatatatatatatatacacacacacatacatatatatacacacacacacacacatacacaaaactaataggatatatttaggagtttattaagtagtattaactcacacaatcatgaggtttcacaataggctgtctgcaagctgaggagcaaggaattcagtctgagtcccaaagctgaagaacttagagtccaatgttcaagggcaggaagcatccagcacaggagaaagatgtaggctgtaaggctaagccagtctagtcttttcacatttttctgcctgctttattttctgattagatggtgcccacccagattaagggtgggtctgcctttcctagcccactaactcaaatgttaatcacctttggaaacaccctcacagacacacccaggatcaatactttgcatctttcaatccaattaagttgacactcagtattaaccatcacagtatcatataacacagcaattccattcttaggtttctgctcaagagaaatgaaaacttatgttcacacacaaaaatatatgtaaatattaatagcagtattattcataatagtcaaaaattagagacaatccccatgaccgtcagctgatgaatgtataaagtgtagtatatgcagacaattgcacattattgagaaataaaaaataatgaaatatcaatatatgctagaccatgggcattaaaacgttaaactaagcaaaagtaaccagatacaatagatcacacattgcatgattacatctaaacaacatgtcagaatagacaaatttaaagacacagaaagcagactggtagttgcctaggactggtgactctggagtaaatgaggagtataggctttttttatggtgtgatacaaatattctaaaattgactgtggtgatggttgaacaactacgtgaatatatactaaaaacattaaattgtgtactttaaattggtagattttagggtaaatgaattatatcttaatatagctgctaataacaagcaagaattattccacagagatgatggagttagcacagcttccttgctgtccacactcagtagcaatctatttgttttcctggagctaatgagcttcttgtggcttacagacagggaccagagagaaacacagaaagtgtcaggtcatgggatgtcttaacacacaggtatcttcctaagggaaatgttaacataggtggatcctataggagtgagtctggtctttataaagcccaaaatcaagaaacagctaaatagaatggatatggaaagcattcctcctgttactgaagccacaaaagtataacgagcataaaaaacagacttgcttcaagtggtataggattagacaattaggttcgtacaatatgaagtgtggatccacacacataagaaaatttcacacacaaaaaagagagttgacagtacaactagttaggaaaaagcaaagtccttcatatatgatgctgtttggtgtttattcagacagaagaaattgaaattgatttcaaatttcattatatacacaaaaatacatgttatatagcttgaaggcttaagtgtaaaaaataaacagttaaaacattggaagattattttgtcaaatacacatataatccaggtcaagagatcagtttattcaagaaatattgaatctggtgatatgaagatatatttgactctatgaacttggataccttgcctatcttccttccttcttccttctttctcatctatctcagctgtctatctcctagaaccagtaaccaaatgtttatacatggtattaattttcacgtattaatattttattaatagaatcaatagcattgatagaattttctattttgttatgttctgttctcttatatactacttgatttcattaacaagagataatattaacaccaaaaattgattttgtgatccaaagtatggcttgaaaatctgctgtagagactttgaatgtttgcatctctttagtgtcataaatatatgtatgcttcctgacttcttccttcctgattttcttcttgaataagtaatttcataaaccattacaacgcttagtatgataaccgtttgctcctattgcgggtatgggctgtggtctggtagagagaatcagaaccccagagggggaggaacatgcagtagtatttgtggcagcaacgtgcacagcaggaagtattagagccttagtcaaatgagaaaggcatctgagagggtgggaggcaaatgtggccatgtttggaagatgaaatgttttggggagccaaatggactggcagtgaagggccagcaagaattgttaagagtctaatgagggtgagtagggcatgcccatgaagtgggggacagcagcagtgtaatttggggtgtcctagactgagtgatatcaggctatctgggctgggtggggtgttgtggaagtgatcaatgtaaagaatcagagcctgggtggggtttcagaaagtaaacggtgtcaaaaccttggaaaagggttgccacagcagcctggcatggggtcatcaaacccaagagaggaaaaggaggtcattcaagatgtctggaatgggaggtcagaacccaaagcaggtaagcagaatgtttaggactgggtcagaatgggaatgatgatttggtgtgatttcaaagcccaaagatggttacaagggcatttgtgtagactctcatatgtgttgagttagggaataatgagggtaatcatggtgtctgcatgggaagggtgtcagtaggacagcagtctacagtgggatgtcaaagcaagagtggagagagtggagcaagatggtcccccagtaatcatcccctgaaacaaacaactttcataacaagaaaatgtcaggtgagcactcacagtacctggctgtaaatacatatcactgaaagagtcactgatgaggataggaaagaaagtcttgaattgctgatgccacccctcccccatcccctggcagaagacacatggcaagaagagaggatctgtgcacttgagagagggagagtgcagcaattgtgaggctttgcattgaactcagcactgttctgtcacagcagaaagcaaaaccagaatgaattcagctgatgccggctcacagaaggagtatataaaccaatcctatccagaggagaataacccaaaccagcagttgaaacttaagttccagccagccttcccaccacaggctaaagggctctggggttctaggtaaacttgaaatgcagtctaggccacaaagactgcaactcctatgcaagtactagtgctgagctgggcttagacccactggactaggatggcatgtgacctacggtgacaatggctggagcagctaagggagtgcttgtgcaacccctccctcaaccccaggcagcacaactcacaggtcagggggatactctttacttctgctgaggagagaagagggaattgtaaagggaacattgtcttacatcttgaataccaggtaagccacagtaggataggacactagtcagtcatgaggctcccatttcaggttctacctcatggctgacatttctagacacatcctgggcaaaaatagaaacctctgccttgaagagaagaacccagtcctggtaggacccatcaactgacgcaacaaacaaacaaacaaacaaataaacaaaaaaccttggtccctgaataaccagcagtgatacccaggtagtacactgtggtgagatttatgagacttgctggcttcagatgagactcagtccagctgtggtggctatgggagagactccttctgcttgagaaaactcttgcatgctgttcgtataaatgtaaatcagtacaactactattggcaacagtatttgaaattcctcacaaaactataaatagaagcatcatatgatccagaaatctcacttctaggtataaacacagaaggatgaaaatcaaaatatggcagagctatctgcactccgtgtttattgcagcactattcacaatggccaatatttggaagcaaaataagctcaataaatggtcctgggaaaactggatatccatacactgaagaataaaactagacacttatctcccagtatataaaagaaaatcaaaggcatcaaactctgaatctgtcatggtaaattgtgtatgcatccacaatggagcattattcagccataaaaagtgacattctgtcattttcaaaaacatgattgatctggacatcatcaaattaagggaaataagaaaattaagggaaataagccaggcacagaaagacaaactttgcatgatctcatttattcatgtgagctgaaaaataaaactattgaattcatgaagatagagagtagagggatggttcccaaaggcagggaagcgtaatgcaggtttatgggggaagtggggatagttaatgggtacaaaacatagttaaaaagaatgaataagacttagtatttgttaggacaacaaagtgactacagtaaaaagcaatttaattgtatgtgttaaataacaaaaatagtataatcagtttttttgtaacataaaggatagatgcttgaggtgatggataccccattatcctgatgtgactattatgcactgcattcctgtatcaaaatatctcaatatcaccccaaaatatatgtacccacaaaaattaaaaatgaaagaaaatttaaaaatacaagtacaagtggaatgaagaaggcaatagtttggggtatggtatttgtggcatgtagtgtgaagtgttggactttgaacttggtaataagtttgtctgcgtggttgtcggtggggtgagggctgcatctgtgctgcgccagtggcagccaggcgtgtggtgtcaaagcatgagtggagtgaggagaccatttgtatggggtcataggcaggagattggtttaacccagtgacatttacttagtacataaatacaatgaaggtaagaagcaggtttcctatcagagaatagagacaaaagtgtggaaagattaaaaaaaaaaaaaaaactagagtaaatggtatgggatcagattggaattgaagttttagtgtgaactcataggtatatatataagtaaacaaaggaaaaataagtataaacaggtctttttagcctgctatttggggcattacactgtgaatttttcatctttactcatgaagacagcttctgattccaaatcactcagcacacagtggttaaattaggacaactgtagcagcaatcaagttttgctgtgctttctaaccatttatttatcaaaatccgaatgaactacctttattttggaggagggaggtaaggaatggctcagtccacttctattgctagataattgtgtctttgtgtctgaaatttatgttttttaacctggagctttctttaaaaaaagctttgttcttatgtgtgggtgagacaagtgtatgactgggaaaatcagagacgaagatgacattttttcccttattttcttttaaaaactggttttggatttaatgaatctatggtttttaaaaaagtatttgaaaccacgagacatataattgaatttttcagttttcttaataactcttccaatgtaaatattctttacttttcaatttaaaatacattgttttcttagctccaaatcaactaattcttggtagttaagtatagaaacaccatagggactttgcaggatcagttgagtctcccattgttctcactagacaactgatacttattagcagtttattgagtatacttcactaacatggtttttgttcctttctatttatcaaaatctcagaaaaattacagcctttatatacttacactttaatcaacaatagctgacagcatgtgaagcaataaatagcttcaagacatgcaataaactctgaggtttatttacaaaacaacacagtgagaatcatttattgccaagttactaaaggtaatagtgattactgctattaaaataccagaagctattaaatagttgcccaagcaaatagtctacattcaaacccagaattcaaattagtcttttttcatttaactttagaaaaacagaatagtttaactctgttcaattagaaaggaaaaaaaaaataaccaagaaacaacaaaaattctccaattcaaacaggtttagaaattgtaagcttttctttgggtcatacaatgggcttttggcctgaagcaaatggaagttttcactttctactatagtcataaacttttgctgataggtcatttataagaaggaatgaataaaagtaggtctctaccatttccataaagatagactaacagagaacatgcagtatcagttgattatcacttaggaaactggaaagagtgtttcttggctttaaaagagacatgatagaaatctaaaagcacagcagataatagggaataaaggtctatttgaagtgtctcttccccagaactccaaaatacacctttattatgacatataattccctagtgattgcctataaaattctattaaagataaagatcttggccaggcgtggtggctcacgcctgtagtcccagcagtttgggaggccaaggcaggtagatcacttgaggtcaggagttcaagaccatcctgcccaacatagtgaaaccccatctctaccaaaaatacaaaaaaaaaaaaaaacaaaacttagcttagcgtggtggtgggcgcctgtaatcccagctactcgggaggctgaagcaggagaatcacttgaacccaggaggtggaggttgcagtgagtcgagatcatggctactgcactccactgagtgacagagtgagactctgtctcaaaataaataaataaataaataaaataaagatcttctattctacctcattcctctggcgaccatattcctctaagtcggggttcctcagtttggtaccaatgacatttttgaactggaaaattctttgttggagaggggatttcctgtgcatttagggtgttcagtagcatctctgacctctatcccttagttgtcagtatgatctagtccccagtcatgataaacaaaaatgtctgcagatattgccagttgtctccaggtggggggtgggggcaaaattgtatctgacagagatccattgcttttatcaatctcaaaatgcattatctgtcatagagtccaattaaaacaacacatagtttttgaaattgagactatctcataaaagctgagacatatgcttcctgaagtcagagttattgtaaccaaccacttgttactcatctcaaaacacattcactgatttctacagtcctcccctgctctgaggatttggttttcaggcaggtggagacataaatactatttaatttctaatgcatcatttcccatgtctctcaaaatgttcccaatagaggtcacacatttttacatataagaaaaaaattcagagtgaaaatccacacaattttaaataataatatatttaaagctaatctaaactcacaataatcttggggatatgaaacctggggtaacagttcattacagttcaagaagtctcatggatgtttgaaacttcaaaggagagcactattgctgattagttacgtagactgaagttttcagtctcttgagaaaagtttggtatttcaaatctgaaaatgatttaagcttactggggaatgaaataaactgcaaaacctttctagcactctaaatcctgatatcacagagattacatctgatattagcatattttgtggtgcctaaagcagttttaggagctgacaattgccagggaaaaagagaatttccgggaagtttggtcctaggaactggacatgtgtaggcatttctccaaattcaaattcaaatatgtataacaataacaataggcatttgtataatagtgtacatataaaacaaatttatagttgaggggatatattttattatatttgtagtacagaggcagatactatattaccgaagatgttttgtttactccagataaacaataactaattcagcacgtttaagcattcatcttgactctcctcactttccaactctacatcattctctgaggcagcaaaacatgtacactcagtggcctcactacagcagtctctccatcttagaacagtgtgaatgtgctctgggcaatatctgtagtgtgaagaaatgtggcttgagtttgttaatttgtaccgtgtcctcatatgcacactttctcaaagggagagtcccagagtccccataacagtcttttaaataaatcttgttctttatactgtgttctgcacttctctaccggtccttctcccaacacagacacacacacacacacacacgcacatcttaatttagaaagaatagcaatcattatttgtaaagacaactgttgggacagcaacaattctctggagaaaagtctaaaacatatcttcttaaaatgtattcctttactattaattatatttgtattagtttttttcacactgctattaaagaccccaaactgtgtaatttataaagaaaaaaaggcctccacatggctatggaggcctcacaatcatggtggaaggcagaggaggagaaaggcatgtcttacacagtggcaggcaagagagagagcatgtgcaggggaatttccctttataaaaccatcagatcttgtgagatttattcactatcatgagaatggcataggaaaatctcgcccacatgattccattacctgccacctggtccctcccacaacacgtggggattattacaattcaaggtgagatttgggtggggacacaaaaccaaaccatatcaatattctgtctgctttttaaatatttttttattttttgaatttctatagtgtatttattatacttcatcacttgggtttctttttattttagaaaaccctgaatccgccatttcctagatgtcatctcaaggctacataacactaagtcctcattacagagttagtaaaaaacaagatggttatcataactgtcttcattacagaggctgcttgaaaatgaagtctacacagagctaaccaataagaagacagtagaaagcaacacaccaaggcaccatttgaaacctcagttgcagcctttcttaaaatcagatccacatgatagtcaacaattttttattgattacatagtatattccaggcactgttgtagttactagggatataatagcaaataaaacaaactctcggtgattatggacctaatataatacttggcatgacaatataacacaaaataagcacaagtgcatataggattacagcaaagaggataaagttaacagaaagcacagcatgttggaatattattattttttataaggtgggtaggtaagaccacttcactccaaggaaatgtaagcaaagtctgcaggaagggaaaaactaagtcatgagaatatctgaacaaggagcctttcaggtagtggaaatagcaagtgaacggttccagaggtaggaatcactcagtgttccaggaggtcagtaaggctagagtggaatcagtgaaaggatgagaagtaggagatgaggtcaggtagctatcagtacaacatttgtttttatcttaggtaatctgagaagccatgtcaggaatttaacaaaaatgtgaagtcattttaggtaatttttttaaaaagtattattctgttgcctgcaactgaccacaaaagggcagggcggtgggctggagcagtccagtagggaagctattgcaataatctaagtaggaggtaggtgatggtggctaggattagggtgaaagcagtgggaatggtgagaaattgtagaatcatgtaaatatctttggaccaaccaaatttattgattcattggtgacaagggggcctgtggataaagagaaaggtcagggttcacttaaagggttttggcccaagaatttggaaggataaagttgccatttactgggtagggaaaatgcagaaggaccacctgttttcattaagataatggaaagtaagtgtcaagcattgagcatgggaaatactaattttgagatgctctgataaaaaacaccatgatatgcttcacacatcctccttcaaggaatgacgggattattcccttatacattagaaatgttgcacactgaaaggcttcagctatcagtcctattcagagaatgcctcatctgaggaaagcccaaggtcaagcagctttctgaggcaacctgcgtctaatgaatattgatgcagacatataaacagcctatctccttgtcacagccttacaaccctgaaggaccatatcacatccataattttccctgtaggcagctgaaagctttacttggactgcactgaagtttaacttctccatacatacaatactgctttcttcccctcccttcaataggagttgataccccaaacactccctaataaagatcctgtaattgaatcttaatttcaaagtctgcttcccagaaaacccaacctacaaaagatgtttctttagtaaccaaagggaaatactgttgttacagattgacatggatctatagttttgagacagagagctaaactagacatttgaattagaagttatgagcatataccacttaaactcattagatctgttgaaataatctttggagtgaatggaaataggaaaagaagaggttaaagttgaaagaagggtgtttcaatttttaaaagtcagggaagttaaggggaagaagtatcaaagaaaacaaaaatagagcagcctgggagtatggaaaaagtcccaggagattggggtacactgtaggtcaactaattaaatttttaaataaagaagaaactatcaattctgtcacatcatgaggatgggttgagtaagatgagaaattaagttgtcaatggaatgggcactgaaaatgcaaaaaaaaaaaaaaaaagccatttgagtggattaatgtgactgaaatcctggttacaatggagtcaacagataatcctggaaaggagaataaccacaactttcttcaggccagtataaacaatatatttgagaagtttccacagtgaagggaagcacagaaatggataaattgctagaaggtttacgggaccaagagaaattttgttgttgttgctttgtgttcaattgcaagatataatggcagtattgcatgctgatggaaatgatcaggtagagcaatggatgcttatgatgtaagaagcacatagggaaattatgaagcaacatccttcagagtagacatacatggaatcagtagaattcaatcagatcagagtcagagtaaagagcccacaattagaaggtgtgtgttttagatttgcattgggccttgccaattacatttccagtcctaagtgctagtgaggtccaataaccagtgtcattctgcaaagtgattatggatcatgatgagacattaaatactgagttgtgtttagaaaattttaaagtgatttgacagtaattttatatatgttgaatctaacagttaaaatggctttcattttacatcttttgtatttcatttttctagtaattcatttaaatgcaccctttataacagaaactttaagaagcactgatctagcatgcaagtgaaagaaatggtttatacagaaatgaggagtgcttatttttaattactgaagtacaagtatcacaggagctttggtgttgcttcgccagctggaaacttctgcggccaatggcaccttctacctgaggattgcctgtgactgctgggcttgttccacctatgcagcctgacaagctgtgctcggtttgtgctactggcccagatcccacatctgccaagtgtgagccaaaagcagagtggcaaaggggtgtgaaggtgagtgaatgtggggtccagtcactgagcacagccaggcacactggctgctacaagagggcaggcagctccaggtgccagtataggaggaaggtccatgtaagcctgtggttggaccagatgcaggcacctgcatctggatgaggggaatatggtggcttgtggaagcttggagatgccaggaactgcagaaccccaaggagggtgtcacagccctggtttggggagcccttagatctgggttccataaagggccacagctcttctctccttcctgttgtctgcattgtggtgtcggggatggggtgcctgtttccgtcctgtttgtgttacagctcttcttttagtcctgcccaaccagcaggtcctgagtttttttcctacatctaggaagaatgaggtacatagacaaatggagggtgagcaaggcagagaggagtttcactgagtggcagaacagttctcaggagacccaaagtgtgtagctcctttcctcaggcaggtagtcccaggtccagcttgtcagtggagaggagatccacagtgggtggctcccttctgcaggaaggtcatctcattgtctgtgaagccctcgtggagaggagacccagggtgggtagctcctatctgcaggcaagttgttatgtcatttgctggagtctggctgagtctgggggttttaatgggcctcataggggaggaagtacatgctgattggtccatgggcagccaggggcaggcccaaaagcagcaccctaaattctcattctgatctgccgaactgacagctgggcccccaggctattactataaagctaccaatgtcattattcatagaactagaaaatactattccaaacttaagtggcagtgaaaaagagcccaaatagtcaaagcaatcttaagccaaagaacaaagctgaagccatcacactacctgcattcaaattatactacaagtctacagtaaccaaaacaacatgctactggtagaaaaacaaacccatatactaatggaatatattggagaacacataaataaagccacacatctgcagccatctgatcattgacaaagtacacaaaaataggcaatgaggaaaaactccctattaaatcagctggctagccatacatagaagaatgaaactggattcctagttttcatcatataaaaaaaagtaacccggctgggtgtggtggctcacgcctgtaatcccagcactttgagaggccaaggagggcggatcacgaggtcaggagatggagaccgtcctggctaacacagtgaaaccccgtctctactaaaaatacaaaaaattagccaggcgtggtggcaggtgcctgtagttccagctacttgggaggctgagtcaggagaatggcatgaacccaggaggcagaactggcagtgagtcgagattgtgccactgcactctagcctgggcaacagagtgagactctgtgtcaaaaataaataaataaataaatattaaaaaaaataaattaacccaagatacattaaatacttaaactaaaaactaaaactataattcctagaagaaaacctaggaaagttttatttttatttttttttgtcaaaatgatgaattagagactttggtgcgcctcagccacttgaaaatagcaaaataaatcataaaaatgaactctgtgaactttaagaagaaaaacgggaatccaatggaattatgaagaataccccagatcctggagaggaaaacaccagcaaacagctcccacgatggtgtccagttgataaaaagaaagaaagaacaaagaaaatatcccacctgcatgaaaaagttacagaaattaaaaatcctagtgtctccagataagaaaacatcagtgcaagaattctggcatcatgaaaatctgaatgtagtgataccaccaaaggattccactagattttaagcaatggtccctaaccaaaatggaaactcagaaatgacagataaataatataaaacatggattgcaaaaaaattcaataagatccaaaacaaacttgaaaattaacacacaaaaaaattctaaagcaattcaggaattaaagaaaaagataaacgtcttaaaaagtaatcaattacagcttctggaatcaaaaaaactcttgaaaaatgttaaaatatatcaaaagctttattaatagactggatctatcagataaaagaatttaagagcttgaagataagccttctgaagtaacccagtcagacaaaaataaagaaaaaagaattttttaaaatgtacaatgtcttcaagaaataaaggattatgtaaaacaatcaaacctattaattattggcatttctgagagagaaagagaaaaagaaaacaacctggaaattacatttgagggaaaaattcaagaaaatttccctgatcttgccagaaaggtagacatccagaaacaagaaatcaagagaacatctgtgagatactatataaaatgacttcactagggcatacagccacgtgactgtccaacatcaatacttaagaaaatttttttttttagcagtaagctcaaaatagcgaatttcattgtttttttaaattattattattatactttaagttctgggatacatgtgcagaacatgcaggtttgttacataggtatacatgtgccatggtggtttgctgcactcatccacccgcgatctacattaggtatatctcctaatgttatccctcccctagctccccactccctgacaggccctggtgtgtgatgttcccctccctgtgtccatgtgttatcattgttcaactcctacttaaaggcagatagagaaaaaggaaagatcacctacaaaggtaaccccatcaggctgaagcagacttctgatcagaagacttacaagccaggggagcctggggatctattttcagcatgcttaaagaaagcaaattccaaccaagaatttcatattccatcaaattaagcatcttaagcaaatgagaagtaaaatattttcctgacaagcacgtactaagaatatttgttaccactagaaagccttcaaagaaatcctaaagtagttctaaacatgggaaccaagaaccatatctgctaccacaaaaacatacttaagtacatagcccacagaccctataaagcaacaacaaaatagaaactacaaagttaccagctaacaacttaatgatagaatcaaaatttcacatatcaatattaacctggtacataaatggcctaaatgccacccttaaaaggcacagagtggcaagttggattaaaaacaaaacaaaaccaagatccatatggctgctgtctccaagagacccaccttatatgtaatgatacatgaagtaaagtaatgatgctcaaagtaaagagatggagtaagatctactatgcaaacagaaaaggaaaagaacagggattactattctcatatcagataaaacagagattaaactaacaacactaaaaacaaaaaagaagaaagaaagaaaggaactacataatgataaagggttcaattcaaaaagaagatttaactatctagaacataaacacaccccacattgtagagtctagattcacaaaaccagtactctagacctatacaaagacttagccacacaataacagtgagggagatcaagaccccactgacagcattaaacagattgtcaaggcagaaaactaacaaagaaattctggacttaaactcaacacttgagcaactggatccaatatgcatctacagaatactccacccatgcaccacagaatatacattcttctcaactgcacagggaatatactccaagatttaccacacgctgagtcataaagcaagtctcagcaaatgaaaaaaaaaaaagaaatcacagcacccatattcttggaccccagtggaatgaaaatagaaagcaataccaataatatttctcaaaaccccatgattacatggaaattaaacagcttgctcctgagtgacttttaagtaaacaacaatatcaagccagaaacataaaaaattatttgaaataaatcaaaacagaaacacaacataaaaaatctctgggatgttgcaaaatcagtgttaagaagaacatttatagtgataaatgcctacctcaaaaagttagaaagatctcaaattaatgatctaacattatactagaggaagtagataaacaagaacaaactaatcccaaagctagaaggaaaataagacaactctaattagagttgaaccaaatgaaattgagacccaaaattccacacaaaggataaatgaaaccatagtttcatagttggttctttgacaggataaacaagatcaatagactgttagttagattaataaagagaagaaaagaaaaattcaagtaggcacaatcagaaatgacaaaagtggtgtaatgtcacagccgatcacacagaaatacaaaactccctcatagacaactatgaacatttctatgcacacatactagaaaatctagaggaaatggaaaaattcctggaaacacacaacctctcaagattgaatcgggaagaaattgaaacactgatgaaaccaatattgagttcaaaaagtgaatcagtaataagaaacctaacaaccaaaaaacagtaataataagccccagtccagatagattaacagctgagttctaccagaggtccaaagaagagctgatagtaattctattaaaactattccaaaaaatcaaggaggggtgattcctaactgattctatgaagccagcatcacctaatatctaaaccgggcaaagacacatacacacacacacacacacacacacacacacagagacagacacacacacacacacaatgaaactactggcccatgcctctgaagaacacagacacaaaaattctcaacaaaatacttacacgtcaaattcaacaacacatcaaatatttaatttacgatgatcaggtagggttaattcctgagattcaaggttgtttcatcatatttcaacatatacaaatcagtaaatgtgatccgatcacatgaacacaatttaaactaaaaccatatgatcacctcgagagacgcggaaaaagctttcaacataattcaacatcccttcatggtaaaatccctcaagaaactaggcatcagaggtacatatctcaaaataataaaagctatctacaacaaacccatagccagcatcatattgaatgatcagaactgcaagcattcctcttggaagtggatcaagacagagagatcttgtctcaccactcctattcaggacaacactggaagtgctagccagatgttaaactttttttttcatatatttgctggaggcaagaggaagaaacaaaagcatccaaatagcaaaaaaaaaagaaaaaaaaatcagactatctgccttcactggtgatatgattttatacctagaaaaccctaaagactctctcaataagttattagaactgatcaacaattttagcaaggtactaggatacaatcaatgaacaaaaatctgtaggagttctatacaccaataactaagagccaaatcaagaacacaattcaatttacaacagccacaaaagaagtaaaatacctaggcataaatctaaccaaggaggtaaaagatctctgcaggaagaactacaaaacactgctaaaaaaaaaaaaaagggaacccttgacaaaaataagcactgtggaaaggactccctattcaataaatggagcttggatagctggtgagctatatgcagaagaatgaaactggatacctaccttttactacatacaaaaattaactcaagatggcttaaatattttaatgtaagaactaaaactataagaatcctagaagaaaacctaggaaacactattctggacatcacctttggcaaaggatttatgattaagtcctcgaaagcaattgcaacaaaaatgatcattgataagttggacctaattaaactaaagagcttctgcacagcaaaagaaaccatcgacagagtgaacagataacctacagaacaggagagaatattcccaaaatacgcatccaacaaatgtcttatattcacaatctacaagtagcttaaagaattaaacaagcaaaaacaaaaaattccatcaaaaaatgagtaaaagacattaataggcacttctcaacagaaagggatacaagtagccaagaaatatatgaaaaaaatgcttaatatcactaatcatcagagaaatgcaagtcaaaaccactatgagatacctactcacaccagtcagggtggctattatttaaaagtaaaacaacaacagatgatgggaggctgcagagaaaatagaatacttatatactcttggtgggaatgtagattagttcagccacagtggaaatcagtttggagatttctcaaagaactaaaaatagaactaccatctgacccagcaatgccacccaaaagaaaataaattgactgaaaagacacaggcacttgtatgctcacagcagtactcttcatgatagcaaggacatggaatcaacctaggtgcccatcggtggtggagcatataaagaaaatgtggcacatatacactacggaatactacatagccctaaaaaaggaaattgtgtccttcttagcaacctggatacagctggaggccatcatcctaattgaattaacacagaaatagaacaacaaatattacatattctcacttataagtgagaactaaatggtgcatacatgtagacataaacttgggaacaaaagacactggggagtactagagggggctggctgagagggagcgtagcaaggctggaaaaaccaactgttgggtgctgtgctaactaccttggtgacaggattaattgtaccccaaacatcagcatcatgtgacatacccatataataaacgtgtacatgtaccctttgaatctaaataaaaacggaaaaataaagaatggcaaaattaaaagaaaaacaaacaatacattttgctaaatgaaataagtcagacacaaaaggacacatgctatatgattccacttatataaggtagctataacagtcaaattaatagagacagaaagttacatggtgggtgccaggagctgtgggctggtgtttggggagttagtgtttactgagtacggagtttcagtttgggaggatgagaaagttctggaaacagacggtgatgatgttgcacaaaaatgtgaatgtacttaatgccaaagatggttataatggtaagtatcgtgttccatatttttattacaactacaataataaaagatatgtaggaatttgccagatgaacaagatgaaaaagggcattgccatgaaataaacataatgaatctgaaaaaaataaaagcatctttgattgcaaaagagcaaattgcaaatatccaaagtaatccttgtaatacacgtgacattataaattttacgatgcagtgcctatgattcacgcacactgtacctgaaccagctgtgaaacattcatgaatcataaactcctgtatcatcttcagagcaaaaatgcatcctattttacaagaaatattcatcaaaaaagggaaagagaagtaaaaaccctgaaatttctagaacctttcaaagatatcagaaaaacaaatcaatacctctgacaggacctgttaattcagagggtcatgctgtaagacagcttgcatttaattcaaactgttttggaacaagatcaattctgtagtgagatcaaggcagcagaaatttttcctcagggctaaaaataataattccttgaggcccagacattaaattccatggcttcttgaaactattcaaaaatgagaagaatggataaagattaaaagaaaacacatgctgcaagctgacaaaacacctttttagacttacacccaattcgttcattagtcaaatgtgtggttttttttttcccttcaggtaactggaggtgtcaacattcaacttcttggtctgtttctcgtcattttctattttctcctgctatttgtctctgagctgttatacctgttattgcagtttccaacaagaaaaagccaggaaaaggaaagagaatcaaagcatcagagcgagtcacctcactgggaggtggaaccagaagttttaaagcagtagcaaaatttgtatgttctgggtgtcagtggacactttctgtataataattttattttacttttgttaagaatcatgaagcaaccacaaaaaattaaatcaaggcttatcaagtagatgtttgaaagagaaacaatgattcaccttataggtagatgtactttgctattgaagggattgtgggcaagtctaagcaaagctgaagggaataaggaaatttcattccttagagaagacagcatagaataatagtacagagagtgtagggtagaacagcttgcattctaatcccacatctgcaacaggattctctttgacataggaaaagttacttctgctttgttgggagtattaaaaatggagaagttttcaagtgcttagtgtagttcctggcttatgatagcatcaattaaaattaggtattgatgctattattattaatattgatctcttagccatctatatcttcagcatccaaagtgtcagtttgttctttaaattgcaattgacccttttttctcaatagaatagctagtaaaataataaagtggaatttcttggaatgtatccattctcctcttttacatttcatttttttattcattatttcaaatgcccagtaccttcttgttcaccctaaaatcttttatgagtttatgagttaacaggaaaacagattccttttagaaaattggaataaaaagaattaccattttttttttttttttgagaccgaatctcgctctgtggcccaggctggtgtgcagtggcatgatctcagctcactgcaagctccgcctcccaggtgcaactgattctcctgcctttgcctcccaagtatctgggattacaagcatgcaccaacacacccaggtaatttttgtatttttagtagagacagggattcaccatattggccagatgggtctgaaactcctgacctaaggtaatccaacccctcagcctctcaaacacttttttctacatttcaaactctttgcaatttacctgctatctcatttaatctcctcttccctacactgaagacaatcaacctccctcctattaaccaaccacttatcctgcctccttatgtaccttaaatacgaaagataagatagtccccattattttaataaatatttattgaatatattcttgacaagtaatcctgcttgtatttttagctagctaatgtgagatacatctttgacatggttaaatgtatgatcccttaattaatttaatataataaactaatgctacattataggggtataaacacttttaaaaatatattttctattttaaagttggctttatacttaacataaatataatggacactttgtttatttttgaatgattatcaatcattcaaaggtcagtacatctgacctttcacaaaaaaagtaaaaggtcaaatgtaaaaattgtaggttttgtggttcacatatagactctgcatattattctttaatttttgtttttggttccatatttttgtttgtttatatgtttcttacaaaccttttaaaatacaaaaaatattctatcttacttgtctctcaaaacataggccatttaacccaggaactgtatttggtcaatctgtgcttcactgtaaatgttctttgttattttaaaagcaatacggacatatttcaagtaaattattgttttcactaccactcattttcagatgtaagtccacaggttaacataaataagaaagtagcagccaaaaacaaaaaaaagagagaacagtaagaaaaacattttaagtcaaaggaaaattgccagcttttatcttctcctaaatcccaatccttcactcctaaaggaacacattaagtgcaaagggggtcatacttttattccattgcaaaaagggtcatacttttattccattccccatgtatacatttgttatccatttggcaaattgtggttgaatttctcttgggatgacctcgccagcagtaggtgaatggatcatttgattcaacactagttcgtaagtgattgttcttttcaatcaggcacacactcactgctgataactgcatattttgactatttgtagaagtgttaaaggaactaagaattttatcgtaaataagccatgttggaacaaatatcaaggccttgagaataatatactttatacctttgctcaacatataatgtaggaaaatatccaattaagagtctagaaatggagtgaggaagggccagctgagtattttgtttaatttttaattgttaactcttatagtaccttcataaagtttccaaatcttttcctttttcttgcttttgctgtaaatacaaaagtccaagcctgcattatattatactcagtttgaataaggaatatcagctccttaagaataaaatgaaacagttttattcttcccaagatcttttcaggcttttatattgatcatcttcatttctgctgtgtagctggcttcatcaatgatgtctcaatttatgtctataattgttattttgcaaaactgtctcattttaattaatatgatgccttactcattatttttaaattattttcttcattattttaaaactaattttatttctaaggactgggaacagggtgggtggatgtgataatctcacacatgttcttgtcttttttccttttattttccctctggtgctgggatagagaggatgaagaaagaaaaatgtattcgttagatgaattatctgtattgaggttgttctaggattactgtgctagaggaaggacccccaataaattccaccattaagaggctcaatatcaagcaacaatcctgtgatctagtggcactgtatggaattctaacgtatcttttagctaatgtccaggtggtagtctgtgttacatcttgatatgcatacctctcttcttcacatgcttcagtatcctttattttatttataattagaagcacaaactctgagatttacggatccaggcaggactgatctcacctacaatactgggcaagatcttcaaggggacagttgatgctttcttgccaactgcccactccaccaccacatttctctccaatgttctctcccttgttttagttgtactgactcaaatctaagcagctatttgattagagtattgaatggtgatcttccctgttttgtgtgaatttctttgggattttcttctctcaatccttgccagactttttttgtaataacactggactagcaacaatttcaacctcacctatttataaaataatgttatctagtactatttgagacctctcttacttggattttttggagtattgtactcagaatcaggaactttttgagataaaatctgagaaatgaataacttttgctcaattgtgctttattcaggttcttatctgtattctattctataatctccaagtgaggaaaatagtcaattcatatttctctaaagtgtttcttcataagagccttaaaataaattgtatatattttaaacattagtacatttaccccaatataacatcacaaaattaacctttggaaaatacagaactaatgtaatacaaaacattcccatccctccaaaaacagataaaataaaatataatagttctctacagcctaatctaaaagaatgtgatgtaatggatagagcactgatttattaatcaaagggagaaaaactaatgtggctcataaacctttccatttctgagtctcattcttttcattttcccgataataatgataataagatcgacctgtttgttagggtcaggttaatgaccaagtgaaatgatgcgttatacatatgtcaaagaaatatagcctcttaaaagaaagttaacgcagctgacattcagtaacatatctcggtttgtaagtaaaaaattagaaataaactcaaataaacgatcaatacatattatagtaaaaagtaataatttgaattaagataacttgttgaacactgatttatcaaactctattgaactaacccattttttaaatttatacttttgtttgtttgttattagaaaaacatttccctagatagaagctgctccactattctgaagggaagtagaaacgatgaaaagcagaactggagatgatccatgatggacatatagtgtgagtaagaaatatatattatttgttttaaatcactgagattttgagtttgtgtatgtgtccataatatgagctaactatccttaatgataccataagtaaagaatttaaagtaaataagatgtgcctgaccgcatattaagtgccacactaagtgttaattatagctccctggcggtaaacaggggactggttccagacttctgagtatataaaaaatccacacatactgaagtcccacagtgggtcttatggaaccctttgtatacaaaaggttggctctccaaataggcaggatttatattatatctctcaaaaaatctgcatataaatggatctgtgcatttcaaacttgggttgtgcaagggtcaactgtgttactattttatgggatgagacggcagagatgatacatggaaattttgtgtttaaaaaaggagaaatatgcaaatggtggtggggtgggccaaatggaatgtgagttacatgaaagggtaatttggaaggaaacaacgcttttgtgaagaaaagaaatacttgaatatttgagtataaaacatagttttatttagtacccttgcctcatctttagtatgataaaaatagataaaaaattcagacagacaaagagggaggaagctgcttgagtgaacatactctgttgatgtaaatactcgaggaaattagctctatattgggtggtgtgctgatgaatgcttaacaaaaaaactttgaagtgaaaggcactgatttgttgtatttgatgatttctgtggcataaatatgcccaccatagcaatgtttagctggtaacatgacatagctgcacagagtcaggaagagatgcacatgactggctctcacgatttcggcgcggtctggctccagcatttgactgtgacaagtttcactggccggtgagaacgctggaggaaaaaaatctacctataactgacccttattagcataacaggtttgagaaagcagagccctattttcctcaagtgaatgccatcaatacagccgtcaggcaaaactgcattcatgcactgaggaaaatcactgcttctcaaacaacttttggataccataaaaggcccgttcttaaaaggggaagtgggaggaggggaaacaagaattgttgcctgaaaagaaacgactttgatctccatcaaaacagattagtttgaagccaatttgctgctatcttcaaaactatatttcccctcaaattctgtcttccaaattgagcagtgcgtcagctgtaggtagtgctagagtgtgaaaaggatgaggatggaggcagccagggtacctccaatgcatcttgttattagaagacttttgaagagtaatttgacgggagcttttcaacttttaggtcactagtttaaatgtagtctcagttgatcatgaacaaaagtgggtggttagtggcctatgaaaagtaccttcatggtattacccttgttctttctaatagagactgccactacagttggcatcctttcttttccttctaccagaagcacaaagggtgaatagaaatgtcatttcaagtattttttcagcctttgtaccagagaaatttgaaatatgaaaaaggccaacttcttttcatctttaactcacaggtagaattattgaactataatatgtttcctagatcttcctggattttattaaaatgaaacctgagccactttacaagtaaaattatgtcttacttcatagaaagttaaattacataaaggcacatacttgacaaatatttaaatataaaatgtataatttcttgacctgaatcttacacatgtaaaatttattttgttttccttttctttctcttatttttttcttgcttcaataaatgagttcccatgaatgtaaagacaaagatcttattactccattaaatgaactatcttaatatttgattttttctattctttatcattacaatactttgacttttttttcctcctaaagagactgtaggttttattccctttcttttaattatttcatgaaaatcctccaaatttccatattactaatatctctaccttcatataattttgtttcaatattaaatgatcaattaaagcaaactttctctaagtacctggagaaaagcaacagaataaatattagagtagagacacaaagtagtacttggtaatgccaagaaaatttcagcagctatcagtaatcagtaggatataacagaaatagccctgttttagaagtgatgaaaactcaatcaactgattttaagcagcagttactttctatggggttagctttccacatctcaaaaataagattgatgtgttatttttgcatcattttcaatacaaacattctatgaaatcttcacttttatatcatccgaatttaagtgacagggtgttaatattcgaatgggatttaagcgagatgtagctgtgccttatgtcacgtcagctgatggtaaagattgatgctgggattttcctgggttagtcatgttaaaatctcccctaggctttaaggccagcttcatgaattctcatatcagcaacttctgcaattaccacataacaccagaagataaactctgttctctgaacattcatatagaaaatagtacgtcatcttatgattcttatgattggcatagcaaagtgaaaatatatcaacaccgtatttagcccaacttgaagctgcatattcagtcaaagatagagcttttcctggccaaagatactttggtcagaaatatataaacagtgaacaccaagctatcatcttgcaagtaacacatatgctcatgaatctctagctacaaataaaaatatcagctaaaactacccccttcttctaaaggaataaaaaccacagcaattacaagatttgcctatggccataaaatgaagtggggtttgtctcagaattagaatgcctaccatcagcctttgagtacaaagttaattcccctacacaagactgcatcaaaaataaatccagctggacaaaaggcatacaagacagaaaataatagtcagctgcagactctttggatccaaagtataaaatattcaagtatgtgtttccaatcccttcattctctcctgtaatgattgcagctaatccctgcctgccaaacgttagttcttcaattgtggcgatcaatagaatagattagctgtggaaaccctccatccatattacccttgctttcctttccagatggaattttcattcactagagtggaggcaagcatgtgaggtttctccctccatacacaaatataaactcattaaatgccaagcttgtcactttagaatttatacacacacacacacacacacaccaaggaacatacctgtagatttaataaaacagcaccaaccctcatggcttcactaatttcaaggctatacatcagctgtgggaagcgaggagggctttgattatttggtggaagcacttcaatatacacagtgcagatggagttcctgcagagaaagagaggaaaagaagatggttacgaatctgcatcacatttaatgttagactgcattgtttattcagttgttgggtttacaggagaaaaaatttccaaattttatgaaaaataatacaatcaaaatgaaaggatagaaaaaactaccaccaaagtataatggttttatgaaattatcttagtaaaagtaattgactccagtatctgtttttcctacttagattaatagtatgaattaaaatggaatagctatacaaataaagctaataaattaacttgccttgacttctgactttgtttttaatgcttctctaatagcaaaatcattctataaacatctggtaataaaagctgtccttggggcttttttgctgttaaaccagcagagggagtattgattacaataactcacaaaacaaattatgggctgcgttttatcagttctgttgctgacatcaatggcttaatgtaagtgcatgtgaggagtcaggatcataaagaatcctacgtaaaatagttgcaaacaaaactaaatacgttttaaaatcttctctaaaaagcaatatatgataagctaggaattagatttaataaagcccttataatgacaggagcttttcttgaaggacaagataccttatcattacaaggaaaaaaaattagcattgacatagtcaacttctttgatatctctgaactttgaatttgttttataaaacaaaaactgaagaagcatgttagtcaaggtttgtaaggtggaaacattagctgaaatatatcaatgagatctgaaaatacataaggttagccctctatcgtgaaaaaacatatatatgtatacatacacacacacacacacacatatatacacatatatacacacacatatacacacacacatacatataacattttgtacaaacataccaccactgcctaagatgtatgctttgaatttaacaaagtcatgatttagttcaaaacacatttgttataatttctatttggggatgagaatctttatttatttatttatttatttatttgagacggagagttgctctccagcccaggctggagtgcagtggcatgatctttgctcattgcaacccccacctcccgggttcaagtgattctcctgcctcagcctcccaagtagctgggattacaggcctgtgtcaaaatatctggctaatttttgtattttcagtggagatgggttgtgccatgttggccaggctggtctcgaactcctgacctcaggtgatccaccctcctcaacctcccaaagtgctgggataacaggtatgagcaccacacctggcctagaatctccttaaagtagtcccaaactctttataagatgcttcaattaaaagacatggtcaccaaaaatatttgtctgagtttattaactacaacattctacttttcaaaaccttttgaaagaaattcaggctgggcacggtggctcacacctgtaatcccagcactttgggaggccgaggcaggtggatcatgcggtcaggagatcgagaccatcctggctaacatggtgaaagccggtctctactaaaaatacaaaaaattagcttggcgtggttgcgggcgcctggggtcccagctacttgggaggctgaggcaggagaatggtgtgaacccaggaggccgagcttgcagtgagccaagattgcgccactgcactccagcctgggcaacagagcaagactccgtctcaaaaaaagaaaaaaaaaaaaaagaaattcagatcataggcactaaaatttcgttttatagcttgtcactttataatatacctaaattcaagttgtttctgagcatatcatcagtagatagataccaatagaatagtaagcataaaagctacagtgacttttaaaaatttcatggttgggtgcggtggctcatgcctgtaatcttagcacttttggaggccaaggtgagcgatcacaaggtcaggagttcaagaccagcatgaccaacatggagaaaccccatctcgactaaaaaacacaaaaattagccaggcatggtggcctgtaatcccagctactcaggagtctgaggcagaagggagaattgcttgaacccgggagacggaggttgtagtgacccgagatcgtgccattgcactccagcctgggtgacagggcgagactctgtctcaaaaaaaaaaaaaaatttcatgcttacatttatcatgatattgttctaaagtaatctcactttaaattaaaatattttaaactttcatagttaaaatatctgtattcatttctgcctctgattttatctatttagtatcaaaatttgccaatacagttaatcagattatatttcttaaatgggttcaaactgatgatgaaatgttgcttatatacttataattattaatgtaaacatgaaacaatgggaagttacaaaatgtattgtatactgcaaagattcccacttccgtgttgtgagaacaaaagaatcgtcattctgaggtagacctaacatccttccaggtggtgatctgactccagaagcagccccaagatgtaaaacattttccctgatattacccttgaagatcttggcttcttttagggtctgttgttgatcaagtttttaaaacattttatgaatctccttcttttctctgatagcacattctctatgcataacaagtcctacaacgttattggtaataaaagtaggtgagtgatgttgaacacagaatttgtaaccagatattcctgagttagaattttgacgctgccctcaatgatctagagcaaattatttctttcagcttcattatttccacataataagtgggaataataataacatctaaggtcagcataaagatgaaataagtttatatatttgtatatgtaagtacatgtatacatatatatgaaacatacttttataacttattttaataaattactcaaaataaggcttaaggtttcttattccactctatgaatagtgcaaacgatcttgcattttccttagctacatcctttataatactgtagatattttaattgaatcctttcacttggctaaattcctacaaaggcttgatactccttcacccctcctgagcatggggtatgttggtgttagaatttgagcatgttgtatcataatctttagggtaggatacaagaatctacaattttcacaaatttccaaagttctacttatagaaactagactttgaagaccactgcttcagaatctcatgaaaagtacaatatgtagactcacctgttttttttaaattacctcaggagaaaaactctacaaagtcacttaacgtcttcaataaccctggatccaagagacttcctcactgtttaacatttttttttttttgacctggaacatatctgtactgcagattcgaagctttctttcaaaagctaggccctttctgcttcgatattctttagatcttcagtttactggtcaagaatactttataaaggttttacaagaatatcagtgtcttaaagcttgtgaaagtatagttaaactacacttattatactttttgtatttctttattcctttccctttcattatcttcccattgtagagggttaaagtgagacaatgctacaataaggaccttaaactcgtatgagttacttggatacttgtcacagagtcgaaaactttaaaatgctgaaacaaagaggactctagtctcagacaaaacacagagacaaattttagcccaacatgaccgtctccttgatccgtccttactcctttgcttcctctgttcctttccacaataattcaaaagctagaattgctaattgtgttcccccacccccttggtcttgaatgttagttatttggaggagatcatatattaaggtcttgtatttttcatcttcaacatcctggcatgtccctataatgtgtttaaataaccaccaggcttcttgagggttactgccttttaaaatgctatctcctttttatccctgatgtcagcacagtgtcagagttagcttttctaaaattaaatacccatagtattaacaataaaataatagtatttatgctgtaataaatagtagtatttcaacagcatcatttaagcacttaataaaatagggcagtcactatataaataacactttacgcaagcattttgtattcatattttatcgctaaatgcataaaactgagcatctatataagaaaaattttatttttgtaatatagccagtatgatgcagataaatctccatttctaaaaacgaatctcataaagctttattatatttcacctggtaataaaggtcaaagtagcacaaaagaggtaatatatttcttatatactcttgaaacctacccaatagttccataaatataaatacatatatacttttttttgataaacatagaaattgacccttctggtcttaaagcttgaaacttaacatttgttttatctgagctccttcctcaggaaacaaccttcaggcctcccaaaaaaggtatcaaagaactgaaactcaccagatcaccacatccgatgagatgccagacccgtcattcattatgattgcttcctagcccctccctagttcctgttttcttacatattgttacatttcttccctgctatgtaaacactaactgtagtcagtcagtgagttggatttgagattgtcaccaatttccttagctgcagcaccagattaaaatcttcttctttgacaattgttgttcagtgattggctttttgtatgaccagctgcagaatctaaactgaacccctggtgttcctgtgacagattttcgttacctgaccaagaacacattgcttgtgtcttggctgccttgagccaagagtcttagaaggcctcctaagcagttgctcacccaattttcactggaggtgttttggtttttttctggccccacagcagctacccccaactacattcctgattgtctagtcagaacagcatttgaaatttgacatctgcacccggataggtgagtgtcaggttctttgtgggcctggacagcatgatcccctcctctcagtttgagaattttttaaagaaatttttatttgtcagttgaacaagcccaaatgactgaaagtgggaagcatcctgtgttagtatggacactttttgggggtttcagtatgaacactcttgggggcttgtttgtaattgtgaggtgtgtgtgtgtgtgagcaagtgtgtatcttttgtgggactagacagtgggattggctcctctcaatttgagaaattcctaaggaatttttctttgtgggttggtcaagcccaaccagtagaaagaagaagcaccccgactgtttcagtttggatgctcttagggctcgtttattgtttcagcagtaggattgtgttggcgattgtgtgtgtttgatatagtcatagcaaagtagaattcagtaagctaatattttctgaaacactgtttggctccaatattctttggaatctggagtttgctattgaatgggaaagcatgacagagttccatgtatccagacttttgtgctactgctctaaccatggtcaggcctggtcagtatgtgatgttctcttgtgatgctgtttggttccagtgttctttggagtctggggaggtttagcctttaaaaagcaaattgccatgaaaactattctacccaaaattttgattcacagccttcaatggattacctactgaggtcaagaaagtgtggctatgtaaaccagtgagtttctattgctatatcatggctataattttgaggtaaaatagattggatctttatgtgtgtttatatgcgtcttaatggtttatgtatgttcatgtattacgtttttttttgtctaccaaattggtttataaataaaagaatacacataagtaagcccaaagtatttttcaagttcaaatgagttaagtcaaccacaataagcaagctggctttaacatttttgataaaataaaaataaaaatgcctttagaattgtcagcatacatttttgctgagttttatatatgtctctgctagatatgattgaggtgtcatggtttggcatagaaggttatagaactataaacccagctaacataaaatgatcttggtttgtgtaccttctttgacaaatgagactaatgtaatgttgttagttgattcttgtgagttaatggcaaaaatacccatatctttaattttaagatttagttgaggacctgacattcatcagctattaaaaaaaaaagtaatgaacaaggaaaaagctaactttaaatgatggtgtctaatatttcagttttcagaagaaatctggataaactattaaaatgaaataatcaagtacttgtaaattgaataaatgttgtaggtacactttttgtgtaatataaaatttttaaattgtttttggtgctcattgggtgtctgggtcatttccaattaagaaaaagttatggggaaacatatttctaaaaattgtggaatggttctcatctgtaaaatgctaatatctgatagtcagctcagaatttcttgcttctcagatgttcactaaagttttgttcactaaaatttaaggctactaagaattctaaagaagatgtgtttttattgagaaaacgaatctgtttgtctagttcagaagttatctaaaggctaattaaaattatgggcttgaaatggttagttatgaaacaaggcagaagaaaaccaataagtagaagaaagagatgtgtaaaaagttatagatacgaaaatatattttaggaaggtgataatgaaaaaaataacaatttttataagaaaagattttgtatggtgaatgtttgtccaaaattaaaataactggttattaaaaaaagaacagaaagaaaatctaagacaaaacaaaagtccaagcatgtcatggatggtctgtgtaagtcatatgccatttttcctgtttctctgtgtgtctatcttcatgcctgtacaaagaaaatacaaagttgaaaaagcttagataataaaatatcctttaaaacttgataaaataggaatgctttggctaattagcattgttcatagttaaagctcatatcttaatgaatgtaaaatataaattattgtaaagaaatacattagcagtttggcaattttttaaatatagttaagcccaaagctggatgtaacatggagccaaatttcatagtatatttgctattctgcatcacatacctaaagtgaatttcttagttacagaaaatgtatagtggtactgctggacttaaagacagtaaatatcaaaaaactgaatcaggaataaaatatccatcaggttaattttttttggctctgggtaacactgtaaagccaaagttaattgagtagaagataaattgagggttggactactgtttatttctgcttttttttttttcttgagacagggtcttgctctgttgccaggatggagtgcagtggagtgatctcagctcactgcaacccctgcctcccgggttcaagtgattccccttcctcagcctcagtcctcagctgggactacaggtgctgccacctcacctggctaattttttgtattttagtagagatggggcttcaccatgttggtcatgatggtctcaatctcctgacctcgtgatccactctccgttgtcaccaggctggagtacagtggcacaatcttggctcactgcaacctccacctcccaggttcaagcaattcccctgcctcagcctcagtcctcagctgggactacaggcatgtgccacaacacctggctaattttttgtattttagtagagattgagtttcaccatgttggccatgatagtctcaatctcctgaactcgtgatcccctctcctctgcctccccaactgttgggattacaggcatgagccaccatgcctgacctatttttgcttctaattttcatttatttgctatttgttctacttaaatatacaaatatatacacatacacatatttatatgtatacatatacacataggtatacatatatgtatatatatttgtatacatatatataatatataaaactattgatgctttttagtttctaatggaaagcttttatttggttctatgaatagtcattttgttttctatgtatttccaacaattcaccatttgttctgtttattgaaagttcctaaactacctttgtcaagcttcaaaacattgatgaaggacagcagccatttaaatttgattggtttttcttacctctgagtatattgatagctatgataattttaaggttcttggcaaaaatcttataaaagacttatttttatgagttctaaacacaaatagtacattatatattttgtaatttggaaaagtagatgagaatagaagtgtttaaatgatgtttatttccaatgtaattcaattcaatcaataatttcagttggttcagatcctttcctttagtgaagaaaaactgtgatatgggttaaaagttttaatgttcaggaaagactgggctgtttttttaagaaaaattttattgattgggatttctctgaaactactttcattgtgtttaccactattaacattaagtgacactcaattgaattaggtagtaattgctttaaaaattgtgacactttgttgtaatttttgatccaaatccatttatctctgatgggcattcatgtggtacttgaaaacaaaatatgcacaagtgttgcactggtttgaagagtttggtgtgaaagttacttaatcagttgtaagtactgtatctagaagtaaatcttagaaatgtgtgatgatgctcttttaagtagctgaagagagattattatgtggttttcactttgtccttgctttgttgtatagtatttaagtgaaatgagattgcttatccttattctgaatttccaaagctgatatttgcatttgccatttttcaataatggaaaaaaaaacaacattagttgtcttgctttcaaaagtttgtcaaaggacctatcaaaactttgatgcttttggtcacagttctgtcactaaaatgctagcaattagacatatggaatgagtaacctaactactttaacaccgtggtcagaagtgctataagtagtatctgctaagctccaagccactgtgttttaatttgtgacattttagaataataggctttctgtagtataaatatcctattaactaatccttgtgctgttaagttacaggtctttgaatcctcagtctgaagaaagcactgacttctgttaaattttgagcattgataccagtcaaagcctcatcttcagacacaggagaaggtgacaatcaaaatgaactgctttcatgagacacagggccagaaattaaaactattcaatccctctagacccaggaactattgtggaaactgtaggtgtgtgagatggtgagggacaattttgagggacaaactcagttcagagtttctgtaaattaaacgttaatgtcaaaagcacaatgatgcaaggtcagtgtctgggcctatgtgtcagaataacagggttttcttggtgcattgatctgctctttaatagataatcgtaaaaggctataagaactttgtcaaactgattaaaattagatagatttgtttataaggttttattaaaattagatttaacattaataatataccatacaaagatacaattttgttttctcttttgaacaaaaatttcatgtaagaggaaactgcagggaaaaaaaggagaggggagagacagaataagttggcctcatgctatcttaagtattaggtcttattgcttaagaaacagagtctcctctctatcaaaaggtaaatgtttttgttttattattttggctaaataaatgaatattttatagtgacctgtgatcctattttgtgatatcgagtgtcttaaacctttgatactcgacagaatttccaacagcaaaatttcaagttctaaattcagtctttgtgaactcaaaccaacctttttggatattagttgccctgaagttcaagagagacatgtaaggcttattaggcttagttgttatgttagaattatgcaggagatattgtcaaatctgaggtggtgctaagtttcctttgggtgatatttatatggatgggttgttaaaatgtgtttgaggattatatgagattcctgtaattctgatatgtcttaatataagttgtcagtaataattatgattattatgttacattgttgtatgccacagaaataaccaaatttctttatctactgtgcctttaactatgactctcttaagacttttgtcatctacaattattgttttgctttgatccttctcaaaaagtgacttataatcagctacagtctagggattgcttctttggtgttcgtgaaaagaacttttcaatgcaggttactgataactttggagattgtgccattaggttagagaggaaaattccagggcactaattgaaaggctgatgtgttcataaagattgttaacccaacatgaagcagagcaataattgattgcatggactaaactaatgaaggactgaaataatttttgtggcttttatctttggaatattgctgatttttttgttttgtttttcagagtctggataattttttagatctacttataagctttaagttatgctttaagtatattaagtagagtatacttttgtaaacagaacttgaggcatattttttctctgcctattttctccggaattatattcttaattcatgtgtgttagtttgcatacatttaatgacaacttgttttcttgtataatgggacacaattggaggaagtggttattttcttagggctttgaactgaaatgggcttgggaaaggttccagaaaagccagtgtaggtcctatataaacaatgaaccttgttgcactttgggtggttaatcaggctaagtatatgggcctgaagcttcttttgcaagtagatttgtcctgctatgacttgcctttgttggaagttggggggctgaagagaaaatgctgtgtttcagaagaaaatgatactattagattagcctttgatttctgggtggccgtgaaatcacctgtagtatgacgctgcccacgatgcccctcctcagtattaagcagccagaaagactgacaaccagtttccccatgattgaaaattgataaatagaaaggggggactgaaaccgaccaaacagtcccatagatcactttttcgataaacatagaaattgacccttctggtcttaaagcttgaaacttttgtgaattgttttctgttttatgtgagttccttcctcagaaaaccacttgcagcctctcaaaaaagtattaaagaaatgaaacgcaccagatcaccatattcagataatgagatgctagacccctcattcatcatgattgctttcttgcccctccctagttcttgtttttttacacattgttacatttttttccctgctatatattcccataattttagttggtcgggaggatggacttgagactgatctcccatcgcctcagcggcagcacccaattaaagccttcttccttgcctataattgctgtgtcagtgattggctttctgcatggttagcagcaggacctagaccgaaaccttggtgttttcgtaataatcttataattgaaaaagatccttaaaacaatgtaatttaagtctcattttacaaaagaggattttaaaaatggaaaagatttgctgactgaatcaagattataacattaattagcaacagcagataaactaaaatacaaggcttctgaattcaaaatctgctttccatttctccctacgtcctacaagaacaaatatgtaaaataaactggagaatttttacttatctatgtgtgaatataaaacatttttggtttgtaataaaggatgttaccttacaggaagccataaattatttcaagtctgaggttcagactatgaagtcacaattttaaattattaatactgtgaatcaaacttcatctataacacttattgtaagaataacataaaatatgaataaagaagagggttggaaaatagacttaagatactttaagtttgggaatgatataattataaaaagacaactttttcatatgacaatagtaattagtagtaatgagataatgttgctagcttatagaggattgtattatcttattattattttctattatatatgtcaatatgtgctacaaggagtctatttgtaattctgcatttctagcttatttctaagatgaaggttacagatatttatattgctttttctggtagatttcagacagattaattactgtttttgttttcctttgtcttctaccaatattgtgctagaaaagctatgtttacagtttgatgttcacagattgtattctattatttttgaaatacatatagaaatctacaagagcaaaaacttcacattgaaaaccaatataggaggacagagaaaacttttctggagaagttacagggcagagttttaagatagaagatgtatttatatataaataccacagaacattaatagacagaggaaaactcacatgtcaatttacagaagattaaagaaaagaaatgtatgttttgtggaactaaagagaagggtgtaagtaaagcagtagtaagagttaaggtacagaggtgggactcatgggctatatctgttgatataaacttcatcttgacaatgaggctcagctggtaaagtttaagcagattagtgattataaccaaaagtgccaagtcattcacagttctttaacacactactttgttttgtttcttttgatcttcttgtttcctctgctgggatattccattatcattcttgcccaggtaaaactgcacttgtatttatctactgctatctgtctagatttacctgtgcctgcatctgaatcccatgtgggcagagatctcattttacttgttttatatttctagtacctccccaagagactaatatttgtgggaacttagacaatttttataaaaataaatgaataaataaatagcctcatcattttttactaatgataaacttagcatgtacatttgtcactagtaaaatgatcttttaaagagaaaattgtattttaaaaagaatgtataatcacaatgggaaaataattgtatttcaaagtaaattatttcatctcatattaattaaacatagccttgcattttatgaaaagaatgggaatttaaaacgtatgttagcccatgcatcagtcatttttatcgtaattttattagaagctatttggggagagagagtgtctcttattatctaattatcaaacagtagtgctttattcatgttaggatgaagtaaatatttacttaatttaattggataacgtaagtataagttaaccaatatacacgactaaagaatatcccaaaataacttaagtgttttttaaaagcttttggtttttatttcttctgtatgcttatcaaagtctcaaaaaaaagtaaaacaaaacactaaactatgtactattccttctctcactctctgaatctttagctggtttactaaattagaataacacagacatacgtatttcattcatattggacttattttcagtcaatattactacatttatggatgaaagctgtcaattttaaaataataatatagaaaactgtctaaattctgaagcctgctgtcattttttgatgttattatttagttagcttacatgccatggttgctggctgggtcgatctgtaaaaaaaatcactatatatatagtgtgtgtatacatatatatatagtgtatatatatagtgtatatatatataatgtatatatatagtgtatatatatataatgtatatatatagtgtatatatatataatgtatatatatagtgtatatataatgtgtatatatacaaatatataatatatatatttgttcataatctttaaatataatcttccttataaaagaagtctgaaagcaaagcctcataacttttcagttcattcatcaattcaatttgaaggattaactcctctccagaaaatagcaaatatgattatcctacagtgaacatgacattatctcagcaggtagaatggaagtatatggattttattctctgcaggtcccacttgatatttcaccaaacattctaaggtgagtttttagtatccaagacattatttaatgaaaataaatgtgaagctaggtcaactaaatttctgatgtcacagaaaagacgtgtatactcagaatctgaagatggcactttgttttctggcgtggaatacaattttacttaagtaaaaaacatttattgtattgataattatagacaatatattatccaggaaaatcaatgatatgtcttacaaatagaaactgagcaaaaagaggaatataagatctcattcattaaataatcaataaagtgatttaaaacacttcaaatgtaatatattggccacatatagatcagaccagatttatttagcacaacacaatcttcaatgaaaaatatgtatatataataccaacttgtggttggttttattttaatattcaagactaataaattaaaagtcttgaatattaaaagactttaataaaatcaaaataaaaaaacaaaaggtgactttgttcttataaatagcattattatcattgctactaaacaattatagttttcctccacaacagtaactacaaagattatagatatgaaacagtggaggaaaaagctttaaatctaacaactctgagttcaagttatggtcctactacttgtttactaggggagtggaagtgggaaaggggactgctgagccaagtcaattatcctatttcagcctcagatttctggtgtgcaaaactaaattatgcaaaagtcatgatgctattgttaatattagaaattatatatataaaggagctagcaaggtatctggtcctagtgtatgctcaataagtattatcaatcatctttaattcctcttcagaataacctagcacagatgaagctattatttaaaacgcactcaaaccttacttggctcttattgtagattctgtaactactcaatgtataaaagtattctatatatttcttctaagaaggagcccttagctgtttatcaggttcaggcatacagagtcctccctcagcatccatgtgggattggttccagagcccataaggatactaaaatctgcagataatcaaggccctgatagaaaatgagacagtatttgtatataatctatgcatattgtctcatacactttaaatcatctcgagattacttgtaatacatataaaatattaatgctaatagttgttatactgtagtttagagaataatgacaaaaaaagtctgcgcatgttcagtacagatgtaatgttctccccaaatattttcaattgttgcacttagttgaatctactgatgtggaagccgtggatatggagggccaagtgtatatttgctttttggatatattaagtttggccacatccaactaaatgtgtccaaaattaaattgatgtcctcacccaagccatgtgcacccctattgacatcaacatgacgtcaccttaagcaaaaccctgggaaatattttatcttatttttgacaaatctatttctctattcttcctaacatacccagttcaaaacattagcagtatttcctgtagactcttgtgcctctgctcccctaaaatctgcctcccacagagacaatcagatggattttacaaaaacatgttttctcacttgactttctaatttaaaagtctttccaagaattcctcctattgactagataagtctaagtttcttataaaagaaaattaaattttctgtggcatggccttttaattttccagccccaccttgaatcagtttatgccccagtaacactgactaataattatctataaacaagaagctatttcagacctttgaggctgtgcaaatagggtcacatacttctttttcatttggtcaacctcatcctcttattgtgggatgacttcttggtactccttcattatcgtaagttccccatcaataaccccagaaagcccagaatttaccttaatctcaaaattgctatgctaaactcaatttaatttatattctttatatactttactgtattttgggggctttcaaatgatggtactgtagttatctttgttttccagaatgtagtaaatggtagtatgtaataaatggtttgttgggctgaaaggaaacttttcctatcacagacacctgaaggaaatgaggccattgagaaatctgagaaaagatccatccaggctgagagaagatgaaaatcaagctcaaaagcatataggtagctatgatcctcagagatagagaggagactggtgccacaactggaatggactaagaaaagcagagttgagtaggagatgaaatgtataaactgttgacatgagggagtgtcctacctgtagtgatagctgacaaatttcactgagcccttttgaatttattttaatgatttgccttttactcagagtgaggtgtgaaagcactggaaagcttgagtaatggattgagatgttttccatgttaccaggatcacccaggctattgtgttgagaagagattgaagagagcacaggaagacttgtaattggaagaagttttcaacactctagactagagattgcagtggcttggactggaatgctaataaccaaagtggcagcagttgttgctttctgaatacatttttagagtagaacacagaggagttgctccaggttatgtgtggagttggggaggaagaggggcattgaggatgactctaagggtgtttggtcagagtgactgcaagatgggagacgccttaaacctcttattggatataaagtcaccaataagtttgacaggagtactgttgaaatgaatgtcaggcatgtaggaagtaaactcttccaagtgtgacttccagtatgtagatgacaataggatatgaggttagaaagaagaaaatttattgggaagagacctatcatctgtcgatgacagcaaggaggggtaatgggcgttataattattttttgacacgagattcaaaggaaaacaaactattgaggaggaggaaatctagtttaaaaatgtaaatgagaatctaatactccaccaaccgtatctctgtgattaatgatgatcacacaccctgcaaagtttagttacagtccatcaagtttcctacacctggtgtagtattgagttatctgacaagtttgatctcgtaagattcttgagacttccttttttttttgaactaatattagtaaactgtatcttttagaagaatcatccatttctgttttcaaattttgcatacatttaagcaaagttgtctctgaatcctactttttttctatttatatgtagtttcttcattagattttattgtatacagttttacttgttctttttttcttgattaggttagatagtattttatccaattaattatgtctttatttttgttgtttctttccagagaaccaaattcagtctcatttatttgttttatatatgtttataatacattcatgtctgatattatagttattaattattttgggggatttcttgtgtttttatttgtttcttttatgaagtattatgacaactatacataatcttgataggatttctcaaaaagaaaagtacagactaattttattaaataaaataacagcaagcatataatatcagcttatttcaagagaaaaaaattatgtcctaatagaatctacaccatggatgcaaaatagatccatctaagccatggatgcaaaataggagctatagtaagatcagtcattatatcatcaactcaagaagaaaagtcattactgtcctcatatatggtagctatttatttgatctgagaaaagcaccattactattttaaaaagtcaataaaatagaaatagatgagtatttttttaacatattaatagtttttaaaaccatagaccaatctaatggggaaacactgaggcagtctcattcaagtcacaaacgagacaagcatttttattggaagtataataggaaatgaaagtaaagaaagaaaatggaggccaggcgtcgtggctgatgccagtaatcccagcactttgggaggctgaagtgggaggatcagtagaggccaagagcttgagacgagcctgggcaacatagcaaaattctgattctacaaatttgtttttaattagctaggattggtggcctgaacctgtagtccccactactagtgaggctgaggtgggcagattgcatgagcccagagtttgaggcttccattagccgggattgtgccgctacactctagactgggagacagagttagacctgggctagggggaaaaaatgtaaaagaaaaaaagcctatttacaataaaaacaaaagatgtagaaatagatcaagtaagaaatgtacagaacttacataaaaagaaaaacaaaaagcctgctaaaaaacacaaaaaaatgcatggacaaatgcaaatgcaaaatgttcttggatagaaagattcaacatcaaacatatataatatattcctaagtaattaatatataaatctcttgtgttcctaataaaaacacagttaacaacaaaaacactgaactagcttatttaaagtcaaagagaaaacttaacagaaggagagggaacattttggagggaaaacagcattgaggtaagttagtagcaccagaggatagagcatactatgtaagcttaatcattaaaattgtgtggtaataggttataaaatataaataatagaattgaatagaacatttagatcaaaatcaaaacacataagaaaatatatgatataataaatgcaacatctcaaatttgttcatcattggatgaatatcacaatgtattgtgtggggaccacagagtatttgactggaaagaactatggctgcattaatacctcctactgtgtactaagatacatctcaaatacaataaagatttaaatatacaatatgaatccacataaacactagtagaaaacgtagaataactgtaatctgggcttaacataccaatataaaaaactgatatacttgcacatattcaaactgatgcatgttgagtgttaaatatttctccattgtcaataaaagaggataaatcgaaaagtttatcaataatagacttcttctacagttttatacttattaaggaatatgtttatcaataatagacttcttccatagttttatacttattaaggaatattacataactgtgaaaaaaataatctgaaggatttatctagtatctacatggagaggactccaggatacattcattgtgaatggaaaaaaaccccagcaaagtgaaggaatatattaatatttattcatattttcttggaatgatactgaaaatctggaaataaacaataaattaacaaaagggatttctcaggtgggagactagaaagatgcaattgtaatagcaggaaatcttttagcttgctgtgtgtgtgtgtgtgtgtgtctgtgtgcgagtctgtgtgtgtatacacatatttaaatacatgtattattttacataactattttaattacctatacactcagaagtgactttgaaaccctgagacattacatgccactgacacatctgttaatttctttgaagaaaagagcctttctctgtctgcagccttacttttccataataaatttgaaatatgcctctgatattgtcctcttcccaaaatttaaccaaatcagaatatgcatgcagttcctgagaatctggtctctctgattttctgatctaatttagatgtttataggataaaagaatacttgccgcgcttcttaaatttaattacagggttaaacgggcccgatgaaaagactgcattggttctaatataaattaccttcgctctgcaggaggagcattatccgctgcttggaccgtgagtgcgtaagtccgcccgactatcatttccacccctggagcgatggtgataagccctgttgttttattgatgatgaagtctccctgagccccaacaaggatttcatatgtgatctccccatttgacccttcgtctgcgtcgactgcagtgagctggaattgaaaatcacaacataaatcctcttgggtctcaacttttcaccaccatgtcgttttttcccccaacaaaagaagcttgctttcaaagaaaaaaacacaggaaagtttccttgacatatatactgttttttgttttttgtttttttaactgaggctactgtgtcctgttacaatactaaagcaatcacaaaaataagagtgattttgttttttgtgagagtgattaagaaataaactttggatcttgaaggcttatctttattttaatttaataaagggaaaaagaggaaagccctaacagaaaatctaatatccctataggaaatttatttttcctgtcttgccttgcattcttgacacataaactcatattaaaacagactgaacctggaaaaaatgaaataggcatagtcggcctttgttactcccaaccttccttttactctcatttttccttccataatgttctcctccctgtctcccagacactctcatctttgtgtcctttttgtttacaattgctctaggaaaggttattaacttgcacaccctgatttataaaggactgataagtcgtagagtattaatgtgtcaacaatcaaacaaatgcatctcccattgtagaatatcaagggtaacatagcccaagaaatgtttctttggggaaagaaaatctattcggagcccttgaaattaagcatgtaaacatctgtatagccaatttacatatatctataatcattttgaaggaactggtatctaaaagactttatttgggatattatatgaaaagataacaatgattaacttcatcaagcaacattaaagcaacagtgatttattatattaaaagtggctccttgacttgctgataaatataaattaaaggggaaaaagaatataaagggattctagcagaaatcttatagtaagcattttacatacatcaatagtattttctgtattcatcatacaaaaagtgaagaatgaaagaaagtggtctcaatttacacatgagggaatataattaaaagttttctgtggaataaagaaaacacatgtaattgtagtaaattaacctacctgtagaaatgttttatttacttatatttatattttcaatacattacttctaaaaatagtagtttttatagtttgcagactcctttgaaaatacagtaaagatgctggtataccttccttgatcaaatgtaaacatacacatttaccttgaaacttgaattcaatttcagaaacatcatattaactaatttcccattcaaaagttcatgtttaatatcctcaataaatgtaaacaaagtactttatacactgtactgtgctgaaggggttatattatgcatattctattttttattatatgtcatgcttagagtgataatgtccatagacatagcagcaaaaaataattgagaatgaaaaaggaaatgacattaatgcaactaagtcctgagactggctatttgggggtggacagatgtggttgctggaaggaaaggcattttatgacatgattctgcgacttgtataagcctgacagacatattcctaaaggcaaaggagaaacatttgcagaaacagtcaaaatgaatggcatatatttatagagagctattcaagccagacaaactaattctgttttgtgtatggataaaattagaaaattagaggatggggataacagaggagatatcaattttgattatacttaaatcacttaaaatgtctcaggaaatcttaattaaaatttagcacaaattggattcaatattaacattcttcctgggacttaaattggctaaaggaatgtaatgataaatggcaatgcatcaagttaagaaaaggtgttaaggagtgtgcttcagggatgtcagcattatagctggtcttatttaacattttcataaatgatgttggaagggaggataagctggatgataattacattgaagaaggtacccacctgggagatgctagaaataccaaatagtactgcaaaacacaggagacagaaacacccactaaattgcagagatagtcaaccacagttgagctaaggtattcagggaacacaattagctctgcagaaattattaggaggtagaaagcttaacaagtacacaaaataaggattctatgtttaagttacctagataacactatttttcagtcttttactactaaataataaaataatgggttatgagtcaatataatttgtttgcatgtatgctaacaaagatattttaaggaaattaatcgtagtccaccgtcagaaaaataagctgagacactgattctgaatacccaaatcataatagtgtcttccatgtaagatcccgaaaactcaagacctttttttttttaaacctcaacattagcaggagaattgcttgaacctgagaggcagaggttgcagtgacctgagatcatgccactgcactccagcctggcaacagagtgagactcttaaaaaaaaaaaaaaaaaaaatccaaaacctcaacgacattacacagtagatgtccccttctgaagtctattagatgatgttgaatggagttgtagttgctaattttggagctaacctatggcaagaatttaattcaattatagttcaatgactctgtgaccagtagatagtgtctatgagatggaaatatatgaagctcatttctaatttagcagggaaatctgcttcctaaatgaaaagggcatttatttacatggggaggccaatattttgcttacaagtttcagatgaaagtaaaaacaatactataactttaaagtgtttattgaaacattgtgatatctaaaaggtaagaaattgtgagctatttgttttttttatttcttttcgatgatgttttatagttctattcaggaactttagccctaccctttcataattccttcctctcagtgtttcaacatgtgcatattccaaatgtccccatctgtattagtctgttttcatgctgcttataaagacatacctgagactgggtaatttacaaagggaaggtttattggaatgccacgtggaattccacgtgggtagggaagcctcataatcatggcagaaggtgaaaggtgcatcttatgtggcggcagacaagagaagagagcttgtgcagggaagctcccctttttaaaaccatcagatctcatgagacttgctcactatcacaagaacagcacaggaaagacttgccccaatgattcaattacctcccactgggtcctcccacaacacgtgggaattcaagatgagatctgagtgggaatacatccaaaccatatcattccaaccctggcccctcccaaatctaatgttctcacatttcaaaaccaatcatgctttctcaacagtcttccaaagtcttaactcatttcagcattaactcaaaagtccacagtcaaaagtcccttccacctacgagcctgtcaaatcaaaagcaagttagttacttcctacatacaatggagatacaggcattgggtaaatacagcctttccaaatgggaggaactggccaaaacaaaggggctacaggccccaagcaagtccgaaatccagtggggcagtcaaatattaaagctccaaaatgatctcttttgacttcatgtctcacatccaggtcatgctgatgtaagaggtgggtttccatgctcataggcagctctgtccctttggctttgcaggggacagcctcccccccaactttgtttatgggctggcattgagtgtctgtagcttttgcaggtgcatagtacaagctgtaggtggatctaccattctgggctctggaggacagtggcactcttctcacagctccactggtcagtgccccagtagggactctgtgtgagggctctgactctgcatttcccttctgcactgccctagcagaggttctccaggagggccctgcccctcagcaaacttttgtctgggcaaccaggtgtttccatacatcctctgaaatctaggcagaggttcccaaacctcaattcttgacttctgtgcacctgcaggctcaacaccatgtggaaactgctgaggcttggagcttgaaacctctgaagccacagcctgagctctatgttggaccctttcagccatggctggagtggctgggacacaggacaccaagtccctaggctgcacacagaacagggaccctgggcctgcccatgaaacaattttttcctcataggcctctgggcctgtgatgagagaggctgctgtgaagacctctgacatgccctggagatattttccccattgtcttggggattaacattcagcttcttgttacttatgcaaatttttgcaggtggctttaacttctccttagaaaatgggattttcttttatattgtgttgtcaggctgcaaattttccaaacttttatgttctgtttccattataaaactgaatgcacttaacagcacccaagacacctcatgaatgttttgctgctaagaaatttattccgccaggtatcccaaatcatctctctcaagttcaaagttccacaaatctctagagcaggggcaaaatgccaccagtgtctttgctaaaacataacaagattcacctttgctccagttcccaagaagttcctcatctccctctgagaccacctcaggctggactttattgtccacatcactatcagcattttggacaaagccatttgacaagtctctaggaagttccaaattttcccacatcttcctgtctttttctaacactccagactgctccaacctctgcctgttactcagttctaaaattgcttccacattttcaggtatgttttcagcatcaccccactctactggtatcaatttactgtattagttaattttcacattgctgatatagacatacccgagactgggcaatttacaaaagaaaacaggtattgaaattacagttctatatggcggggaggtctcacaatcatggcagaaggtggtagcagataagagaggagagcttgcgcagggaaacttccatttttaaagctatcagattgtgggagacttattcactatcatgagaacagcaagggaaaatcttgcccccatgattcaattacctcccaccagatccctcccacaatacttgggaattcaaaatgagatttgggtggggacatagccaaaccatatcaccatcaatcacccatgtgaccacaaaataatctaagttgctcctaatgtttccttttaaattttggctgcagtttactactctctttaattgctctttcctggttctgataaaaaaaatacagcttgatataaaaggacaaatataaagatgattgaattgtgcataagctgaacaaaaacattcaaattggagtctcaaaaatgacacagaaagccacagttgatataaaccatatgcaagaatataaattgtaatgcaagagtgtaaacacggtattttatatgaataaatatattttttattagaagtgaattatgggccggaagctgtggctcacgcttgtaattccagcactttgggaggctgaggtgggcagatcacgaggtcaggagtttgaaatcatcctggctaacacggtgaaaccccatctctactaaaaatacaaaaatattagccaggcgtggtggcgagcacatgtagtcccagtgtttttgggaggctgaggcaggagaatggcatgaacccaggatgtgaagcttgcagtgagccgagattgtgccactgcactccagcctgggtgacagagtgagagtctgtctcaaaaaaaaaaaaaaagtgaattatggcttaattgataatgcatgaatgtgttgatcatttgatgtttttgcctcttgggcatccttggctcttgcttccagtaaaagtcccttattttcctttggggagcaattggcaaaaaaacatgtcaagttattcaagttggtatagtcaaggtgactcctagaactactgtaaaagagtgtttttttcttcctctagggctaaactggtaaatttatatctggtgtttctgctggctttccagtcttcattggatgtacctaagactgagacccatacagaagaagacatgtcaagaaataagcagaaaatatcgctcatgacatggtttctgcttatgcctgaaaccaaattcaccactttctgatagattaaaaattacatattttaaatgctaatttattttgaaattatgtctttcaaccgtaagaaccctaaatatataaaatagttttgatgcttaactactcttcttggtttgctttttgattatttttctaggattattgtgcttcgagattttggtttgagataccatgtaatcattaatacaataatgtaatatataattattcattacaataggcaaagatattgcttgaaagtggtagaattgtccctgtatagaaataatattgaattactcaataagtaaaaaaatacagataaattagctggtaaatatttccatcaagagaggacagactcgatttcagggaaatatttaaatgagtattgctttgttttttcttcttcataatttcatggatagaggattcattcttacatagatatgagcaacctcagcatacaatttttttcattattaagatgagaactttcacattttaacttaaaggaagcactttcatagcttctctttgatatatatgaattgccagaatcactactcctgtgctttgggaccattgttatgtaaaataagggtaccaccacaggtaatctaataacagagatagcttctaagtgactcatgggcagggagcatagatgtcctggagatgctggacaaaaggatgattcatgccccccccaacaagctggggacagagtaggacacctcaagatttcatcacactactgaaaatggcacaaaatttaaaactttggaattgttgatttctagaattttccatttaatgttctcagaatatagttgaccaaaagtaatagaaaccatggaaagcaaaactgaggacaagggaagaatactgtaaaaataaacatgaactgagagatttacctcacagcatatgtaaaattaactcaaaatgcatcacagacctaaaggtgaaagctacactatgaatactaggagaagataatataggagaaaatctttgtgaatttggttggcaaattttcttaaatatgacagtaaaagtatgatacaataaaaaataaacttcctaaaaattaaaagctttttctctaccaaaaacataagaacatgatacataaaatacagattatgtatttgcaaaatatttgcagatcatatatctgataaaggacttgtatttataatttatagagaatacttaccagtcagtactaagaaaacaaacacaaattttttaaatgagtgaaagatttgaatagatatttcaccaaagaagatcaataaatggctaataagcacatggaagtatctcaaattaatttgtcattaagggaacacaaaatcacaatgagatactaataagcatctgtataatggctttaacaaatgaactgacaatactatcagagaggatgtagtgggtggtaaaatggtacaagccactgttattaaaaagcagtttgacagtttatttaaaaagtatatatttaccatgtaatctagcacttttcgtaagatatctatatataacaaacagaaaaataaacatatatgtgtatatatatgtgtgtgtatatatatttacatttccaaaaagtgacttatatagaatattcacagtcacattaaactggaaacaactgaaatgcccatcaactggtaaacagataagcagaatgtgttttcacaagatggattctattaagtaactcaaagaaacagatatatagcattgattcatgccacagcatagatgagctacataaacattatgctatttaaaaagccaggtaaaataaaagtaaaagatacatactatgggactccatattttttaattcctagacaaggaaaacttttagaggcagaaaccaaaacagggggtgtctacagctgaaaatgggagtgagcattgactacaagtggtcatgagtaaagttttggggtgatggaaattttgggggtgaaagaaatgtatagaactagattgtggtcattgttgcacaactgtctaaatttactaaaaccagcccaactctttcatggaactgatgtttactggtctttgaataaacacagaaattgaccccccacccccaccccaccataccctgtcttgaagcttgaaacttacatttgtctcatgggagtttcttcctcaggacactaaccctcaaccctcctagaaaccaaggaactgaaactcaccagataactgtatccagaaaatgagatgccagacctctcatccatggattatgattccagtttaccaattcctcttccttaccctaccctaatatttgtttttgcacaagtattttttccctgctatataaacccctaattttaatcatttggggagatggatttgagactttatctcccattctcctcagctgcagcacctgattaaagttttcttctctggcaatatttgttgtctcactgattggcattttgtgaagcaagcagcaggacctagatgaaacccttgatgttttggtaatatacatacatgaggacatgtaaattataccttaataaagttatcgaaaataacaaagataattccacccacacatctgacctttttaatgatatttatccatttttttctgctacattatagaatgcccttcaggctacttgttcatgtattgtttcatcatttgagtaactttcttccttcttcctgccttcttatgcacctcacaaagtttagatcttgattatttgtttctttctttctcttttaaaccactgtatgttcctctgccttcagagactttactatcaactccatgaactccatgctacctttgtaaaactacttcttcctcctatgaatggacaggtatgaaagctctggcaagcaaagaaaagccagacccatggaagaaaagcagaatgtaatcagctaatccaactatgaaaggctgtctgtgttgagaaaagtaatcagtagaagagaaggtgaaattgtggaatatagaatggagagcacacaaacaaagatttcaagataagataccttcatattttcctctgagagaacattttatagcaagagtataatcttcttagcagctcccttcagatgtggtaatgattaatggccaatgctggagaattgcacagatttggcagaaatcaaggtacaagatatacttgagaactctactgggatcatttggggttaatgtctccttatgacatgccagaatatgagataggattgtatcacttgggcctttttcgttggttatatttatcctaattttacatttgaagccttgagttaaattctaactttgaccttatctgatatgcagtggctggcagccatagcttatacatgtatagatatgtataaaaatgacatcacttaaggcattcttcggtggtttcctagtatgacagagtcgatttttcttttttgcctcaccagatgtgtttaagtgtgggatgaaatataaacaaacgtttatggaatcagtattgtaaacaagaaggtgaacagtaaagttatatggtgaccccatatcctgatgatttgttcctagaaattctcaagggcaattataaggatccttttgcacactcaggttgaacttcacctagaagtagaatatgcctaatctacaagcttctgggagaaacaatacttctgtatgcacacaatatacttgaatcgtattcatatcatatatacttagaggaaatgtatcagtctattttcacactgctataaggaactaactcagactgggtaatttatgaagaaacgagttttaattgactcacagttccacaggcttaacaggaagcatgactgggaggcctcaggaaacttacaatcattacagaaggcaaaggagaaggaagcaccttgttcacatggcagcaggagagagagagagagcgagaggagaagtgccatatacttttaaaccatcagctctcatgagaagtcactcactatcatgagaatagcatgggagaaatttgcctccataatccaattaccttccactaggcccctactccaatactaaggttcacaactcaaggtgagatttgggtggggacacagagccaaaccaaaccgaggaacaatccttgagtcaccttaatcaacactggacataaagaactaagagggatttgaagttcaataaattagtttactgaatcaagtagagatggcttttaggcaaacatattaacctaaataagcagagtagggaacattctttttcaataacttggcattactcaggaatgattacagagtaatcaatgattactgaaataacaattataataaattctgatgtatttaaatggttctagttggctatactagaagatcaagtcaggagggacatatctctgggaactacggacaatctaaactataccaagatgtcatttgtaagtatgggcattatcaatcttctattacagtcatatttctatgaactaggaaacaaacatcttcttcatggtacctttggcgaagtttggacagactaagaatcaatgcattgctttattaaagaaaagtgactggtgtgctgcattcatatgcagaagctttcgctagtgaaagtttattcctaggggatggtttatagttatgctatcagaccagatgcagaattgtcggagaaagagtatctaatgactactctggtaatgtaaaatgtatgatatgtaggaaaagtctattttttgctaggaaagttgagaaaataatttggaaatattaaagtgtattgtgttaaatatttcatctctctgcctcagctctatcgtgtgataagggatttttaaattcatttatgtagttagataaaaataaaatctgagtgcatactgatctctaggacagaaagattatttggatgggcaacataaaacttacaactaggtaatccttatgtagaaggatttgccagagaaagaattgaatttacgtgtgtaaactaatatacccagttgaatgtatcaacacttataaaaaggcagaagtaatagaggataagggggaaaaattgtctttcaaatgttaaagaaatatcagaacagttaagtgaatctatctatggttgttaatttgctttgtagagggaattccaacttcttagtgtatgaaatatgctctggtgatagccagtgttttaacatctatttttaatgcactagatattatagaagttagtgtaacaaaaattttaagaagattcctcagaaatgtgtagcaagtgggtaacacataatgagtgcagatgacttagaagtcataagatattatatctaaagttacaagacttctactatgctattgccatagaagctatattgttgcctgcctggtatccttaattaaagctaaatcaacttggagctgtgtaaggtctactgggtctctccaggttggcattcagtctgaacctaaggctgctgctcattaaactatcactggaaattcactattcagtgtgatttctgatggaaaaatgatataatgggtttgcttttatgtttgttgatttcttcatgtgtcaataacattcaggaagttcttcaataactcctgctggccaagcaaattggggattgcaaatgtatttattttcagatttattctctgtggccttaatgtgaacaagtgatgctttaaagccaaaaagcataacaggctcccagttttcccccttctcttacgcatatcctagaataatccaagatgatgggcacctcagtagggtaggtggctggcaaatttatcactttggttgtataatttggaaaaagatattgataacattaataataacatgatcattaaatacttatatgaataattgtcaccgaagatgaatctcccatctatgcatttttcttcccaaaaaaaggcaagaaataaaacaacaagaagatgactttaaagcatttcttttcacagcctgactatttaaagggcttgtttcttttctgcagcaacttcatgatccttttgtaaaggttcattggttctaattactcaaactctgagactggaaactggaaccttaagtgctctaatgctatcaaattctctcatgcccaacttacactctcaaaaaaagatttcctcaaagttggcttccattaatttccatctcattagctttaacccatcgatttaaggacccagtctttcatacttcttcaagaaatctcacgttgtatacaatgccaaatctaaactactctacatgcaaggtagccatcttaaattaatttataaataattggatccatttattcagaccttaatttgtaccaaatgtctgactccgaaaaatgaagagtggaaaagaaacagaaacaataacttctgtcaaacagaaggtgctctaggaaaggagatgagagagaaacctatctttaaatgaaatgctgttacagaaacataaaaatactttacaaaagtacagaaaagcctgtcatgacaaaggggctgggagaataaaccaacatatatttgacttagtaaaagaaaagcaaatctttgagcattcagttcctcttctctccaatgccagttaaatttgtatctttaatgcctcatgaaattactatgcctttggccgtatcatttcatcttcaacatcatattatcttcacttgcctatctgagtactctaacagatcatcatccccactcacttttgatgaattctcgttagtgctcttagtctttctcatcaaatttaacaactcaataattgtgatgttttctgattatttcactgtgaagaaggattatttcttgcaaaatatagtcaactccttgaggattagggctgtgccttactcgttctacgtatttttcagagcacttagtttagtacgaatcacctaaaaatctgtgtagattaaattataatctagccaagaaagtaatacaacatgtagcatacatatattaggacttgcacaatagtgcttttgtttgtttgtttgtttcctttgccaaactggatgagcaagtttactagggttttaagaaatccctactgctctatttaaatgtttgttttttcccctaagatctcctgtatttgaaatatctcaatacccaactatttttattttactcagatgactatgcttggacattataactgtcaggcctctgagcccaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctcgctcatcctggctcaaaaagcacctccactgagcaccttgcgaaccccactcctgcccgccagagaacaaaccccctttgactgtaattttcctttacctatccaaatcctataaaacggcctcacccttatctcccttcgctgactctcttttcggactcagcccgcctgcacctgggtgaaataaacagccatgttgctcacacaaagcctgtttgatggtctcttcacatggacgcgcatgaaatttggtgccgtgactcggatcgggggacctcccttgggagatcaatcccctgtcctcctgttctttgctccctgagaaagatccacctatgacctcaggtcctcagaccgaccagcccaaggaacatctcaccaatttcaaatcaggtaagcggcctcttcttactctcttctccaacctctctcactgtccctcaaccactttctcctttccactcttcaatctctcccttctcttaatttcaattcctttcattttctgggagagacaaaggagacacattttatccgtggacccaaaactccggcgccggtcacggacagggaaggcagccttcccttggtgtttaatcattgcagggacgcctgattatacacccacgtttcaagggtgtcagaccacacagggacgcctgccttggtccttcacccttagcggcaagtcctgcttttctggggaaggggcaagtacctcaaccccttctctccttgtctctaacccttctctgcttttctgggagaggggcaagtacccctcaacccctcctctttcacccttagcagcaagtcccgcttttctacagggcaagaacccccaatctcttatttccgcaccccaacctcttatctctgcgccccaatcccttatttccgcaccccaacctcgtatctctgtgccccaatcccttatttccatgccccaaccccttatttccgtgccccgaccccttatttctgtgccccatcccttatttctgtgccccgacctcttatctctgtgccccaaccccttttcccacttttctggaaggtaagaacccccgaaccccttccctctgtttccctactctctcttttctctaggcttgcttccttgactataggcaaccttccaccctccattcctccttctactcccttggcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaagatctaaataattcttgtcgtaaaataggcaaacggtctgaggtgcctgacgtccaggcattcttttacacatcagtcccttcctagtctctgtgcccaatgcaactcgtcccaaatcttccttctttccctcccgcctgtcccctcagtaccaaccccaagcatcgctgagtctttctaatcttccttttctacagacccatctgacctctcccttcctccccaggctgctcctcgccaggccgagctaggtcccaattcttcctcagcctctgctcctccaccctataatctttttatcgcctcccctcctcacacctggtcgggcttacagtttcgttccgtgactagccctcccccacctgcccagcaatttactcttaaaaaggtggctggagccaaaggcatagtcaaggttaatgctcctttttctttatcccaaatcagatagcgtttaggctctttttcatcaaatataaaaatccagcccagttcatgacgtgtttggcagcaaccctgagacactttacagccctagaccctaaaaggtcaaaaggccgtcttattctcaaaatacattttattacccaatctgctcctgacattaaataaaactccaaaaattaaattccggccctcaaaccccacaacaggatttaattaacctcgccttcaaggtgtacaataatagaaaaatgttgcaattccttgcctccactgtgagacaaaccccagccacatctccagcacaaaagaacttccaaatgcctgaaccgcagcggccaggcgttcctccagaacctcctcccacaggagcttgctacacatgcaggaaatctggccactgggccaaggaatgcctgcagcccgggattcctcctaagccgcgtcccatctgtgtgggaccccactgaaaatcggactgttcaactcacctggcagccactcccagagcccctggaactctggcccaaggctgactgactccttcccagatcttctcggcttagcggctgaagactgacactgcttgatcgcctcggaagccccctagacaatcacggacgccgagcttcgggtaactctcacagtggaaggtaagcccgtccccttcttaatcaatacggaggctacccactccacattaccttcttttcaagggcctgtttcccttgcctccataactgttgtgggtattgacggccaggcttctaaacctctgaaaactccccaactctgttgccaacttagaccatactcttttaagcactcctttttagttatccccacctgcccagttcccttattaggctgtgacactttaactaaattatctgcttccctgactattcctggactacagctatatctcattgccgcccttcttcccaatccaaagcctcctttgcatactcctcttgtatccccccaccttaacctacaagtataagatacctctactccctccttggcgaccaatcatgcaccccttaccatctcattaaaacctaatcacccttaccccactcaacgccgacatcccatcccgcagcacgctttaaaaagattaaagcctgttatcacttgcctgctacagcatggccttttaaagcctataaactctccttacaattcccccatttcacctgtcctaaaaccagataagccttacaagttagttcagaatctgcgccttatcaaccaaattgttttgcctatccaccccgtgctgccaaacccatatactctcctatcctcagtacctgcctctataacccattattctgttctagatctcaaacatgctttctttactattcctttgcacccttaatcccagcctctcttcgctttcacttggactgaccctgacacccatcaagctcagcaaattacctaggctgtactgccacaaagcttcacaggcagcccccattacttcaatcaagcccaaatttcttcctcatctgttacctatctcagcataattctcataaaaacacacgtgctctccctgccaatcgtgtccgactgatctctcaaaccacagcaacttctacaaaacaacaactcctttctttcctaggcatggttagtgtggtcagaattcttacacaagagccaggaccacaccctgtagcctttctgcccaaacaacttgaccttactgttttagtctagccctcatgtctgcgtgcagtggctgccactgcattaatacttttagaggccctcaaaatcacaaactatgctcaactcactctctacagttctcataacttccaaaacctattttcttcctcatacctgatgcatatactttctgcttcccagctccttcagctatactcactctttgttgagtctcccacaattaccgtcgttcttgacccagacttcaatccggcctcccacattattcctgataccacacctgacccccatgactgtatccctctgatccacctgacattcaccccatttccccaaatttccttctttcctgttcctcaccctgatcacgcttgatttattgatggcggttccaccaggcctaatccccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagttcgaggatttgccccacccaggactggcaaattagctttactcaacatgccctgagtcagataactaaaatacctcttagtctaggtagatactttcactggataggtagaggcctttcctacagggtctgagaaggccaccgcaggcatttcttcccttctgtcagacataattcctcagtttagccttcccacctcaatacagtctgataacggacgagcctttattagtcaaatcagccaagcagtttttcaggctcttaatattcagtgaaacctttatatcccttacggtcctccgtcttcaagaaaagtagaatggactaaaggtcttttaaaaatacacctcaccaagctcagccaccaacttaaaaaggactggacaatacttttaccactttcccttctcagaattcaggcctgtcctcagaatgctacaggggtacagcccatttgagcggtatagatgctcctttttattaagccccagtctcattccagacaccagagcaacttaagactgtgccccccaaaaaacttgtcatccctactatcttctgtctagtcatactcctattcaccgttctcaactactcgtacatgccctgctcttgtttacactgccggtttacactgtttttccaagccatcacagctgatatctcctggtgctatccccaaactgccactcttaactcttgaagtaaataaataatctttgctggcaggactatgctgaatctccttaggcactctctaatcagatatcctgagttgtcccaattcttagaccttttatacctgtttttctccttctgttattccatttagtttctcaattcatccaaaaccgtatccaggccatcaccaatcattctatatgacaaatgtttcttctaacatccccacaatatcaccccttaccacaaggcctcccttcagcttaatctctcccagtctaggttcccacgccgcccctaatcctgcttgaagcagccctgagaaacatcgcccattctctctccataccaccccccaaaaattttcgccgccccaacacttcaacactattttgttttatttttcttattaatataagaagccaggaatgtcaggcctctgagctcaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgactttaccttgtgaaagtccttttcctggctcatcctggctcagaaacacccccactgagcaccttgcgacccccgactcctgcccgccagagaacaaaccccctttgaatgtaattttcctttacctacccaaatcctataaaacggccccacccttatctcccttagctgactctcttttcggactcagcccgcctgcacccgggtgaaataaacagccatgttgctcacacaaagcctgtttggtggtctcttcacgcgcatgaaaataacaaaatttactaccagtgaaagctgaaaagaaaatgagctcttttttggaaacaataggtgaataaaagctaaaattgatcaaagaaatgtttcatttattggacatatactaaagaaaatagtataaaatatattgtacattttgtttcttctagagcaatatcatatttcaagtcaaatatctagtaaaccagcaatatatagaaccataagtatgagcgtgaatatagtcaaaattaaaaatacacaatttacatgattgtaaaaacaatcacatacaaataagcagaagcttcataaaaaatgcaagcacctaagcattaattattgaaaccggaccatgaaattggacaactttcactatgacaaccaaaaaacatgatacagaaatataaaagtaaataattgtgtttacaaatgagttttctttaaaaagctacactgttaagtatatcaaggaaaggggataacgtctgaaaaataatataaaatctaaatattctgttttcagttacacaaattcaaaatgcaaggaattgtgattactataatgctagcattagtatttcttcaaatttatcaaatgggaaacctcagcctaaactacataagccctaaggttttaagagatactgaaatatgtgctaaacacttaataatgtttaatttgatgatctaagtcatatttgtcatgtattataaaaccaaaatataatttgcctttcttcattagtagtctagtaattacttaaggtcataaactatatgttgatagtttctttatttcttatgatttggcatcgtgcgcaatactttaaatgctctacacaataaatcattttcaaataaatgtgttaattattcaactttgcctctttaacagcatatatgattgacttatgttttcagtcagtttagcatctcaagagtctttttgaagtgattcttctgaataatcaagtttggaagtactacgttatagggatactaatataactgtagtttaaaatattttactttgtaaaaaatttaaaaatgaattaacctgaaatataagttatttcccatgactcataaataaattcctaatacatattttacctacatctattagttctttttatccatttattcatttaacaaataatatttattaaaggtcaatgtgctgggactgtgtaaggtgttaggcatacagtagtgatagaaaaagaagaaaagtatgcaaaaaaattgacaataattttattccatttgagcctataattaagtgagagaaacagatagtttaaccatataattataaatttttaaatgtgctgtgaaggagaaatcaggatgctccaagataataaaggggtaacattgagaagaggaaatcatggaagtcttctttgaggaagcggcatttaaattaagacctaaaagacggaaagcatatgaatgaaagttatctcatcactgtgggagcatcataacaaataagagaaagataaaatgctaagtgaagaaattgaacgctaatccagtaatacaggatatcgattatgggcttcatttttatagcagtagaaaaccattgaaggggtcaagcatgctaattatttgagtgatttcaaatgtaatatagcccactggctaatgaatgaagaagagggaaagaggagacataaataatactcatagaaggacatttcacaggtttaggtgaaagttgatggtggcagtgaaagaaaaattaaggccgggcgtggtggctcacacctgtaatcccagcactttgggaggccgaggcaggcagatcacgaggtcaggagaaccagaccatcctggctaacacggtgaaaccccgtctctaataaaaatacaaaaaaaaaattgccgggcatggtggtgggctcctgtagtcccagctactcaggaggctgagacaggagaatggcgtgaactcgggaggcggagcttgcagtgagctgagatcgcaccactgcactccaacctgggcgacagagcaaaaaaaagaaaaaaagaaaaacaggtagatgcattaaataagtatatgagaaaaaattggtaggaggtggtaatagattggagatgggagtaaatgagtatgtttcaagaataactttttccaatcaaatggaaggtgttgctattttcttttccttctttcttttttctttttcttttctttttttttttttttttttttgagacagagtctcgttccgtcacccagccgggagtgcaatggcgcgatcttggctcactgcaacctccaagagattctcccgcttcagcctcctgaggtgttgctagtttcttagattggggaatatcatccatttgaaaaaatgctgatagtgtaatcaaacttggaattcaattaaagtcctaagcatgagtgaataacctgtataagttcagaattacatgttggtgtatatatttcaattctaatacaaataggtttagccaagaaatggagtggtctttagaaaaaaataaaatgcttcaaatatcaaaaataaattaaaattgtgtactaatgtaaaaataggtccacatttttgtaagctttgctcatgaagactttatccggtatttgctgaaatactgaaccccctcaagaccttaagtaaatataaccctcaaactttaatcatgacattatacacacaaaccaaagaaaacaaaatcattatttgaaagaaattgtcgtctatggccataccactctgaaccctcccaatcttgtgtgaaataaattgtcaagagacattaaaatacgatgtagttttatcttaaacttgaatatttgaaattacaaaaacagaatttaatatgtaattttatatgttatgtacgtgtcctccacagagcactaaataacacaggacactcagaagtatatacagataaggtagcaacaaatattaataatcataagtgctttacataatttatgagaatggtacagtaataatagcaagttaccacatgcagcatttgctaagcatgcatgtgatagtagtttatatagttagtttaataatcacaacactcttttgaggttggtactattattatcaccattttaaagattggaaaactgaggtacaaaaggttatgtcatgtaatggtacaaagtggcagaaagaaatgcaactagctagcctgcctcccaattctattgtctttaaattggattctacttcatctctgtcacttaaaaccctcgttaatttggaacaatcatctgtcattatattaactcacatttttctataaaattaggctataaaaataattatgttcaaagttttttcctatgatatattacctatgatatagaataactacctatgatataggtatgataattacctatgatataggtatacctatgatatagaataactacctatgaataattacctatgatatagaataactaagaaattaaaatatttccaatttaagagcaggaaggggtagcttggctaaagctgtgaagttagagatcatctcgggaaaggactatgtgaggtgatacttagtgtgtgatagaattcttacgccaaatagaacatatatctaaaattaggtgttttctaaactcattgagggtacattagtcgagggaattaaattctatggacattaactgaattcctactgtgtgtaagtcattatactgaccactcgtggttagatcattaaaagtttttgtcttaaaggaacttacagatcagtaggggagacagacacgtaaaagttagccttaacgcaagccacaataaaacatgtgggagatacagttgatagctggtacgtggaagcaattaattttgacttgctaggaaaatatagcctttattaaagaggtaacaattgtactgtgtgttaaagattttcttttttaaagatacaacttggatcaaaccttcaacctgagagagctctcaatagttacagaataagaagaatattccatgctaaaaacaagtaaaacaaaaccctatatattattctcggattcataacatgaagggatgtagcaggagatgaaacaaatatatttaagagtattacatagatgtccttgactgtatgtgtggagctttcttccttccattggtaggttttccaggagggtgaggatctgttctgactcagtttcagaataatcatctgaaacagtgtggtaggaaatccattgaaatagccagattgcccaacatagtttactgtagtagcctaaattatggcagcacataggcatggaaaaggaattggtggtggaaatgggaatgcaaattggtacagtcaccttagaagacagcttctcagtttctaacaaagatatccatattcattctatatgatccagcaatcccactccttggtatttaccaaaaggatttgaaaatttatgtccatgtaaaaaaaaaaacttagcatggatgattatagcagctttattaataatggccaaaacttgaaagcaaccaaaatattatttcatggaagaatgaataaataaactgtgttacatctagataatggaatattatacagccctgaaaagatatgggctattatgtcatgaaaagacatggaggaattttaaatacgtattactaagtgaaataagccagtctgacaaggctacatactatatgattctaaacacatgctattctggaaaaggcaaaatcatggagactgtagaaagatcaatgattgtcaggggaaggaagcaagcaagggggagggaagcataggcagagcacaggatttttagagcagtgaaactcttctgtgtggttctataatggtggatatatgtcattagtacaaaaccataaaatgaagcaccgagagtgaatcctaatgcaaactacagactttggatgataacaatgtgcgaatgtaagttcattaattgtggcaaatgtatcactttggtatggggtgttaatattggggcaggtatgcatctgtggggacagtgagtatatgggaaatcactgtatcttcctctcaattttggtgtgtacctaaaactgctcaaaaaaaatctttaacaaaaaagatgaaatgatgatctacaaatacattctaaaatagaaattgcctaaactgaacaataatttggatgtatgcaggtaaagcagagggaaaacaaacaagactgcaaggtgcctatcctgctgcctgtggaacctaaagattaatggtgtgcatcatgatatagctgcctccaacacgactagatgcatgtttttgagtgtctgtgtttgtttattaaaataaagataattgattagttaatgtatttttggatatgtgcaatttgaagtgcttgtaaaagatctactttgtcatgtccagctgatatctggaatgtcagcttgctgcttgggaaagaggtcattacagggcatttaactttgggagacaagtatatatagaggtgatgattgaaaacttgagaacagatgaaaaagagaagaagtatatatacgtatttgaagaacgttaatttttaaagggtgataattgaacaaggggccagtaacatctctcagccaacagagaagtaggatgggaaccagggaagtttttcataaaagggtatagttgagagtttcaaaaagattaaggacttttgactttgacatgtagaaatagactgatgggatatctaattttatatgattttagtggtgtgatgtgagtgaaacccagagtatattctatacaagatagataaatacagatagaaatatagagatagatatagatcaatatatgtatgcaggcacttagattgatacatttttgtcgataaggaaaataatcagagtgggatagaagcatgaagaattatatctgggagtagggattagaccagaacctggggatgttaataatgttaattgggcaaagggaagggattagtcactggagagagattattgcatcaaaaaaatagaataattggtggagcacagaaattggaaggagtgcagtctaagacaggaaagaagagtaagaagcatcacagaagaagggaaggagaactaaaaaacaaaagaacaatgaaaagaagtggggtgaggatcagaggactcaactttatgtgggattccatcttaatgacttaagaagtaccagaatctacaatgaactcaaacaaatttacaagaaaaaaacaaccccatcaaaaagtgggcaaagaacatgaacagacacttctcaaaagaagacatttatgcagccaaaaaacatgtgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggattgtaaactagttcaaccattgtggaagtcagtgtggtgattcctcagggatctagaactagaaataccatttgacccagccatcccattactggatatatacccaaaggactataaatcaggctgctataaagacacatacacacgtatgtttattgcggcactattcaccatagcaaagacttggaaccaacccaaatgtccaacaacgatagactggattaagaaaatgtggcacatatacaccatggaatactatgcagccataaaaaaaggataagttcatgtcctttgtagggacatagatgaaattgggaatcatcattctcagtaaactatcacaaggacaaaaaaccaaacaccgcatgttctcactcataggtgggaattgaacaatgagaacacatggacacaggaaggggaacatcacactctggggactgttgtggggtggggggagggggcagggatagcattaggagatatacctaatgctaaatgacgagttattgggtgcagcacaccagcatggcacatgtatacatatgtaactaacctgcacattgtgcacatgtaccctaaaacttaaagtataataataataaaataaaatttaaaaaaaaagaagtacaattattcagtggtacttttaaaatattgttgtttaaaactgtaactctcaaaattggctgcatattagaactgtttcaatttcttaaataaaatctgtctaagtgagtccgttatgggtggccaaatcatttaaatacaaacatcttagaatgaagtgctggcatcaatactttaaaagttcctcaggcagaatgctaatagtcaattatcattgagaatcacagtttaagagaattgcagatgtttgcgaatagtgtttatggagcattaattggatagctagctactagtatttaaattgacatcttcaaaatattaaaatctgtatcctgtatagggagtaattgtcttttcaagaaaactagcaatgtgtggattggtattagtggagcatagtatttattagtttcaacctatacgattgcattgacatctgataaaacggtctgcatggaatgaaaaatgaaattatctcatgcagtaattttcccttaaacaaaatatgtgctaataatgtgattatacttcagctccggttacggaagatgatgttggtgctttaaggcatcactcctctaagtgttgttcatgacccatgtgcatgagaatcactccaggctttttgaaaaaatcaagtgtaagagacatatataaagtcagaagctcaatttataactgagaacttataacaaggatctggttaaaactttataaccaactcatttgctccttgcagacagggtagatacttaataagaaaaatatactgtacttaaaaaattgagtatgcactcacatcaggctaaaagagtctcatggctacattgaaaatgacaataattaaaacctgttgcccaagtgtctctttcctttaaagtgctcattgtcacttttgtttctgacactttcagtctttgacatcagtttactaaccacaaagtaaactgatgtatcctgtgtcaggtcaatggggaaaggcagggttgtgatgaggtgtagcatagggacctatgtcatgactcttaaagggtatatgtagatcagagttctgtatcaagtttctttgttttaaaaatattctctcaatgagaactagtttatgtctaggttcttggaggatgttttatagcgagaccattcttctaccacataccagaaataacattaaaatactaattataaagcttaatttgttgacttaaataatttttaaaattgtgggcatgctgacacaaacaacagtctatcttcataatctgcatagttcaggaaaatatataaaagtcttgaaaggcaaggaaatatctgttttacaaagagatacataagggaaattaacttttgtagacttcaaatgaggaaataagcctttgatcccctaaggcaaacatttttgagatacagtttctccatataattgctatgattttcttacttacactttgtagttccctgctggctgtttttctgtgtaaacttactttcatttccaattatgtcattatagagatgaaaatcagctctaattaaataagaacatgacaataattgtcattcatttatttatgtaaactatgatttttctacctgtgaaaaggtgatttagcaaagaaaaatgtagctctcatggtccatcaattgactggaactaatagtcatgtatctacagcttcccattctctcatatctttattcattcaatattacttgtctaagggtcttcctttctttcatcttcaaataagcatttattaagtagctacactatatttattttattttataattttaacttttatttcagattcagggggtacatacgcaagtttattacctgggtatattgcatgatgttgaggtttggggtatgattgattctgtcacccagatactgagtatagtacacaatagttaatttttcaattgtctcttctccctctctccctccatagtagtccccagtgtcttttgttgccatcagcagctaccgtattaaacatctactatatgccatgaactatagatacagatgccacagatacagaaataaactagttacagttttgccctgaaatcaaatgctttaaaacacattcattttattaatgtgacaagtaccataccaatatattaaaaaatttaccatagcagtttgaaacgttttttctctctttaccaaatacacagcagaagctatttacacatagaataaacattccggtgaattcccagtccccaggctatcatgtcaccccttctatagaactcaagaaagcatatcttaattcataaataaaaaataatagcattgaatgatttcttttttctttcacattttgcttgtttgtttgttttttgtgtttttctttttaagacggagtctctctctgtccccaggctggagtgcagtggcgccatcttggttcactgcaatctccacctcctgggttcaagcaattctcctgcctcagcctcccgagtagctgggactacaggcgcatgccgccacgtccggctaatttttttaaaaatttttattttagtagaggtggggtttcaccatattgcccaggctggtctcgagctccttagctcaggcaatccgctcgcctcggcctcccaaagtgctaggattacaggtgtgagccgccatgcccagctgcattgaatgatttctaattttaattaacaattaatgcaaagttggtgatgatttatccttggaataaatatttactgcatggctaatatgtctgccatgtgctggcattacagtggcaaacaagacagccaaagttgctaacctcctgagttttccatttggagtaagggaaagaagaaaataggttaatttcagatatgggctatgaccttgatgagagaggaaaagagagaaaaaaagtgtgtgtgtgtgtgtgtgtgtgtgtgtgtgtttgaaataacttatttaagtgtaataagcacagataatggtaaaaataagataaatcaggaataaagatgttgcctgacttacatgttttcaaagttaccatttactatctaacttaaattttctctgctgtaatgattatattttatctaggtaaccaatatctagtgggattatgcatcaatttactaaggcagttttttgtatttatctccaagtgaaatttaatcaatttctacagtagtgaaaagtaatttgaagatttaatatattcagtattttaataaaatataaactggtcaaatagctatgcttttttttttaaagtaacaaccaagcatttattcacttactacaaatagctatgtttacctctaataaccagttaagtctcctttagagtccatatagatatgcttttatttgtttttggttttttgtttttgtttttgtttttttttgagatggagttttgctcttgttgcccaggctggagtgtgatggcatgatctcagctcaccgcaaccttggcctcccaggttcaagcgattctcctgcctcagcctcctgagtagctgggattacaggcatgcgccaccatacccggctaattttgtatttttagtagagacagcgttggtcaggctggtctcgaactcccgacctcaggtgatccacttgccttggcttcccaaagtgctgggattacaggcgtgagccaccatgcctggcggatatgcttttatttgaaaagtaacagaaatttaaagctatttaaactaattatgctatacaataagtgtgaaatcaatttctgtttcttaagtaatttcttcatgagcatatcgtataatgcacatgtaaataacagctttgagtgtacacttatattatgtgagtagttacctgtatgacactgtccccaggtctcatgtctgtataaacatacacatcataggatatttcagggaaggttggcgtgttatcatttgcatccatcacttgaatattgacgatgactggctcactttcttgtacaccatcaaatgctgttatctttgggaggagaaaaatacacttagtagagatgttctgcaaatataagtagtacagagtttgctcttacagtttaacaagtttcttacaggtaatcttacaatttgaaagggtgcaaaaatattttgttgataaaaggacgtaatagagacgtaatattacatatattaaaagtgttctaatatggtaagaagcaagtattgaagattttgttttaaggtattcaactccaggcatattttaaataatcagatatgcaaaatatcatttaaagtgggccaataacattgctgactcttagggttaactacaatttaatccttaaaaacttaattggaaaatattatttgcatttacatattttgtatacaatagttccttgtacagtcaatgtgtttataccatcaggaaggtagacttcctagatgtactttgtatcacagtaattcacccaatggcaattttcaaaggactaagtggtatcatttaattgtgatattttatactttatcaatgttgataatgtatgttatactttatcaatgttgataatgtacattatcaagattttaacaattcctgccaaatcagtgctacagcaccaccatctttgtctaaatccactttgtatctaacttttaacaatcacataaactttcctggaagttctgatctttttctatgtaggcttctccagaaataatttctacatatcttgtttaacttgtgctttctcttagctcatctttctcctgtgactgattcaaaaattgggatataattagaagttacattttttctttatccaactgtcaaccctactatacttgttatttacgtgtttgtgtgcatgtgtgtgtatgtttatgtgtgtgtgtgtatttccctatctcatgataaatatttacaatcacaactttaataacctttactttttttcccccttgattagcctaacccatgatttatctacctcagtgctattgacaccttgggacagataactctttattgtgaggggctgttctctgtattacaattagcagcatcctttatgtctacctactagatgcctatagtaactaccccttcacaattgtgacaaacaaaaatgcctccagatgttgctaaatgttcactggagggaaaatttattccctcttgagaatcactggctcaaccttatgactaaataaaaaatgcaagaacaacaacaaaaaaggttaggaaataattctttatacctcaatttaagacaattatgactgtttagtaaagactgaaattctcactttcttttttttttgaaaagttttttcttctgtgaggaagaatgttaatatagctacacaaattacaaaaaaagagcaatacatgtaaataatttttcattgatcttctctctggtattgaaaataatgtatttttcccccaagtcattgattttttcagttttaaccagacatctctttcagttccatacaaacatacatacatacattcatacatacatatgtatatttacacaaaagctctttaccgaaaaggtgtaagtttgctgttcttccctgtccactggttgaagtaaggtgaggtagcgagtaataccagtctgtgtgacggtgaagactgaggtgtagtcattcagaaaaaggtgaagctctgggtcttttgtctttgaaaaaaaatgacatcgtttcaaacgttgaataaataatgtagctattagttcattacctagaagttaatgtttgaaatttatagcaaaaatccacgtgaaagtattaagaatttctaacgataaaagatatttaactagatatttactcaaatgatctaaactattcaaaagatggtgacctatatcgtggaatacaaaatactgaaatacaaacaggtataatcaatgtgggaaaaaaggaaaaataatagaaaaacagaaagaatataaaaactcccaattaaatatattcttactgattatttgttatcaatattttccaaaatagcattggactggagaaataagaaataaaagcaagaaaagaaaattgcatttcaaaattttagcaataagactttataattacttcatttatagtaataaactgcatatatacatattactatcttgttcttacttataatgcaaaatagaaataaaattggttatgtattattcattacctataaatatcatgcttactctttcttattttaatgctgtaaaattttccaaatggaaacatgtttactttaattaaaatatttcagataatttgatttaaaatatgcataaatttagcaaatgtgtctgatagaaaagtctagaaaaaatgatatatacttaaaaaggaagggatttcaaaattcaagtctgagagacaatcaacttagcattgaagaccctttgcaatttcattgccacccctgaaacagaagacaacatactctaatttagagaaagaacagcaatataaagtaagaaggctagcactgatgtctgcatagtaggaaagaaaggcaggtggagcgaagaaaaaaggaatattcagagagtggactattatgaaggctttgaaaaagagagaaaggagtgatacagggaggtaaggtgttgttctagattatactatcttttaaagtatgcatagcatgatatgaaatggatttaatatcataaaacacttctttaagtctgatgtcaaggactgaggcaagagcaaagaatagaaaattgttaaatgtgtttaatttgaaaataatagaactcataatttcaaaatttctatgtaaaatacaaaagttgtaatgcacactactataataaaatgtgaacatgatttgatccacaatatacttgaatctgcccatcttttaaacattgtgatatgtgtagatttcaaataaccttgaaataaatggtttcatttgaacctaaaacaagttatgtattcataatatctcattctgtagtagcttctatgttcaggattttgacttaaggtcactgtgctacatttatcctggaacaataagaaagtaatactacacataataattccaactggcgtatttattataaaatgatcaaaaatattgagaaaaagttcaagaggcttcacactctgatattttcaaacaggcacttcagttgtttccatttcagtgtcatgaacccaattactcagataactagaaagcgggatattctaaaaaatctaacatgttagttttaaaaataaattatgtatttttaaaagtcaattagaaaatgcatatgtctattctgaatgatattttaagcattcttattttacactttagagtgaattgtgattaaattcaattattagagttgataaaaaagttttagttaacatgcagtttcagtcaaagaaactctaagtatgaatgtctgccatttgttttgtgttcatcctggatttacctaatcactgggcttttaagcacatatacacttctctaaatgcaccaacaatggtgccatctggcatgccttaatttattcggacctttaaaccctaaatgcaagctgaggaagttttgctatgtaccttgtttaccaaatatttactttgttccttttgttcaaatctcatcattctctacttcctttataccttaattctctcaatttattttcttcctttcaaccgtaacctctgttaataaatttgttaggtatattcactcatatcttcacatttttaagcatttttgtgtgtcaagtatttcgataatgcaatatttcaataagtattgagttgtcaactagtgtgtccaaatgtgactgtagtataatatgtttgtgtcacaaagagcacttactttttaccactttcaagaaaacctctaggttttgtttgtcaaatgcttttcgtttgaagataatgcacacatcaatactccataaatagacttccttatattggataaacagaaacattaaagatcttttgttaatttaactgtctcagtttcttgagtgcttttataataactagctggagaaagataacatttcccagaactacagtgtatttgctttttgtgaagaagataatctatcacagaaagctagcactatacatggcatattatagctcattctgttttgtttagttaatctctgatcaaaatataacatttacatttatgtatatttaaaataataatcttgtacataaatgctactggtaaatatcctcgtattaatttaagtaaaaaaatttaggaagccagatttggaaatgttcaacaaattgtcactcaatgtttaataatttatattcatttttaaagatagtgcaagtttcaaatgttgtgtatatatttatgttccaaatattacagcatatcattttatgagttttatgaaaattttaagtaatatcaacataaaatgttaatagatacatatcagtaccaactaacctattgttttgattgacaatatttacagttcaaggttttgctacccttcacaagaaaggtgtatcaaaggtttggtaagaaacaatgtgcatttgaagtcaaatatccttctctaaatctctttataaacttaaattccttcttgtcaagctgcattccgatacagtttgaatttcacaaatatatttgaattttgcaattcctaaagagtaacttgagtcaacacttgtatatttgcaactcttttaatcatgttagagttaatagcttataagtttcatagactaggatgtacatggacaaataatgctctggcttaatattccaataggggtagcagactttaggtagctgttgtgtctataagtttatttaaaatgaatttaagtgttaaatcaataggtacacagagagttgattaaaaaccgttaattttcctctgacattaggtaatatttattttaccctaaaatatccagtcagtatataccaaaagtatgatatattaattcacttatctgcatattatattttgagatggtaaaataagctctgacatgcacacataaaaacagaaaaaaatgcaaaagtaaatgcatatgaaaacacacaggtaaacaaacatatgaatataaaataaacaagcattctatcatataaaactatgttcaaagatgagagtctactgtttaaacaccaacttggggtttctaatgggaataaatataggatatcacaaacacacaagaccatatgcatgcacatatataggcacatacaacacagacatgtatagacatatgtgcacatatatatgtatgcatatacaagagcatacatataaatgacaaagcataagagaaaaatgacaaaaaaatgttatctcctcagccagttttaattacttggtagtagttgcctgagtatttagttcaaaaaaattcaatttcaaacttacaatgttttagaaaaaatgccatgataaattaccaatgtttgttgtggactgagaaaacattaataattaagcagtctttgcctcagttgacaattaaatttggattttacaaaatttcatagtactataaacaatagattatgtaaatatttttaccttttttaactttaaaatatttttaaattttaaaccaatgaagtaagtatatttaaatttatataaagtatttgtagatatccttataagggataatgaagtaatacctacgtgttttagtgaagaaaaaaaagaacaaggaaataaaccacagcaattaacaaaagaacaatcacaagcttaacacctagtacctacaggaactccactgggtggaacctatacgcaaattaaacatgaaataaatattgtaaatgtaaatgatcacaaccgcacatatgaagaaaaagcaaaccacttccagcacactagactgacaatttttttcagagtatacaatttttttattagcattgtgacccacatataatggaataacgatatttatgaagcatataaatacttaactgctttatgagtatattgaattaaatatcaaagatacctcttcatagtaaaataacgttaagcagagaaacaaatttacatgaagttataaataagtatctttttacaagccaaatgagtaatctttattgattattattctttgtcattttttatgatcagcattcaataatcaatttttagcatctctgacactgaaaacctggtggtctcagacatgcctcttaacaccttgtgccttacctattctacttatattatgggttattttgaaattatgatgtggtacaagtactctaaaaggcataatgtataaactgatatggttcatatatgtatacatgcatgtgtatgtgtgtgtgtgtgtgtgtgtgtgtgtgtgtgtgtgtatgggtatatgtctacatctatatagcaataaaaagaacactggtgcaaatatttcttttcctttcttttcagtattactgtggcccttggaattctttctgacttaaaatctacactgtgaatactatcacaactcacattcctggctattgtttcttaaaatgtggcttcactttccactaaattaaagggagaaacacaacttaaattttacgcaaatggatccaaacttgtccccttcttggcatttaccatctggaatagctatgcttgaagcaactcttgagagccaagccctgcaatgacaacttccacttttatgcttgaggcttaatctctaatactatgctgatattgtatgaggtggcacactgtctctctcaaagagtttatccctataatgatgattgtcactaattctgacactcaaaagcaacaggattttgtttcattttgttgaattagggtcccaatttgtcatctagcctgcagtgcagtggtgcaatcatggctcactgcagcctcgaaccagtgggctcaagggatccttctgcctcagcctttcaattagtgagactacaagcatgaaccaccatgcctggctaagttttttgtttatttttgtagagactgcatctccatatgtagccaaggctggtctggaactcctggcctcaagccatcctccagcctcactctcccaaaatgctgagattatgagtgagccaccacacccagccaagagtggcatgatttaccttgaagtaaaattcatgcccataaactaaaatggctttaaagttttcttttcataatacagatcttttgaaaatcccagaaatgaactaatttactttataaaaataaatggtgctcggtctataaaaaacagatgtatcagaaggacataaatccatcttctaatatatgaatgactatttcatagatttattttgtgtgctggcaaatggaagatttaaggaataatagatgaattaaaagaaaactggtttcaactcagtatgaaaaacagctttctaagaattagagttgttcaaacatgggataggccatcttgtgaaatacttaatgcaacatcattagcatctttgaagcatctgttagataacctaattcattcaatagtgactgaatttatgagtttattgaagagttcccaaaccctattaagtgctggaaactgtgttagttcttcagcatacaaaagttgctaagatataggacctattctcaacagatgtaaactcatgagggagaaagacattattttcaagttggaagtatagaattagagaaatgcactgagggaggcatgcaactaaaattggataatgaataccgtggaaagattctcgaatgaaggaatgcctgaggtgagctctaaacactgagtataagttatccaagccagcctgtgcaacagatgaaagatttcaaagcctagaacatgtaatgagcaaacattagacaagatgtagcttggcacatgaaagaaacgacaagcagttgccaaatgttataggtgaattaggaagtttccaaaactcaggccacaaaaatgttcaggtatcaagatacagaaaattgtgtgagcttaaattttcttctctagaggaataggtgtcataaaagtatatcaaatagaaatgtgggccagacgcagtggctcatgcctgtaaacccgagcaaggtgggtgtatcacttgaggtcaggagttccagaccaacctggccaacatggtgaaacactgtctctacaaaaaatgcaaaaaaaaaaaaaaaaaaaattagctaggcatggtggtacaagcctgtaatcccagctacttaggaggctgttgtgggagaatcacttgagccagggaggcagaggttgcagtgagcctggattgtgacgctgcactccagcctgggtgacagagagaaactctctcaaaagaaagaaaagcaagggaaagaaaaaaaagaaaagaaagaaggagaaggaggggaaggaagggacggggggaaggaaaggaagggagagagaaagaaaaaaataatgaacggagagaaggaaggaaggcaggaaggcaggcaggcagaaggaaagaagaaagaaacaaaggaaggaaggaagaaagaaaaaaaaaaaagaaagaaagaaagagaaagagaaagaaagaaagaaaaagaaagaaagaaagaaaaagaaagagaaagaaagaaaggaaagaaggaaggaaggaaaaagagaaagaaaggagagggagagagggagagaggaaggaaggatgtagttagatgttagatttgagcttttgaataaatcactctaatggccctgcagaagatagacttgagtaagaaatcaagagaccaagaacatcaggaagtaattctaataacagaccaatagggtggtggttataaggatagagagaagaaaagagattaaataaataattaggggacaaaataggaagatctggaagatttcttagttgtggcgaataaagaaaacataaaaatcaagcaagacttctaggattctaggttgcatagcacaataaaacatctatcaatttctgggaaatgggttttaggagaggatttcatacagtactggaagtttaaactatttctaatattctatgagcttatttatattttatatatagaaactacatatgatatttttaaaaattttattactagaagactaggcatacttgttcactctctggacacctaatgacagtcactcaccatagattattttagaaagggggtgagtctaagtaataaacaaatgatcagttttgctgattaattacttgacacttttataaaagttatgaagcatgccaccctccatgtacatggcatcatctcagggaaattttctctccatgccctttcctaccagtcccaactaaagacacataccaaggcagcaatgattgctaccatatagatgactggacaagagggggcacctgatgagtatgaaactcacaatgttatacagctattacatgacagaaccaggagtcaagccaagatctgtctaaatccaaagcccaaactgccaaaaacacttcagagcatttcatagactaactggtactgtacatctccaagagttgaattataagtagtgtttctcaaaggttttagacccctgagctctctccactttatttcatcaatgccctgtgagtactactgtcttttacaaagttccttggaacacaattttaacatttgtaatttaaaagtgaacagacaatccagacaagtacggggtcacataggcaagcatagggcttagtgtgtaaccaatagataatatgaacacactgagaaggtataaatacataaattttgctattgtgtaaacttaaaactacctaactttagatttagatttttctaaccaccagttctattaaggtatgacctaagctatcatacactttcaaattgattagtcactacttaaaatatgagtatgtattcaattgaaaagcaaaatccgcactaaaatttgtgggacattagtagatctacaaaatacatttgctcagcctggattgaagttattaaggtgactctaggtgttttctagtggggattcagtagagacttttttcctgtgactcatgaaacccactatacatcagagaatccctaaattctcttgactggcatatgaaactgtgtatagattaatgtgttcacttttctaggaaaagaacctagagcattcttcagctatcattatagtcagactatgatcaaagtatataaaatatagagtgcttaaaattgagaactttgttttccataaaccttggcttaaggtccatttctactgtttactaacactgtgatcatggtaaggcatttaaactagctttaatatccctttctgaaatagggataattgcatctatcatgtttgttgtgagatttaagggaattaatgcaagaagaatttactgtattgtttgacatgtactgagaactcaatgacagatattgttaaaacttgtggtttaagaagacactaaatgtgagagaccaggaaagattgaaaaaaaaaaaaaagctagaatggaaaaagaaaacaaagcaaagagaaacaaaagaataaaataaagcatctggtgggaagaggtggagtgccaacaagaattgtcatagcctctgtggagtgttacaaaatttatttagaaagagaaaaaaaatctgaaagtgccttcctaatttcctgaagtgattataaagctatgtgtaatgagatattagggaacattctagagctctgctgccttatgagtgacatgtatttatatttaatttcattaatattaagcaaaatttaaaagttatgtttttagtccagttaaattttaagtactcaatagctgtataagactagtggctactatgttggacagtacagttacacagtaattccatcatcacaaaaaaatccatctatctgagagcaagcactgttaagggagaaatgaatgaatcaagaattatataacagcaagtaagaaatccaactatcttttacatatagttatgcttataatccaaacacagttgtatttacttgctgttttatatatatgtgtgtgtgtgtgtgtgtatgtatacctgtgtatatatctctatctatctatctatctatctatctatctatctatctatatctgtatgtgtatgtatacctgtgtatatgtctatctatctatctatctatatatatacacaaaacatatgtatacatatttatgcagtgaggatactgtggtagttcacaaactcaaaggaaaatctttgggaattagaatacctctggggaacttaaaacttaaaagacaggcactcaatgggactctcttttctgtgtgtatctctcaggcttcattctctcccactgataattggctttctcatgatgtcagcaaatgtggctacaaaggtttcagattcatttccacttctctaatacatgataccaaagtctttcagcccttctgttctccattgtaaattcctgggaggattctggctagcctggtatagattttctgtccctttataacattcactctggctaaggaggtaaagtgttctgatttgctcagcctggaccatttcccactcatgtagatagtgtgagtacaagaaaaacaaaagacaatgatttgtggagtgaagcgtaagcatccacatagtcactggcagaagtatgaatgggtcagctgcctcaaatatattttaataacgatgccctcagacttgaagaaaagtctctgagaatcacaatctaggggtgctttcatgattttttactcatgtagtaacaccattatttttgctttatcaataattatataaaacagttctcaacatatgttaataaaaatattgccctcgtcattaaataaacatcaagtaaaacattcattttcttacatatactgaatatctgcaagctgaaaaggaatagttattgaattcaaagatactttttaaaatatccttgttttggaattaaattataacactaaaactcacttacagtgacttaattctctcttctctagcttatgtagccatatctttgtcatatttcccattaatggaaatatgagatttgttacacaaacaagagcaaaatatgtatttaacttacatcttctatgtccttgtccagagctactattcttaaaggtgaagtcaaattgagactgtccgaaatggttgctcccactggggcagattccaggatatagccttgataactgggcattgtaaaatatggactttgattgttttcatccagtatttcaatgtgtagaccggcaaaggcaggaagaggatgaccattgtcttgttcagcctaaaattgaaaagaaaagaaaatatttagaaagtatatgtcgtgctatctttttggagtttcacttttcatgcaatatatagggttctctttttaactaatatcatcacataaggaaaaaatacgttaaagggccatttgaaaatataaatgaggaaatgaaaatccagtgaggcttaattgcttcagtcttctgttttaaaactcagtgtatattttaaaaattcactgtaataaattattattattttattttatgtttttattttttgagacagagtcttgctctgtcgcccaggctggagtgcagtggagtgaactcggctcactgccagctcttcctcctgagttcacgccattctcctgcctcagcctcccaagtagctgggactacaggcgcccaccaccacgcatggctaatgttttgtatttttagtagagacagggtttcaccgtgttagccaggatgctctcgatctcctgacctcgtgatccgcccgcctcagcctcccaaagtgctgggattacaggcgtgagccaccgcgcccagccaaattattgtaatttttattgaatgcagtaggagaggtaattgtgtttaaatacatttagtcagaaaattcaaatggagatacttgagtgtaccgctgataaaatatttaaataaaagaaaaaaagtaacacaaataaagaactatcgtatcgactttgtctcttctgtgtcttctcattttacactaatgtttaaatctctgctatggtctctgctgttgtaccccccaaattcgtaagttgaaattttaaccccaaaggtgatggtattaagaggtgtggcatttggaaggtgataaggtggtgagggcagagccctcattaatggggtgaatgcccttatagaaaagggtctagagggctccttttccccgcctcccaccacgtgagaacaagtaagaaggtggaaccaccctctgtgaggaagtgggccctcactagaaaccaaatttacaagagtcgaatgtccagcctccacgactgtgagaaataaatgttccttgtttataagccatccagtttatggtgttttgttattgcagctcaaagaaacgtagacaattcccaaataattcgtaattctatataaaattaataaagttatatttattgcccactgaccgtccccaaaagcttcttaaaaaggacagaaataataaatttcattgtaatgttgtagaaactgtgaattgcaatattatttaactagaaatgtttttcaagtaaaattaatattcttatgtataaattttcttttttttctcccattaagtttaagaagttgataaaaatttctgtttctaacacattttcatacaaaatctctacatggtcatgctgcacataggaaaatactaaccatagattttctgttttttaaaaaatatatattttattatatgtgtattggaaggtttaatttaaaggaagatttcatcacaattgacttctggaaaatctcctccaacttttatgagaaaacatggatataatttaatagcatatacatttattaaaatgaattcaaattctatctttaatttttgttatgttttccccattgggagaaaagttgtatttttaaatcaattaaaatgaaaataaaatatttgatattaaactctggtgtgattttctagatagatagtgacagtactttgtaagtagctcagctagagatctctaactgttaaaacgtgaggaaagaaatttggtctccagaagacaatttttcacttccttctaatagtaatttaacattttcatctgttaaaaaggtaggtaacaaactacagtgatattggtagggattgctgacttttcaccaagaaatattacaatatattttccttcatattatttatattgaagatttgttgaaatattatttatgtcaattactaatgtgaaattatgctaattaataaacccatagggaggtaatgtcatataatgcattgattaaaaaacttatatttgatttttaatatattgatatctctatttagataatatgctagattttcttagtaatattacatagtttaccttatgcatttaacttttcatttggcagcagaatgtcaaattagcccatggcacaaaacgctttaagatcctgctcagcactaagaagaacagtactggaataatgtttggtcctgtctgggattatgtatccatctcacataaccaggcatgctgctaataccatcagtatggatgaggtctttctgcatccagcagttgtgattaatttgtgccgagcgatggatgttcttttaggagttacccctgtgacacacatcaggctttctggagacagctgaccagggcaagaggtagagtctacgcctggaaaacattgttttttcactgtttaaaactaattggtccatatgggcttccaacccaatgaccttgaaatgatttaagcaggaatcctctgcttcactcttacaggctcagagcagttcatacatgcaaggcattttgaacagatttttttctctctttcttgtatctctccatctttctttaatatctaattattcttttttttttttttttttttttttgagacaaagtctcgctctgtcgcccaggctggagtgcagtggcgggatctcggctcactgcaagctccgcctcccgggttcacgccattctcctgcctcagcctcccaagtagttgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaataaccagcatgtcatatccaggacataaaaatgctatgaaaagtcataaattctacaacttttcctctttccccgatgaacacacccaaacacacacaatatataggtggtgaggaggatgaaaaaagcaaaattgtataataatgaaataagcttacattttacattcagatcatatatcattagtttttaccagcagctgtgaagccagtaaaaatatgtattatttgcatgatgaaaacaaagtgattcaatgaaaagagaaataaaattcaaatcagatctatgaagataatctaattcttaacttcctcatatctataaaaattacatataaaggctctgcccatttttactctaatattaatttagagttaataatgattaatatttttggattgctactatgtattttgttctatttgaggtgtttcaatttgctgaccagatatctgtctccaaagcccactttctttatgccatttatctgtccagatgtgaaaatgtgtatttttgaactgatggaaaaaaagaaaggttagttttatattcaaggccacataggctgtaagttacatacagaacatgggcccagactcaggtctcctgatttttaagaggctacacaggaagattcatcatatgtttctcaaatttacagaatgcaaatgaatatcgaaaagcaagagagatgggacaaattaacagtaggaaaaaatattgagataaatacttctgttaagtaagagttaaaatgttgaatttaaacaacaacaacaacaataataataataataataataataatatactttgctcgttagtgggcccatgcatcaaaactctgatacaattatcttttcttccatacaatataaataagggttctcaaaaatctgaattattctgttcccctgaaatccgtggtggatgaaatgagaaatattttaaaaacacctcagttggaataaggtggtattttaaaaatcatttactttcataaggtaaccttatttatatttacagagtctatagttacgagttaaacattatatttaagtgctaggttttgtttgaaaagcgtctgggcatgagtctcactttcagtaacgagaccaaagtaaaactgaagccaaaaaaaatgaagtataaaaagcacaccattttgttactttggaaggcaaaacattgaaaaagacaaaccactccatcttcaatattgaaaaaaggaaatactgataatttctgagcaccttgtaacggaggactgagactacagaataactttgttcttcctaactggtggcaaacaatttaacaatttcataatctctaatatgaaacctttcaagtagattcaacaatttaaaaaagacaatggtaaagcttatcaaattatttatcatttaaataaattctaggatagaagaaagaaatcatgttttccaggaattatttattgtgcatctacagagcccactttttttttttttttttttttgtattttaaattctgggatacatgtgcagaatgtgcaggtttgttacgtacgcatacacgtcccatggtggtttgctgtgcccatcaaccagtcatctacattaggtatttctcctaatgctatccctccctaggcccccaccctcgacaggccccggtgtgtgatgttcccctccctgtgtccatatgttcttattgctcaactcccacttcttagatcgcaagtgctcaccttcatctgtattcaccctcccaagttttcttaaacccacttcaatcatacttttgcctcagccactcaaagccagctgcttttgtcaaaatcaccggtgccttttacattgctaaaagcaatatttattttcagtccttatcttacttgacctatcttcagcattattcactatcctttcacggcaacagcttctcggttctcttcctattttactacccattttttctcattctcgtttggtggtttccccttttctcccctacttaattttggagtggcccagaagtgaggagttattcatcttttctttatactcactcccttgctcaatctagtctaatctcacaccttaaaaatgtcagtactattatgactcctaatttcaatctccaacctggatttctcctttgaattccacagtccatatccaactgtgtacttcgtaacactgcgtaagtatctaacagacgtttcagatataaatacctgcaacaatgaaattctgattaccctgcacgaacctcctccactcatggtcttttccacttctttaatggcagctacatagttacaggtaccgaaaacaagaaacttggaggcacctcttgcttcagtggatagatatggaaaaagtgaaaaccacttttttgaaaattgaatttgaagttccatcttctcatttcacaatacagtattagcagattatatatgccaagaaatattctatgttagtaaacttgagatgaaaaaatactcttatgtcaatgtagtgaattatggtcttatcctactgaagcattaaaggtaaatattgcaattttcaaagttaaggtaataccacattttaatttggataatattataaatttatgaaatatttttctatatttataatatgtaaaaatagaaatataatcatattgcttgtatagtaaattccactgttctatgctattgtaaacctaaacctttcttgtaattagtctgaatctcatttttcattagatttttaaattccatgagcataaacactgtaaatgtatcagtttcattcactgctaaaatttcggacaatccctggtatatggaagaaggtcaaatatatatttatttttacttttctgtatctttaattttaataggctttaaatatttttttaaaaattaagtgattgtgacatcattctaattcccattcgatagatatttatggatgtttttccagtgtgtgtgtgtgaacgtacacgaagtggaaattaattaatgtgaatgtacaacatgaacaccttagattatagaatgtctttattcacacattttaaaggtttgtgatatctgcaagtttacctatgggtaattaatactgatgcacattcttgccagtcttatgaatgggcctcacccagccccctcaatcatcaattatgattctatatctatagggatggtgctgtgaacagaataacgtataatcttctagaaggtttatgcatttacatgtaatatttatgcaaaaaggcctatttatatgcatttttgaatggacagtggcttaaagaatgagatgttagttgtgactttgctcttaacacatggcttagatacattttattgtcagaatggtgcaaattgaggactttagcatgattttgactgtgtgtactcttccagtccactcaacacattttaatttattaatttaatttacttgctttacttactgaactatagcttttaatacctagttcttagaacctgcttggccaattttcgcaaacattagatatcttaggaagagaaaaaaaaaagagggagggaggaagaaaaagagggaataaaggatggatagagggagtgggtaaggaaaacaaatggcattctcctttcaccagaggtaagggacagataaatgttaaaaatcatggcaaccacacaaggcaatcattctcaaactctgatgtacctaagaatagaatggaaggcctaataaaaagcagattccctgggccaggcgcagtgtctcacgcctgtaatcctaacactttgggaggctgaggcaggtggatcaccagaggtcgggagttcgagaccagcctgaccaatgtagagaaaccctgtgtctactaaaaatacacaattagccgggcatggcgctgcatgcctgtaatgccagctactcgggaggctgaggcagaagaatcgcttgaacccgggaggcagaggttgcagtgagccaagattgcgccactacattccagcctgagcaacaagagcgaaaccccacctcaaaaaaaaaaaaaaaaaaagtagtttcccacaccctatccacaaagattctcgttcatatgttgatgttagaggcaaggaatctccatttttatcaaactgtctgtggtggttataatgtgagcagaatgtactttcacagacattattctgggtgtggctactcaaactccaatttttagagaatctttctttttagccctattggttagggctattggttagccctattggttagtggaccagtctttactaatggatagtccttataatctggagcaaaaactccagataatacagtgcatccaagagccaatgttgtcacgccagaagatttggagtctagtaactgaaactgcatgcaattatacaattatcaactgtgtaggttcaacaccactaaaattgtcatgtgactctagcattaccaaagattgctcgtgtgtcagtgggaatactctacaagtaataagctcagtcttagctagtattcataggtcatggtcaaatcctcttgacattccattattcataattaattagaatttaggtatgttggtgtatgtgtgcacgtatgcctgtgtatacacagtatcaatatagttttgggtgtaagccaccacttttactttatcatttttaaataaaggaacctcagattgagaaaaaaagcagagagaaggtaatttgacatacagaaagtttttggtttctagtcagagtcagagaaagacaaacgcatatagaatgtacccggaaggcagataatgacaacattctgagtaatagtatattcctgttgctagtgactaaacataggatataaggctactatgtaattcaaaattttcttcttcctgtgttcccttcctggacaccacacctcttgctaaacagctcttcagtaaagccttcaatatacaagggtgtaatttttccaagtttcttcacccagcaaggtgcaggctgcatattgatctttatatgaggatgattctgaaaaacgggcaaattgaccgaactaccaatgattcacgcatatccctttattcctttattttcaattttaaattcaactctcaagtagacaaagaagattgtttgctttggttaattttgctggagggctaaattatatatcctgtctttctttatggatagaaattgcatttgcttaacattttaaaaatcactttagacagttaaaatatgtttacttaagctttcaaccaatttattttttggcaataacaatattattagtgtataaccttcaaatagcctgacatttggacatgtttgtcttgggattcaaacgtgaattacttgtacttttattttgaaatcaaaatgttaataaaagtctcagatttttctttagcagacaattcattgccattgaattttttcacaggtggaaagtatatggttgtggaacatatacatcctgagttggttacagtacagaaaaatagaaggaatcataaaactcttaagaatctgattaaaaacatcaacatttaatccaattataaagtgttgcaaaaaaaaaaagagaaaagtaatctatgctgttagaatcctatagtggaagtttgtggttgtgtcaggtggaggtaaggtgattagtgactaggaggaggtgtaggaggcgtatgggatgtttgtagcatctttttttaacaaaaatctggttgttagttacatgattaacttcactctgtgaaaattcatcaagatatacactttcctgtatgtcagcagcatgtcagcatttcaataaaaatgttactaaaaaaataagctatgaacttgctccccaaaaaagtgtacatagactatcccttcctctcctatcacagtaaactaggatacgggcgctcaagtccaagtggtaatttaatagcagctgccctaggaagtgacatggaaaaccaacattatgaagatacgtgaaaattaaagatgctcccctcttcaaccatctgtgttcattaaagatggaccccaaaagtaaacttggccttttgcactttcccactaagtgtttcccaaatactgtggtttccaaagccctgcttcttatctgctgccttaaaataatctaaggtaattgttaaagcaaattcccaggggctcaaccaaaatatctgacatgtatctgctgtattgcttatttgttttctttattagtttaattttatcatatcttcctaagttttcaagtaattttaatatatgacttgctctcaaaatttagcatccgaaaatcacatgtaaatcttgattctgtagggagagccctgaagtctgcctttccaaaacagccacatcccctggtcctggatatgtagaatcagtagtcgtttgggatcagttggatcaggcattttagcttctctcacacaggcttataggtagctgttacactaaaaaagcctagggtgagcagctgaggccaactctgttctagccttttatgtaagtcattatcactcttcttcactttcagcaaagtctcttaatttggacttagttggaaactgaatggaaggaattcatttatgtaagggaattctctgtaggatcctgcagctcactgaagctctacaaaagctataggtccaaagcaacagtaattggtaacaggttatcaggttatatttcctttgtgtgtgtgtgtgtgtgtgtgtgtgtgtgtgtgtaaaatgtcttagggagggatgactgtgaataacctgtgctccatgaatcaatgaacatattatcaactgactaaaaattattaggtttttgccattaaaagtaatggcaaacaccacaattatgtttgcatcatcctaataaaaataagaatatcccattgattcttgaccctacttataaaattaactgccttaaaacctacaggagcctccttttattcaaaatttaatactctaaaaattaaaggatgcatatacagtttgactttaagccaatttattactattactaaacatactcaaaaacttataaataaattcaaaaacctataaaattcatgagataaaatacaaataactgttgtatgctgtaaagtttgtttgcaaggctatacagcaaaagagtatattcttggttggaaacaaatacctttttttgtatgacaaaaaggaaaagaaacttcactagatagaatataggcagcacatattttataaagccttgtaatataacgacgaaataatactgacacatttcacacctagggaatatttttaataaaacgaaatactttctatcttcacttcaagtaagaatatgcccattctgtttataacttgttacaacgaacacatgaatcctcaaagctcttgtatacctttcaatgataaaaatctttctttttgcttagagcatgagatacaaatcgacactggaatgactaaaaggattttgaatgatttaaagaaaaaataaccttgccactctggggaagaccacagattctgaaaactctcacttatcaccgacatgttgaactatttagctggtgtttggaacgtgagaatcatcttgggtataaacagcaaggtcagccagatataaaattctgatagtgataaaggggtaactttttttctgtgaatcttccaacttatgttttatttttattattttatcctgccttttgccttccaaccagcaaagccatcttatcctacactgaggtctgatcccattcccagttttttgtcaaccaagagaaaaccacactaaagtaccttctatgaattagccaaccagaataatgtattttgtaataagcaaattttaaaaaatcattaacataaaaattatatctaaatcgtttatttttcagagcctagaaggtattgagggtgagaggtcaatatttctcctccacctactggaccgttcttgagacaaaaaataacaaagagttttagcctacaagtttttcaatatgctctttcattgttatatttctatggaaccaagaaacctatgaagaacgattactcgggaacatatgtgatagagtgctaaggatgtttatgtgtgtggggattgcagagtggggagacgtgacaagggttcagaaagtgcctttcctttgaacattttacaatgtttggtcttgctcttgtactcttacaatgacctttgcagacaagaaggccttggcaaaaagcaaggtactctgatgagaatggataaattgcctttcttcttcccaagcagttacaggtcaccttgtgaggaagaaaaaaggccaaataaaatgtcacctctgtgtgtcttttgtcagtttgtgctttttgacagccactatattcaactgctacattctatttctgttctaacactgctgcatgaataacgatatgagacaagaggacatcatacttcctttccttttattagcttccataattggcataatagttaattaatttaggccagtacttagaattgttagagacaaaccagtggaaaataaaaacacacggtgttctttctgaagaaacacaaatactgttttgttttgtgtgtgtgtgtatgtgtgtgtgtgtgtgtgtgtgtgtgtgtgttttggtattatttattatttcctagtaatggtagtgttgctcttcggcaatatttttgctttgattaaacttaactcattaaaacaaaagttgtaaaaggtaaagtttttagactgacttctttttgagcttctacatcctctgtgatgtatctcagtatgttatctgagtcaaattgttgctgttctcatgatgtgttgttggatatggtatcaggcaccctgtggaggaactctctggtgggaggtggtgtacaacgtcacactgtagcagaaaacctgaaggatactcttagctgccttctctggcatttgatcccttagttctatccaagtgtatcactttatccttaggcagattaaatttcatattatacctctgagctcatttacttactctgttacacttaaggtaaaacagatatagtcatttgtcttaaccattccctcttatttagtgatatgttcaaatttcctaacataaaggcttttcttcatcattaattagaagcattagtgatcttatatagagagtctcgtggaatatagttttctcccaaattcttcttggccctccatttttaagccagttgataacatccccttttgttagttggatgctatgacatatcatgacaaaaattatgctttgtgtggcaatctgctaagtttaaaaaaaaggagaacacaaaattaaaatacgaacacttagtgtatcaaaggtcaattgatttcagaaattgtaatatttgttggaaattcatggaaagattgctatttcattactaataacaagtaatgcctgaaatttctgtggggtgattttctctaaaatgtgtaagagatatttactttgccttaccttagagacctggctattggggtagaaaagataaacttattatattatttagtaacctactgaactgaggtgtggtgtgcaatggacttaatatttgtatctctccaaattcatatgttgaaatcctaatccacaatgtaatgcaattaggagaggtaattaagtcatgagaatagaggtctcataaaagtagttagtgtccttacaaaaggtaccccagaaagctctctcaccctctcaccctctcatcctctcatcctctttccaccaagtgaagatacaaacagaatttggcaatctgcaacccagaaaaggaacctaactagaacccgaccatattgagtatgaaattccagcctccggaagagtgagaaatatatttctgttgtttataatccacccagtcttttgtactttgttagagtggcctgaactgactagtacgtgtctgtgtgtgtgtgcgtgtgcgtgtgcatgtgtgtttgtgtgtgtttcattcttgccataagaataagagtaggaatatattgctagaatatttccagatatagaagatatgtcatttgtagcatttgtcttccttcttgtagcttggcaatagcagccctgatgttttttctcttgtcctaactctgggtcactatggaccctgttcaacctcaccttaaaggagtgccaatcgtttccatctcttgtctttttttttcctctctctctctcttttgtttgaaaactgatgatatacacattagagtagaaagaatataacttatatttcacatctccataacagatttaattaattttattagctttttcattttcacggtaggttccatctttttcattttgagaagtgatgactgatgatctttgacttgctactctgcctgacttagacacctgtgatctttcaacttgacaacatctctgtgggaaattcaggtagggggcaaattgtaaattggcttgaaggcaacatgcagcagcatgatctattttttgttgttttagcgatactctgttggcagtgtgaaaagatggacaagatgcacagaaatgaagcatgattttagagactgcttgtgtaagatcatgggccaagagaatgcgaaataaagaattgcagtagatgagcagagttgagatattcaagaggatttcaaaggtatcaggaagggattctatgagtgactgagtgggaacatacgagagaagagacctttgaggaagtggaagtgtctagcttgagtgggtgaccaactaaaatatgattaactgaaaaagggaatagaaaatagaaggtttggaatttttaaaggatgtatatagtttgctatatttttaatttgtcacaattaaataatactaggagtagttatccaaccaataattgaaaagatgtccgtaggcatcagaagtaaaatatgtctcctcagaccaagaaaaatgccaggcacctgagaagcattcaacaaggattagggaaattgaaaactagcaaatgtcatatgctttaaaatcattgaatcagggtgttctcttaaatttctatgaagtaaaatatgatttttatcattactcaaatagtgactaaacattttctagagttatgacattagtgattcatgtagggacaggggttgtagtagctgtcctcctcttagccctcaatcatttctcaaatgctgttttcctgtaactctcaaattactgaaggatgacaccttgccagggcatcaggcacatcagcactaagaatcaagctcactagttttaattccctggctaattttctatggcaaatatgtaatttttctttagaagaaacacattttttgacgcagtcataagtagctttagttgtgccataacaaaggtgtgacattttttctaggcattgaatttatgtggaaatctatttgctacatttgcatcttttttttttctggacagagatgcaagatcaaattgtatcaaatgcacacacattcacatgtaagtatttagatagagtgaagacgtaggtacacagattcagcagtctgaaaagatttactgtgccagggagaaaataattacaacaaatgtttattaagcagcttctatgtgctgtatataggtaggtgtaggggcatgggatgcagtgtaaataaatgttttgcaatctgccctcctgtaaaagttgggagaaaataaacaggtacattcaatagagtaattggggccactttaggggccaaaaggctgcaaaaaagcagcttcctaacagtggctatgcctttcgagggcaaatgtcttcttagttaaaaactgaaacatcagtttgaattagactgttgacaagaagagggaggaatgattcaggaagagggagagtatctctaaatgcttagatgtcagaaagagcatggtcagttgagggcactggaagcggtttagtatgtttggaacagagggtgtgcaagttaactagtgagagctcagggttagtgagctcatgagttggaaggaaaagaagttaaaaggcagcatgctagatagaataagtaggtcagtgagtaacaacatgaaaatcagaggaaacatgaaacaattatgcttctaatttcattgtgatctttgctcttcgttgttaattaaagggatttagattaaaacatgcaattgttatttgaagaactgagagacagtaaattattcaaaatttatccatttaattggccttaataattaatgactagtagctttgtattagatgcctgaagtataaatatatcaactaataatacttgaaaatatttcacttacaatactgaaagtgattttatggactttgtaatagatggtccacacgtgaactaattcactcttaccagagttcttaaatgtgctttcatatttttacatcacaggtggtttttattttatgagtgtagtgatcaaataacttatccaaactgggacatttaaaagagcaacagaggtattatgaataattacacaaagacaatggacataaacatgtactgccctgggtaaaccaaatctatgattcttgttcacagtgtatatcacattttaaagtatgcttaaatgattacaattatataaaatttaggatagtgttttggaatggaacaaactttttcaactgcatgttttaatcttttcatagtctaaagtttgtgaactattccattttgtcttccaagttacacctttacatttttatttgtcagcatgctgaataaatcactgggagaaaaagagaaaaaaatgaacatgagaaatctctaatttgtggcactcaccagctgttaaatacacacatagctttttaaagcagaattcttcttcaaaatgtaggagaagagacttcattttattttttctccgcttttgaaacataaattgggatctagtccaacaaaaacttttagggccaatgaaaaaatgaagtattattaaagtaaaaagagagagagagagaagaaattgaaagatttactatagaggagaactgccagattgtagcatttcaatggtcccctgaacaatgccacaatactcagttattattcaagcaggtggcacattattattacagttagatacctttgcttattatgcccttgacttcacacaaaacatagtaatttgaatctaatattgtctgttaaaacttccattaataaaagaaagtgctattaaaacaaaaaaaaaatctgtggcctattgtaattgattttttttctgtaattgatggactgagttacactgtacccaggtacaccaggacagctgaattcgataataaaggaaaataattgatttttggtttcacatgtgacagtttggaaacagtgctttgtcaaatttcttaattcccatagaaagcagcaccacaagagtcaggtagatccacaatagaaaatcagtacacattgtggagttttatatactctcataataattaacataaaatagtcaatgtaagaaggtgaatctcatgcatggccatttaatacaactggttaaagtggtgttttttgttgaataactcccaaacccttaataaatgaaatcccaggaaactgtagtcatccttcaggctctctccgtggtctgacgctatacctcatttccctgttaactgcttgtagcctgtgcattatgtctccaagcgtttacttctgtgcctccttatgttcaaacatcatttcccacttttattcattgaccatactctttcaatccagcaacatttagcttggggtgatctccagaaaatcttccctgagtttccagattaatttaaatgtccctattctgtgtgtcgttaccgctttttacacgtcttcctcttagcatttgatgcattttatctgatttatttgattatatgactgtttccctttctagactataagttttttcaaggacaaagatcgctgaataaacacaggttctgtgctaaggacatatctattaattgttaaactagacaaccatttctaagtatctgcatatttgtgaagtgaaaagagcatggctttagcgtatataaaactaaatttgaatctcaactctgccccttattagtaatgtaactctaaggtaatcacttaccttatccgaactttagtttccccattttgtgcaaatgagaatattactaaaattgcggcaacagttcaatgaaaaatgcacacaaagcagcttaaacaatgttcattctcagtaagcttccctaccttacttccttttcctttagtatgtttacatttttcaaaaggtaagaaaaataccatcgggatgcatttctagaggttttttttgcatgcttaaatatgagagagttatgtactatatacaaaacttatgctgaatctttgcttttgtcttttcttgtacttacaatgcccttttcccagtcccatctctgcctggcaaattcctgtttttccttcactgcttagattaaatctcaccatctcaatgaagtccatcgaaattaattagaagaatatctgcattttttcagtatctatttaatgattatattaaaatatagatatactattaaaccaaaagtgaaatgccaaatagattagcttagctttgaattatttcaagtctaagatcatctttcaatataaagaaaataatgagacatatattgaaagcatctttggataggcaagacctcttatttttatgttggaaaaatcattaaaaatacattagaatacaattaagtaataaaaatgaaaacaaaattaaaacaacatataaatcaagcacattttagatgtcttaattggtcatgtttttgtggtaaaacgctaattccttttagtagaaaaataatgttagaagacataatgaattgtgtagaattgtatacgcttgaccaaggcatttgttacatataagaatatttagtattttaccccatagtactataaaacgttattttagagaaaagcaatgccatgtattaaaagtgggcttcgcttattttctttttaacaaaaaattgactgactgctgtccacattaattttaattttataacataaaactgcctacagtagcgtctacagatttatctgattagcagttcataaacacaaggaaataagatattagcttaatttaccttaataaccaaatcaaatttctggtgaaagtctctgtttactggctccaggagactaagttctgctgtcctaggatgcatatggaaaaatcgtgggtaatcctcaggagtccctggaagacattgagatttcagtacataattgagaacaataagtaatatgtgtatctgctttttctatttcccttcatcagctgaggaacaaagctacaatttcattagtaaattaagtttcacaattatgcagttcagggaaagcagacacaaatgtggtatatagttattaataattagcatatcagtaagaaaatggaaaatgtttggatgatttttgaaattttttttattaagagggctctaattaatttgaatcttcatcacatgaaaatagacattaagtggagggagagtaaattttttattatgaaattttattttaatggtgcataaatcttaattataactgtttggtctttcaacatatattgtaataaatgattagtaatttgtaccaaatagtgagatgcttggaaattaatgtgaacatattttgttgcatatattatttcttaagattaatatcaagctaataatgttaatcatagtaaattaaatataggttctgatgatactcttaatgtctacacagggtatttatttatgtatttatttttgagatagagccctgctgtgtcacccaggctggagtgcagtggcttgatctctgctgactgaatcctctgccttcccggttcaagtggttcccctgcctcagcccccaaatagctgggattataggcgtgtgccaccatgcctggctattttttgtatttttagtaaagaaagggatttgccatgttggccaggctggtcttgaactcccgacatctggtgatacacccacctcagcttcccaaagtgctagaattacaggtgtgagccaccacgcctagccaagatggtatttcttaatgtattttaataatcaatatacatttcttcatgaagaaatgtcttctaattgtataatcttcctttgtgtactgcaacattcttttcccaaaatgaagaagtcaaatcataaaattgtatagtatatacatttgtaaaattaataaccataagagaaaaataatatagcttcctattatggaaacctactctgtgctaaatgctttatataactaatcatcaataactaaatcatttacattttacagatcatgacttgggagactggggagattaaatgacttatttaagttaaagggacaatctgaaacagagcttttattaaaaatccaggctgccagatgttaaaacacatccaaaaaggggcttattgttactacttattttcctcaactctgagacaagaagggaaattctactgggcagtaaatgagggggaaaaaaaacagaaacatatttcacaccattaaaaccgactgtaaaatctacaaatagtcaaaattatagatgaaatgcaatatatgataaagaagttatccctcctaataggagagtcatacagaaaatcatagagtttcatacattcttcatggaatatacatgagcaaaccccaaatgaagaagatattcataataataaaaaaatgagcactagtcatagatgaaaatgtggataaattttactctaatgtgagagtgagcaaacctttcctaactatggctcaaagtcaagaagtcaggaagaaaaagagataagtttaactatattgcaaaattgcatggtgagacacaatgaacaaagtaaaaccacaagtgacaaactgagaaaacatttgaaatttatgtcgagacggccgggcgcggtggctcacgcctgtaatcccggcactttgggaggccgagacgggcggatcacgaggtcaggagatccagaccatcttgcctgacacagtgaaagcccgcctctactaaaaaaaatacaaaaaattagccagcctggtggcgggcgcctgtagtcccagctacttgggaggctgaggcaggaaaatggcgtgaacccgggaggcggagcttgcagtgagctgagatcgtaccactgcactacagcctgggctacagagtgagactccgtctcagaaaaaaaaaaaaaaaaaaaaaaaagagaaatttatgtccagacaaaatgttcatatcccgaatatatatatataggtttataaattagctaaaaatagggccagtgagggatttaaaaagtgtggggctggctcggcgcagtggctcacgtctgtaatcctagcactttgggaggctgaggtgggcagatcatctgaggttaggagttcgagaccagcctggccaacatggtgaaaacctgtccctactaaaaatacaaaaattagctgggcgtgatggcgcacgcctgtaatcccagctactcgggaggctgagaaaggagaatcacttgaacccgggagacatggaggttgcgtgagctgagattgtgccactgcactccagcctgtgcgacagagccaaactccgtcacaaaacaaaacaaaatgttcggggctagagaaaaaactgttcacagaaagagaaaggcaaatgactctagatcataagcaaagataagcaaagatgcttatctcgatacataagaagaaaactacaaattattcctacattaagatttcattagtcacttagattagcagttgtcccagttggagactgtactctgttggcgagcctgcaggaaaacagacactttggacactggtggtgttaatacaagtgttgtaaaatttatgaaggagagtatgacataagctaccaaaataatattaatgtttactttttgacccatacatcccacatctggacattttcccatttataataacggaagataaatgaccacctaaatatacatcaatagtggtctgggtaaataaatggtgatacatcctaaagcagatgataattcaaatgtaatgataaatgatagatatctttagctattactatggagttattttcagctatattaagtaaaaaaaagcaatttggaaacaagggcctataatatgctaacctttaagaagaatacacatgcatatttacaaaggaatacatacacacatttaaaaatcgaagatagactgtaacataaaaaattgttacttatgagaaagagagggaacacgtggagaggataaacactgaaactaaatttcattacccatatcaagttttttacattttagagctacatatgttatatattattataaaactaattaaattcaaggacttctctaaaaataaaataaaataattcaatctaaatgtatatttagttgttggcacaagcacaaacaaaaagaactaccccaggtgaattttaaaagtagtactgacatcacacccacagtgtaatataggtgaagtaccagagaaattacaaaactcaaaaagttaagctatctacagtaatcatattggtggtatgttgtgattccaagatagttataggagtattttacaataaataagcacattattatgtgtcattctgattctattcttttcagtattgaaagctggattcttggcaggggatgataaagagatagaaattaaaaattaaagaggtaaaatagaacacctatggttttgattttgaattggcagtggaagtttaaactcaggttgtagtttatcttaagaaacaaaatgcatacaacacagctctgaatgctgaaacacagaactatatataatggccaatatagaagcgatgaatatttctaatgttcagactatggttttgaaatactatttaccaataaaagcacttaagatttctgagagagagagctgatttcaggtccagggcagaaaatcaacaaatagctgtgaaacatctgctcacactaagtagcaagaaagaattccgagactactaaactgatttgaaaagttttcaagagccaaaaggcttttttttgtttttttgttttttaagctaaagataagacaatttgagcatcaataaggatcatatcagtaatgatttgaaacagatcaaatatgtttaaattcataagtttacgagtgttgcaaaataacgtattgatcacttttggagcatgctagagaaatattttgtaaattagaaaataagaaaacagagcatgctttttccatatgagcttaacatggggtaaacaaataattgattaaaaagtgtctcattaagaaactatttcagctaataatttaagaagagtaatagtatcagagtgccatcattttacaacccctcataaatgaatggatcatggcattgagcactaaatgctgctaatatcacaaaaaaagagataaagccacatacataccactcaatagaagaattaattcaacatcatctgctatggcctgagttgtccccctcaccattaacaattttatgttgaagcccttactcccaatgtgaccattatagagagatagacccttttaagaaggtaatcagattaaatgagtctatatgggtgggctcttaaatctgatgggactggtgttctctttgtctctctttctttctatctcttccctctctctctgtccaagggcacacagaggaaaggccatgtgaagacacaagaaagcagctggagaagcttcatcaaataccaaccatgaaagcaccttgatctcaggcctccagaactgtgagaaaacacctttctgttgcttaagctactcagtctagggtgtttcttaatggtagtgcaagcagactattataccacctatgaaacagttttgagaaaacccaacaaagaaacaaacaaaatatgttatttgattaagtgtcaaaatttataggaaacatgggacagagtaacatgtaaaattaaaccaaggaaagtacaatcaagatgacgagaaactctataatataaacaacttgacttctcaataaatgaatcacaagaaaacaatttaaaaataaatggaaagagaaccactgtagattaaaagagacttagggctgggcgcagtggctcacgcctgtaatcccagcactttgggaggccgaggcgggaggatcacaaggtcaggagatcgagaccatcctggctaacatggtgaaaccctgtctctactaaaaaaaaaaaaaaaaaacaaaaaaaaaacaaaaaattagccgggcgtggtggtgggcacctgtagtcccagctactggggaggttgaggcaggagaatggcgtgaaccaaggaggctgagcttgcagtgagctgagattgtgccactgcactccagcctgggtgacagagcgagactttgtctcaaaaaaaaaaaaaaaaaaaaggagacttaggagaggctgggcgtggtggctcatgcctgtaatctcagcactctgggaggccgagacgggcagatcaccaggtcaggagatcgagaccatcctggctaacacggtgacaccccatctctactaaaaatacaaaaaaaaattagccaggcttggtggcgggtgactgtagtcccagctactcgggaggctgaggcaggagaatggtgcgaacctgggaggtggagcttgcagtgagccaagatcccgccactgcactccagcttgggtaacagaacaagactccatctcaaaaaaaaaaaaaaaaaaaaaaaagagacttaggagaattatcaatcccaacgtgtgaacttacatgaattctggtccccttgcatctctccctttccgagaaaaacaaaaacaaaaaaacagaaaagaaactaaaaaacaaaaataatatttgtgagaaagtgaaaataaacactgactgatatttaatattaaataaggattgttatactttttatttgtgctatgatattgtcagaatgctctaaaaatagttattttataagcataaattcaaatatttgtggattaaaattatatattttttcaaaataatgaggaaaaaaattgatagacatatatattttaataagtttggccaagtcttcataattcttgaaactaagtgatgccaaatggtgattttatttactatctcttattttatatatttttaaataagagttttcaaaaatgcaatataatttatcatttgctttggtttgcttttaccctagctttcatcagcatagaatggagcagggctcctggaagaatgaacccaaaatggtgaagataattgaataatagccgctgagctgggaaagattttcatttcccagagagtaatacttactagctgttaactagttactacggtgaaaatgttataatctctttatttgtaaatgatctatctcatctaagtttcaaaacaatcttatgggaaagatatttattgcttgatctgtgaagaaaccaacactcacagaagttaagtaaaatattctgaactctcacggctagtaaatgactaggtcagaagtcaaggtatctaaattcagagtgtaaactctttcctgttatgctatatagcctgagttcagtgaattagacactttggcttcatcggccatctgtttctggaaggttggtttttagacatccttacagaatatcaactcaacaagagtataactagcaattaaaaaatacatctccttagcactttgggaggccgagacgggcggatcacgaggtcaggagatcgagaccatcctggctaacacggtgaaaccccgtctctactaaaaatacaaaaaattagccgggcgtggtggcgggcgcctgtagtcctagctactccggaggctgacgcaggagaatggagtgaacccaggaggcggagcttgcagtgagccgagatcgcgccactgcactccagcctgggcgacagagcgagactccgtctcaaaataaataaataaataaataaataaataaataaataaataaataagtaaaataaatacatctccttggacaaagagtaaaaccaagtgaaatttatttccctgcatttcttaaaagtgtaatgcttttccagcgaggactaagaacacttaatgtttgtgctttcattatacacaatgtttacagtcaacctaaagctgttctttagaaacaaaaaattagccgggcgaggttgtgggcacctgtagtcccacctactggggaggttctttagaaacagctttgattgcctaaatttagatgtaaaattgataactatgtttattatcacaattataaataatacggtgaatttcagcattataattattagagccaacataattagtggttgccaaaacatttattttaatttttatatatgctaagaaaattctacgtttttcactttttcagtattatagaggaaatggcaacctaaattaatcccttggtgaaaagtttacaattttgaagattacgggttttctgtaggataaagaaaaaatgctacacaattatcttcatatatttaaaatgtagaattttaattacacgtgttgatcaagatagtatcaccatgactaagatagtaagcctatccataattgccagaaatttccttatgacaatgtctcctttctctccccattcatatttctcaccctatgcaaacactgatcactttctgtctgtcagcataataggaatgggatcatttatatagtatgtattcttttttttttttttaattttgagaaagagttttgctcttttttctagtctggagtgcaatggtgctgtcttggctcactccaacttctgcctcctgagttgaagcaattctcccgcctcaacccccagagtagctgggattacaggtgcccaccaccacgcccagctaatttttgtatttgtagtagagacggggtttcaccatgttggccaggctggtttcgaactcctgccctcaggtgatccactggcctcggcctcccaatgtgctgggattacaggcatgagccaccctgcctggccttacagtatatattcttttcgtaggtgtgtctggcttctttcaattagcataatgattttgaagtccatgttgtttcatttatcaatagtttatttatttctattgcctaggtgttattctattgtatggatatgctacaactcatttatctattcatacattgatgaacacttgagttgcctccagccacaaataaagatgctatgaactttcctgtatacctctctgaatgaatctatgctttcatttatcttgagcaaatatctaggagtggaatggctaggccatatgatatgtctatgtctaaatgttttattaagaatttttgggcagggaacaagtctgttaattttcagttacgtataggtttgtgtagtcaataccacaatcgggatatagaatggttttatgatcaaataactactttgtgttttccttccccaaagttaaatctttagcaatgactgatttgttcatcaccaccgtactttcatctttttgagaatgacatttagatggaattgtgtagtataaagatttggagactggcttctttcaactcagtataaagcattagagattcctccaagttgctgtgtatcaataatattatattttcattgttgagtaatgtttaacttttaaagaaattgccaaattatttttccaatgtgtctgtaccattttacattcttaccagcaatgtatgagcatttcagatcttccacattttcaccaacacttgatattgtcagtcatttaaattttggccattctggtgtgtatgtagtgatattcattgaggtattaatttgcatttcccaattagctaatgacattgagcaacttttcatattcttattttgtttataaatctgtaataatttgttaaaactttctgccattttataattgtctcatttttattaaattgtgttttcatatattccccaaacaagtcacttgttggatacatttcgcaaatacattctccttttctgtcagttctttttcagtctattgtcagtgccttttgaaaagcaaatgcgtttttactttgatgaagtcaaattttaaattttttcttttatagatttgcatttgttacatttaagaaattgttgccagccgggcacagtggctcacgcctgttatcccagcactttcgaaggctgaggtggggggatcacctgaggtcgggagtttgaaaccagcctgaccaacatggagaaaccccgtctctactaaaaatagagaatcagccaggcatggtggcacttgcctgtaatctaggtactcgagaggctgagggaggagaattgcttgaatctgggaggtggaggttgtggtgagccgagattgtgccgttgcactccagcctgggcaacaaaactacgtctcaaaaaaaaaaaaaaaaaaaagagaaattgttgccaaccctaaggtcataaaaatctttaccaatattatcttttagatgctttatagttttagctcttacattatgtatagaaagtctttcaagttggtttctatagatagtgtgaggtacggattgaagtttatttgtttacatatggctgtccaattgttctgcaatgttggttgtaaagattaacttttccttcttttaattgtcttttgcttcatattatttttgaagtgtttataccttaacagttttttctcatagctgtatttgcctatcatttattagcataatacttctgattccctacatatagtaaattgaaggaaatgtggatgcctgacctaaactatataattaccacttaatctttcaataatttttatttagagcaaagaatcagaagatggatgtacaatctgtaccacaaaaataatgggcatctagaggaaaggccctctaatccctcatcttgaaattcctgtttctgcttcttaaaatgttattgtttttgacagttccttgaattctggaagaaaacaaagtcctttcaataaatttccttaaacgccaagatgaacttaagttcacctctgtattttttacccaaagaggcccattcaggaaaacatttgtttttaatgcttcatacatttgaaaatgcacatctaatatacttcaaaggagcactacctcaaaaaatacagtatcaaatttttcccttcaccactgaaaatgtttatctttacatataaaattagtaagctgattaacacagaaataaaagagaacactgtcttctgggtgccatgaagatgtgtggtaattcctcagattttgacattgtagatatatagaaattatagtcagtttcaataaaacactgctaatgaaaacacccacaatttcctttggtagaacaaaaacaattataacatgtaacttatctctccaggtaatttttttgtgaaaaccttttaatgaaccatgaatgctggataccctgcagaagccaaggtattgaaatgtaaaaacattgtacgagaatagaaacacatgtctaagttcaaggtccctacagaatcccttatttatcccacttagaaaatgtaatataaactctatttagcaaagcttaattcatctaaaaatatagctgcttctgaaccatctctgaagctctgggttttatttctttttagtcattcccttatttgatcttgggattaattatattaatattccattcctctgacattaaattcacctgctaccccttttacataactaaaattttgttgataattttaaccattattttcatctatgccctaacaacacatttgtttttgtatcaagttatccctaggttcaaacatatattagaaaaattacctctaatttctcattattttcttccattaattttaactttagcactttttcttttcagctaatatgttctcttagtgcattctttgataattctaaatgcaaaaagtaaactacctttgtcctgcttttacagcttccaaaaatcattagttctaaatctgtctcctttgcaaaacttctttttcagctacttgttataaataacgaacttcattttcttatcgaaaatgtttttaataactgtgtaatagccaccaaaataatttaaatccatttttacatattattagggaaaactaaaattcttatcttagtagccaatatctcaacttcaaaaaatctttaccaaagattttattgggttgcttttcctatgcatatttatgacaatgcttctgattgtatagttcaggtatacctacactagaaagaccgagttcttgtcccagatcttctgaatcagaagctctgaaaagggaggtcaagagaatgcactttgaacaatctcactgaattcttgtatcctttaaagtttgaaaaccacctcttcatggtacatgatacgttcatatctgttatttaaacataaaaataattacaaaattcagaaactatgttattactaatagaaccaacattttttctgactacgtagattcaaatccccaagttactttcactagccagttctctacacattttccaagtgattcttccttaccttagaacgtctctctgatgtgttcctttttcatagtcctaatctcttaccttacttagacccttgtcatttcatacttgtaccacggtgatagcctcctaatatcttctgacattccattcccttataatcactgaaggaaactttctaaaacgctacttttattgcccaattatctagacaaaattttatctattgtgtactggggtaacccctaaaatagaattgagaataaaaggtataaatttatttttctttatgattgattcaatttacatatagtgaaatgcacagatcttaagctttaacgttttaggggcatagacccatgctattaccactcctattcaaactttatatttatttttaaataaaataatacaaaagtaaacttagctaatgctttatatactgactgacactgtgtctctgtatgttttagggacaagcaaggaatcttgagggagatgtgacaagtgtacagtgtgaagggataagcagcagtgtattattcagagttctttagagaaacaaaacaaataggctataaggacatattagtactgacagtgagaaagaaagagagagagagagggattgattctgtcaatcaattggctgattgattatgcaaatttgttgttttagtccattttcacactggtgaaaagacatacccaagactgggcaatttacaaaggaaaaaggtttaattggacttacagttccacgtggctggagcctcacactcatggtggaaggcaaggaaaagcacgtcacttcttacatggatggcagcaggcaaagagagagagagcttctgcaggggaactctgctttttaaaaccatcatatctcgtgagattattcactgtcatgagaacagcaacggaaagacttgccaccattattcagttatctcccacatggtccctcccacaacatgtgggaatttaagatgagatctatggccaggcatggtggctcatgcctataatcccagcactttgggaggctgaggcaggcagatcacctgtgtcaggagttcgagaccagcatgcatagcatagtgagatcccatctctaggtgagatttgggtgagacacagccaaaccatatcattctgcacttgacctctcccaaatctcacatcctcacatttcaaaacaattcatgccttctcaatagtcctccaaagtgttaacccatttcagcattaactcaaaagtccacagtccaaagtctcaccagagacaaggcaagttccttccacctatgcatctgtaaaatcaaaagcaggctagttactttctagatagagtggggatacgggcattggataaatacagccattccaaatgggagaaattggccaaaacgaagggtctacaggcccccaagtccaaaatccagcaggaaagtcaaatcttaaagctctgaaatgatctcctttgactccatgtctcacatccaggtcacactgatgtaagtggtgggcttccacagccttggacaactccacccctgttgctttgcagagtgtagccccctcctggctgctttcatgggctggggtcgggtgtctgtagtttttccagaggtactgtgtaagctgttggtggatctaccattctggggtctgtaaaatggtggccctcttctcacagctccactaggtggtgccccagtagggactcagtgtgggggctctgaccccaagtttccctcctgcactgcactagtggaggttcttcatgagatccctgcccctgaagcaaacttctgccttaacatacaaggcatttccacacatcttctgaaatctaggtggagcttcccaaacctcaattcttgacttctgagcactcacaggctcaatactttgtggaagctgctgaagcttggggcttacaccctctgaagcagggcctgagctctatgttggcccctttcagccacagctggagcagctaggacacagggcaacaagtcccaaggctgcacaagcatggggatcctgggcccagcccacagaaccatcttttctccccaggcctccaggctggtggtgggaggggctgtcatgaagacctctgaaatgtcctggagacgtttttcccattatctacaggattaacatacagctcctcgttacttatgcaaatttctgcagccagcttgaatttctcctcaaaaaatgagattttcttttctatcaaattatcaggctgtaaatattctgaacttttatgctctgtttccctaataaaactgaatgcctttaacagcacccaagtcacctcttgaatgcttttgctacttagaaatttcttccaccagataacctcaatcatctctcaagttcaaagttccacaaatatctaaggcaggggcaaaatgctgccagtctttttgctaaaacataacaagagtcacctttgctccagttaccaacaagttcctcatctctatctgagaccacctcagcctggttttcatcattaatatcattatcagcattttggtcaaagccattcggtaagtctctagagagttccaaactttctcgcatcttcctatcttctacagagccctgcaaactgttccaatctctgcctgttacccagttccaaagtcgtttctgcatttttgggtctcttttcagcaacaccccactcctgttaccaatttactgtattagttcattttcacacagctgataaagacataccagagactgggcaattttcaaaagaaaaaggtttaattggacttacagttccacgtggctgaggaagctttacaatcatggtggaaggcaaggaggagcaacccacatcttacatggatggcagcaggcaaagagagaacacttgtgcaggggaactcctctttttaaaaaaaaatcatcagatcttgtgagacttattcactatcacaataacaacacaggaaagacttggccccattattcaattacctcccaccttgtccctcccacaacacataggaattcaaaatgagatttgggtggtgacacagccaagcgatatcatttgttatgaatgctaagagcatctactctctgcaaattagagaaccagaaaaactggtggtgcattttttatcaggtccagaggcctaagaaccaggggagtcattggtataagtctcagaatctgaaagcctgagaactaagcactgtaatgtttgatggcaggagaagatggacgttccagttcaagaagagagaactcatccttcctctgcctttttgttctattcaggccctcaatggactggatgatacctgcccatattggtaagagcagatcttcttcactcagtcttctgattcaaatattagtctctttttgaaacactctcttagacagacccagaaataatgttttaccagctctttctacatgccttaaatcagtcaagctgtcaaataaaattaagcatcacaagcagccttctctcttgtctgtttgctttcaacacattgcagtgacttttagtttacatttggccagttaaagggatctgtattttataatattaattttacaccaaactaatgctcaaaaaaatgaataaatagctgagaaatatctctgcaaataaacctgagattaaaggtaacactaatgatatgtgtagaagtgaacaccaacagagatggaaaaatcccttcccattcctctgctaaaacagcttaatcagtcatgttattaggtcaaaaccgtggagatccaggcagaccggaaataaagtcagactgacaattttgatgtaattaatacaattatttataatgttgacttatatataatacaattaatcattttctatgtgatatatgaacattgaaaatttaatgactgataaaatacatgtataattcttaaatattagagtgtgtactcaaaaatattttttaattcatgggatgaaggatcataaaagttatgtattcattataaaatgtagctatcattaactaaatgatatggttttggctgtgtccccacccaaatctcatcttgaattgtaactcccacagtttctgaatctcatgggaggaagcttgtgggaggtaattgaatcatgaaggcgggtctttcctgtactcttctcgtgaaagtgaataagtctcacaagatctgatggtattaaaagtgggagtttccttcacaagctctcttttcttatattttgccatgtgagacatgccgttcaccttccgccatgattgtgaggccttcctgaacatgtggaactgtaaatccattaaacctctttcttttgtaaattatgtagtctcaggtatgtctttatcagcagcatgaaaacggaataatatactaacatacacacacaatcttgcctaaagttatttatgtcttaaagttcagagctccactttatgaaccctctcatctccttgaattacttgaattagatcaaagatggaaaacattttttgtttcctaacaagtaaaataatctttttttcccctcaccttaaatctgggcaggaattgtccttgctttgaccagtatatgatagtagattatttctactgattcagttctgggatcaggccttcagaagtttgatagctttcacttttgccttcttaaaaggcaggcatacatgcaattaaatggactattttaaataaattctataaagaacattttctttaaaaaataatttccaaaatgtagaagtacattaaaattagaagaagcattctagagaatggtaaggcatgaggaaaaatacaccttgggggatatatttaaggttatataatgtttgaaaaaaccacatgtgctcagctataagtgttcagttataagaacccagttgtgtagcacaaggatcatgaaacaaaagaaaatataaacaaaaaataagaaaacaaaaaaggaaacagaaaaatatggactctctgataactgtgaaatatgaaatacaaaatgaaatatggtaactgtgaaatatgaaatacacaatagaagaaatgttgggcccatgaacattttcatcccttctcaatgtgatatatgcattgaggaagggacaaaaaatgtgtttttctcttcacatttccaatatgagtatactgtatacttggccatgaaagtgctaatacttgataatacctaccacagttaatgaaggttgataaaaaaatttaaaccaaggtttctggctctagtatctccattcttaatcaatgggtgacaccaacattttagttgccagaatattcataatattattataatcatactttgaaaaattagaaaaaatactgttagcaatattatatttatgttttagtatgtaacatatatctcatctatatgatatttaatacatattacttttcacacattagctgctcatataagagtacttaatactacaagctactgttacaagctaaagtcagcagactttcttatattattagaaataaatacacattgtatgatatcattattaatgacagtgctgcaacagagcttgatagctgttaacatttacattaaaaatggtcagacttgataacacaattagaagcagaaatttcagctacatatatgattaaggggtctacagattatgcttttctttcagagaccttcatggcaggtttctccaccataggccttgagacttaggaggaaagaatggttttgtgggccaggaccacggctccactgccctgtgcaacctcaggacactgcttcctgcatccagccattccagctctagccatggctacatggcccccagatatgcctcaggcctctgcttcagagcatgcaagccatagccttggcagcttccatgtgatgttaaacctgtggacacacagagggcaatggttgaggcttggaagcctccacttacatttcaaaggatgtatggaaatgtctggatgtccaggcagaaatctgctgcaggggtggagccctcatggaacacctctaccagggcagtgtggaagggaaatgtgaggtgggagcccccacacagagttcccactggggcactgcctattggagctgtgagaagaaggcaactattctccagaccccagaatggtagatccactgacagcttgcaatgtgcacctggaaaaggcacaagcaccaaacaccagcccatgaaatcagccaatggggctgtactgtgcaaagccacagaggcagaaatacccaaggccttgggagcccaccccctgcatcagtgtggcctggatatgagacatgaagtcaaaggagattattttggagatttaagatttaatgactgccctcctgggttttggacttccatggggactgtagaccctttgctttggctgatttctccttttttggaatgggtgtattcacccaaagcctgtacccccattgtatcttgtaagttttttcaggctcataggcggaagggacttgccttgtctcagatgagattttggactgtggacttctcagttaattctgaaatcagttaagacttggggaactgttgagaaaggatgattgtattttgcaatgtgagaatgacatgagatttcagaggaaccaggggtttcatgatatggtttggatttgtttccccacccaaatctcatgttaaattgtaatctccaatgtaggaggagggacctggtaggaggtcattgaataatggggggaaatttcccccttgctgttctggtgacagtggtgtcagtgagtgagttctcatgagatctggttgtttaaaagtgtgtagtaccaccccttctctctcctgctctggccacgtaagatgcgccaacttccccttcagccatgattgaaagtttcctgaggcttctccagccatgcttcttgtacagcctgtagaactgtgagccacttaaacctatttttatttataaatcacccagtaacaggtagttatttatagcagtgcaagaacagactaacacagaagaggtattaaatattctctaatggtagaatttaccagtaaagcatctgatccagaattcttctttgtgggaagatctttttgattactaagtcagtctattaacttgttaaaagtctaccccaattttttattttttctgaagtcagtttgaatagtttgattccaggaatttgtccattgcatccatttgtctagttggcataaattgtatataatattccctcataacatttttttatttctctaagctaaatagaaggtcctctctttcattccaagttagtaaattgcatcttatctcttttattcctggtcagtctagctagaggtttgttaattttgttgatgatttcaaagaattgattttggcttcatttattatctctactgatttcctaatccctcttttattactttccactgtagtctctattatttctattgtgttgtttagctttctttctttttttttttttttttttttaaagagagtcacctccaatctcctccatcactcaggctggagtaaaatgatgtgatcgtagctcactgcagccctgcagccttgacttcccagacccaggtgattctcccaccttagcctcctgagtagctgaggccacaggtgcacaccactatgcccagctaattcttgtattttttgtagagacagggtttcgccatattgcccaggctggtctcaaactccaggtctcaagcaatccaactgtctcggcctcccaaaatgttggaattacatgtgtgagtcaccacagatggcctcccttctgctctttttctttagtttgcttaacatttccagtgtctttgtgacaaatattacattattgattagagattaaaatacatgttacaaagtattgttatttttatttgtctcaaagtatttttctgattttatttcttccatgagtcattgattaaagaatgtttaacttccatacacttgtgaatttccaaaatttccttcattataatttctaattgcattccatttttgtcagagaatagagtttgtattatttcaatcatcttcaatttaacgatattggttttatggcctaacatgatctatactgaagaacattctaggtgcacttgagaagaatgtgtattctgctgttagggggtagagtgttttgtagatatcttttaggtctagctgctttatggagttgttccatcttgaccttaagttactgcatttgcagagtttcaaggttagtcagagatgagagcttagggccttcccaagtgcttcctgagtatatatacagcttgcttttatctttttagaatcccagaaatatgttaaactttttaaaactccctatgaacatcattatctagcttttcctttaaagacttttggctagtcaataattctgccattgatgttcatgacagtagaaccattgaagaggttgacaacagcccttggatgacctcgtcatagacatcagcatccgtatcctcacatatagtaaacagagactgtctataacaaatggaagcaggagaggagtcgtccatgtggtaatttactgttagcttggagaaacacatatattcagaagtatttgtatggatttagggaaaattaagagttttgacaaagtacgtgaagtcagagtcatggatatccccttctgtgtgtgtgtgtgtgtgtgtgtgtgtgtgtgtgtgtgtgtgtgctgtgtctggtttttgtttttgtgtttccatttgtaccagactgatgtgacttaggtaacatgccttattttccttcctaatgctaataacaatgtcaactaaaatgtattgagcattaactttttttccaggcagcattatgtacatttacaatgtattggatcaaattctcacaacccttttgtacaaagatctatttttgttaatcctatattaaagaagaataatctggtcaggtagtggctcacgcctgtaatcccagaacttagggaggctaaggtgggaggatcgcttgaacccaggaagtcgaagcttcaatgagctatgattgtgccgctgcactccagtgcgggtgacagagcaagacactgtctcaaaagaagaaaataagaaggactaatttcaggtaaaggggggctaaataacttaaataaaattatgtctagtgtgagttaaagtcaggatttttaacatggacagtacaatttccagaggctacactctcaacccctacaattctcttccttctaaaaatgtaaatagtgtaaaaggatattattcatttaccttagctgtgacagcaaataattgtaagagtttatatctattgtttgggacaatccactatcctacggttgtaggctgatgaaactttccatcactgtgtcacttttctgttaaaattttttaattggctcctcatttcactcagagaaaaatacaaagtagataaataacatacaaggctctctagtttctgctctgttcttatctgtcacctttctacttttacctcactcacttctttccagtacttccggcccccttgttgtttctgaaacccacctggcaagcttcagttttgatctctgcctagaactcttcccggagatatcaacgagaataacttcctcagcttctgtaagcctttgctaacagcttaccttttgatgacacaagtgctgatgatactgcttaacactgcaacttctactacaatcctcctctgcttttccaatcccattcatatgatcgatttttcccatagcattcacaactttctaactttgataataaacacttacttattatagtaaatgtttattgcctatctcttctgccagaaaactggctccacaaagtcagtgataggggttgcttcacagggtaggtgatcgtttgttgagaaaaagaatgcacataacttttaaaagtgaaataaacttgaacaccaatgcatccaactggctctgagtatcataattatccaagtctgttattaaatttcatcctttggcttttgcacatgctgcattatctatatagataattgtctctctttttccacctggaaactcctgtctttctgctaaaatgacacttcctaagcaattctcataaaatgcttaatgctctcctctcatgagcctacatgtggttcaaactttatttagagtgccttaaatattgtattttaatttatcttttacgttgttttaatgttttttagccacagactccacgactccctaacctagaacattcatctctcatatttgtgtttttagcatctaataagagtgattgacatacagtcaagccttcagttaatgaaataaatgatgctttattatctacaccaagatctctatagacttaaaatagtttctgtttatgaaagttttttacaaatataaaagtctgagctctgcttatgatatttgtgtctttataaagaccaaaggcttgaaacagaattgcttgaattttctttacagacagcatttctaagaaggatacagtatgatatttgcaaatctaatatctgttggttgttgtgtatttgtatatgcacataggcttcaagtaagaggacagaaaggggttgagggctaatgctgaactccattaaagttatttttcaagcacacttcaaaagaagccctttctcccttaaaagatatatagcctgtctcacatgcatctgtctgtctagaggctatgcaaatcagcaacatccatatttcagcaaaagcaatctaagaagagcagcataatcaatttctcatcatttttgcttttgacacaattagtagtatatgcatagggatggattaggatggtttctgtggaatttttcaagaaaaatatttaccaaaggttaatatttcgtgttcccttgggctaatcgtgctctctcaccttttttttttaaatggctccaaaatagctctttttaaattcagtcatatattatcacaattatgtatagtaaccaaccaaaggtaaaacacgtgtaaaatgtttttcattttatattaaagctgaaagttggtgctagaggaagttttatatgataagttgatatgtagaaaaatactaatatgtaggttaatttcctaatattttgaattgctttgcttcttccataaaagttattcatttatcattctacacatttcagtccaacaaattgaggaagcaaatatcttgaattattatttttaaaatgtgtttatacacaaaagtaacaatcatgtcaaataataaactttgttatttaaaatatttccttggaattgagagaatttgttactgtaagattctagaataactgatagtgtaaaatgttatcagatacaaaccaacaaggatggaatagaggattcctggcctatctgatggcggttgaatattccggtcctgatcaatggcttggattggtggcgtaacaataatggggttcagttcttcctgaaaaaaaaattaagagagtttcattcagccgcattactaatacttcatgaaggattgagacagatgctttagtttggaaatctatataacgtctgagacagtaaactcaagtttcaacatttatgatctaataccttttactagttaattttgaatgttaagggggagcaaagtattctcaaagtcaaaatggtaagacatagtgattatgcacatagacatttatatcagtaactactcctaaaaggaaatcaaggaagaatgataatgcacttttaatcttctctagaggatttcacaaaagaaatagcagcctatcaaatagtttatgaagtaatgttttctctttgctttagacaagatttgtaagaatacttgtattctttccttgctaaatcattttttagtttcatacacatcaattatattaaaatataaataaagtaaataatttcataaaaataaaagtcacattattgcaaatttcatataattaaaattgattttaaatattgcaggtatttacatgtattttacaatggtctataagaaataatgtttaaaattataatatacttctttaatttggtgtttcccaatttaatgtccagtactattttgttgtgctatcaggactggcaaacatttttctgtaaagaaccagataataactatctttaggctttgccaaccatatggtctatgttgcagctaccctcaactctgtcattacagcaccaaagcccaagtgggcatggctctgttgcaataaaacattacaaaaacaggtggtaagttatatgaggttactgactactgtgatcataatagatatgctaaaaatacaacaataggtatgttgaaaaataataaaaagcttatctacacagatatgcttgggaaatatgatattaaatacagttttgaaagccaattaactgtactgcaaatcttttcagacttaattatgctaatctgcatactgactttctaagaaaagggtactatttgctcactttcaagaaacacccattaacctgtttttgaaatgatgcctttagaacacagtttgggaaacactactctaagttatgtagccctcatcccaaatatgtaagtggtaattctaaatgaaatacttctaaagggtaattctaaagggaaattccattacatatttgggctgagggctgtgaaacttaaactactgtttcccaaacatttagtatgtctcaatatctacaaccttacattctaaaaaattactgcaatgttctcatattatttcttctcaaatgacagaacattgaaatatgtaatgtacttttatacaaaaccagtagtttcagttctcagcaaaaatgtatagtgatggcatgctaaaaaaagagcaatgatattaaaacattatgtataatacttgattttatattgaagttataataaggataattattgaccaataatttaaacaccatagacattgtatggggtttctctcgagttcattatcactaataggtcctaagtagtctaaatgttatcagtattttcctgaaaataaagagttgttggtagtagcaacttactaatactctattctctcctttaaacgtggaatcagaaccacgaaaataccaaataaatatcaaaattactccattaaatccagaagattattgttcttaaaacgcaactctcactgaacttttcctcccatgctgcctctctctctctctctctcacacacacacacacacacacacacacacacacacactttcccaataatcaatttgcttggtatgcaatacctgtatttctccctaaactgaaaaaaaaatctgaagttctttgaaatatgtatgtttgagcacaggacttaagagttgacaagctctttctagtaatttcactgaggaatctgattgccatcagccaaagtcagcttatacttaagctgtatcactcctggttcatataattaaatctgcagtaatttttccaaaaccgaggctctatttggatcctgtaaaggcatttcaaatctgaggattttctgcagttccattctgcatctcatagtcagaaaaatattttcctaaacaatttttgctattataaaataagtaatttcttatctagaaattaaaataaaattgaatcttagcttttcgtttggaatgtaaaatgtaagcaaatcacaatatttgaggatatgttggctgatcaccttcatctatttatttctatagatttgctaagttacctacacataagcagttttagctttaattagtaatgtagtataaaatattctttctataatatatagaattgttgaaatgagcaacataatttatttacattgaattgttgtataagcaatgtaaaaactaaaagtaacacatcaaacaaaaccaagaggaagggagaaatgaaaattaaattcctcatcttacacatttgcctgtgattaaatatatatatatatatatagagtaagaactgaagaactaaaaagaaacaagtgtagtatttagaattatattaataattagaagatgaaaaactgtgagtatctcaggatactgagcatggaagtgagggtagatgggatagaaaatattttacataaagccatttggtactgtgtgactatgtcattaccatagcccgtactatttgttttaacattattaataaataaattatagtattgagaataaaagaaaataaactctcttgataaaggctttcacaagtttctgcaaatttaaaagaaatggtgtggtttaaataacttatcagaattgacattttatcttgtcctatagagactagcaacttattttacaatatttatttttccttctgctaccataaatgaaattgtcagataatctaggattaaaggtgaaaagaatgatttcttaactattatgtgtatgattacctctcaagtaaactgtgctccatgaagcttgaaatgtttaaatattattaatacatgacattaaagaatactaaaaattatgatttttaggatgaccttgttaaatatttaacatattttataaagatatgtagcattgaagtcagaggcagacaatttatatacattaattagaagaaacaacataaataacatgcattatgtttgaacttctgtctgccaacacaacctccacagtagatgaaaccaggcctggaaagggtattcatataagcaagaacaacccagattgaaatggttccttagaataagtgagaattttacagagagaacagaagtaaaataataataataatatgtacgtattcagttcaagtatttttttttaacaacagggtaaatccaaagaaaactgagtaaaaataaaatgaaaaaggaaaaaaaaaagtagtatatagtagtaaagtatccaatgctgatgaacaaaggaaacagataaaagaaatagtctttgattaccaagtgccagcatattactgtccttgaatttattgaaaaatagtatccttataatgaacctctttttccctaagttagtttcaggtcagttctctgactttaaacctagagtaccaatctaataaagggctaaagataagagaataacagatggtgtgttggctctcttagagacatttacttaaacttctaaattctgttatttattttcttttgctttttttttttttttttttttttgagacagagtatcgctctgttgcccaggctggagtgcagtggcgcgatcccggctcactgcaagctccgcctcccgggttcacgccattctcctgcctcagcctcccgagtagctgggactacaggcgcccgccaccacgcccggctaatattttgtatttttaggagagacggggtttcaccgtgttggccaggatggtctggatctcttgacctcgtgattcacccgccttggcctcccaaagtgctgggattacaggagtgagccaccgcgcctggccaattctgttattttcattgaacacagttacagctctatgaagagaacagaattattcttgcccatgaattgaaataatgtaatcatttacaggatttagcaaatagcagatatttaacataattttgccaacttattctgttgagttatccaaagagatcactactctctggtcaactttgtaatatccactagcagaaaatagtccatctgtggctactgccaggtcttccacagttccaaaaaggagattgattcagtgacttgtttcttctgaagaacagagtctcttcacatagacaataattgctgttgcttattctctgtcgtcctcatttctcctagtttttgactttactgcctatattacagaggaagtacggtatgtgttgaagaaattagaagtccacccatagctcaaatatgcttgggtatcctttatggaaagtatcaaaatgttcctctattttattacaattgctatatttatctttttgccaaaagctttattggtctgtgggcagaaattatcttatttgtacttacaaccctcagcctagtgcctcacagatttcaacaaatttttgttatcaagtcaagaaacacagaaagagctccccaaaccctggatggttcttttatactttgcctctgaagcaaagctgctttctttgctgtctcatttgtcttcaagaagaggtcatgtctcctgaattctgttccagttgataagcatatattagaagcacacaggatagcagatttgcatttcattgctgtttgaactgtcagagctacattccctgtcttagtcatggggacacataagtaaagtgaattaggtccatataaagagattcataatgagaaggtaatcatagaaacgattaaacaataacaaaaaaagtcttctgtgaaaatactgtgtaattatatggtttaagaaccttaaaattattattttaattttaagaaccttaaaattattctattttgaatacatgcttcctattcattagcttttctggagacacaccttctcttttgagcaatgttaagacaatgttttcatgcagaactgttgtattattctgagaggataacagtagccaattaacatttgatgtgagtgagggttaattatgcctcatgaaacctcactaccagattgaaaatgaacttttggtctgaattctatttttatatatatatatatatatatatatatatatatatatatatatatatatatatatatacacacacacacatacatacatacacataatcattaataaaaatatattagcaagcaatcccaaaagattaagaagcctttttgtagatttaataaaatctcagctttctggtcatttaggtgttcatatggttatcttgaacaaaaggtatattcaagagaaacactcagatttcagagattggatacattcactgtttagcttatatcaggttaacagaagtcatgatccatagaacaataagatttaacctattatatcatccctaatgttaaatgcatacatgatgcctatgattttcactgtttcatgcatgggtaggttgtctttaaaataatatgaaaccagttcttacttttaaaatacttctcacttcaccaatgaaaaataatatctatcatttacacaagttgatgggtcagtaaacttaaaaaaatgacatttcgcagactgattattaaagcttccagccttggttgagatagacataatagaagcattgttaaaatactaaatattctcaacttggcatttgaatgatgtcttcatctgagtaacgtatacatagtagtatactgaatgtgcccaagtatttcaaattaactgaaggcattataattatcttcaagaaagaatatgttctgatacatccctggaaaggtaatctgagctcatataagtacacagtttgctgttataaaagccaaactttgatgtattatataatattccacttatcattgcttagatctttacactgtattttaatcaagtaataacatcatagtatttggagaaaggttatgctaaaatagtaaaaatatgctgtaagtattccaagaccaataattaagtgatttgaaatcttagtaactatataatttaatacctaagttattgaatttattatttagtacttaattactttcactaattttgtgtgttctttacatttaagtaggtgctttttcaatatctattaaagtcattaatatttaatttgtacacttcctttaacaacagaaaatttctactacatttaaggaaagtcagtgtcacgcctgtaatcccagcactttgggaggccaaggcgggcagatcacgaggtcagggatcgagatcatcctggctaacacggtgaaaccccttctgtactaaaaatacaaaaattagtggggcatggtggcgggcgcctgtagtcacagctactagggaggcataggcaggagaatggcgtgaacctgggaggcggagcttgcagtgagcagagtttgtgccactgcactccagtctgggcgacagagcaagactcagcgtcaaaaaaaaaagttagtgaacattattagtctcatttcatattacattgcaaatgtactattttcctcaaagctcttgattattttcagccagattcttgcttgtttccatgtgttactaacatagagaattagaacaaatcaaaaattttctcaaacacattcatatagacataaatacaattatatgttacctttagaggccaaacaaccatttctgttttcactttgcttagttttgcttttttcaagggtcagaaatatcagattgtttgaaaaagtatcagacatatcgaaatgtttttcctggtgagattattttaaaaaatagtaacgaattggggtgagtagtatgggccaagccaattactttgaactttttgtattgttatggaagaaacacaggttgaacattcacaaacctctttgaaactgattcactgcatatatcaaagttcctcaaatggttttgacaattattatccttagaacagaagagtgaagagcacatttgagataggtatataattatgattcatgaaaatcataacaattcatgcctgatcactggaatttcgtatcacatattaaaacaaaaactcacttagctaacagaaaatacccttgttttattatttccatgagcaaattttatgacccctccaatatcatactctttattctaccaagtatgtgtaaatttaccttgtataatgtgactgaatttgtttccaaaatgtgcatttcagtatcctctcaattgcatatttgaatacttttactgatacttcccttattttcaaaatacttccttgaatgtctttgtctttaaagtttgtttacctgggattatatgcctccttttctatggatcatcaaatgatttctagacaggcaataaaaaccttggctggtggtaacccggtaattattttccatgaataaataataaaagcctgtaacaaaatcttgttggtaacaaaaggttggtgacttgttccacgctgtccaagtgacaaagtctgaagcattactgcaatcaagttggctttgactatcaaaaatcgttttccacataactcaaacctgagaatatgcatttcacagatgttgtaaggaggatacatagatcacagaaatatttcttacaaccctttctcacattcttatccatttctataacaactattctggttcctacttctcacactgccacagggctaactcaaaatcttctggttattcacctccccttcattcccatcgtgcacatcaaaaatcctccaaacgattttgacaagcatgacccactctggaagtcagaggaaaggaagaaattgagcagacagagtttgctttaccatgaagataaggagacaatcttgggagaatttatttgttcataattttagtctcattaaatttggatgaatatttcaatgataataatgatatggttcccattgtgtgctctcatcaggtcaggagacgactgtttttgtgatgacttcaattcattgtcaaatcacaattctatctaggacctccttgttagcagggactgtgtgagcactccctaggtttttcaccctcaatctctccatataaggcctccacactcaataggaaggcaataaaacaaggacaacaaatatgaaacatatataacaaagtaggccttttttattgatttgattttggagaaataaaatctgattttgcattatcagatgcagtagtttggtaaaagaacatacatttttaatttagataaatgaagcaaagtaatgtacagttttcccaagtggttttatcattttatatttctaccgagtatatgtgtaataaatgtgaaagttcaaatcaatgggagaaaatggatttttaataaagaatgattaaatattggttatcaataaatagagaaaaaaattatgatagatattgactttaccaaataaagctttggaagattgccagataagtctttaccagatacatctttggtcgattgcttatgccaaataaatttttgtagaacaaaagtgaatgtatgagaaaaacacatgtattagaagtcaacatagtagaaaataaggtaaatgattacttaaaaatattgcaaatgcttgcttagcaatgatttaaaacaatcccaaaaattggaactgttgaaggcatgaggagatgtgggcttttatatctgtgatggaaataaaaagcaggttaagttcaaggaaaaaaaaaatgaaatctatcactaggtttgacaatatgtatagtatagattaaagcatttcaatttgagctttatcttacataaatattgagagatatgctcggagatgtgttgagaaggatattcattgtacaatatacaatttgctttttaaaagaataaatttcttattcaagtacaacctatgagataccttcataaatcaatagttcacagtctgatgaattatcacaatgttataattataaattccaggaaaaaaattgatattttcacaaggtctgacaatatatgtagcttaaacttcaggattgcactttgagcttcatcttacataaatattgagagggacatacgctcagagatgtgttgacaagaatattcactgcacaatatataatgtacttttaaaaataaatttcttattcaaatataagttatgagataccttcctaaatcattagatcacagtctgacaaattattacaaagttataattcattcatgtaatcacactgtgatcaagaaatagaatattgtcagtatctcagaaaaccacttattaaattatctactcataactacccctacttccatcctagagatggcctgatttgtaatatgaaagatttgttttacctgttttaaattttctataaattgaattacatagtataaaaccttttatatatggctttttaatcaattattatgtcttatatgatatgtatgagtgtaagattcttgcatataattaagtgcagtactagtatactcatattaatggttatactatcatccattagatgaatacatcatattttatatgttagttttttttcaactggcgatgaactttgtacttcttctagggtatgctgtgaggataatgctcttacgaacactcttgagtatgtcttcttactgatatgattgcatttgtgttaaatagaagaataaagttgcagagtatgtatacattctgataggctagattactgtcagttttctaacgtggttgtatggtttacattctatcacagagtaggagaattctaactctttcacatctttaccaatttcagtctcttaagattttagcaaagccagtgaatatgtattattatcttatagttgctttaacttgaattttgatgatgattaatggggttgaacaactgtttgatgatcttggacatttgtaaagtgctgttccatatctcttgcctattttagttgaattgtctgttttccttaatgattcacaagagttcttcatatattataattaagtcatttatcagcttaatgttttataaatattacaattcttatggcttatatttagaccctattagtgttatcttgtcaaagaaaagtttctaattttaatatagttttatttatccctttctctttccatatatacctggctatttcctctacctgtacacatatcctgaatgtatgaagtatagacaataattttccttatctatttccatagataaaatattgcactcatccacatcagaatttatgtaaactgagttggcttccctacaactttcttgagagcaaagtgaaggtctattttcttttatatctgtaggaccagacagtacatatggcacacggagactcaaaaactttgaataaagtgtttctttgttgtagattatttagagtatttttaggctcatacacacttgccttgctctctgaatttctgtaggacatctaaatacaaataatgatgttttttgagaatctatttataatttcaatatctttgagcttcctaaattgctgcatttaactacaggccaaaataatctggtcataagagtgaatcatatacacatataggggctcacagcgcttcattgagatggccttttggggtagtacaataaacaatgtcataaacattccaatagaatgaacggtgaactcctatgtcctacaacaaaatatgccaagcttgccaataagtagcaataaagcttttcgataaactagtctcttagagcttgaattatgattttcaaggtgagattaataatatctacattacttgcaccactgcactccagcctgggtgacagagcaagactctttctcaaaaaaaaaaagaaatatgtatatatatatatctacattgcatgattgatgtgaggatgcatgaaagaatatatatatatatatatatatatacacatacagtaaatgacattcttaatatgtggaaattattatagttagttttttaaattgataattttaatgcttttaaattgtgtaatctgggtgttaaaattgactccaagttataagctagggagaaaaaaattttcatttgaaactagaagcttaattgataccatgtcttacacatctgtctgaaaataggacagtgatatgaattttgaaagtttatttagaattccatagttgatcaaataattgaggaagtaaaaagggattatctatctctgctatttaacttgaagccaagcttcaaatgagaaacttatgaattaaattatttaaaaatcgtacttaaaaataagatagtctgccagagagttgaatattcacttaaaatagttatcttattttgatttatttaaaggtaacttcagtgaaattattttctatagactaagacatatcatacttttatatccaataataaattcattccctacatttttattgtaaagagttgaagtgaaatttcttaatttgttaacattcagatgaattatataaatgcattaagcagttggcaggtaccaagaactctactaactgctcaagcagtagaaaataaattagacacaaattctggagatatgaaaaagctcacagtatcagggatggggattcaaagtgcaggtaccacaagttaatttagaaaatgttttgttagggcatttctcaatacatggtaagagaaagctctgataaaaaaattcatgctgtcaagtattaaaggtgaattataaaaaataacaacaaacagacattcaagcatgtgtactttgatccaagtatcaaatgtgatactgctagtgaaaaatgatgttcttgtctctgataggagtgggaaaaaagagtaacaaaatatagtagaaaatcatctagagacattttgaggagagtttctaaatcgccttaaaaatggaggagtttaattttcataaactgagttgccaatgaaaaacttctataggtaaatagcaaaaatatttattgtcttggtgattaaaaaatgatcctagagtatctttaaaagtatagttcagagaagcaaaaatatttataaccctaccacccaatgattatcatttttaatatttaaggtattttgtatcagtatttgttatctatgtatatatattgcttgtctaattgtccgtatataaacacatgtaatattttaccatgttccatatttaattttgttgacattttcatctcatatcataacattggtcttcatcaataaatatgcatcaaaaacctatttttgcaatagctttccaaacccactaatgtcataatttataaaatgatatatttcctcttcagtagtgtgtaaaaaagtctaactgcagatgcttgtcaatagtgagggagatatacatctagagtgttgctagttaagcataaagtataattttaaatttctttggtcactagcataatttacttgatatatttgtgtcttgcctgttcatttactttgcctattttgctttgttttaatttgggcattttaaaattttatttccatggcatatgtgaatagcatagaaatcaacactttgtcaccagccttaaacatattttcagtttgttgtttgccttttagtgttgtttttgacatttaggaggttggtgtttttatttactcaaatatttccctttccttttggatttcaggctagatactttaaaccatctgaaaattatgtgaatatcaaattatctattttttttcaagtactatggcttttttatatgtaatgtttcaatccatcaagaaattgaatagtaaagacttaatactcaccaaattataggtggaattttaatctttatcatttataacagaaataaaactagattgaaaaactatattttcccattgtatcttaaatggatatcttatttatttatttatttgagacagagtctggctcagttacccaggcttgagtatgatggtgcagtctcacaacctccacctcatgggctcggaccatcctcccacttcagcaccagagtagtagctgggactacaggtgcatgccaccacatccggctttttttttttttgtattattggtttcaccattttgcccaggctggtctcgaacttctgagctcaagcaaaaggcccacctcagcctcccaaagtgctgggattacaggcatgagtgactgcacctggcctataaaatgtaatctcattgcaaaactcaatgatgccatgcttctataatatgctattacttttttttttttttttttttttttggagacagagtctcgctctgtcaaccagttgcccaggctagagggcagtggcgcaatctcggctcactgcaagctctgcctcccgggttcacgccattctcctgcttcagcctgtggagtagctgggactacaggcacccgccaccacgcccggctaattttttcgtatttttagtagagacagggtttcatcactttagccaggatggtctcgatctcctgacctcatgatccacttgcctcggcctctcaaagtgctgggattacaggcctgagccaccgcgcccggcttattacattttttaacacaggttttctctagtagaagagagccatgatatttaggattatggatatgtgtgaaagctagacatttaaaaagcacacaatgacttgaaatatggaattgggtatcaaataatctggatttacggaaaactagtcacaaaattcatggagataaacaagatggaatgccaaacaagaaaagaccatgtaattgcatttgttaaatgtctctaatgtgttccacatccacttcccaatctctctctcacacacacacaacccaacaaaactgctttccttgtaaataaaatttgagggttgaaaaccaacatgtatactttttgcattacacatgtactttaattatcattttaaattcctatattaagttaaaaatacatatttagattaattttattggtttaattctttttcttcaacagtcaattgacagacgtctttgagtacttttattctgaagataatatgaatccttgtatatatgagaatgatgtttcattcttaaataaaaatttgattgaattttaggttctctatttacaaactttttctttcaatgcactgcaagttctacctaatctttgctttctttatgctttcttctttaaccatctggtagaaatttgcttttatcctagaaataaatatagtttaccagggattttccaagtatttgtctgtgctttaactgtgattcataattaacacttttgatctgcaaacacaggttctttatataacccttgagtgtttttgtctttgtttttgtttttccttacagtatctttgttattgtacttgcttacttctcctggtttattaataaacacaaactaattacatttttatctggctctctgatcttcgttgctttattctcctagtcagttcgtctgtagtctggaagatttttcaaacatgtaagagcatactataaaatcgtagagagtgctttttttaaccaggctgatgcagacaaagtcttgcctctcaaattagtttctgtgaactccaccttttgctggtctataaaataaagagtaatcttaccttctttaccaagaggtttgtttattaactgtggaaatgcttgtaaaacacctactaccattgtcctatcaagttctaaaaaaatatttgttattattgtttagagtcgcagctttgctttctgcatcttaaatcctatctttctgtcttaaatctcttcagtttaattatttcatttttcttctgtatcaatatctttatttaactttcaatatcatcctatatattccattcttaattaaattttatttcttatccaaacttttaaaaataatttaatagtgtttcttttagtcaatcttattaaatatatgctcccccctgcctttttatcttcagtgtaaaatgctgctctaatgttgtggaatctttcaagggattcaagtgtgtttgaaactgtgtattaagcgatgatcactaccttgctgactgcaaagtttccatatttctgtggtggagaggtagaaatctctcctttatccctgtctacatctcttttccctctactgctgctttcttacactagtcttggcaaaaatcgtacttagaccccttgtttctagtgttgatgcaacttgtcatccctttttgctgtctccacaagtacatcaatagggccatgagtaaaactaatgcagatactagtagctgcctgacatttcaattcagacctactctatgtatttcaatccaaacctactttaggttaagagatggaaaatgacatcacagaagaggtgttagttaaaactatgttttcaaagattgatacttcgaggcaaagccttctcctctaacttttccagatagaataatattgattatcctcactattcccattaaaatatgctttcctctgcattagattattaatcagaactctcacattcttagttcatcatcatatattttatagcagtccagtccagaggaaagcatgctgccatcagagccagaacgaccaaggtcttcaaaactcttctccacaacttattcattatgtaaatatatctttctaaatatcaacgttgtaagtgtataatagtaacattaatttacaacgattcatatatcagattagaccaattaatcctatgtcattttaattatagaacttttctcaggatttttttttttaaagtaacattagacggccttgcagtgactgtcccagggaacattcaataaatattagttttataatttcttattattctatttatgtataaatttctttctgatctgtactatagttatattgaagagaatgtctatttctttcatgttagtgccttacttggtgcctgacacattgtagatactcgattgccacttattgaatcaaagaaccaaggtattgattgaattatgggagtaaaataattacaacatgttataaagctgggagataggaaaatccaaaagaagagatacattttggggaaaacaattacctagtaaattcgattgaggattgggtttactagagaaatatcattttaaattcacaattcagaactggagaaaatttaaaagagtaagaaacagaaaaaatgaataaaaataactttgttttgatattaattttcatatgttgattgaaccttcaatataggcgagaatattaaagttactgcattttcctacagtttttttgggtatattctatatggaatgaacacagtggtttttattgtcagaatattcaaatattactactaatagcactatctgtcactgatcacattcactagcacactgtagaccctacatgtacatcgagaatattgagaaatctgtgacaacagtgagttatatattttattgacttcctctagttctgtatcatccagcatagaggacacataatactttacaaaatatacccttgctgtatgaagtaccaacatttttagtttcatttacagaacaaattctgaactttgtctctgatataaattatgttatacagcagcatttaaaagagatattagtgattagtgatttctttttataaatgcaatgtgaactttagtaatattaaaataattttgtcaccttactatatttatattaaaatatgcatatggtaatgcttgctataaattaaatcatataaataactgttccttttacagctggtttgaaaacattcttttgctgtcttttaacgtagattttagatctcaaatactgtatttttaatttaatagaacacatggccatttaatactaggaagaaaaagagatgttaatgtcattttccaatagtatttaatctaatatgttaaaaattttaaacatatacagcatttgtgcattagctttaggaaaaatacactagcagtaattatattctttgcagaaacatttctgaaattaacaaaatgaggaatataagtaaaccatttttaggcattgaaaaggataaatttatcctaaaagatgttgatttcagactcaaaataccataaactctatctgtttcttggtatttaaaattgaataaagaataataacatcctcttattaccaagaggacctactgtctcaccccgtggttagtgtatgtgacttaagaagcaatgattagaatttgtagagatgatgcaagtctcacattgacaaaaagaaaatttagaaaacagcaatgctaaaaatagaaatgcacaccaggatatactagcaacataaagttttaatgctttacagagctcatataacctgaattttctgagaatacaagaggagcgaaaataaaggttcatttttttgatagatagtcttggtgggattatgtctgcctcactgaacagtataaaacatttggcagagcatgtataataaccaccaatagcatggttcccaattcactcttactcaactcccacagctagcatctgaatcacaaacagaatagaagcttcccagaactcaaccactggcaacatttaaatccctcagcatactgaaggaccttgggagattagggtctttttgtggaagggcaaactgaaacacttggttttaatgtttgaaattatcatgacctaaatttgttttcacacttctgttttgtccttgtagtagaggtgactactttaaccacagcagggtactgttgataactctggatgctgatgcctgtaaggcactgatagatgcttcataaatctttttcaaatgacattcttgatatttgcccaccgggtctctggaagcatctgctaaacttctcaatttgtcttcagaatttcaacgtaattttttttctttctcctttctgcattggcaacaatttatgtcttccacataggatgtacttctttcacactatgtggatatttttaaaagtgtaggtaccatcacactcgcatcagaagcatctgttaaagtaatcacactggtgggggtgaccccagaaagcacatattctcataacaccttacaagagctgtaggtaatttgtattttggacaaacatgtcagactttttttatgtacaaaaaagatgtatacaaactataaccttttaaccctttctgataagccttcctatatcctgacatcgatttccttcttttacttgtttctctctcagtactcttcaaaaagagaggtggtgaccagtgttggaagagatgaagcagatgcacatcacttcctttgggaacttgctgaaataattctttgcattgcattttcatttacattatgctgaccagttctcttcacttagaactttcttagttgttcttttgattcttactgttgaaaaccaagattatgctcttgtgatgaagtgttttcaaatatcaaaatctgaataattgggcagcccactttcagaatcttatcatgaagtttatgctgcaaaatgtcagtttaaattgaaatattcaaactagtagcaaggtaccaatgataagacatccacagacccaaaagttaactgaattcatatgctattttttgctgaacttatctaactggtagccatacacagcaataaataggctggcaattatgcatgggggaaaatggagtttcaagtgtgtagtatcatgtctataagaataatattaatgatagcctgaaagcccactcagatatctcacagagcctatactctgtaacttagctatcatatataatctgtcctggggatttacaaccctggcccaagaattaccaggcatctatgaaaatgcgacctagaacaccagttgccctagagaaaaagacgcctcagcataggtgcaaatttcatagatgttaaaacaaagctaacccttacaagaataacttaaactccttatatgaaataaacatctgataattgaccaggactgaatacagatgtaagaaaggggaagacctccccaaattccgagaatagtctccggaaggataccctcccagctatttggtggccatgccaccagcctgctcccactgtcttgtaagagcactgccacaataaaccacttgggaatcaggtgatgtctaagactcatctttgaagcgtatcctactgaagagaagaagttgcctctggagaagatggtcagctaggctcacctaagaccctggagtgcaatggcagaaaagataaaaaaaagcatttaatgatgatctgatgactaacaaagcaactaataaataagttaacttttaaaggtaaagatgaatcagatggtcagctttacttagaaatatttgagataggttgtcctaattaattaaccaacaaacacttattgagagaaagtgagtagattggaagtagactaacatttattgatactctacttgcatctggttctgtaggtttaattttcacaattctactgttatagaacctatcaaaagcttcaagtaataagtaatatagattgaatcagaatctgactttgaatactctgttttttggatcaatttgactttccaccattatatgtgtaaggctgctgtttcctcacattacctacctgtcctggctgattgtacctcctactattgtgtttcccattccttagtatctctggtttatttttcttattaaaataagccaaaactttccttttccaggtttttcattggttatttctttagccttccatttatatctcacatttcaactcaaattctccttccttagagaagcttcactgaccactctagttaccaaagaatgctgtcttcttaatagtatgtatcagtgcctgaaattttttgttgaaattttaatttcctgtcttcttacactgaaatgtaagctccctgaagcagtaaaataacaatgtctatatccctagtacataaaacattgtcctgcactaaaagtctttcttgttcatgccttcattcactttctcattctctctctctcgatagattagatagatagatagatagatagatagatagatagatagatactgagatagagatatagtgtgtatgtatctataactgatggactgatttttttaggtaatgttccttgtcaaggagttgaaaatataattgtaaagaaagtttaactaatatatgatacaactaacaattaaaacaatgtatagtatgtggaactcacctactgaattactgagaggacagagggttgcgttatgagggaatctgaggaatacagatatcacttcacatttcgtcagaatttcacagtttaacatatattttatttcatttgtgcctcataggagctgtgtgaaataaagagaattgtcttctttttttttttttttttgtcaaagaagtcaaatgacatctcaatccacaaatccagtggtaaggcaaggttccctaaagaagataaacttgctaaaaatactaccctcctttgtttatttttcagaaatttaaattgctactcttcattgagaaaattagagcaaatgatgagattttttaaatctgctactgtgagtacgtgtatgatatttgatgaagttagcttgctgaaggcatcatagatcaaatccctaaaacaagaaacattttgtggccttacatgtgtaggattggagggtgtatgcatacactttcagtatattctagaaatcagtgagctacagtgtgatgtcatacagatatatttggccactgaccaaaaataaaagcatgctatagaagcattcgtcttgaaacaatatacttgccaaactgtctttacattggaataagccaatatttttatattttatatgtgcaggcaatcaataaaaaattgctaaggaacagagtctctattcacagtcctctgcatggggcacggcccagtacacattaagttgacctactgcatgatgtccagtcagtattaaaagggcttaacgattaaaaaaaaatcagatgtttaacatgtaaaagataattaattggtacattcaaagtctctcattcttttttgggatcatcctctgtgcttgatttttacccaatatttcagagccatttctgccagtgatgaaaaactggagatgaggttgcttagacacagcaaatcctgtatagccaaagggaagctgaaggtcaaagagtgaattagattgatgtcttgttcttgttgaaaacagaatttatttgttttgctgacagagaaggaaaatataaacagtcaagaacgggaagacatattattttgctataaaatgaattcaagaggaaataacagatataaggaaaaacacagtgaatattattataggaataattcattagaatagagagacaatgaacttaaacacttgctaattctcctgctgaaatggatcaagtgattgcttcgactggagaaaaatcctaaactaacctaaatataaatgagtgctagaggacaggcagaatcacatcatgacacagacttaaaggcagagccagaagtacaataaagttaagacctgagctctccatataaaacaaaccttgtgtaacaagtgaaccacccaggtatgtctttaaatttatttttgaaacattagtttctgtccttaattattttctaataaaaataaaatcatttgataaaagaaatacaataataatatccaacgtgaataaagtctgaagactcagagggaaaatatttttttcaataactgtaatcatcgtatttctccaaaaatctcatttgcaaataatattgtgaaaaaaacaattttcgtgatataactcacaaggcagaagtctgatataaaacataaaatgtccttttgtttttcgttttgcatttatttcttatttcatcctgataaaaatgaatgcatgcagttttcaatatgagcaaataagtttttttccatatatcctttaaaactgtcttattcacttcgaatcttataaaatatattcatttaaattatatttatagaaaatcttcttgagaaattatgaaacttctaaatttgaggagatagtgacctaaattactttaaaggtaatcttgatcataatagaatgctgcagaagggctcaaagtttcacttttagaaagtaataaattgcatggcatttaacaggcctactctaaataagccacagccttgaaaagaaaattgctttagacactggtcctcttgccaatgtactgatttctattattagccaacatcttctaccggcccctgtctggggtcaccttaggtctagctgaagctgtatcctcagggccctgaatggattcagaatcagcatgcaacatgcttgtggtggcagtataaaacagtctacgtgagagaatggtccatgagagcaaaatcaatgtaaggataaatgaatgtagatgggatcaccaatcccaaatatgttacaagaagagagtgaacaaagtgacacggagactaagagaagataagaaaagaagtagaaagcaaacatagggtgagtattatggaatagttcttgagtaaaattcagtaactataaaattataattactatggctctatctgttaatgtagtgggctatttaataagccaaagcagcaaaaactagggcattactatggattagttctctgtgtgtttcctgaaacctagagaagattgtaggatataaactcaattgtgtcctagaaactcattttctatgttccagtcttgtaaattctacaaggttctagaaatctgtagtctaagaggcaataaacctaattatgaatatactaagacttagtcccttccaggaaaaagataaagaaaatactagtgaagattatttccttatgaaatgtaaacatggccttaatctagactaaaatacattttttcctaagaattttagggattaagatagattttctgtggtagtaacaggagcacagccgctaaatttatgccactagaagcaaggaagatcataggaaagatataacctgtcaactttgattcattttgagaaatcagtactcatgtaatgacggtaatggtatttatcgtatgtaaaataaaaccataataagcttttaaaatagtttaaggtacaaaagagtattttaaaaacaatgaatttgatctcttaaaatttattatagttttgtcacgagttttattagaagattttccatgtgttctttctgggagaaactatttaaaaagtccattaactttttctaaatgtttaattttttttttgagaaggaatctctctctgtcgcccccaatttttatttaacatgagttaccaaattagggtcactgcattcttattaactatgctagtttaaaaaaatttatagaaactttttaatgcttaaatatgccatcatatcactgccaacatttgtctctttttaatcaatatttaaagtaactatttccagtttttcattttaatgatttatatagtctttaaaaacattcataatggtttcagtggaagccatctctgtgttgatttttatgcttttatgtttctttctttttttgagacagagtcttgctctgtcacccaggcaagagtgcagtggcgcgatctcggctcactgcaacctccacctccccggttcaagcgattctccggcctcagcctcccaagtagctggaactactactactactacaggcatgcactagtagtagtactacgactactactactacaggcatgcaccatcacctctggctaatttttgtatttttagtagagacggggtttgggcattttggccaggctggtcttgaacacctgacctcaggtgatatgcccacgttggcctcccaaagtgtggggattacaggtgtgagccaccatgcccggcctgatttttatgcttttaaatggcttttggtctcattctttacagtaatgaccgctgttggtttgataatcaaccttcataatgttcaaacagtttatatttctgcacatattttctatttaaatactgacaagtattgtggtcttagtctcttagagacaaaataatcataaaatatttgttaggataaaaaactgttaggataaagacataaaaatgaagttttagaaggaaatgtagataactgtttgaaaatgtaaaatcagtgagaccttatttattgtaggataataaatagctattaaaaatatacagatttaacactacatgaaaatttaaacatttttataaaaaagctatcattaatatgatcaatggataaatgacagattttggaaaaatagcatttaccagaatgatttgtaatacctataataatactaatgaaaattaataataataatacttcaaatagataagaaaaagcatattgctaattgaaaaagacaaagttgttaataggcaaattacagatgagaaatacaaatgacctgtaagcatttggaaaaaaaaatgtttaggttcattagaatttttgggtgtagtggatgcaagtattaaaaataatgtattagatttgtacctgataacctgtaggaatttcctacaagtggtttttaaagtaaagcaagatacattaaaatgtgtatacaagtattctattcttaacacacatatgcatattacatctattttttataatataaagaattgaatgtcagagtacatatcagtgttggaggaagagaataaggaggaagcacagaaagtaaaaaggaaaaataggcaccaaaaaagatttggagaatggcagatggccaaggagatgcagctgggaagtgcctcttccatggagaggaacccaaatatccagtaaaccgtcacattttaaacagatcttttgagagaaaacactgaaagttgatacagaggtgacacagacaccatggttgaagagggaagaaatggggcagtctgctcagagtcactagacaccaggactggcccatataccttgaacaaacccaaggaaggggtgagtgaaggaaccctgggacactacatacccacaatgtacttctgagatcctagctacaggagtttctacgacccccatagatctttggactggtaggagagctgcctcgagcacatgcagaggcacagtttgaacccacaccgagcccagaaggctttgttgtgcggtgcagctgcagcaaaatgcaaccctaggtgcccatcccacaagtctccatttcatactgagtggctaagttcctgctatctgccaggctgggagtgaaccgtgcctggcctgctcacatgcccaagataggccccatcacccatgctgcgtgattaaggtacatctggtccacatgcccccttgcctgtcaacgccttcccagacctcatgcctgaccactcctgcaagagggtgtccacagcacaacatccactgcccagcttaagtgttttgttaacagcctgggagaagttcaccaccctgtccccaaatcatagccagtgcttaaagcttagaggccagaggacaaatcagtgagcccaggcccgtgagctcagtcccgtgagcccagtcccaactccccaagactccagtacaccacgcagggacattgagctgagatttgtgacctaatctcaagtgaaggaggaggatcctccacagtcagaatgcagagaagaatgtggtatgggttctcatggggcatgggagctggacacccctccctttgcaagaccagacaacgaaaggtatggcctgatggtcgtagctttttttccagggagtatcctggcacagaatgcctggagtagctcaacaatgtgggagcagatggcttggggaaagcctagttggttgggcttgccgccagggcgagtgtctgtgggagatctgctgggttaggggagtgtgagctaggcagacaccatggttgccagctgggctgaaaatcacgggctgcaagctccatactggtgttgcacccattgtggcactgccctgcctggagatcctctacccttgaaatactgcattttctttgtctctacacttgaaatactgtattttctttgtctcatgttgtgttttgagacagtacaactcatacctaagttgtgtatcacagcaactgcggacataccctaaaacctgctctgactttggtaagcacagtagactggtgggtctctggagagttgtgtccctagagatgtaatcctcagtgtggaccactcctgagggaaggggagtgcagcctgccaaagcacaccatgagataaagaaaatgtggccatggcatcagccactaaaagggtcaccaccaaggcccagaaccagacttggagaaggaatcatgtcttgcctccatctccacttcccagtgcactgttgcggatgcagcagtagctcttcccataaggtcctagaaagtgtgcactgaaagaagttgtttctcatgatgctccagtgaggacaagcatgcaccaagaccccacctgccagctcttactcttaaatctgtctaccagattgaagtttgaattatagcatcacataaaaatacattgctaaaacaagcaacatctatgaaagccactgcaggaacctatctctaaccaaggaacatatatagaaacttcacccctgcaactacccagaaatgaagccaatgaatcacatacaccacagtcatactttcaaggagaataaaaaatataaaagccctgtgatggttaatattgagtgtcaacttgattgtattaaaggatgcaaaatattgttcctgggtgtgttttgagagtgttgccaaaggagattaacatttgagtctggactaggagaggcagaaccactctcaatctgggtgggcaccatctaatcagctgccagcacagctaggataaagcaggcaggagaagacagaagagcagacttactgagtctcctggctttcatctttatcccatgctggatgcttccagttcttcagattttggacttttgtacttacaccagtggtttgccaggggctctcaggccttcagtcacagactgaaggctgcacatcagcttccctacttttgaggctttgggactcggactgccttccctgctcctcagcttgcagatggcctattgtgggactttaacttgtgattgtgtgagtcagtgatccttaataaactccccttcaaatgtacatctatcctactacttcagtacctatagagaactctgactaatacaaaccccatctaaatgaagcaaattcaaaaacaaagtatcaactcccgcagatggaaaggaataagcacaagaactctggcaatacaaaaagccagagtgttttgtggtctccaaagcctctcactagctccctagaaaaggatcctaaccagatgtaaatgtctgaaatgagagacatagaactcagaagatggatggcaaggaaagtcaatgagacataagataaaattgaaatccaatacaaagaagccagaaaaacagtccgaatttgaaagacaacatagctatattaagaaagagccaaactgaacttctggaactgaaaaattcactaaataaatttcgaaatacggttgggagtcttaaaaacagactaggccaagtagaaggaaaaaattcatagcttgaagactgattcttcaaattaacccagtcttgcaaaaataaagaaaaaatattttttaaaaagacaaagccttcaagaaatatgggattatgtaaagaaaccaattctacaacttattgatattcctgagagaaaagaaaaaataaccaacttggaaaacatacctgaggaaaaatttcaagaaaatattctcaattttgttagagatgttgacatgcatacatcagaaatccagagaaccccttttatatactataaagacagccatccccaagacacatagtcattagactatccaaggttaacacaaaagaaaaaacaaatctcagacacagctagagaaaagagcaacactacccacaaagggaaccccatcagactaactggtcttctcagaagaaaccttacaatccagcagagattagaggtctatttttagtactctaaaagaaaagacattccagaaaaaaacattcatattcttcaaaactaagcttcataaacgaaagagaaatggagtctttctgagtcaagcaatcggtaagggaatttatcaccaccagactagccctgcagaaatgcttaagggagttctaaatgtggatgtgaaagaacaatacacacaaaagcagagttaagtacatagtccacagactctataccacagactctataaagcaactacacaattgagactgcaaagaaactagctaacaaaactatggcaggaacaaaatctcacatataaaagttaaccttggacataaatggcctaaatccttcacttaaaagacatagagtggtgaattggaattaaaaaaaaaaaaaagaatcatccatctgctgtcttcaagagacccatctcataagtaatgacactcatgggttcaaagtaaagggatagagaaagattaatcatgcaaatggaaaacaaaaaagagcaggagtttctattctatcagaaaaaacagatcttaagcctaaaacagaaataaggacaaaaaatgttattgcttaatgacaaagggctcaattcaacaagaataattaactatcttaaataaatatgcacccaacattaattggagcaccaagattcataaagaaatcactactagacctaagaaaagatgtagacagcccctcagtaataactggggacttctacacccaactgacagtggtagatagatttatcgaggcagaaatctaaacaaataaattctggacttaaatttgacacttgaccaattaaacctaatacacatctacagaacactctacccaacaaaccacaaaatatatatttttctcatcttcacatggaacatactctaagagtgatcacatatgcagtcataaagcaagtgtcaagaaattaaaaaaaatattaaataataccaagcatcctcttggaccacagtagaataaaaataaaaatcaatagcaagaggaactctaaaacgcagacacaaacacacacacacacacatacacacacacacagaaactaaacaaattactcttgaatgactttcatttgggtaaacaagaaaattaaggcagaaatcaaagaactttttaaacaaatgaaaacagagacacaatgaacaaaaacctctgggatgcaacgatagcagtttaaagaggaaaaattatagtgctaaatacatcaaaaagacagaaatatatcaaattaacaacgtaacattgcacctaaagaaattaataaaacaagaaaaaaactatatccaaatatagcataagaaaataaataacaaaaataagaacaggactgaacaaaatcgagattcaaaaatccatacaaaggatcaacaaaatgaaaagttggttctttgaaagtttaaacaaaattgatagactgctagcaagattaacaaaaaagagaagatccaaataagcacaatcagcaataacaaaggcaacattagatccagtcccatagagattcaaaagattctcagagactactatgaacatttctatgtgcacaactagataacctaggagaaatggataccttcctggaaacacacaacctctcaagattgaaccaggaagaacttgaaacactgaacacaccaacaatgagttacagaattgaataagtaatagaagtccgggactagatgaattcatagctgaattctaccagacatacaaagaggagctcatgccaatcctactgaaactattccaaaaaatcgaggatgagagattcttctctaacttactgtacaaaacctatatcatcctgataccaaaatatggcaaatacacacacacaaaagaaaaccctaggccaatatatctgatgaacatagatgaaaaaatcctcaacaaagtacttgcaaaccacatccagcagcacatcaaaaagataatacaatatcaagtgaactttattcctgggatgcaagggttgttcaatatatgcaaatcaattaatgtgatttatcacataaagagaattaaaaatgaaaaaaataagattatctcaacagatacgttaaagtatttgataaaatccaacatgccttcataattaaaaccctcagtagactaggcatttaaagaacatactaaaataataagaaccatctattgacaaacccagtctacattatactaaataggcaaaagttggaggaattctcataagaacaagaacaaaacaagaatatccacttttaccactcttattcaacttaatacttgaagccctagccagaatgatcgaccaacagcaagaaataatagacatccaaataggaaaagaggaagttaaattttatttcttcactgatgataggattctatacctagaaaaccctaatgattctgaccaaagacgcctaaagttgattaaaaatttcagtaaagttttaagataggcaatcaacatacaaaaagcagtagtatttctatacaatgcaatgttcaaactgagaaccaaatcaagaacacaatcccatttatgagagccacaagagaaaaaaatgaaatacttaggaatacctctaaccaaggaggtgaaagatctctttaagtcgaactacaaaacactgctgaatgaaatcatagatgacacaaacaaatggaaaaatattacatgcttatagattggaagattcaacatcattaaaatgtctttactgcccgaagcaatctacaaattcaatgcagttcctatgaaactgccaaaatcattttttacacagaattagaaaattgattctaaaatttatatttaactaaaaaagagcctgaatagccaacacaatcttaagctaaaagaacacagacaggggcaacacattacctgacttcaacctatactacaaggctacaataaccaaaatagcatggtatgggtacaaaaatagacacatagaccaatggaacagaatagagaatccagaaatgaggcctcattcctacaaccaactgatctttaacataattgataaaaatgcaatagggaaaggataccctattcaattaatagtgctgggaaaactggctaaccatattcagaagaatgaaattaggctcctgtctctgaccatataaaaaaattaactcaagattgataaaagacttaaatgtaaaactttaaactataagaagcctagaattagacctaagaaactcttttggacattgacgtaggcaaagaatttatgactaagtactaaaacacaaaagcaacaaaaaacaaaaattgacaagtgagaccaaattaaactaaagagcttctgcacagcacttgcatgttctattgcaaatatgaaatagcaaaggcatggaatcaacattggtttccaacaatggtggattgtataaagaaactgtgatgcatatataccatggaatactatgcatccagaagaaagaatgaaatcctttcctttgcagtaacatggatgtgcctggatgccattatgctaagcagatgctgggacacaagaaaaatctttaagatatgtcactgcttcttatcaataataatgttctagtgagtaacaagagttaagaacaccactaattatagtactgtaaatataattacagttctaataagacatacacacacagagaacaattttgtctggtggttgaggaaatcttcattgatttaagatattttttgatgaacaggatttttcaataactatcagacgaagaatgtctatgacttatttttaaaaactattttcttctctgccttgcatatctgacattttcatctcctatcttccttgaatacaatatagaacctgacatttctttcctttcaaagatccttaaaacatttcctacatttaatctgaatgtctttctcagtaatttttcttatacaagcaattatggctacattttcttaatataatcatgaaaaagtgagcaactgaaaatttaatctggagaatatatatgaaacatattcaattaattcaagttgttgttaggctgcatatgttcagctttcagtgaaggtgattgataaatgagaaactgaaagaaaacaaaccaataggtgtttttcagaaacagtattattaaaatgcatgtgctttctactgaatgaaagcaatatagactttttcctcgcattggtagttagtaaggtgtataaaaacgactttgtaaagaacaattaatataggttaatgaatcactgtgaagaggggataacactttattctagcaatgatctgcaaggtgttaaaagttaaaaaagatgaaaaacaattgaatagttatttcatcatagtgtttattaaattgattttcctgtatctgtcaagctttacagaaatgtcttcaacagaataacagtgttggaagccaaatgaaatgcattatgaaatatgattcttcacttggtatgcaggtatactctcaggtgttaactcaggcaaagagacaaattcaattttaaagttccatttgttaaaatttgatgattgtgattaaagacccataacaattctatctttgacattttagttttttcttcacagaagcattctactgcaattttcttagttttctttcctcttaactgtggtattacccataaatgctggatttctctgttttaagtgtaacaaacctacaatcaactatttctggaacaccacttcatcttaacaacaaggacccataaatattctaaaaattcaaagtgttttatataaaatgttaaatgatacacataataaatttctaagtagtaattatgattatgcccataattatacccataatttaaaaatatgttacctgaagtaaattattacatattttatgttggaagtattcatttatctttgatctcttttaacacactgtactaggtggtaataaaataaactgccttattgggtagtcatttatcttttgtttcatattttttactggactaatattccaacgctatagatagtgaaatataacattcaaacaatttgatagtagtcaatgaatccagtttttaaaaatgggatccattttctaaaattgagtatatagatacttcatgaaatgtcttatcatacatcctaaaccaaaccaacctcttcccttgactgtcttacagtgcgttattattttatccactgcagcaactagcacatttttcagaacctagtagatattcagtcattgtctatggaatacatgaacacattctaaatttggacagtcatcattcttggtgttttaaaacaaacacttcctgaattgcacaaactattttctaaatagccctgggaattcattgaaggaaggtatgggtaagttgggggtcaaactataaagatgtaggttctcctctcaaaacttcttcagcgtatcctcattgttgtttgtttgcttgcttgcttgttttgaaagatctagatatagtctaatgagagttgtataaatgtgatgttccacaatgattctaacttacatggtgcaaaataataaaatattacattctagctgtttgtggaaaatcagggataatataaaggatctagattttctctctcctctcctcctaagatttattcactcagcaaagttacctggtgactacttactgctagacactgttttagatacttgggctataacgttgataagaacagggcttgaattagtgaaaagtttattttaattagctgtatggcaaaataggaaactaacaaaaataaacatataacatgtcagatggcaatggctgcactgagaaaaatgaaggagaataagaagttctaaattattatatatgaccaatattaccaacatattatagaaagaaatgagttcataatgtttatcagagaatttcatgaaaatcactaaatttttccagaaagccaggcactgataagggaataaacaaacagataaccgattttaatttgatcttctcttacaagtgcagctatgatctgccattgtatataatttaaattttaaaattgtttatatttctttcacataattatgttcttacattttgtttgtttgtttgttttgagacagagtgtcgctctgtcacctaggctgaagtacaatggtgcgatctcggctcactgcaacctccacctcccgggttcaagcgattctcctgctccagcctcctgagtagctgggactataagcaggagcccccacgcccggctaatttttgtactttattagagacagggtgtcaccaaattggcgaggctggtttcgaactcctgatctcagattatcagcctgtgcctcagcctccaatagatgctgggattacaggcgtgagccactgtgcctggccaatattcttacatttaaagatcagacatctatcagattcccttctccctgctacaaacattgtatacttttccataggcacaagattttgttttcattcaggttggactcaacaagtattatttagcagttcattgcatttatccatttacccaatagaggaagtataaaagatacagatgaataaagtgtaataattcttatactcactatttgcccttacatcatgtaagtgctcaactgtacaacatgtttgtgttcccaaaacctaactggaagggataactcagaaaaatagaataaaagtattgtatatctcatacatcttcattttagaatattgtaggggtacagatcagtataaataaaatactttggtaagtgcccaccacatcatctgtttgtcatccttagagccagattataccattctcattaagaaagaaaacttactactgtacctcctacccagtaacatatatatgatatatatatatcatatatatatattttatatataatatattatatatatatataaaacatttgctactggttaggagtaacactcagaaaatcatacttaataatgtagtacaattgggtataaattcacctagtatttttaaattttatgtatattcatatttatatgaatcatcatttaaaatcatgtctactgatcctgatggcattaaaggcataagaggtaccgaggatattaatttaattttgtttacagctatgcacagatatttttagttcactcagatttaatccagtagtctattatttgattaattgtacagctatcaaatcattcaggactcccactgtttcaacaagagtggaaaaatattttttcatttatgtttatatgcagctatttgtagtctaaattaatattctggcaattgatggtgaaattaaaattatttctgtcagatatggtaatttgatgacagtggataagcatgggagtaagagaaagttttgaggaagaggggtactttttgtttacttaatgattattcaaaagatgttaagtaaacattctatagaatgctacagatagtggaatacaacattgaaacaatttaataatgcagtcaatgaatccagtttttaaaaatgggatccgttttctaaaactgagcatacagacacttcatgagatgctttatcacgcatcctaaaccaaaccaactccttcccttgactgtcttacagtgcatagggtatctctacattctaggaaaggaattatctgtttatatgccacttataaaatcatacttaataatatagtacacttaggcataatttcacttagcatttttaaatgtaaaatgttaacgaaaagtgttcttgaaaaatatttctgagaatattttctaaaaaatgaacaaatcgtaacacctaagggatgatatctttctagtgaattgattatcagagtataatgtggtatgttctgattatgttacataatattctgattagcagaacattttaaataagtgaatttagcaaaatatttagaggttaaggaaactgttttacactgactatgttttctgacccaaatgtgagaaagaacccaataaaaagaggcagccagataatgctgttgtttgtgaacttaaacagaagcttgcatgtaatttattgttcaaagaaaaataaaaatagaagttatactttatttagaacttaatgacagtgaaaattacataaaaaggaagactactgaatacagcaaaagctgaaattatataggaaatataaatataaacacacaaaataagtgtaaattataatgaagtaaaaatatatcaaagagaaaaaaggaagtagtacagtaaaaaaaaaaaggtgatgctttaaaaactgtaattaaatagacaaatttccagccagattgatgaccaagtaaagagaaaaggaaggagacagatcaaaagacacaagatgatgaatgaaaagggggtcagcacttataaatgtagtagcaatgtaagccataatgagcacaagaaaacattatcaacttaattttgaatatataaaatagagacacttaaaaaaactgaacaaaaacaacttactagttttaaaagaaaaaaaagtcatcaaacatatatccttccaaaagtatagacttcaaaagtatagccccagatgggtgaacaacttcaaaagtacagtcccggatgggtgaacataaaccacactttaagcaagaactctcagttataactgcttgcaattttagaggataacagccacactcctgaaccagagcttggcaccggctattccctctggaacacccttttatttccttctctaagcaaagacatggaatcaatctaaatgcccaccagtggtctgcgggataaagaaaatatggtatataaacatcatggcatactatgcagctataaaaaagaacaagatcttgttctttgcagggatgtggatgtagttggaggccattatccttagcaaactaccacaggaaaagaagaccaaacactgcatgctctaactcataagtaggagctaaattatgagaacacatggacacatagagtgggggacagcacacactggggctttttggagggtggagagttggaggagggagaagacaaaaaaaataactaatggttactaggcttaataccggggtgatgaaataatctgtacaacaaaccaccatgatacgagtttacgtatgtaatgaacctgcacttgtacccctaaacttaaaagttaaaaatgaatgaagcctgtcagaaccacccactttgtagtcttacattttccctagtattcccaaacccctttgcctagtcaacattttacaaagcgcttttcatcttctactgtgttataatttatatatttttagtgtatattttacacactttattagaatatgagttccttcaaggtaaggactgttgtttgttttgtgctccctgatgtattttcagagcctagaacagggcctggaataaaataagcagccaacactatgcgatgaaaattttttggtgggtataaatgcctttgattcgaaacaaaactcagtttaattgtgtgtgtgtgtgtgtgtgtgtgtgtgtgtgtgtgtgtgtctaaagtcaccctaagcacactgttaataaccctagaatgactgacgtgttcgtattatgcaattttttatttttttcatcatattgacagataaaggattctaattcctataccttttcaataatgcagaagccttcataacatttaaattccattcatggtaaagattcttagcaaataaagaataaattgaaccttgatcaattactttaaagtagttataaaagacctatagtgaatatcatacttcagtattagaagctttctctttaaaataaggaacaagacaaataattggcaacatgacttcttttcaaattgcacagcattagggatccaagccataaaagaaaataaaagacatgtggatcataaagaaaatataaaacgttacttacagacaataaagttgtctgcataaagattataagagaaagctaaaaactattacagtcaaaaagagacatcagcaagcttggtggaaacaaaacaaacaagtacaagttgtcagtgacctttcaacaaccaattaggaaaaaaatatatatatacgttaaatcttaacactgaaaagcaacaaaaatatggaaacagtgcttcttatatgccagattctgattgaaatattttacaagtttaactcatttaattttcccagtgattcttgaggtagaggccatatttttcttaactttaatagatgcagaaactgaagcacagagagcacttgacttgcctaaggtaaaagttaaaaggcggcagatgtagaattcattcacaacaatctagatccagagtatttcttgtgcccctgatgatatgccaattctctggactctatcactaactctattaaatgatcaagaacttgaaagaaaaaaatatttaaattagtccatgaacaggaaatgtccaagtcataaacctagtaatatttcccaaagataatgcttaatagtggtgtcattacaaccaaaatactaaaaaaatgtgcaagccaatctcaaatatgtgggagagaaaacccaatactaatttgaagaggataaaagagcaaggcatctcccttgctgacagaaaggcttcttataactacaacattcatactgaaatgctattatactagatctagcactgaaacaatccaggccactacaaatgaatgaaaaatgagtccagaaaaacacagatccatatatgaaaatttgttttataacagaaattgcattaacaaatcagaggttaaattttaaaaaccataaaatatttcagacaattaattatttatgtggaaaaaagtaaagttgactcattatcctgcccagtacacaaaaatcaattccaggtggacttaaaaacataatgcaaaagcaaaactttaacataattaccaaaaatgtaagtcatcatctttatggtatttaaataaaaaaaagacttctttaaaaagacacaaagaaagcaaaacccataaagagaaaaactgatactcttgaagatgttcaagtttaaaactcatgcaaaatagcaccaaaaacaaggtgaaaaggaagcttcacagaggtactagataattctgctatgtttaactagcaaataattagtatccagaataaataagaaagcaatacatcactaagaaagtgacacacaaccctatagaaaaatgggaaaaaatatgaattggtaattcacaaaagagaaaatccaactgaatactaaatattataagagaatgttgaacaagtcaaactattaaagcaatacaaattaaattgccaataacattattttattcccatcctattgaaaacaattaaaaattctgaataccatgtggtggtgaaaatgtgatttcatgagtatatagcaatttggacagcaaactgacagcatgtgagatagttgatgatattcatatgacccagaaattccactattctagaaaataatcttgtacatatatataataaaatctatataagaatgtatactgcaacattttaaaattcaattaaagattagaaaagctctaaatgtatcaaaacaaagaacttgaaaaacagattataaataaatttatacagtggaagtcagtaaactgataaatcacaaaaacataagtttgagtaacaacatcaagttgcagtagacatgttcagtatatcatttccacaaattaacaaaataaatagtgctatatttttatggctataacacataaaggaaatatacatatgactttctagataggtattatttcttgtatctacaagtagaaaatggggttgcgcagagagggtgatagctacaattgcttctgtaattattctctttaaaatgatctgactcacaaacttaagagctggtggaaattcagcacgttttttttcctctttttctctccctgaaaagcatggaggtgttgtcactctcttcctgagtccctcagtgagcagacgtagagaaaaataccctaactgatctggaagtggaagatttaagttaaataaccttcaggaaaaaaggccttaaactgttttaaggcactaatattaaggtggtttcattgttacaggataacctagcatacgctgactgctattagaattcctgccatgaatcctaaaatatatgatatagtcttagtgatcattgggtgagtggcaaagcaactataactaaagctgaaagcatggtaatacatcttccgcagtgacaggatatttgataagactttcaccagcaaaaatatggaaggtacatgacattcctaataaaattgtagttccaagagaaggatggccagatttagcaaataaaattgcaaggcattcagttaaatttgatttccagatataaaacagatattattgtttagtaaaatttccatgtgatattatactaaatgattatacatatttgtactaaagaaaaacagtgttgtttacccgaaattcaaatttaactggttttctgtgttttacctggcaatcccatcaagagggagacgttgtgaaatagaaaagtagcaatatttcttggttactataaaagttatttaacaagactttataagggaacatgaagtcagagaagggggcaaaacactagtcattttaaaaactaggtggggaaatttggaagtagaggtgaccagatttcacagaagattgtagggtgagaggagtatagaggaagccaatataatacatcaaggtttatggtttgaaaaatggaaagatggaatatcaattacctgaaatgaagaaaatagcacacatttgtaatttgagttgcttattagcacccaactagagatatcaaatagatagttgaatatctacatctttgaattcaggagagagattcaaactgaagacataaatatggacattgacagcatatagatgacagtatactaagtttataaagataaaatagtaataaaagctaatattaacctcttttgtgtcagtccttgatgtaaatttttttatgtgttaactcactgagtccccacaataggtcgatgtaattggttctactataactacactctttaaaaatggatattttagtaaaaagaaggactcaatttatactcaccctcaatttgtagccattggtgtcatctctaagacaatttttagtaattgcctagtcagtgaaccttgccatagtccttagttatgtaaatttattgtattttttggaattccttttcattagccataacgctttaataacatatttttaaaattttgactttaacatctatattgtagtgaatatttaaagaacttcctccaagtttaggatacagaaatgggtaaattatgtctactccctcatatttcactattaagatgatggtaaattagcagtccaagagatcatggtcctgaaagtacagagaaaaaaatagaacccagtgacccaacataactaaggagcatatttgagacattgtcattcttggtatttctgaagaagcactgggatggaagggagttgagatcattttgtcagctacagcactaaattttggtcatgaatatcaaagtgattccatctttatgaggagcctgtggagaatggcaacatgctatatgtatacattttagaatggattaattgccatctgcgtaccttttatcaggttattctatttgttcagcatgccccaagatctcttttgtactttacaaatctgcacttcaattcttcttagttcgagactcacttcaacctaccgcatccttagttttctgcacttacttgttgtttctaaaaaagtatacatgatattatacaataaacatctagaattatacatttatgtactatattcacagaaattggacttgcctttaagccctcctttttacatatattcctgttattgtctcactgctaagtaatattactggatggcaaaataaaccaaaaaacacaaattgattttaatgaaaaatatcaatattaaatattagcttaaataacacaaataagtaaatattgaaatagatgggcatgttaggctgggcagctttttgtgggcacaatcatacaatttcaacttcaaattccatcatataacaggatgttctattggtacaatatctccttgttcacatgaggaaattaagtatattgatattcaccgaacaccaatttttaaatgtatttgaaattaattattttaagtgtctctcaactctcccaatagtgcacaaatatgtagttatgctatatactaataattaaataactttggaaactcacaacttcaaaaaaatgttcgctgttgtggaaagtttccgcagtagagaagggaatgtgaatggtatcagtcttagataacaagaaaactactttactttgtttcaactctactcatttgccatccaaatatgatagaagatgctgctcattcctaacaaatatttccagatatcatgcattccttaaaggagatgatactgattgccctctctattttcactcactttcccattacaattagcagcagattcttttaattatccctgcccttcttaaagcagtctcagatatataaaaattaattgcctggaactcacatctttataattttaaccttttcatgcttcacttatttacggtgacatttatctaaaacacttatcaggtgactgcgcatggtagacatctggtttatcagaaaaggcaggagaaaaaataaatgtaggacattaagcttgctatggtgctttgagactttcctagaaatcgttagctcatcaaaacttgttttggcatggcagaaagacatgtcccattaaaaggatattaatgcaagatcaccattgtcattaaaccatcataccatatattacacatttatgctgaaaatgggttcaaactttttattcccttatcctttaattattagaagaaactttgcagattatagccagataatttaaaataataaaatcaatgtcacttacaaggtcacaggatttagtaaaaccctgctacccatttccttttaagtaacttcgcattttagaaatgaagactgcctattcatgtggcttctgtgattttgttaaacattaattaacaaaatttctagtttttttttttttttcttctagagcagttcagtggaatgaaagaccttttttatcctatgcctctaaccacaaccgggtgtctctatcttaaaagatatttatcaagtctctgcttcatatttccttctctacaccattacagtcctcagcaagccctgctatctcatgatcgcaaatcttggccctttattgttggtcttctttctttcattgctacatgttagaataaatggtgtaagagaatgcttttatctattcaatttctttctctttggctcctgacccactgtctttgtttcagaataattatcagtgcctatatattaccttcacatatgaggcctttgttcgtttcattctttccatctcaattttctgtacattcgtattctctaaagtcttcatctctgtcaattgttcccttatctccctcaagtggacactgtcggcttttcgtagatgttcctactcaaaagagatcttgcaagccagtattttacattaagtaattgttctatttctcgacttttgctggcctataaatataacacatataaaggtagccattgcaggcacagtaaattatttgtctatgaaatcacaatgtttgccccagtatcttaatacaactctcaaatttatataattttttaatttaaaaatttaaaaataactttgcttaaacaaaggcagtttgttttctaacttatctatgtgtgtatgtatatatacacagaaatgtatatgtatacacacatatatattcataaattattgaaagtttcatgcaaattttttactttgccaatatgccccaaaacttgatatgaaattaattatacgaaggagtacagccttgtctttaattagctagaaaaattctcagcccacttaaataaactgttcccaacttggggagataaatttaaatatcttatcttggcaacgaacttataacccttaaaaacatttgctatggcatctatatattatatttcccttgatgtgaaaaataagaaacatttcagaaaaacccacaattaaagaatatcacctggcatcatgtctaaaaatgtataacagtaaaatagaaaagatttgtggatatgacaacaattctgcttgctttcaaaattattttttgctttgttttttgcaaagcctaattaaattaatatatgaatattgagtctattaatcttctctcttaaaaattcaaagcactattttaaagtaaattatcttaggaatattatctaagaatgaacttcatgtggtaaataccagcataagtcattactaaatgtgtttagggtatacaatggaagcagagtctgctgctaggaaaaattgaccttttgttttacaatttataatttatttagtgcagtatttgaaaatcatatttagatataacaggtgacaagagagctctatactaggaaagataattttagtactaccatctataaaagagactaataaatatgaaatgaagatgctataattaaactgtaactcttgcccatgccagcccaacataactattataaaattgtacataactatcaggctgttaatttgaggtaatattgcaggcactacaaaaaaaattcagtaactcatcaaaactattttcttatgaaggtaataaaagctacaatacctgcccatgtcaattatttaaaggtgttcgaagcaaatttcttaaataatttaatttctggagccagacataacagttgactttgtgctctttgacatttactactacagactgttgctaagtccaggcttcaagaactctcctgcatttattctttttaaatcaatggtacaaattatctaactagctatatgtgacgacagcagtggttctcagtttggttttaacaccacctggaaacctgcaaagtctcaggtttcaccccaggtctaccgaatcagaaacactagggataagccccaacaatcactgttttagtaggatcttcaagtgatttcaatgcaggttaagtctgaaaacactggaaaagaggagagaaaaagagagagagagaggagagatggagacaaattcccagaccatacactgcactagaaatagagtgttaggactttacaacaggttcaaaattttagagatgaattatagctgacatttgaacacaaaggaaaggagcccattagtccagggaacatctctgattataaacaacttcatttcctgcttaggtattattcaaatgtatatttaacagtataatgcttctctacaatcaagtaaagctcaaacaaatttaagatgtctttttttttaatgttgtatgttgatgagatttaaactaatagaggcttagctcaattggtgattaaggtgatgagtctgccctggaggtggaaataaatatttcattagacttgtgatgaattctagataattttgacactactagaatgattttgaaagtctggatgatttttgaccaaatatagacccaaatacaaatattgtgaataaaagtattgctaggatttagaaactttaacaagttacataatgtttaaattcatgatttctgtgggtaatttgtggtcagtgctttggggggcagaatgttaaagagatttctatatgagattatgagtaaaactttgtgacaaacaatttgaaaaaatagttgaaaagaagaattcagtaggtaaagttaaaaaagtagaccttactatgaaaaaaagagtagggatatatagaaaatttagatattacgagttgaatgtgtgcagacttcccaagatctatgaatgctataaggaccactacagttgatagcgtagagaaactaaggcaatatttatgcagtgttttagaaggccacagctccattccattactatctgatgatattttagcaaagctggactctgcagtatccttttttgtttgaagaggaatagtagaaggagcatttgtcactcttatttcaccttcaacttctcattatttcccatacacgctcctgttacaattcttgggaaataattaaaataaacttacagccttttatatgggtaatttaaccatatttactagtgtttaaatgattcaaccactgctaggctgtgtagaaaatacaagtactggtagttgtgtgaaagttagctgagtttagataagaggtggcctgaaaagtcaagtctcactagagcactgagattttaaaactattctctgggaactagctagctagctagctagatagatatagatgtttctcaataacaacaataaagaaaattatttcttcatgtatttattacaataagcaaaatattgactaataaaaacacaagaaaggaaaaatactaacaaaaaacatcctgaatactctatatactaaagtgtaataccaaaataaaaattagacacttagcattttctgtgagataaaatagaccaagcaatgagcctcgcttgatgcttcatacaccaggagagctggaaggatgcacaggttcagtaaaaacatgccaaaattaacatgagaagacatgattttatttacttatttatttattttttagagacagggtctcactctttcacctgggctgggatgcattggcacaatcagagttcactggagcctcaagttcttgggctcaagcctcctgagtaactaagactacaggtgcatgccactatgcccaaataattttaaaaaaatttttaacagaaacggagtctcactaagttgctcaggctggtcttgaactcctggcctcaacccatcctttcatctcggcctccctaagtgctggaattacagtcatgagccatggtgcccggcctaataaatgattttcaataaattatatttaacaaaatggattagaattaaccaaaaaataaaactagtaattcaaagctttaaggagtggatgtaggtatgtatctacgcatggatgtctgttaattttgtttctttttaaatcagagaaaacaaatttgaaaagatgctttgaaagtagctgccttcttattgtaattgttttaccaaatagcaaagtctagttcttcaaaattgtcagaacctgttatttatactccatttattcttatgattgggcaatgtgtggcacatttaaggattattttccagtatatcataaatatattaacaatgtgacactttaaggatctaaggaggactgaaaattttatctgaggaattcgttagtctatcacagaggtagctctttgatacctaagtcatcaccttttatagaacgtaacataaaggttgaagttttcacagaataagtaatactgtgaattttcagatagagtgtaaactcctctgggttggctggcttttctgtccttacagagctgcccattgtggtcaaattgaccacatgagaagttgatgatgcagttatgccatgcatagcaaccgcagcaggccttcctcattccaatgtaaatattcattatatgaagcattatctaagacccttttgccttgaaagagagagtaaaaaattaatcaggagtagagtctctaaaatattcatttccctggttcatggagtcatacaagcttctttatcatctcagcattttagtctagtccaaaagcccaaagactaaataaagtaattgatacatggcatccatgaaaataatacaagtaaaatatggctttatgttgactatgcaaatttcatatgaaagaaattgtttccaagaaacttaactcaataaaatttaaaccataaatatttttcaccaattttattcaataaatacttactgagaacctactgtttcctggccttgttatacttgtttggaattcatttgagaagtcaaccatataatacttcatgacattggtctaggcacaggtttttttggataaaaacttaaaagcacaaacagtgaaagaaaatttaaaggcatcttaacagaaaaaaaaaacaatcagcagagtaaagagacaacctaagaacaggaaaaaatatttccaaaccatgtatcagataagatattaatatccaaaatatataaggaactcaaacaactcaatagcaagaaaacaaataacctgattaaacaatgggcaaaaaaatctgaatagatatttctcaaaagaagacatcaaaatagccaacagatatatgaaaaatatatttaacattactaatcttctgggaaatgcacataaaaaccacaatatcatctcatcccaattcgaatattatcaaatagacaaaaaataacaaataatggcggggatgtaggaaaagggaaactctattacactgtttgtgggaatgtaaattagtacagtgtttatgaaaaacaatatggaggttcctctaaaaattaacaatagaactaccatatgatccagtcattctactactgggtacacatccaaaggaaatgaaatcagtatgtcttagagatatccacttccatgtttattgcagcactattcacaatagccaagatatgaaccaacctaattgttcatcaactgataaatgaataaagaaaatgtggtatatatacacaatggaataccattcagccataaaaaaataaatcctgttattcaaggcaacataaaagaacctgaaatgaaataagccaggcacagaaagacaaataccacttgatctcactcacatggaatttaaaagagctgatttcatagtagagagtaaaacagcagttgctagagactgagaagtagagtgagaaggaaagatggagagagactggtcaaaaaattcaaagttacatttgcacaggatgaataagttctggtgctttattgcacattagagtgattatggtaaaaagtattgtattgtatgtttcaaaatacttagaagaaagaattttgaatgtttttaccacaaacaaaatgataactgtgtgagatgatggatatgctgtataccctgaaaagattattacataatgtatagatgtaggaaacatcacactataccccataaatatgcataattattatgtgtcaaaaacaaaatttttaaaagttaatcactctctaatgaaagtatcttttggctcctagacacctgattttttttttccattttgccaaaagtcaaattctacatactaaaacaaagaatttattgtatcctttcaaaacaatatattttaatagcatctatagattcatcaagcaatgatgtaatgaacacaataaaagcttgagtaatctaactactttacaatagaaattgtaatgtttttgtttttgttttgtacgttcaatcctctgaaaaacatgactcttcctgatttttttttcttttttgaaaggagtcttgctctattgctcagtctggagtgcggtagcacgatctcagctcactgcaacctccgcctcctgagttcaagcaattcttcctgcctcagcctccagagtagcttggattacaagcaccaccaccttgccaggctaatttttgtatttttttagtagagacggggttttgccatgttggccaggctggtgttgaactcctgacctctggtgatccacccacctcccaaagtgctgggattataggcgtgagccactgtgactggccaatattttaaatgttaatgtctatcattatattttctcattctcttttgctgtacttattaaatggtctattatcctagaaaataggtaagaagatgaaaaacaaaccagtagcataagatctgaaactgattgataagttatacattaaatatatgatttgatttgcttaagacctctagtatttctattccttttttaatttttagagtttcaaaatttcattataattttggttaaatttactgacttctcaaaacttctaaagtttaatgaactatatacccatcagtgtattaagcagaaaaatagtttagaaaattgtcaccaaagtatgcactttgtatctgaaaacaataatgaggcttctctctgaccattaatcttgggcttttatgacacacaacaattttactattttgtttatttgcttggtttatagtacatgaagacagaaatattatagtttctgtttcatgtagcacatttctttaaaaatgtgttttaaaatgcctttttttctgcaaaactgaattccagtacctaatttctctgttactttggtgggccaggagtcctgccgagaagaatattgatgtctctctcatcagaggtttttgataatgtcaggtttccaatatatcctaggggtatatttttacctttttaaaacaaaatttatttttgcctatttttttcgttctaaggctctttatgacaggactatttaaagcactgaggacaagacaagatgtttatatatacttcctgctgtttaatattcatgcaattctgacaagattaatatactaatttctctgtcattagtttcattaacagatattaattatatctgaatctaaatgccaaatgaatagacagttgggattcaattctatttaagataatcgaagttctctttacaatcatgattggggtggcatacataccatctattctggttagagatggactctggacgctagataaaacacttgggattaaaacacttatcctagaacttatcattataggcacttcacataatgggggaaactgaatatttacaataaccttttggaatagttgatgatgatgatgatgggaaagagagagagaaaggccaggtgtggtggctcatgcctgtaatctcagcactttgggaggctgaggcaggtggatcatgaggtcaggagttcaacaccaacctggccaacatagtgaaaccccatctctaccaaaaacacaaaaattagccaggcatggtggagtgtctgtagtctcagctacttgggaggctgaggcaggagaatcatttgaacccaggagggagaggttgtggtaagccgagattgtgccactgcactccagcttgggcatcagagtgagactccatctctaaataaatacataaataagagagagagagaggagagagaaacatccttttttctggtaaaatttagagactagattgtccaatgaagatggctgaataggaacagctccggtctgcagctcccagtgtgactgacgcagaagatgggtgatttctgcatttccaactgaggtactggttcatctcactggttgaatagtgggtgcagcccacggagggcgagccacagcagggtggggtgtcacctcacccaggaagcacaaggggtcaagggatttccctttcctagccaagggaagatgtgacatactgtacctggaaaaatgggacactcccgcccaaatactgtgcttttcccaaggtcttcgcaactggcagacaaagagattctctcctgtgcctggctcgtcaggtcccacacccacagagccttgcacactgctagtgcagcagtctgagattgaactgcggggcagcagcctggctgggggaggtgcgtctgccattgctgaggcttgagtaggtaaacaaagcagccagggagctcgaactgggcagagcccaccacagctcagcaaggcctactgcctctatagactccacatatttgggcagggcatagctgaacaaaaagcagcaggcaacttctgcagacttaaaaatccctgtctgacgctctgaagagagcagttgttctcccagcatggcatttgggatctgagaactaatagactgcctcctcaagtgggtccctgacccccgtttagcctaactgggagacacctcccagtacgggctgacagacacctcatataggcaggtgcccctctgggatgaagcttccagaggaaggatcaggcagcaatatttgctgttctgcagcctccactggtgatacctaggcaaacagggtctggagtggaactccagcaaactccaacagacctgcagctgagggacctgaatgttagaaataaaactaacaaaggaatagcatcaacatcaacaaagcagaaaggaatagcatcaacatcaacaaaaaggacatttataccaaaaccccatctgtgggtcaccaacatcaaagaccaaaggtagataaaaccacgaagatggggagaaaacagagcagaaaagctgaaaattctaaaaaccagagtgcctcttctcctccaaaggaatgcagctcctcaccagcaacagagcaaagctggatggagaatgactttgatgagttgacagaagtaggcttcagaaggtcagtaataacaaacgtctccaagctaaaggagcaagtttgaacccattgcaaggaagctaaaatccttgaaaaatggttagacgaatgcctaaccagaataaacagtgaagggagaccttaaatgaactgatggagctgaaaaccatggcacaagaactttgtgatgcatacacaagcttcaatggccaattcgatcaagtgaaagaaagggtatcagtgattggagatcaaattaatgaaataaagtgagaagagaaggttagagaaaaaggagtaaaaagaaacaaacaaagcctccaagaaatataggactatgtgaaaagaccaaatctacatttgattggtgtacctgaaagtgatggggagaatggaaccaagttggaaaacactattcaggatattatccaggagaacctccccaaactagcaatgcaggccaacattcaaattcaggaaatacagagaacaccacagacactccttgagaagagcatccccaaggcacaaaattgtcagattcaccaaggttgtaatgaaggaaaaagtgttaagggcagccagagagaaaggtcgagttacccacaaagggaagccaatcagactaacagtgggtctctcagcagaaaccctgcaagccagaacagattgggggccaatattcaacgttcttaaagaaaagaattttcaacccagaatttcatatctagtcaaactaagcttcctaagtgaaggggaaataaaatcctttatggacaagcaaatgctgagatattttgtcaccaccaggcctgccttacaagagcttctgaaggaagcagtaaagatggaaagaaacaaccaataccagccacctcaaaaacatgccaaattgtaaagaccatggatgctatgaagaaactgcatcagttaactggcaaaataaccagcgaacatcataatgacaggatcaaattcacacataaaaatattaacctaaaatgtaaatgggctaaatgtcctaattaaaagatacagactggcaaatcggataaagggtcaagatcaatcagtgtgctgtattcaagagacacatctcacatacaaagacgaatataggctcaaaataaagggatggaggaagatctaccaaacaaatggaaagctaaaaaaagcaggggttgcaatcttagtctctgataaaacagattttaaaccaacaaagatcagaagagacaaagaaggccattacataatggttaaagggatcaattcaacaagaagagctaactatcctaaatatatatgcacctaatacaggaacacccagattcataaagcaagtccttagagacctacaaagagacttagactcccacacaataataatgggagactttaacgcctcactgtcaatattagacagatcaacaagacagaaggttaacaaggatatccaggacttgaactcattcatttgaactcgcacttataaaattgaccacataattggaagtaaagcactcctcagtaaatgtgaaagaacagaaatcacaacaaattgtctctcagaccacagtgcaatcaaactagaactcaggattaagaaactcactcaaaaatgcacaactacaaggaaactgaaaaacctgctcctgaatgactactgggtaaataacaaaatgaaagcagaaataaagatgttctttgaaaccagtgagagaaaagacacaacattccagaatctctgggacacatttaaagcaatgtgtagagggaaatttatagcactaaatgcccacaagagaaagcaggaaagatctaaaatcaataccctaatatcacagctgaaagaactagagaagcaagagcaaacaaattcaaaagctagcagaaggcaagaaataagtaatatcagagcagaactgaaggagatagggacacaaaaaaccctccaaaaatcagtgaatccaggagctggttttttgaaaggaccaacaaaattgatagacctttagaagactaataaagaggaaaagagagaagaatcaaacagacacaataaaaaatgacaaagtggatatcaccacagatcccacagaaacacaaactaccaccagagaatagtataaatacctctatgcaaataaaccggaaaatctagaagaaatgtataaattcctggacacatatgccctcccaagactaaaccaggaagaagttgaatctctgaatagaccaataacaggatctgaaattgaggcaataattaatagcctatcaaccaaaaaaggtccagggccagacggattcacagcctaattataccagaggtacgaagaggacttggaaccattccttctgaaactattccaattaatagaaaaagagggaatcctccctaactcattttacgaggccagcatcatcctgataccaaagcctggcagagacacaacaaaaacagagaattttaaaccaatatccctgatgaacattgatgcaaaaatcctcaataaaatactggcaaaccaaatccagcagcacaagaaaaagcttatccaccacaatcaagctggcttcattcctgggatgcaaggctggttcaacatacacaaataaataaatgtaatccatcacataaacagaaccaatgacaaaaaccacatgattatctcaatagatgcagaaaagaccttcaacaaaattcaatggcccttcatgctaaaaactctcaataaatcaggtattgatgggatgtatctcaaaataataagaggtatttatgacaaacccacagccaatatcatactggatgggcaaaaaatggaagcattccttttgaaaactggaacaagacagggatgtcctctctcaccactccttttcaacatagtgttggaagttctggtcaggcaaatcaggcaagagaaagaaataaaggacattcaattaggaaaagaagaagttaaattgtccctgtttgcagatgacatgattgcatatttagaaagccccattgtctcagcccaaaaattccttaatctgataggcaaattcagcaaagtctcagatacaaaatcaatgtgcaaaaatcacaagcattcctatatgtcaataacagacagagagccaaatcatgagtgaactcccattcacaattgctacaaggagaataaaatacctaggaatccaacatacaagggatgtgagggaccttttcaaggagaactacaaaccactgctcaatgatataaaagacacaaaaatatggaagaaaattccatgctcatagataggaagaatcaatattgtgaaaacggccatactgcccaaggtaatttatagattcaatgccatccccatcaagctaccaatgactttcttcacagaattggaaaaaaactactttaaagttcaagtggaaataaaaaagagcccgcattgccaagacaatcctaagcaaaaaagaacaaagctggaggcatcatgtaacctgacttcaaactataccacaaagctacagtaaccaaaactgcatggtactggtacaaaaacagatatatagaccaatggaacaggaaactgggctcagaaataacaccacacatctgcaaccatctgatctttgacaaacctgacaaaaacaagcaatggggaaacgattccctatttaataaatggtgctaggaaaactggctagccacatgtagaaggctgaaactggatcccttccttacaccttatacaaaaattaattcaagatggattaaagacttaaatgttagacctaaaatcataaaaacctgagaggaaaacctaggcaataccattcaggacataggcataggcaaacacttcatgactaagacaccaaaagcaatggcactaaaagccaaaatagacaaatgggattgaattaaactaaagagcttctgcacagcaaaagaaactaccatcagagtgaacaggcaacctacagaatgggagacaatttttgcaatctacccatctgacaaagggctaatatccagaatctacaaagaactcaaacaaatttacaagacaaaaacaaaaaaacccattaaaaagtggtcaaaggctatgaacagattcttctcaaaagaagacatttatgcagccaacagacacatgaaaaaatgctcatcatcactggtcaccagagaaatgcaaatcaaaaccacaatgagataccatctcacaccagttagaatgacaatcattaaaaagtcgggaaacaacagatgctggagaggatatgaagaaataggcacacttttacactgttggtgggagtttaaattatttcaaccagtgtggaagacattgtggcgatttcttaaggatctaggactagaaataccatttgacccagcaatcccattactggatatatacccaaaggattataaatcatgctactataaagacacatgcacacgtatgtttattgcagcactattcacagtagcaaagacttggaaccaacccaaatgtccaacaatgatagactggataaagaaaatatggcacatatacaccatggaatactgtgcagccataaaaaaggatgagttaatgttctttgcagggacatggatgaagctggaaaccattattctcagcaaattatcacaaggacagaaatccaaacaccacatgttctcatagttgggaatcgaacaatgagaacacttggacacatggcagggaacatcacacactggggcctgtcagagggtggggggctggggaagggatagcattgggagaattacctaatgtaaatgacgagttaatgggtgcagcaaacaaacatgccacgtgtatacctatgtattcaatctgcacgttgtacacatgtaccctagaacttaaagtataaaaacagaaattagagacattttctgcctcaaatagatataacgcatgttactaatttattaagcagaactcatcaagatgccaaaagataaaaatctactaaatcaatgatatagttaccaaaagtcaccctgtataattcatggatttaggacatgattaagtacatacttagcataattgaaaggtgtccacctgaaagcaacagtaatcacacacacacagacacacacatgagtcaatctgtcaaaattacacaccaagcttttaattaattcatcaattatacatcagtgtttctggattattagaattattttgacacattaaaaagtaaacactcctaatttaactcatattatttttgataaaggcattgtggtatgccatcatttcataatatacactgaaacatattcaaataaaatgaaactatatctgagacatgcttcaagtaatttgggaagaaaggatgggagaagatatagttggtgcaagtatgcctatgaattggtaattgttgaaactgggtgataaattcatagtgtggtcatgatggtcttctgtttttttgtatatatttgaaaattgctatataaacatttttgaaatacaaattcttaggccacattccagtcatattgaattagaataccctggagttgaagcttcaagtgagaggtgaagccagctgagcttctgggccggatggggatttggagaacttttgtgtctagctaaaggattgtaaatgcaccaatcagcactctgtaaaatcacaccaatcagcatgctgcaaaatggaccaataagtgctctgtaaaatggaccaatcaattctctgtaaaatggaccaatcagcactctgtaaaatgggccaatcagcaggatgtgggcggggccaaataagggaataaaagctggccaccagagccagcagcgtcaacctgctcggatccccttccatgctgtggaagttttgttctttggctctttgcaataaatcttgctggtgctcactcttagggtccacaccacctttaagagctgtaacactcactgagaaggttcatggcttcactcctgaagtcagtgagactacaaacccactggaaagaagaaactctggacgtatctgaacatccaaatgaagaaactccggacataccatctttaagacctgtaacattcactgtgaagctccgcgcttcattcttgaagtcagcaagaccaagaacccagtggaaggaacaaattccagacacatttggcaaccacgaagggataatcaccaagtagtgagtaccatcggacccctttcacttgcaattctgttctatttttccttagaattcaggatctaattatcgggcacctgtcggtcagttaaaagtggttggtggccgggcgcggtggctcacgcctgtaatcccagcactttgggaggccgaggcgggcggatcacgaggtcaggagatcgagaccatcccggctaaaatggtgaaaccccgtctctactaaaaaatacaaaaaattagccgggcgtagtggcgggcgcctgtggtcccagctacttgggaggctgaggcaggagaatggcgtgaacccgggaggcggagcttgcagggagccgagatcccgccactgcactccagcctgggcgacagagcgagactccgtctcaaaaaaaaaaaaaaaaaaaaaaaaagtggttggcacggccactggaataaaaacacgggtgtcaggcattctaggaaagggctctcttacaacccctgactcttcggggttggaagcattgatttgcctggaaccagcttccacttttcttgtacttctgggctgagccgagggtagacagagtggaaagccattcagctccagggtcccaacaacaagttggttgaccctgaggctgagcggaactctcaaagacatgtcgcctaagggagactcgcccatctctcctatctatcctgacccttgcctcctgggtcctcatgcctgtcagacaaacttcctcttgcctctcttctctgaggctagtctcgcttctaaaaaccactccctgtctctggtgcttttctagtttctcgtataagaatgatttctagcataaactttaggactctattcccttctttaggcacccaggctcaccaatcagaaagacataatttttgcccaaagccccatcggaggagccagactatcttatctggaattttaggacccctcctcaggctagcaggcctaacaaaggctattcctgaagctaggatatggggagcctcagaaattgtatccttgctattcatataagtgaggacaaaaggcatcactcttccaaccctggagatctcttccctctctcagggtatggccctccacttcatttttggggcataacatctttatagggcatggataaagtcccaatattaacaggagaatgcttaggactctaacaggttttctagaatgcattggtaagggccaataatccgaccttcctcattcctccttgtggtctaggaggaaaactagtgtttctgctgctgtgttggtgagcgcaactattcccatcagcagggtccagggactgttgtgggtgcttgggcaagaggggtttctgctgccacgtcagtgagtgtaactattctgatcagcagggtccaggggccactgtgggttcttgggcagggggagaaacaaacaaaacaaaaccgcaggtggttttgtctttcagatgggaaacactcaggcatcaatgggctcacccttgaaatgcatcctaagccattgggaccaatttgacccgcaaaccctgaaagaaaggcagctcatttttttctgcactatggctcggccacaatattatctctctgttggggaaaaatggccacccgagggaagtataagttacaatactatcctgcagcttgactttttctgtaagagggaaggcaaatggagtgaaataccttatgtccaagctttcttttcattgaaggagaatccacaactatgcaaagcttgcaatttacatcccacaggaggacctctcagcttacctccatatcctagcctccctatagctccccttcctgttagtgataaacctcctctaatctcccttgcccagagggaaataagaaaagaaatatccaaaggaccacaaaatcccccaggctattggttctgtcccctttaagtagggggaggggaatttggcccaacgtgggtacatgtccccttctccctctccgatttaaagcagatcaaggcagacctggggaacttttcagatgatcctgataggtatataggtgtcctacagggtctagggcaagcctttgatcttattggaaagatgtcatgctattgttagatcaaaccctggcctttaatgaaaagaatgtggctttagctgcagcctgagagtttggagatacctgatagcttaatcaagtaaatgatagaatgacagctgaagaaagggacaaattccctactggtcagcaagccgtgcccagtatggatccccactgggacttcaactcagatcctggggactggagttgtaaacatctgttgacctgtgttctagaaggactaaggagaattaggaaaaagcccatgaattattcaatgatgtccaccataactcatggaaaggaagaaaatcctgccttcctcgagcagctatgggaggccttaaggaaatacactccactgtcaactgactcactagagggtctattgatcctaaaagataagtttattacccgatcagccacagatatcaaaagaaagctccaaaagtgagccctaggccctgaataaaatctggaggcattattaaacctggcaaccttggtgttctataatagggaccaagaggaaccggcccaaaaggaaaagcgagatcagagaaagactgcagccttagtcatggccctcagacaaacctaccttgctggttcagagaggacagaaaatggagcaggccaatcacccagtggggcttgttaccagtgtggcttgcaaggacaccttaaaaaaggttgtccaatgagaaacaagctgccccctcatccatgtccactgtgcagaggcaatcactggaaggcacactgccccagagggcaaaggttctctgggccagaagcccccaaccagatgatccaacaacaggactgagggtgcctggggcaagtgccagctcatgtcatcaccctcactgaaccccaggtacgtttaactattgatgaccaggaaattgacttcctcctggacactggcatagccttctcagtgttaatctcctgtcccagatgactgtcctcaaggtccgttaccatccaaggaatcctgggagagcctgtaaccaggtatttctcccacctcctctgttgtaattggaagactttgctacagatagtaagtatgcttatctaatcctacatgcccatgctgcaatatggaaagaaagggagttcctaacctctgggggaacccccattaaataccacaaggaaatcatgcagttattgcatgcagtgcaaaaacccaaggaagtggcagtcttatactgccgaagccatcaaaaaggggaaggagaggggagaacagcagcataagctgctgacagaggcagggaaagaccagcagaaaggaaagagagaaagagacagaaagtcagagaaagaggaagaaacagagagacaaagaggaggagacagagagaggaagagacagagacaaagaagaagtcaaagagtgagagagaggaagagacagagagacagagagtcaaagaagtaaagagaggaagagacaaagagggagtcagaaagagaaagacagacaaagaagagagagacagacaagaagtcaaagagagagaaagagggagatagaagtagtaaagaaaaaacagtgtaccctattcctttaaaagccagggtaaatttaaaatgtataattgataattaagggtcttctctgtaaccctataacactccaataccaccttgttgtcagtgtaaacaagggtgtagcccaaaagcactgaggctactgacaacccatagccttcctatcaaaaatccttaacccagcaggtttccaaacagggatctaaatcttaatgaattaccatacaaaggtctgaccagatctaggaggaactcccttcaggacaggaggatagatggttcctcccaggcagttaagggaaaaagacacaatgggtgttcagcaagtgataaggaaactcttgtagaagcagagttaggaaaatttcccagtgattggtctgctcaaacgtgcgagttgtttgcactcagccaaatcttaaagtacttacagaatcaggaaggagctatctataccaattctaagttaatatggactgaacgaggttttcattaatagtaaagaaaaattataatcccaaacttacaaggctttcaactaaagtttgctaaaagttaacagtgtaatatgtattatcctgctaccacacactcttaaaggaattctcagacagtttgcaagaaataacgaaatctatccttactctacaatccgaagtagactctttggcagcagagactctcctaaactgctgaggcctagacctcctcactactgagaaaggaggactctgcaccttcttaggggaagagtgttgtttttaccctaaccagtcagggatagtaagagatgctgccaggcatttacaggaaaaggcttctgaaatcaaacaatgcctttcaaactcttataccaacctctggagttgggtgacatggcttctccactttctaggtccggtagcagccattttgcaattactcacctttgggccctgtatttttaacctccttgtcaaatttgtttcctctaggatcaaggccatcaagctatagatagtcttacaaatggaaccccaaatgaactcaactaacaacttctaccgaggatccctggactgacccactggccctttcactggccgaaagagttcccctctggaggacactacagctgcagggccccttcttcgcccctatccggcaggaagtagctagagtggtcatcgcccaattcctaacagaagttggggtgtcctgtttagaggagggattgagaggtgaagccagctgagcttctgggtcggatgggggcttggagaacttttgtgtctagctaaaggattgtaaattcaccaatcagcgctctgtgtctagctaaaggattgtaaacacaccaatcagcacttggtaaaatcgcaccaatcagcactctgtgtctagctaaaggattgtaaatgcactaatcagcgctctgtaaaatggaccaatcagcaggatgtggatggggccaaataagggaataaaagctggccacctgagctggcagcggcaacctgtttgggtccccttgcacactgtggaagctctgttttttcactcctcacaataaatcttgctgctgctcactctttgggtctgtaccacctttaagagctgtaacactcactgagaaggtatgtggcttcactcctgaagtcagcgagaccacgaacccaccggaaggaagaaactgcagacacatctgaacatccaaaggaagaaactccagacagaccatctttaagagctgtaacactcactgtgaaggtctgtggcttcattcttgaagtcagtgaaaccaagaacccactggaaggaacaaattctggacacacaagttcctaggcttcatccaaaacattaaatcagactctttgaggtagagtaagacacatatttacaagctagttatgcaagttatgatccaggtaaaacactaatcgattgtatccaaaatataagtcttctatcattctgttgtacaaaatgaatgaaatctctaaaatatttctttaggaaccaacacaaagatattccattgtactaagtttgttttctggaaaacaaactctcaggtaaatttgcatgtatgatgtttataagggaattaacttttaattaattatgagaggggagttgaaaagaagtacaatccaggcagagacaacaagcccacagaatatcttaaaaggaatggcttcctgagttctcatgcactgaggctagatgactgggccttgatataactctctccagccccactgaccagccatttgatactatgcttccaggtgatgaatttgtgtgaaatggttgtctttaaatgaagggcaattcctcaggagagactcaagtaattttcactagccagcaacattcctagcatgtggggatgaaggtaattgagaggggagaattcattgcctcaatggttacacatgtaacacttcatagcacccaccacatctataagagctaatatattttttctgggaatttctttactgtcttttctcatttatctttatatatcccttacaagtcaacaaagaaatactgcagtggtggttatagtgactacactgtggttgctggctgtttttttagtgtttaaattaaataatattacccttaggaataaaatgtaaaaccatttttttaaaattcccatcaaaatcaacataacatactgtttgtgttagtaacagaaatatatttaactgcatagataataatgaatagcagtctggattttcaaataaattatttcaagatgatatttactaggttagatacatgtaccctaactcccacccattcacttcctagaaatgtgttttaggtgatgttatttaggtggtaaaatcaggtcaataactcctactgaatccttagatattatgtgttgtacagggaaaaggtagtataggtaaaacttgtgtgagacacactttgttgttttagactagactgtaagttccagctgtgtctgaatgtttgtgtttccccaaaatacatatgctgaaatcctaaccctcaagatggcggtattagaaggttgggaggtgattaggtcatgaggggtgttaacaatagttcccttaataaatgaaaggcctaagagagacccgtcgcacattccactatttgaggacaccactaactgtgagccaaaagcaggacctcctcagacatcgaatctactggtgcctttatcttagaatgccaacctccagaactgtcagaaataaatttttagttttataaatgcctagtttgtggtattttttatggcagtcgatcagactaaaacaaatgtttactctgttgtgatcagatagtttatataacttacctaacacataataggtactctagtaggtcgctcctcctttgacctcagacctttccatttgagaaattttacaactttatttcaaaatgcattccatctactttacaaagtaaaaatacaaaggcctcttatcatgatgtgactattaggctttacaagcctatatcaaagtgtttcatgtaccccataaatatatacacccacacatattaaaaatttaaaaagtgaatgttatacacctccccacttcctttacaaaacttagctcaattccatctggataataagaaaaataggaaactttattgaataatgagtcacttctatgtgtaatttccactgctagtatgagccttcagaagggactggctttaagaattggtacagttcttgactgagaggaacttccaccacctagcagatggggcaatagattacaagggcaattatcactcagagaattgctgataaggtcaaattactgctgtcactttattcttaatctctgtatgcatttttttttctaaaagaaaactgcatatacaattctacagaccaaaaatattgcaaaaaatatgagtttatatgtcctaagagggttccccaattatcacaattgtttcaaatggaaacaatttcatatcccatatgtacatatatataaaaatatatttatgtatgtgtatatatatgcatatatatgcacacacatacacatttctctgcagatgttagtatgtggaaatgtattgctatataatagggacaataattagaactcaaaatctagagtaatgcaactgaaagtcatatcatgcatgtattacaagtaagatactctgcaatgtatacaagagaatgtaatttttaaggaccaaatgtgtgttattaatcaggtatacactctgtaaacactacgtggtataaaattgcttctcaacacaggaaatatttataacctaagtatacagtccaagaagtactttatttctgacacttcataccaaagcaaccagactgacaaataagcattctgagtaaaagcagtgttttaaataacttttgaacccaatgcatgcatgcaaggctgataaatgcaaacccttttacataatactcaaatcatattaaagagatgcttcttgacagagatacacttaaaccattctacatttctcctttttgttctcctgtgtgaaaatgtcaccttaaaagcaattttttaagaaacaagtgctgtttcatttcatgtcttcagatacattgtctgcccatgttttagcgattaggaatttagaggtttttggatgtttattacaactctttgacttatcagtataaatatttatcataccaatcatatttattctttgattatcttgacatggcaaggttttttcaattttatttaaaagagccagctgttttgtatcttatttactcacccatatcattgtttcccgttaaattaacactggcataagccagctgcaagttgcaaggaaatcgcactgaaaacagagctactataaattgtattcgcctctatataccaacaaaaacaaataaaacttttttattaatctctatgactttgttgttgtttaaagcaaatctacattaggaagagttgtcaggaaatttgggaagttatattgtttcctgaaacctgatattgattgatgagagtataccaatgattgcaagttctgagaaaagagttttacacaaaatgaacagcaaaagcttgggcatgagaacaaacttagaatgtccaagggataggaaaaaacgtcctggcagcagagcagcagataggcaggaattgaatcatgtgtactttggtaagccatacacgggcattgagaattttattcttaccacagttggaagtcactggaatattttaagcaagagagtaacttgaactgatttatgcttttaaaagattaccctgattggctgtgtgaaaaataagcgatagggagcaaaagtagaaacagggacaggagatgacagtggcttatgtataagatttcttctaaggatcttgaaagcatcatgaactaacatcacttgggaagtagataaattcattgctgtgtccatagtctgtttatttccctttttttttgtatgtatttgcagaatatgttagtaaacaaagtgaaattcaaggaaatcactattagggctgcctacaaatcaagtcggtttagagctattatagttgagtagtaatattctttcagaaaaaatcttaatcataaagcccaacacttatactatggcttcttaaaagtgaagctgcaaaactgcttgtgaacaatcttacagctatttttataactttttaaagtgttatgtacataatttcttttctgatgacctcattgaattctaaaccatcttttagccacacataagccccaacagttaaaactattaaaatgcattagcatgtccttcattatttgttttaatcaagaagaactgaaataaggaatatgtaacataaatttagttttgctaacgaatacatcagagagaaatatatctccttagagaggaatatattttatctaggtattttttttgaacagtgaagcactttttaaaaaagtaatactgtacacagaattccaaaatataaaacagacaaataaattaaggtacctttatacaaagtcattctatgcagctattataaaaagtaaaatatatatgcattgatagggaagttttaatttattccatataagtaaatattaattgagcattttatatttgagccatcatcctaacagtttgtgataagatagcaaatgatatagggaaagtctctgttttcagatgtttttatattttgaaggaagtagacaaatattaatcaattaagtgaatatgcaagaaatttccacatagtaaactaatctgcagaaaacaaagtcatgaattatctaattcttgagggaacctattacagactgtgttattagggaagccttttttaaggaggcatatatgagggaaaatctaaataactaaaggagccagccataggaaaatagcagaagagaatattctggaaaaaaaaaatggcacacaaagacatttcacctcagccaaagaatatgggatgataaaggacagaaaaaagaccaggaagcaggaggaagagaggtagtagaagcagatgggatgaggcaaatgagacaagatagtgtaggaccttacaggtcatggtagaggaagacacttagatatgattacttaataagaagctatcatagcactgaagcatggaagagatgtgatctaatgtctatttttcaatgccattctgaccagatttcgggcaaacctggtagacacccatagtaagactccaggaaaaaaaaaatttgatggtttgattatatatttgctttaaacatttggcttttcagctgccttgcatccatttccctttaacaatttatctgtttttaaattaatgaccttttctattagacacactttcatcaggggccctgtattgattggtatcttccagagaaacagaaccaataaaatgtgtgcgtatgtatgtatatgtgtatgtttctcagagagagagagcgagagaaagataatttaaggaactggctcatgtgattgtggagttgggcaagttcaaaatctgtaggacaggccagcaggctggagacatagggaggaattgtcatagtttgtgtccaaaaatagtttgccagaatcctcagttttttgagggaggtcagtctttttacttaaagccttcaactgactggatgcagccaaccgatatcatagatccaaagtccagtgatttaatgttaatatcatctgaaagcataccttcacatcaatatctagatatatttgacagatatctgggtaccatgtcttagccaagttaatgcataaaattaactatcccaggctccattccctctggtcaaagggcaagcatgtgattcaagctaggtcaatcagttgctctctccctcaaatttgcactgggttaaaaagacaaagaattacatcctgtctatacagtcatgccaaatcacatgatccatctccaacccctaaaacacataggtatggcttttgttctcaaccttcagctcctaattcctttaaaaagttaccagtatattctgtgaggccacagtgaatcttctaatagtttacttttatgtaggccagagtcatttggcttgtttgaaattaaatatatatatatatacatatatatatatatgtgtgtgtgtgtatatatatatatatatatatatatatatatatatatatacatatatatatatgtgtgtgtgtgtatatatatatatatatatatatatatatatatatatatatatataaaattgcttcagtcaggctccaggtacttggaaagacattcatcaaattaataatggttatcctggggactgggctttgaggattgaggatttctgatttttaatatgtgtctaatctttttaaatgtttcagtataatttataattagcagccaattattttataattaaagtaaatcctgaaaaactttctacattagtgtgtggaaaaacagcacaattgccaaatttatagggcgaagaagtcctatgtttacctagaggggaaactctgaaccaccacagcccaacaggaggctctgtgggacaatttggaaaacattaccataatctattgtttttatatttatttagaaaagaaacaaagggagcaagatacctccccgtctgacatttaaaatttgattcactgatatattttggctcacagtatcaccttgtggcatttggcatctgctgctccccctccccaaagtcataatatactgcataattaattcagcacaagtagtgacaatgccaactctgtttatttaaaaagatacctcgactgttcttttgaataaatagattgcattcctttaaaaatccaaaataatactgaattaattagaagtagtgcaatcagaataaattaggtcctatctacatacaactcagttttaaagctagaaattcaaattaataactaatttgaattagctacttcttcccatgtgtctctgagtaaacaccaagcagacgaaaaatttccattgccaataataatagtaacaatagcaaatattgttaaactcttactatttgctggtaactagttaagcatgcttcataaatcttcttttatagtagtcatgaaaaccacatatctgagctattaccttcattttgtggatgacaagttcaaactgagttttagagacagtaagcaacatacccaacatcacacaagatttaaattcagactctgagtgcttacaaactatcttacgctgtgatggtaaacatctttgcaaattttccctcataattgagtaagccatcagagtttcagaataaatgtgtaggaaaacttataaacatcagggacaagcttaaggacttgacatcttttacttttgtgtgtgtttcatagaaaaaaatagctcaaaggttaatttaaagtaatactttgaacaaactccttaacaagaagagttagacttcatacttgttattcagcagaatagtgactttgttcatacaactaaactaacgaactcaattcctcctttcgactgtttcttttttttgcctccttaatagttattttatacctgtttcttattatttatttattccactaaaaatttcaatgtcttcacattatctataattggtgctatggtatattacagttgaatatagttgaacctgttcaaatacattttgaccaatgataaggagaaccaaggattcctttgctttcatattacttcacacatgactttttaaaaaatttactttaatttctgggttacatgtgcagaacgtgcaggtttgtaacataggtatacacatgccatggtggtttgctgcacccatcaacccataatctacattaggtatttctcctaatgctatccctcccctattccccgacccccagacaggcccccatgtcacacaccacttttagaatcacaatacaatttcacattcaggacaatacttgctgaattttagtttgtgtttgtgtgcgattgttgatgggaagaacaaaatggcagtcacatcatatgttgactctagatgtgttatttatcatttgtttcttcaaaatattttgacaaacgatcttcgcattaaaaggctgtgggcagtttgggagctaccacctgtttccctcttcattgatcactttgctggccccaaaacatatccacagaaaaaattttgaaagtgattggccaagggactcagtgaggatatactttaatatttagaacactattaaaaacaaaaggagacattattaacaatatgctgggacaagaattataacctgggactttctatggcaaatgggatatatgattacttgatctagactgtataaaataaataatatatttggataatctacaattacaataagtatttatacacacaaacatatatatacgtacatacacacacacacacacacacacacacacacacacacttcacatatgtacctttacaaccaatatactttaattgagactgagaggacaagagccatgattattcatatttatattcaatgacttattacataataaacatattttgaaaatttgatgagttaattcaattcaaaatatgcaaaaaatatcaggctgggcacggtggctcatgcctataatcccagaactttgggaggccaaggcaggtagatcatctgaggtcaggagttcgagatcagcctgaccaacatggtgaaaccctgtctcaactgaaaaaatacaaaaattagccgggtgtggtggcacatgctggtagtctcagctacttgggaggctgagagaggagaatcacttgaacacaggaggcataggttgcagtgagccaagattgtgtcactgcactgccttggtgacaaagtaagactccatctcaaaaaaagaaaaaaaaaatactgtatatctgctatgtgaagccaatgggtttcaagttaggatataatgacaaagaagtttaaagaattcatagcgtagtgaaagaaaaacattcatagtaaatgaacacactgtaatgaagagtttaatatttatagtaggaataaatgggatcacaaagagaaactattagttttgaggatctatcattttaggttaactgatatgaaccttcaataacaaatatgtgcttaacatatgaaacagagagaaagtagggtaattctcagagttgttcagggtcatatgtgatgttctgtgtgcctagacaagttgtactatgtgtgttagaagagatgagactggaaagtggtcagatataagttactttgaatgataagataaaagccgtggaattcatttggtgtatgatggaaaacactgaacctttttaaacaccaaaaaatcagatcagcattgtattgaaaaacaaaaacaaaaacaactttggctttattgtgatggtggttagaggagtgagagactggaggccggatgccgagtttagagtatgtctttaaatagatgttctgacagtgtaaatagacaggtgtcaaacagatttgagtaagagtatataggtaatgcagaaaatggctttggagattgattgagtttggaacggaggtcattgaagtctaggttcaaatcaataatgaccacaggagtaacaatacatagtaagtatggatacattagaattggatagaaagaataatgaggcatctgccagaaacacagttaaaaatatccagaaaaagacgagaaattcaaacttggaactcaagacagatttcaagttagaagacttatctacaacaaatacataatccctatttgaggaaaaatagaactctatataggtttgctcaactcaatcttagtaaaacaataagggagaaaaaaagaattacaaaagagagaagccttggaactctttaaaatttaatcataattttaaaataaatttcaaaataaataaaagtgatcaaagatttaagaggcaaaatccaaggccaccaagggaatgagaaaaaacggtacttccataaaaaagcaagagaggagagatttcccagactgtaatatatttaatgtgaggctatgccaagaagaaatgataagtgttgtagatcactgaaaatcatcattacttttctgataactgagaaagcttccccggagggagagggtttcatagataaaccagagaagctgtttttgacatgaaagctagattttttaagacaaagattgaagttgagatgtttgtcactagaaattattgggatccaatccaatggttttaaacagggggagagaaaaagatgaccatgttcagtgagcaactgatgttgaaatactgaaaaccacatggtgcaataattaaaggaaggtatacacagtaaacgcatagaaaatacgttaatatatcattcatttttctgtccagggataaataacactgcaaaagaaaaaacagccaaccaatcaagcaaacacataaatgtatgctactgttcaattgaaaaaaatgcataaggatttatcatggttttatctgtgcttcattagaaaataaagccaaggattttatactccaaattctacagacttttttcataataccagaaaaccttaactttacagacataataactttaaaagagttggaaattaagaataaacatacataataatatatctgggcaataatttatttcatcctacttgcctagcatcctcaacgtagtttggcatacattaaggtcctatagaaatttatcaaattaatactaaattagcagagtactatgaattgctttctacctttgtaacaccagatgtatatatttatgtgttcaatataatattaatcttagtgtttgtgaaaacattaatttgccaaagagagttgtttatattagaaaaccgtgtaatctacatttataaaatcagtgtatttctaaacaagtgactttaaattttgatataaagcgatttttatttttattatatcatagttcatgagataaatttattaatagactatatttttaaaagtttttctgaactgacaaattctgcatgtattataatggggttaggaatggtttctcaagtcaagaataccaccaaagtaaggaaaatttcacatcaacataggtgaacaggtggcaagtcttccaaaatttgaagaattctttcaagaaaggatcagcaagtatgtaattagagtcaacatgttctgtttagctgacattaatggttagctttcactctggagagcaagatcttattgaaatttcatgaaattttagcagaatatataaaggaaaatagaaaaagagacaatcaaaaagaataaaagtacagacataaacacagtaatttgaatgtgaagctcaaaaactaactccagtttttatacctagtgttctagaatggattcaaaataacaatatacataacaatgtacataaaaacctgatgccagtactaaggatgattttattttctaaagattgccacaataacattttcttttccatatgctcttcttataatgtgacttggacacccctcatatagggaggtggagtatgtttctaccccttgaaactggcagagatttgactacaacagaactgacccttcaaattccatagctaatttatgaaaatttctgcctaattctcttgggaagcttgttgtgacaacccactgtcttgctgtgaggaagccccaacagcctataagaggcttcagtggggtgaaaatgaagcctcagtcttcaatcctggatgagcaccagccaacagccaaaatcaacttggtagccatctaagttaatcattatgaaagtggcacccagccctcagttaaagtgccacagctgatgctgcatggagcaaagataagatgttttctcaagtcttgctaaaattgcagcttagtgagcaaattaaatgattgtagtttgagcccactaagttttggtggcctgttatacggtgactgataatctgaccaagtgcctaggcttacaagtaaatatatctatatttttgtacatgaaataaaaaaataaatatttgccataattacttaaatgtataaatcttaaattctcattttttcaaagtatgttaaggaatggctcaatctgttaaaaatgataaaaggatcaagattgatcattccagaatttcttccataatatttaattcaaaaagcaaggttttaaaagaaaataaaagagtaattgttcaaaaaaatatttattgatcttcagttaaagacctcctttttttactggcaagaatccactatccttaggatctttcatgctctttgcccaaacactactttacaaaggattcagagcataaaaaatttcctgacttatttcttcaccattagttcattattctccttatgttaggatatgcaatatttaatattggactgggtttgtcatctgaagactgaataagttttatccttggactagttctactttgagtactgatactcaaaatatgaatattatagtacaacaagggagatagtgaggcattctgaccaaaaatttgcccatactctctgaaaatacttttggatataaatatttttcaacaactatgtccacctacagagtgaatctccaacttaacccaggctgccagagccagaaaaaacctgctatcaatttttgcatgtagagctaggactcaaatgtatcttaattttatttactcttcctaaattgtatctatatacttaaactgtctaccagaaacgtttttgtgtatattcaacacatgcaaccagttaatatttgtgcagagcttagcatagttcattacgaacagaacattctatacaacctctagacattatgatcacttacgttattaccccaaattgaaagtataatctggtctctagcattaaactgcataggaatgagagagatgctcagtctgtaatctggagaggaaaggaaggtcaatgattctttgtaaaattaagtttgtacactctgcttttcaagcagcagtctctatcttcctttactttcctcaatgaactaactactagtaaacagtcatcagactgactcattgaattggattattgcggtttcaatgtataccttctcttggggtcccactggtacactagctgaatctattaactcggaaacataaattaatactaaaaatatatttttctttttccttttttatatttaaaaggattttaattggaagtacacacacacacacacacacacacacacacacacgcaatacagagtgccaaatttgtatggggatgattgaaaaagattattatcaagtattaaatatttgtttcagcatatttgttttttcactgttgtctttccgaatagaaattttcgaatgaaacaaaaatgcacattttaataccagcccaatatacttgatccttacatgtttaaatttcatgtgcaaaaaatgattagtcatagagcaaacccaccctcttgtagaaattttaaaagattttaatgccagcgtaatatacttgaaccttacatgcttaaatttcatgcacaaacaatgattagtcatggagcaaacccaccctcttgtagatattttaaaagataaataaaaatgaaacttttttaaaaaaagagttatattttaggttcaggggtccatatgcaggtttgttacataggtgaagtcgtgtcatgggaggttgttgtatagattattgcgtcacccagttagtaagcccagtacccaatagtcatcttttctgctcctctgtctcctcctaccttccaacctcaaatagacttcagggtctgttgttctcttccttctgttcatgagttctcatcatttacctcccacttatatgtgagaatatgcggtatttggttttctgttcctgtgttagtttgctaaggaaattagcctcccactccatctatgttcccgcaaaagacaagacctcattattttttatagctgtatagtattccatgtggtatatgtacatcattttctttatccaatctgtcattcatgggcatttagattgactccatgtctttgctattgtgaatagtgctgccatgaacattcatgtgcatgtgtctttatggcagaatgatttatattcctctgggtatattcccagtaataggactgctggatcaaatgggagttcttcttttagctctttgagaaattgccacatggctttccacatggttgaactaatttatactcccaccaacagtgtataagtgttcccttttctctgcaaccttgccagcatctgttattttttgactttttaataatagtcattttgactgactgtgcaatggtttctcattgtggttttgatttgcatttctctaacgattagtgacatttaactgtttttcatttttttattggccacatgtatgtattcttttgaaaagtgttcatgtccaaaagaaaacactttttgatgtttttatttaattcttgtaattttaaattcctcatagatgctggatattagacctctgtcagatgcatagtttgcaaatattttctcccgttctgtaggtggtctgttcactctgttgatagtttattaagctgtgcagaagctcttaagtttaattagatcccatttgtcaatgtttgcttttgttgcaattgctgttggttctttgttacaaaatctttgcctgtgcctttgtcctgaatagtattgcctaggtggtcctccagggtttttctagtttggagttttacatttaagtctttaatccatcttgagttgatttttggttatggtataaggaggggggggtccagcttcaatcttcatatggctagccagttctcccagcaccatttactgaataggaagtctttttgccactacttttgtcagctttgtcgaagggcagatggcagtaggtgtgcagccttataaaaattatgtttgtcatcattacttttaccagtcctttcaagtaaaatttttatgttcaccatctttaatagtttgtgtgttttttttgtttgtttgtttgtttttgtttttgttttttgggttttgtttttttttttggctgggattcaacaaaataacataatggcatataactttaggtattctacatctattttgtccagtcaagttctgattagcttttttgcctgcaaaaatacttcatttggctgaaaacatatttttatccaatgcacataactatttatttttctctccagctgttttttttattcatgcaagttaactggaccagtgatcattgctgtgagtagactcaaaagtgattctcagctattttagatctgctgtgagaaaaaccaatagatgtattaatattataacattggataagcactctggctttacatttaggaggcattcctgttctattcctcaaaatctcaaatagaggaccctcagaacttcagttctcatgtattttgaggaaaaaaagtcaagtagcttccaacaaattctaacactttgagccattttgggaacccagagagctgattgctttccagggaaatagcaaaaatactggttaaatggttaaatcctagaccacggaatttttaaaaacagaatatgtgtatacacacacacacacacacacacacacacacacacacacacacacacaaatacaccttttaggggagaaattgatatttttgcctcagcaggatatccatttgccttaaaattcttattcttaggtatgtacatcaatcatctggggaggtccaagctgtgaaatccaaactgacagaaatttatagctccattagcatttatcaaaaatacaggattaagtgtagaaaatatgtattcatgcttcacctttctatatctttactttaagaggtaagtatttgtattcagtatttgttagctcctaccttcaaacggccaaacataatctccaataacatttcagaattctactgggccaaaaatgtatcctattgacctgtgtgtcctctgacttacgactgcatgtttaaatatgaatttaagaaaatgctgcactgattatttggagtttttcagaatggctagtgaattccttggtgatttattggtaaaaaaataaaataaaataaccatgttggactgttgtttcataacatactttctatttggaaattatataattactctttgtgttaaaaatgtattcatactccctgaaaatagtttcggacataaatatttttcaatgtgcatatactgagttttgctattataaattatatgtctacaaaatacttgaacatgatcccattgggttttaaaacatgcaaataaatggagaaagataagagtatatttaccggagttctcaactcaggtatggcagcttgataagtgagtggacggcaatcacgagtgtttggcacaaggacacaaggaagaaacattggacccaagtcatctccatccagaacatccactgtgagagtggtggtggtggttcgcctctcattcagattttgggcacggtcctgttagggagaaaaacaaacaacaggtagtttatagaaattaggcacaatagccaggagcagtggcccatacctgtaatcccagaactttgggaggccaaggtgggtggatcacttgaggtcaggggtttgataccagcctggcaaacatggtgaaaccccgtctccactaaaaatacaaaaatctgggtgtggtggcaggagcctgtagtcccagctacttgagaggctgaggcaggaggatcgcttgaacttgggaagcagaagttgcagtgagccaagatcacgccactgcactccagcctgggcgacagagtgagactcagtctcaaaaaacaacaacaaaaaagaaattaggcacaatgtagacttagttttcattgaaaaaaaaaagattggtaaattaacttgcttaaaccaacagttttaagtggttgagtcaggatgtaaactgagatccaattgtcttcaaagcaactttcttgaaagtatgttacagtagttaagcttttgtatgttaggcctttacctaacagttcacattactagacagcctaaccataaaggtcactctcatctcattagagcatttactttagaaaccttgtaattgtaaattccttctctgcgcctctgaggtgttaatcttttataagctgcttgtcagttctacaaaccaggcccatctttttcatgccctggggggccatctctttgaaatgtaatagtcaaggaagaagcccgtatttcccagtttctgtgggaggttaggagcctgacttcctttggaggcttgctccaatttctaaaactactttctgtcatgaaaattcaaggaaatttattttcctttgggaatgccaattagtaaacacatctggtctgtgattcccccacacccaagtccactggagtgtttaacagctctccagccattttttctattagagatcagttcagatctagtctgtattctggtctctcttctctattgcaatagctgtgaatacagtcttccttatcatttaactttgtctagtgcaattttgctgtaggaatacattgttactaactaaaatccaaagtttctttagatttccttagtttttacttaatgtcagttttctgtttcaggatcccaatcaggataccagtttgcatttagtcataatggttccttaggctcattttggctgtgacaagttctcagacttttgtttttgatgacattgacaattttgagcactggatattttgcagaatgtcccttaatgggtgtttatctggtgttttcctcaagattcaactgcggttatgtgatgtatgtaggaaaaccacaagtcaactgctattttgacatatttatcaaaagtatatgattaatatgacttatcactgttgttaacttcatcacctggctgaggctgtatctagtcagttttctcaactataaatttcctctttcttgtttccctttcatttctttggaaggaaatcatgatggacagcacacacttaaagaatgggtagtaattttattagaaatgtaaattgtttatatttatctgaagaatgtttgtcataggacagaagaaaataatattggacctaagtcatttccatgaagaacatccattgtcaagggtggtggtggtagcatcattcattatgacagaatctggaaatgtttttactttcacagcatttagttattattttgaagaactattatgcttttctgcctttttgaattctattttgtacaacattgacaagtatacttgcatgcatgttcatgtagcactattcacaacagacaaaacttggcaaaagcccacatatttatcaatgaataaatggataaacagattgtggtatgtacacacaatagcatatgattcaagcataaaaagaaatgaagtactgatatatacaacaacatgaatgagccttgaaaacatcatgttttcaaataaagaagccagacaaaaaataaggtcacatattatacgatccatttatatgcaatatctggcagcagtaaacatattggtggctacaaggagctggggaggggatatggaaagcaactgcatgagtggtgccagctctttttggagtgattaaaatgtttgggaactggatagaggcggtggttgcacaatactgtgagtgtaccaaatgccattgaattgttcactttaaaatggctaatcttattttgctaatttatgttaaataatttttaaaagtaattatactaacagacctgtatttttttttttttgttcataaaatgtcttcctttgtgacagttcccagacattaatatttgccttccaattaaaaaaaaagtccctcttgttaaacatggttaatagtacattttggttaagctcattcccagtctggttgctcataaaaacttgtaaagcaatgcttgagggtaaagttttaggaaacacgaatttctgttggtggaattttgtcagtacaaccttgtctagaatgtaataactctgtggttccaggattctttgatatttttatacagtataagacagactgcgataaaattatagcttaaaaaaacacaaaatgtttaaattttcaaagtttcggaactcactcagatccctagaggcactataaagattattcaaacctaaagacatttgagattcaacaaacagaaagaagtcttttctgaacttcttttatgtcactaaaagcagatacttatgagagtgaggctgccatgaattccctctgccaagaaagtttatgaaaatgaagaaaaaacaaggaaatctattcttacctacataaacatgatcacaagctattttaatctcccctttgactcctagaaacctagtttttcttcccttagaagcctcctccctctcattgtgttaaatatatacaccttcttctttagctgtttaaggagctgtgtatatgcactcccatatgtatatcaacctctaggccagttgaaaagtagagtaggagcaacatgtggcatgtgagataattttggtggttcacaaattaactttataaattattcttaagatgtatgaattttgaacatgtagaaaaatattaatttaaaataagcgtatgtgtatattttaaattttaaaaaaaaatagctcatcaaacttgccacttttttaatactgatcttttatttaattgggttatagctatgtctataatatatgaattaatagacaaatgatgtaatgatttgttcagtcagcatatcctgagtagcttccaaggggcagattccaatacactgcttctgacggtcttaaaaaaatgatgaggacatgtttcctcatcccattattaagagagtcatttagtactgaaaattactaatgttaagataatgtgacctcataaagattagtaggttatattttcacatatatttccctttgtgttgcatcatccagtgttttaaatcattaagtaatctcatcttccatatttctaaagttatattaaagtttaagaactaaaacaaatctttaaatttctaaatatatatatataaactggaagcttctttaataggggtggtaaacttttgttacatttattaatgattttacatttgacatttttctcaataacaaataagttaataaaatgacatatttaatatgtatttgtaaatttacttgtggcactggagttaatatttgaaaatttttttatttataaaatatttatttatttatttatttattttagaaatgagaatctcactacattgcctatactgacttcaaaatcctgggctcaagtaatcctcgcacctcagccttctgagtagctaggactataggtatgtgcctggctttaacccaccatttaaaataatgattgcttatgaagttttaaaagattgaattaatctaaatttaatttataaaaatagtaaatagataataaatattaaatatttataatattttatgtgatacatgaatgtagcatgcagatataaacacacatatatatgcatatatacacatacatgcatataaatgccagaggcaatatttctacccttccatgtcactcagccttctttatatgtaatcatcaaatcactataataaacaaatttgaattttttaatgttatgttttctttcagtctgtcagcatcaaatctctcactattatctgcttctttgggtcattgtcactactccatagaatagatactggtgtgttaaagatagtgtatttacaggaagtgtataccaaaatacataataggagttttttctcatattggggaaagatattgcttacaaagtgttgagctctaaaatttgtatttttaagtgggaaataaaaataatcctggcaaaatgattgtgagcagagatgtagcaacaaaatctactaacagtttccacacgtgggaattctcccacattttatcaccaacacatatcacataggaaaatatataaaaatatgtctcatgcacactcataacttgtgagcccataatggtaatgctaattcatgatgttctcccaatttggaatcagatttgatcttaaaatatccatttaaaaaataatccttcagcaattgagataaaaatcaaaacaaaaacaacaaaaacagaaaaaacaaaacaacctacacttttgatctttatagtaatatactactgctcaaggctcttctgagtaaatgaaataacattctaaattgtgagtggtaaaaaataaaaaataactatttctataaacattccatataatttaattatgttttcatttacgttatgtgataatctaatatatattaaaatccacaaagaagatctcctttcttccctttcccattttcatctgcatttctcttcttttttaaaaaataagaatatatatttaacttcaattatttaaaaataacaggatattacattaagttaggaaactgtgattctagttggcaagcaagaatatcttttaaaaagttaaacaagttcaaccagtactctgaacagaattgtgtctcctcaacctcaagctagaaaatctagagtaaagtgatatgtttctggaaacacataatgttccaagatcgaatcaggaaactattgaaaccctgaacagatgaatattaagctgtgatattaaattagtaataagaaacttaccaaccaaaaaaagcactggaccagatagacacacagctgaattctaccagacatacaaaaattgactcaagatgaattaaagatttaaatgtaatacctcaagctataaaaatcctagaggaaaacctattaaaactcttcttgacattggctttagcaaggatttcgtaatgatgatatcctgaaaagcaattgcaacaaaaacaaaaactgacaagtagcacctaaactaaagagcttcggcacactaaaataaactgtcaatacagtaaacagaaaatggaaagaatgggagaaaagctatgcaaactatgcatctgacaaaggtctaatattcagaatctataaggaacttaaacaatttaagaagcaaaagacaaacaatcccattaaaataggggcaagggacatgaacagacacttctcaaaataagacatacatgcagccaacaaatatatgaaaacatgctcatcagcatttatcatcagggaaatgcaaatcaaaaccataatgagatatcatctcataccagttagaatggctattattaaaaagtcaaaaaattacatatactggtgaggctgcagagaaaaggaaatggttatatgctgttggtgggtatgtaaattatttcagacactgtggaaagcagtttgaagatttctcaaagaatttaaaaccaagctaccattcaacctaccaaccccattactgggtatatacacaaagaaaaatagtgcattctaccaaaaagacacatgcatgtctacattaattgccatgctattcacaatagcaaaaaacatggaatcaacctaggtgcccatcaatagtggattgcataaagaaaatgtggtgcatatacaccacggaatactacaaagccatagaaaagaatgaaatcatgtcctttgaagcaacatggatgaagctggaggccataatcctaagtgaattaatgcagcaacagaaaactaaatactacataatatcagtttttcaatgggagctaaacaccaagtgcccagggaaataaacctgggaacagtagactgtgaactgctggggcaaggagagagaatggatcaaaaaactacccattgagtactatgctgaccacctgagtgcaatacacccatgcaacaaacctacatatgtactccctgtgcttaaaataaaagttgaggaaaaaaataatgcttctatgaacattaaccagaggaagttgggtattctattgtcttgtaaacattttttgtttgagatatttgcctaatatttcttattttttatgcaaaccagtagacagaattatattatcatttatagccccaaatgctcatgtatctttagtagccaaacactcagtaaatattaggtcccataaaccatcacctgctatcctcccatttcactctcactcctcagaaaatgcccaagaaacttgcagagttaaaacaatggggttacaattaacactaattccacacatcagtaggaagcagaagtgagggaaggtcagggtagaggttatttctgaaaagttgtttacaaggttgaaatataaaatatagaaaattaattttacctatacaaacacatatgtttgcaatgcttacacattttatttgaatatttctgtccataaagataaaaaattgagctaataaagaaatagtaatattataattttaggaattatatcttgttaggaaagatagctagcatcccttctctagattttgctatttgagaaatatacaacacccttgctattcataaaataatttagaaattataaattattcttgccatgattctaaattaaatttaggccgggcacagtggttcatgcctgtaatcccagaacattggaaggccaaggtgggctgatcacttgaagttgttaatggtttcagaccagcctgtccagcacagtgaaactccgtttctactaaaaatacaaaaaattagctgggagtggtggcacatgcctgtaataccaactactcgggaggctgagttaggagaatcatgaacacgagaggcgaaggctgcagtgaaccgagatcacccccctgcactacagcctgggtgacagagcaaaaccccatctcaaaataaataaataaattataaaataagtaaatataaacttttttctttctggtaattaagaaatcttgattacaaaagtgttcttatatatttcactcaggataacaataatataaaagagagtttgctttgaagaaaaatgatatgtaaagagattactttgattctatgtgaattagggtaacatatcaaagttgaggttataataatatgtagtaaatttcaacaaaaagaaaacccatttgatctttctagatctacccccaaaatttttgtctggaattaatcattccttcattatgtatttatatttgaagtcaatagcatgggtgacaatattgcaaatattctcaaaaaaatatgtgacagggttttctaatatgggtcagtcaaaactcaattaccttaattacggatcataacatgtaaacacggataaaaagaaacctccaaactacatgtaatttgaaggattctcttcgaaaatcaaatatttttaacataagcaaaaccaggtcaaagctgggtaatgttcaataatttgtcatgatacctgtaattattcttttagaggccatatactttaaagtcaaaattgattgctcatatcttaattctccttatgacttcaagataatatattggtgcttaatgtacatgacttacattgtgcataccaccaacacaatataaaaaaccactgccaggtgcagtggctcatgcgtgtaatcccaacactttgggaggctgaggtgagtgaattgcttgaggccatgagtttgagaccagcctgaccaacatgctgaaacctcgtttctactacacatccaaaaattagctgggtatggttgcacgcatctgtaatcccagctactcaggaggctgaggcacgagaatagcttgaacatgggaggctgaggttgcagtaagctgagatcatgccactgcactctagcctgggcaacatagcaatactctcctcccctcccaaaaagaaaatccaggtgtggtggtacgtttgtggtcccagctagttgggaggctgaggcatgagaatcacttaaaccccgtaggcggaggttgcagtgagctgagatcgcaccactgtacttcagcctgggtgacagagcaagactgtctcaaaataaataaataaataagcaaacaaacaaacaagataaatgtaaaaaaaatggaggtacattttagatatatggatatcattatcatatacaaacaaagatatgttagacttatgttactattggtatatacaaaacagttaatgattaacaaccagctatcagataagtagccctgatttgtagcactggcactttccatactgtaaatgctcccagcatggctgcaaatgtgagatcactgaactcagagtttgaaagagaaacccacaattggccctcaagcaagtctcagctgactttccacctccaacaacccacagttttaagttacagatttaaaatgttgtgaaaatgagcatccttctttatcatttgtggaagtgtgatatgtcacaacactttgaaaaataatatagcattatctactaagattaaaaagtatgtgaatatatatgtacaaatacacatacacatatacacatatatatgcatacatataattttctcaaagcaattccatttttaattactgatttttaaacagtaaagtaccagtattttagtgatttatataatactgtaataatgtctcaatatatttcaagcattagtctaagtacttttttgtttgctaactagctaattgtaaccagaacaatgtggtatgttttattaatatacccattttactggttaggaaattaacatacaaagcatgccccaaatcacacagccagtaaatggctgaactgagatttgaactcaggtgacataattcactacactcactgcctctcttgaacatcatgagggtagatatcaatttggtgccaaaaacaaatgatcaaataaacaaaaacggagtattgttgaatcaatggtgatccattattattatcttacattatgtagctattaaaattatttgttcttaaaacttttaaaaatgcttaaaatgttataactttctatatttaacatttcattgtgtactgtatgacttaagtttataacaaaaactgttattgcatttaaattcaaatgttcattcgacttcttcctaatgctattccttccttttgatgattcacatatgtacttctgttttataactttatccctgaaatgctaaaaacttgtcactacctcagtgatgagtagtccatcatgttggatagaagttgttccagatgtctttataaatattttaaaactagacaccaattcagaatcttttaccttgcatttctattaaaaaattatatctttttaattgcatgataaaaaaactagcttacaaataccttccacagcaatctgacttcataaaaaagacattctaccttttcttcacatcttcagttaaatagaaaaaagaattttctgtgtttttgaaaaactctgagtggccctccctaatacattttacttttccccatatctacagttttcactctgctctatgttacatgacattaaaatatatacacacatacagacacacacataatacatataacatcttataatatataattataatatataaaataataaatcatttttaaaatctgaagaaatataaataaaagcttccaaacttagcttcaaaaattagatctatatgtctatctacatatttctatctacatatccctaattatatatctatctaggtatctatctatacacatacacattctgtgtcaggtgatatatctctaagaaaggcaagaaaatgacaagtttgtggcacattttttcatgttaacttcttcagaacagctaattgaggttattttccttttagcatcccctgctatctatctgttctgctgtatgagcaagattacaacgcttaggagtcattaaaggcacaggatggcttcagagtatagctgctttaaaaaagaaaaggctattaatttagagcagttttaggtttatagaaaaattgagaggaaggtatatacaccatgtctccacacgtgcacatcctccccacttacaacatccctaatcaaagttgtacattggttacaattgatgaatctacattgaacaatgataatcaccaaagttcatcctttacattaaagatcaccgttggtgttgtacattctatgggaatggacaaatgtataatgatatctatccaacttcatggtatcatccagagtattttcactgacctaaaaatatttcatgatccttctattaatccctttctacctgcctttaccaccatatccctgacatccactgatctttatactatttccccagctttgcctttaccagaatgttatatattggaatcatccagtatgtagccttttcttaatggtttattttgcttataagtatgcattcaagatttctccatactttttatatctttatgcctcatttcttaacggttatttcaaaaacgtaagcttgtcacttaatatgggactttttatgtgacctccccttctagcttttttctcaaggggtactcccattcatcttgctaagaaaagaaaaatgttttcaggtcatcagtgtgcccagtctcaggatatgaactatacatagtataattcagaagtgaataccgcatatccctttgacacatatggacttcctcaaccttcgttcctattatgctgacacaggtgatacaagtctagaaggagatgttggatgggagaaaactctgaagagagtatcttcccagataaaagaaggaagaatcaataaacgtaaaagaaatcctagttttgctaccctttctgcctgttgcattcagacttgaaatgcagttgtgatgcttatggccatggtacacaaatacctcccagctgataaggcattgggaaaataaccacattccagagaagagggaagtataaggatggaaggaacctaagtccctggtgatataattgaactgtcaaaccaaacattgagctgcataattccagaaattttattaaacttccactaataataactataataaatgtctatgttttataagcatataagcatgtctatgttatataagcatgtaaggatatctatgttttataagtatataaaccatgtctgtgttttacaagcatatgtttggatgtcctgttattgttatctacatacattagcataaacttcagttatgggaatattagctgatatctagtgaacaattactcaataaatgatagccatgaggaagaacacgaccaattaggcaatgattctttgcctttagtgtaccttagaattccctgaagagctaattaaaaatgcagatattccacttccatcatctgagatttttattcagaacatctgaggtagggtccagaaatatgtatatttaatacacacccaaggtgattctgctgctgttaatttgcaggatcctactttgaaaaatatttcagtatagtctaaaaaggttggataatggataatacatatgaataatttagaggtcaaagaatacagtgaataaaaacaacctattctatccctttctccatctataagagtattatatataaacaccaagggcaggagtgccctgatgaagaagtgagtggcacagagctctccaagagtatctgatacattttggatgagttttttacttcataaattcacagaagaaatttaaaagaaattgaatactcacattagcttggattatgacaaagtagcgagtcttatcttcatagttgagcctcttccttaacactatatttccagtcaacattaggggaatttcaaaggtgtcattggatgtctgcaaatattaaagatacagacttcagattatttgaatgtaagatgaattaataactcaatattttggattaatcctcttggaagttagagatgacatgcttatcatctgaaaatagaatgactataagcttcagagtcaatattgttatcatacttccaaacatttaattttgatcaatgggtttccccagagtcctttggtaataataaccagaaaatttgtttcttgtcatagtttttaatatattactagtattattcatcaacagtcttggaatagttctaaatcaaagtccaggtatctgaaaaacttccctgttaccacattatcttttcactgtgttctttaacaccaaagcattcaaacactgaaatctgttatttctacatagtatcaattgtcaacattgatatccattctgtattttaagtatttttaagtattatctggcattaaatacaaaaaaaaaaatacagttacgagtcacttagtgatgaggtacattccgagaaatgtgttgttaggtgatttttgtcattgtgtgactattatagagtgtagattcacaaacctaaaatggtacagcctactacatactaggacaagtgatatagcctatggctcctaggctacaaacctgtacagcatgtcactgtactgaatgctataggcaattgtaacacaatggtcagtattttctctataaatgtaatctaaacatagaaaaggtatagtagaaatacaacattataattttatgagaccaccatttgctatgtgatatatcattgaccaaaatgtcattatgcagagcatgactgcgtgaacttgaatcagttcattattgtggaaaaaaaaatccaggttatatatcatttttttcttttaggttccacaacttctgctcattagttaagttctctgccctgtctaggactgagttttttcctggtaacatggaagtcataagggcaacactagtgctctggtataagcagccctcagtgtaactgtattcacaccttaagggagtataatttataagataaatctcttattcttaagaagaccttatgtcacttttgtattttagtgccattttaaagaatgataaaattgtttctagtaggctcaataactcagtgttattttgttcactgaaattgtcttgtggttgttcagttgccttgtgtatttgtgcttgtgatttttttgtgaaatatttagtttgaatctgcattagattgctgcaaaaggaaggaaagagagggaaagaaaaatgagaggaaaaggcaaggggaaggagaagagaaagggaaggggaagtgtggaagaagaaaaaaactgtgtatgtgagagagaaacagagagagagaggaagagagagagagtgttcacaccctcaacttagtgtaagtgtattcctaagagtcacataagaagttaaactcaatgaaaaaaaaaaagctgattcaaatctctcagctcaggctcaatcaatgaaatgtgtgtagtttagccttccatgtctagagctgtgatctgtctcctttctttctttctttgtctctctatctctctttctctcggggatgcataaagacacacacactgtacattttgcagaattaatatatatttttaaatgattcattctgtgctcctcatgtaatgggccttgcaaatcgttcttggatgcagtcatttaaaagtaacaatttaaaatataaatacagaaaatgaaaatgaacaacacaattaaaaacagacatttgacattttccctaattttttgcctattcaactttgcttatacctatgagtggggctggcattatgacacaggagtgtgaaaatgattgaatctaaacatgtaagttgaatatgggcaaaaccttagttaataattgctgtttacactgttaaacttatcctaatgtgttgttatgaggttattacattttagtgactcaataatatagaaatatatattggtttctagcataaatatggaagatactgtggtcttaccacaaaactaccacatctctggactcagaaccccaaattagctcacatatctggtgacattgtgcctcagaggaggctatgtctctaaatgagatgagtcttgaatagtctagcttaaaaacagtaattccattctcttttaccaggaagtattttgcaaatgtacatgtgattccattttgagtaatgaaaaaatttctcttaattgcaaagatagagagaagctaaaaatcccttttcaggttatagaagtttctgtcaggatataaaatttagaacttcagcagccatttggggactattgataaaattaattacggagaaatagctaacatgctagtgatagcagagtataaaataaaaagagcccggatctgtgttgtctttgagttgctgagcaaatcttgatattaccccatctctgaaaaacttattatgatagataataaattacctttttggttaaatcatctttaatttagttttttacatatatataatatatatataatctatattatatattattatatataatataatataatctatattacatattattatatataatataatataatctatattatatattattatatataatataatataatctatattatatatataatatatatatagtaaattttctgcagctgaaagcactttgatacatgattattcctgtctctatgtgtttacactgtaggcctctctcttctccaaacaggccatggctcttcacacctgatatttgctcttatttttctcttgcttaaatatcccatcacttatttctctgtgtactaatctttgcaaactttactcagtgaaacctcttaaatgtaatttagacttaagtctttgatgtgatctcacattattttttccaaaaaacacttatttgggatcttctgttttgcttgacagattcctcaagggtctcagtctgtgatgcagaaataacctatccttaaatgtctagctaagcaacttaatgaatctttgcaatactttttttgttgttgacagttttcattggacgtttgtagaattattaaaaataatagttattagtgactttattgatcttcagagcactttcaattgcactgaattcttatcatcttaaatctatcctttagagattttatagattcttagattttaattttactttttatatgtatgtatttatttatttatttattgagatggatgcagtcttgctctgtcatccaggcttgagtgcagtggtgcaatctcagctcactgcaacctctgcctcctgggttcaagcgattctcctgcctcagcctctgagtagataggactacaggcatgtgccaccacatctggctaatttttattttttacttttagtagagatggggttttaacatgttggccagtctggtctcgaactcctgacctcaagggtatgcccaccttgcctcccaaagttctgggattaaagatgtgagccaccatccctggcctagattttcattttgttagcacttgtattctataaaatataagaataggatatactttatcatcaatggtgcttctgaaatgttgcatattgaaagccactgtattaaatttaatttattaattaagcaattattgagtattcattctgtctctaaaatgtagaataataatcaagaaaattagaagcaaaatatagatatctttggtatctttatgatagtcttctttttcctctagtaaaaagaatactggattagatcaaccctaagtaaaagtcttgctttaatgatatttctgaagtgtttacctaaaaagtttaaaaaaaaaaaagctaaattaagcaagggaaaaaagtagattttttaataaataaatacatgataaagccatgaaaaaaacaaaacaatacttagaacattcttaaagtttagaatgcacaagaatcataggcatgtatcattaagactgtagattcctagcatctattacccaaaattcccgaaattcttgggaatcggcatttttaacaaacctaccaggtgatcctgatgcagatgattcaggttttacttttgagaaaccactgtactacgtaagtctaagagtgactgcactctctgtccttgctatttatttttctcttctttcattcttagagatttgttccaccaatgaggcagaaaagtttgggaacagagcaatgcccatttacttaagcaaccttacatttctaaagccaggacattgccccctttctgatagtcgtggatattctctttaaaatacaaactaacattggcttttttgggtgataagaatttaagtgctgactacctgcactgtattaatgagaaaaatccaattatggttaaatgatttaatacccacacgccccaaacacctggcctccattaagaaaggtccactcactactttctgacagttcagtgacaacaactgtcaaataagggacaattctccatttagtaaaataagggcataaggcagtttaagcaatttatcactatcacagatatgggaagcagggtaggagacagctgtaacatccacgccacacacattcacattcaataatggagagagaaggaatgttgaggctctagcaactctgtgtttcccaagatgattccatccccccagaatcccctttactaatatgggtttgcaccagtttagataaaacggcagctctctgaaaggaggtgttgaatcctacagttaaagatgctctagaaatggaatatggggttattagcactatttcttctcagctgatagatttggtcattcatcatttttaggaaagagggaaagactccagcctttcacacctatgttgtaagcattgtttgtaatattctcttttcagctgtgatgactagaaattcagttcaaaagaagataatttctaaagaacacacacacacacacacacacacacacacacgtgtatatatattttctggtgacctaaagacagagacttagtacaaaagtgcctcaatgggcctgtaattgagaagtggcggaaatgtagataattacgattttctctttatctctgtaaattctcttgttctttgacacttttttttgaagtatcttcccttatctttgtgtctttttctgtacctctctcttctctctttgggtttcccccatttgttcacattgaatataactgtgagtctgtgttttagttccaataagcagcatcaactttgcccttatcaatctttagacagccttaagcttgtctctgattaagctcaggctactgtgccatcagctgctgaaaattctatgttattgtcattgtttgtgtgtctcctctaatctaatttcctaaagtaaaaagtggaggactaagtaaggctatgcaatttttgtccacccaagagggactgggatttgagcaggcaacattaactttgctcctaagagaaagtcccaacactctaatcattttttctgtttcatactgttaaaacatgtccctggctgacagacaaaatggactccctatgactaactgaagtaagttaaaacaaaaccaacaaaaccaggtggccatgcctgagtgacaaagtggtcgcatactctgtgttctcagaaagatgtcaaagcatcacaggatcttcctttctacaattgatatggtttgggtgtgtcctcatgcaaatttcatcttgaattgtagcttccataattcccacgtgttgtgggagggagctggtgtgagataattgaatcatggcatttccccatactgtttttgtggtagtgaataagtctcatgagatctgatgcttttataaagggaaatcactttcacttgattaaattctctcttagtctgcttccatgtaagacatgccttttgcctcccaccaagattgtgaggcctcccaggcacatggaactgagtccattaaacctctttttctttatacattacccagtctcacgtatgtctttatcagaagtgtgaaaacagactaacacagtaaattggcactggtagagtggggtcctgctgtaaagatatcaaaaaatgtggaggcaactttggaactgggtggcaggcagaggttggaacagtttggagggctcagaaggacaggaaaaggtgggaatgtttggaacttcctagagactttttcattggctttgaccaaaatgctgataatgatacggacaatgaaatccagggtaaagtgatctcagatggagatgaggatactggagtaaaggtaacccttgctatgttttatcaaagagactggtggcattttgtccctgacgtagagatttgtggaaccttgaatttgagggagatgatttaggttatttggtgacataagtttctaagtagcaaaacattcaagatgtgacttcagtgccattaaaagcattcagttttaaaagtgagacagagcataaaaattcagaaaatttgcagcctgataatgcagtagaaaagaaacacccattttctgaggagaaattcaagccagttgcagaaatttgcataagtaatgaggaaccaaatgttaatcaccaaggcatggggaaaatgtctccagggtgtgtcagagacatttgtggcagcccctcccatcataggccaggagccctaggagaaaaaagcggtttcatgggccaggtcctggacccccctttccgtgtgcagcctaggaactcggtgccccgtgtcccagctgctccagccatggctataaggagtgaagacatagctcaggctgcggcttcagaaggtgcaagccccaagccttggtagctttcacatggtgtggagcctatgggtccgcagaagtcaagaactgaggtttgggaacctccacctagatttcagaggatgtatggaaatgcctggatgtccagacaaaagtttgctgaaggggcagggccctcatggagaacctctgctagggcagcatggaaaggaagtgtggggttgaagtccccacaaagagttgccactggcgcactgcctagtgaagctgtgagtagagggccactgtcctccagaacccagaaagtagatttactgatagtttgcactgcatgcctggaaagcagcagacactcaaggccaaactgtgaaagcagccaggagggaggctgtaccctgcaaagcaacaggggtggagctgcccaagaccatgggaacccacttcttgcatcagcatgacctggatgtgagacatggtgtcaaagaagatcattttggagctttaagatttgactgccccactggatttcagacttgtatagggcctttagaccctttgtttttgccaatttctctcatttggaatgtatatatatatatattcatacccaatgcctgtacccccattttatctaggaagtaactaacttacttttgattttacaggctcatgggtgtaaggaacttgctttgtctcagatgagactttggactgtgagcttttgagttaatgatgaaatgagttaaaactttgagggactgttggtaaggcatgattggttttaaaatgtgaggacatgagatttgggaggtgccaggtgtagagtaatatgatttggctgaatccccacccaaatctcaccttgaactgtagctcccataatccccaagtgttgagggagggacccggtgagagataattaaatcatgggggtggcctccccagccacgtggaactgtgggtccattaaacccctttttctttataaattacccagtctcaggtatgtctttatcaacagcgtgaaaacggactaacacaacaataaagcaaaaacagatcctgttcttggtgccaagataaactacagctggaactacttccttttgccccctatgccatccctacactggccctttagcactagccctttgaaagaaacatctgacagaaacttctggtttggggcttggaaatcaaccaatcagagctcacctgaatcaaccaatcagtgtatagaacagtcatgactcatctgttttgaccaatcagaattaagcaaggatctatccttcatttggatgaagacagcttattgggaacctgggtgggaactatagctataaaaccctaaccctctctttgttctctgaaatgtgtcttagcttgaaaccacaggctgtatatccatggtttgaaaactgttcactgaaataaagtctctttcgtccaaattcctttccagagaacatttgcttacaatataaatttaccactctccctcacacaaatacaaacagattcattcacatttaatgatgcattatgattacaatgcagttcaacttatcttattccatccaacttccaaggaaactgtatttgtgtttggttgggttttgaaacttaaaagtcacagccttggtgtgaaaagactgaggttcgaagttttacacaaagaaggcctttacaccagtcttaattatacatgagtttccagtaaaatgagaatattatgaatttatggaggcatggaaatctcatgatataatgtaccctgaaaagtattattaaactacagtaaattttttagtaacctacctaggaataagtaatcactgttttagcttaaccttaaatattttattgacatctgaaatttggactttgacatatatacacacacacagaactacttcaggatggtgatttttttaaaaatcgtttgtccttaaaatgtggttttaacttcctgactcaggaaattcaaatgcttacacattacaaatgaaaattatggcttacattttctgaattatctcaaagctacggggagtcaaacatattacaaaagaaggacaatttactcaggaggacttgataaaagatgttaccacccactgaaacaccactgtaatacctcaaagaaagaagctgcttatgcatattgcttaagtgtcttcattttttttttctgagtagtaacagtagtgaataacaatgttatgctgcttcctcagtaaactggagactgctacaagggacatgtcatcagtctcctccttatcactttaggtcaaacttaaaatgctgaataaacatgcctccagtctggcattaaaataaaaaaaaagatcaaaaagacatgataattattgtctaaatagtcttatcaatcttgctaacaatgagatttaatatatcagaatacctatatttagatttttccatataagacaaattctcaaaaatgaaagttactgcagatcatgtgatgacaaattcttatcaatttcagagttcttcttttattttttcaaaacaaactaattcaagcttgtctaacccatagcccacaggctacatggggcccaggttggctctgaatgtggcccaacacaaacatgtaaatgtccttaaaacattataagatttatttgtgattttttattatcagctcatcagctgtcattcacgttagtgtaatttgtgtgtggcccaagacaattctttttcttccagtgtggctcagggaagccaaaagattagacagacacctctgaattagttcagtgcattatgaacactcttactttgtattaccatgaaggcattaaacaaaaaaaaaaatcagcagtattttacaataactgtgatgagtacactagaaattgcatagaaattaaatgcccctaattaaaggcctgacaacatatattgtccagtacatatttttacatattgtctactaccaagttccaacagataattcaagtggtacttaataaacaaaaggtgaccaaatgagaaaatgaacttatacaaaagaaagaagaatgcttcttcttctgaacaatagtgcagactgacaaagattctttgcctggccaaacttgatcaggcttctgaatcttctcctaggctcatctgtatacttcctcataaaatcactttttaacaaagaaccatactatatcactttaccaagaactcctctacctttgatgaatgatctatcttgaaaactcatcaggtttctcatcctgcaccaccccttaggtgatgtctgatcaccctgacttgtcttcagcaacaatcgtattagcgtgttttagccagaattcccctaatctctgatgtttcctcctagtaattttccatccagtgaccctgaccctgctccttggttataaagtcccacttgcccatgctttatttttagttgagtccaatatctctctccaactgcaagacctcattgcaatgatttctatacctattgcagtggtcctgaataaggtctttcttaccatgttttaatgtatcattaaataatatttttatttaacaattgtctagaggacttttagaagaagatatttactaaattatttttttctaaatacatcagccatgaaaggatagggaatgctgcaggaacaaacccttaaactttcatttttttctttacttttcatatctacatatctaatatgcatcagcaagtggtctctttttattgttgtcattggctaatgaatgtttctcctcaacatgtttttctctgatcacaacagcaggggcagagaatatgattacttgtatattggttctttgagtttacatttcattagtcaaagcaaatacttttctccaggcaagaaaagtacacctctagtatgaatcaaaagagaggaagaaccaaacatttttggtaaacagctcaagtgcttttgttaacagcagtgaatccatatgggtctgcagcaactcggtcctaacctcagaggaaagaatgtgatttaggggaagaagtaagtttaaggcagagggagagattgaggtgagttttagagtaagagtgagagcttattaaaaagttttagagcaggaatgaaagcaagcaaaatactcttggaagacggctaagtgggtgacttgaaagatccaagtgccttgttcatcccttcacttgggggttttctacattggcatggtttgggggtttgccattctcctcccttgatttttcttttggggcaggctgtccacatgcacagtgcctgctggtgcacttgggagggtcttcatgtgcagtatgtttactgaagttgttgcatgcttacttgaggcatttttgccttaccagtttaacattcccagaaaaaggtcatatactagtgaaattctgccattttgcctcttaacgtgcatgcttcagccctcttgcccaacttctaagctcttattgggaagctgctgatcaccagcttcaagtgttttctatctattgggagactatatttccctggcactggctgtgatcaattattcttttacagaaaaagtttaaaagccacctaaccatcacctgacgatcagctgacattcctgggggtggtcctctcctgccctgctcatatctgcctaaccatctagttgatatggtttggctctgtgtccccacccaaaacaaattacaatgtcaaattgtaatccccatgtattgagggagggatctggtaggtggtgactggtttatgggggcagtttcccccatgctgttctcccgatagtgagttctcacgagatctgatggtttaaaagtggcacttccatttttgctctttctgcctcctgctgcatgtaagatacaccatgcttctccttcaccttctgccatgattgtaagtttcctgaggtgtccctagccattcagaactgtgagtcagttaaacctcctttctttgtaaattacacactctcaggtagtatctttatagcagtgtgataacaaactaatacaggaaattggtactgggatagtggagtactgttaagatgataacctgaaaatatagaagcaactttggaactgggtaatggtcagaggttggaacagtttggagggctcagaagaaaacaggaagatgtgggaaagtttggaccttcctagagactttgtgaatgctttcaaccaaaatgctgatagtgatacggacaatgaagtccaggctgaggtggtctcagatggaggtgaggaacttattgggaactggagcaaaagtcactcttgctatgctttagcaaagagactggtggcattttgcccctgccctagatctgtggaacttggaacttgagaaagatgatttagggtatctggcaggagaaatttctaagcagcaaagtattcaagatgtgacctgtctttttctgaaagcatacagtcataggcatatatgaagacattatgtgaaactggaacttatgtttaaaagggaagcagagaataaaactttaaagaatctgcagcctgaccatgtggtagaaaagaaaatcccattttctgggggaaaattcaagctgggtgcagaaatttgcataagtaacgaggaaccaactattaatagccaagacaatgggaaaaatgcctccagggcattttagggatcttcatggcagccgctcaaatcacaggcctggaggcctaggagggaaaaatggttttctgagctgggaccagggccccactgctctgtgcagccttaggacatggcatcctatgtccctgccactctagctccagccatggctaaaatgtacagttcaggccattgcttcagaggtgcaagccccatgccttggtggcttacatgtggtgttgggcctgcaggtacatagaagacaagagttgagctttgggaacctccaccttggtttcagaggatgtgtgaaaatgccagcatgtccaggcagatatctgctgcaggggtggagccctcatggaaaacatctactagcataatgcagagggaaaaagtggaattggagtccccacttgggactgcctagtggagctgtgaaaagagtcccactgtctcctccagatcctagaatgatagatccacagacagcttgcatcatgtgcttggaaaaaccacaagcactcaatgccagcctgagaaggcagctgcaggggcagtaccctgcagagccacagggacatagctgcccaaggccttggaagcttaccctttgcattaatgtgccctggatgtgagacatggagtcaaatgagattatttcgaagctttaagatttaataactgccctgctgtgttgtggacttgcatggggcctgtggtgcctttatttgggccaatttctcacatacagaatgggtgtatatacctaatgtctgtaccctcattgtatcttggaagtaacaacttgtttttgattttataggcttatgggttaaagggaattgacttgtctcagatgaaactttgaacttggacttttgagttaatgctgaaatgatttaagactttagggaactattgagaaggcatgattggttctgaaatgtcaaaaggacaagagatttggaagaggccatggttggaattatatggtttgtctctgtgtcccgactaaaatctcatgttgaattgtaatctccatgaatctagggagtgacctggtgggaggtgactggatcatggggcagttttccccctgctgtttttgtgagagtgagggcattctcatgaggtctgatggtttaatagtgataattcccccttcactctctctctcctgctgccatgtaagatgttccttcctccccctttcccttttgctgtgattgtaagtttcctgaggccttcccagccatttggaactgtgagtcatttaaaattattttattataaattacccagtcttagttattctttatagaagtgtgaaaatgcacactactgtaacactttcactttaaattggatcaatcagttcagcaactatttattcccaaacttgttgcttctttgttttagaacaccatttgaattgcaataaaaagagttgcttaagttctttgtagatttgcggggggaggtgggaggggagagggacagcattaggagatatacctaatgtaaatgacgagttaacaggtgcagcacaccaacatggcacatgtatacatatgtaacaaacccgcacgttgtgcacatgtaccctagaacttaaagtaaaataataaaaaataaaaaataaaaataaaaataagttgaaacataaaaaaaaagatttgcaacaaaacagaaaggctcaatttaattattccaattttattcatatattaaataaaatagttatggtgaagaatttacaatattttgctttattgaaatgttattattttgactagtaaaagtgccacactatggtgctattaatgtaagcagaattactagagatttagtagtagcagaacataaaatttatcatgtattttctcacaggtcttacaagagaagaaactggtactgaggtttacactaattttatatgaagtctaaaagtggattctctccctaagattgtaccttggttaatccttttttccttcaatacatcctaagttaagtgtcatgatgtcttactattttttccacagaattaagagcattttagcttgctaaaacatatattatttatttttcttttttcatttgtaattttgaaaatgcatgtggttgattggtttatccactctgtagggagtaagagttacatattatattgtacagcaaacctacacttccctggaatggggaggcattgagacagaattattgcacagttaaaaaagaatttaagccttattaactgtctacattttaagcagaaagatagtttaaagtaatatatttttgctctcaaactatatctaaacattgaatatttttatgcatgcaataaatatctccctaaaaaacatggactagtcatttgatacttgctgggaggttttatttttacaccttggggagtaaagattagaaagtaaccttcataaaatttgagctagaaacatggcgcacacgtacaattaattctttaaaaaaatacctaaagagcaaacaaaataaatggtttcaaaatcgaatgttcagtcagctgtttctacatttaagaaaaagcatttctgctgcccttttctttgctgtttctttgctacttcccacttcatttcttatgtaacccttcatactgtccttctctgtcacattctcatcatatccccaactcttggttttattgtctctgcctaaaaaaaagtcctcttttagagaaacaaagcaaaaaaaaaaaaaaaaaaaaaacaagactctaaaatctgaccttcaccctgctaataaaatgtatatatatatattatatatatatacttattttccaaatttattaaaattttaacacagccagtacaagttttttttgtgagaacacaatagaggaagagtatactgaaactggattttacagttcagaagtagttttctaatatgacccaaatcacttcacttacgagttttctttgctatgcaacagagataatactacttttaactgatttgtgaggataaaatgagaaaatgcatccacaatttacttaacataatgcaataaatttgtgatgtagatcttactgtgagttctcagactctactatcccaatagagttttttgtttgtttgtttttgcttgtctgtctaaagtttatctacaacatacaatggtaaaaataagggcaaaatgttaacttcaccattgtttatatttctaatatttattaaacataaaagagatgcattcaatttgaaagcttatttaagtagtgcatttataattgctttggggggcccgtgggattttgaggagctgcctcaaagaaagtggggagatgtgaggcaaggcttccagctctagcttcagttaaaaaaaatcttactttgtctgtttttttgaataatatgtcattagaggaaatgattcatggccttaaaaaacaacatagaaatcttcttgtctatttgggaggccgaggcaggcggatcacgaggtcaggagattgagaccatcctggctaacacagtgaaaccccatctctactaaatatacaaaaaaattgagcttccagtgagccaagatcacgccactgcactccagcctgggcaacagagcgagactccgtctcaaaaaaaaaaaaaaaaaaaaaaaaaaaaaaaaagaaatcatcttgtctaatggaaaaaaaggaagaaaaacaacaaaataaaacagactatagctagtggctttgtcttgtcttcttctctatctttggtttaactggtggacggctagaagtttaaaggcttatcaactccagcaatacttggtgtgtgttcttgaggtatagcaacaatattggtattaatttatgagttgcataaaattcatgtttgacacttgttatctcatctccagtgatttatttagaatgctttggagaccacaaacataacagaaatttagtaaatgaggcatattatacctatgaatatattttaaaccttatctaaaaataccatcaaaaattagcttctagcaataaagcataaatattacaaataattcaattttgagacatttttaaataatagtatcattactaatctggttctggaagttactgaataatacaataactatcagctgaaaaaatcattaattttattccttttaagaaaattacattgcaaataggtatttacataccggatcatctggattatactgaataacatactctatctgtccatttggtccatcatctatatctgtagctccattgtctcctgaaaatcctgtgaatattgtggtaccaactggagtgagctgaaaggaaaaaagattttaaatatcaattttcattttatcaactgcacaccagaaatgttacagcataaaaatcagctctttattacctaaaggaagataccagttggcagcccacaaccacaaactgaagtgtttcaaaagaacagttttgagccttacacaggagttcttaaaatgtctgaaatgtccaactttgtgattcttgctatgggcgaagaagcagaagacgctgattccgtgttaaacacatttggaccaatttatagccattagtatgttagctcctgtggagaaactgcatctgttgtttctcctcaaaacccttgatgcaatgttacccacaggctagaatttaaactgtaagaaaaagttagtttaaaataaacgatttacgagtgagcaatgaaatccaggctgatgattatatgcaagtggcaagtttgagaaagagaaattggagacaatgaatagtctgtatattagaggaaaatactgggagtttcttgagtccttctgatattggttgagtagaacatgatcaggtcacagcagctggagagatagcaacatcttttcattttggattaaaacatcagaacttaatatgtgtggcatacaaaaccatgatttgatgtgtgacctaaattgctagtcttaattcttacttatgcccacaagagaatcaccgttatttttttttacctgtaggtttttgcgcaatgtgctcttataaccagagtaatttttttaaattttcccctcccagtttttaggttttagctgaaatactactcattagttaaatttcaacttaattagatatcagcttctcccataccacccctcaaatagcattacacacgccacatcagaagatgattccccttttcttgtgcttgcattttgcactttgttcctataatcattgcattgttagaggaactaaatgcacttcatcaataaacataagctctgtgcctctacagactggacgcttttaatgtttgctcagggatttgttctcttaatttttgactaggattccttgatggtaaaaatagcttaagaggcaacaaaaaagttgccttattcagttttactttcagaaactgaaaattcacattttacaaggatccctcaggtaatgtaaatgagtgaagcaagcatgatgagacggtggaaaatagatagaacatgccctctctgatgctactcagagagggtagctgctactagtagctgctactcaatcccagcaaattcttgccatcttggaatatggagcccatgctaccaagtcttctaatattttaattgtatataaaatatcttgatgctaagattgacaacagatttttattatttatttatttatttttgagatggagtctcactctgtcacccaggctggagtgcagtggcacggtctcggcttactgcaagctctgcctcccgggttcacgccattctcctgcctcagcctcccaagtagctgggaccacaggcgcccaccaccacgcccggctaattttttgtatttttagtagagatggggtttcaccgcgttagcaaggatggtctcgatctcctgacctcatgatctgcccacctcagcctcccaaagtgctgggattacaggcttgagccaccgcgcccggctgacaacagatttttaaacattaaaatataaataggtaaaataaaatatgcccattgcctcaacaactacactagtttgcaatctctgatttaggaaaagaatataattatgacttaaaaataaaccataagtacaaggaagttcaggatttataaggcccagtttcctagcaggcagcattgaaggcaaactttggagagctgagaatgaagtgagacgagatcgtttaagtagtacctatgaggacatcgagggaccactggggatagatttagtagaaatgttagtcagctaaattgcttccaagctgacgttcaatatttttcttttttaatggaattcctgttgcaaaagacatccttatcttttataaatattcacccattcttatgtagctgtactttgatatttttattaccaacttatttttaaatcaacatatagaattttgtatatttgttgtgtacaacatgttgttttaaaatatgtataccttgtgtgatggctaaaccaagctaattaacatatctattatatacttttttgtggtgagagcacttaaaaaatctattttcaaaaatagatagttattaactatagttaccatgttgtacaatagatttattgaatttattagttcaagaaatttaaattttgtatcctttgaccaacatctctcaatccatatcccagcccctagtaaccactcttatactgtctgctgcaattacttcaactactttagattccacatacaagtgggatcatgtagtatctgaatatctgtgcttggcttgtttcacttaacataatgtcttccaggtttatccataattttcaaactgtgaaattttatgattggatgacattgatttgtttccatatatctaataaacttaaaaattttgttgccaaaaaatactatgtcatggaggtagatataaaagcaaaacaaaaaatcaaaataaaacaaacaaattttaaaaaattaaacagtatcgtctgtggaaattttgaggaaataaagggggtgcccatgcctttcaatctgcttactggggtaatgtatactattggaccagatttattttgaagagcaggatcccaaagccctacaacttagggagataaaattggtcttgcggggaagatataggacatccagggagaacttcacgtttgccactcttaatcaagattaaatttctggaataaatatttatatgacagaaatttgttggaatagatggtttgaaagattttagtccttacaatgtaatatttgtaaagttgaaggcatatttctaaattcaatatgcaaactattgaaaagatcaatgtttttctctagctctacaatgtttttttgaaatgatgaaaaggccacataaaagtagcatgatgtcttaatatattaccatcaagtaatatttttcttcatcactgacatggctttttccatgcagaaatcacatttgtaagtataatgtttaatatgtagtcctttaaaataaactctacattgttataatgtttaatatgtagtcctttaaaataaactctacattgtatttctttgattgactttcaaaaaatatacttgctgatgaagcctaccaaagattgataatagaccacaggaaaaaaattgaatatgcatttgcttatggtttcaattttaagcttaatccaaagagtaattcaatttcaaatgttctcatttcagaatatgagctcattttgtgtgccacaggtaaatttccctaatcatatttgtgtggccatatatacttttattatttctgaaaaattgcaagtagaaatatgattctataataaatttcattaatttatatctttgaatagaaaataaaagagaaacaattgtattagccgtaggaatagagaaaaccttttttctataatgatattatataaaggttatgaatcatccctaaatataattttaaggtcttttttagacaaaattttagattccttgaaaattaaatgaaaagcattagtgtaatagcaatagatttcagcatgttctttcattcatggctgtctttcttgacaatttcagtaaaaatttctccctaatttcacaaatatggtatttactggctgacaggggaggatgggcaggctcaggaattgtcccaaggtgaggtttgctctcctccatagttccacatttaaggcaaatgtcttagcacagatcactcctgtgtatttctactactagattgtgcaagcatgtacaaatagccattcatatgtaaaatgcaacacaaaatggatcagtcatacatttttctcatgatctgctcaaatttcatgatttgttcaaatggtagacctgttcacatatgagatagggttgaggctaatatgagagaaatagccgagaaaaaagaagataagttatatgggcaaacatgggaggtctgaaaagtctaaaaaggctctaatgaagaggcctatgccagatgcaaaaaagcagaagaaagtagaagcagaaaaaatgttttttaaaaaatagtagatcctggccagatgccatggctcacacctgtaatcccagcactttgggaggctgaggcaggaggattgctgcttcaagtctgagagtttaagagtttgagagtagagatagatagatagataataggcctggacacggtggctaacgcctgtaatcccaacaatttgggaggctgaactagatggattacttgaggtcaggagttggagtccagcctggccagcatggtgaaatcctgtctctactaaaaatacaaaaattaaccaggcatggtggtgcacacctgtagtcccagctactcaggaggctgaggcaggagaatcccttgaacccaggagactgaggttgcagtgagctgagatcgtggcactgcactccagcctggggcgagaacaagactctgtctcaatttaaaaaaaaaaaaagatagatagatagtaggtggttatatgtatattatattcagatcttttttgtgctattataaaactgtgaacaaagagacctaccttatgtttcatagataactctttaatgctatatctcaaaatcacaactaccttattatcattacaaaaaccaaacaaaagacatggcagaaagcccacacctaaatgggcaggtagcattgaaatgtatgcaaaaacagagtgttagtagtgaactgaaataaatttaaaaggtccctcttgacagcctatttgcatccaaaagctctttaaagacagaccataatttttttctttttaaaaaaatatttcatagcatcaattgtagaaactggttcatcagtagaaactcaattaattattcttatttatatatattatttatgcagatgagactgaaacttttcacaatttcttcatattttaatatactaaatcctctacaaggcctctatactggaatactgtatccacatcctcatcctctacctgcctgttcctggttcctcggacaacctcacttttagaggtgatttccacccattcattatgctgttcaattgcaacaggatggccagagcttctggcagctcactgtcaaaaaaccctgcccacctttttttgcttccatgaagaaaaatatgtagatttcactgtgaagtctagttcttcccatgctcttgccagttttcctacaagaaaattttctacagactgtccatgaataaactataaccataataggacccaatacagcaagcacatgcaagtagaataaccttatattcacgaaaccgatggtatgctgttcacttggaataaaatattgagaaggatatgtggtagaaagtcctccacaaatcataatattgtgttgtacatatatatttggtgattagaaaattccactggcatcaatatcattgtgttggtagataacaatgattttctgtttcatattttctggagtctcatgtgtcatatcaacacagaaacaaaaagtttagtaaaaaataaaatactaaaaaatgatttctgaatacctaaaatagtttacacatgtattccacaccaatgccttctgatagattctaatggctttaatgattaaacagaaaccatatgagagtcctaagaagagaaaacatatatttttatgtaatagacacaacttaaataatacctcttcaactggaagacaattggtacaaaaggatattattcaatttggaaacttgcccccaaaaagagccaccctagaggaaaaatttaaaatacgattgatgagattttactttttcccatgcttcctcaagaatccaagttttttgttttctcctacccaggaaaaatggagaatatctgaaggatactgaattttagataagctgaaacagaattaatcactacagttacttatcatataatgatgatttgatgaaagaaatgctaccggggtggcaggtgctctatttctactaatagacattaacaaaaaagaagcattacctttagtgatgcaagattacatatcagcctatgttaaaacactacacatttattttccaattgttaatatcattgatctgatttatagtattaggcagccacttcatgtcaattaatctcctagaaaacccaatcaagataaggcaacattctgtacaaattatcattactagtgaaactgaaggaatcttccacgtttaatcaacaatgagaactatgattcatcctttaactttctccccagataaaataatgttatagattcattcttgcaattaatccctgccttggaaatatgctttagaaatggtaaatttagaaattttaaaccaaagattctccacacatgaaatccagagttgattttgtaaacaggcagtcatcagtggaatattattgaaaaattcaacattttctgacaattatgaaattacaatgtctctgaatctacgattatttattgagaaaatatcgtttgccaaatcattgtttctgtgaccattatattggtcttactttaactagtaaatataacatttgttttattcaaccatttttccaaatcaaacatccgtttgaagtccatcttaaaactttccagaactgataaaaaaaatacatattcttgaattcaaatacagtgcaagttatcttgtaatgatttattaacattaaagaaaacataagaaaagaggtatagccctttttgtctagttaacattaacttatgaaggtacaatttatattaaacaaaatgcagagatcttaaatattcagtatgttgagttttgacaatttcatgaacccatgtaatgaacacctacacaaaaaatataatatttttatcacactgtaaaatttcctaatatccctgtacagactatcttgtcagatgcagctgcttttgacttcaatcaaaattgcttagttttgcctgttcttggacttcaatagagtgtgtaccctttcctatctggcttcttttgctcaacttaatgttttttttgtttgtccttggtccatctattttattctgtttcattaatgtttttcagattccctttaacataatatggttttcatacctgtgttaaaaatcttgatttcattaaaaatcttgattccattttttatcacaaagactagatgattaatattaagggttactttctctgaataaataatagacaaattcatgtagataagtgtatttaaaataaaaaaagaattattactgttacagagaatgataaataactctatctttactaaaaactgaggagcaattaagcttaagttgaatatacatatgagcttatttatttatttatctatttatttatttttgagatgacgagtttcgctcttgttggccaggctggagtgcaatggcacaatctcggctcaccgcaacctccacctcctgggttcaagcaattctcctgcctcagcctcccaagtagctgggattacaggcatgcgccaccacgcctggctaattttgtgtttttagtagagacgtggtttctccatgttggacaggctagtctcaaactcccgacctcaggtgatccgcctgcctcggccttccaaagtgctgggattacaagcaaaagccactgtgcccggcccatatgagcttagaagttgttgaatatttgaatacttgaatgttgtaaaacagctaaaaaattgattcccacgtacatgcttaaagtaaaaagaaatgtattaatatgtgcttctttcacttcctttaatctccttatctctttctcttttttaactgtttcctgattctcagagagaatgtgcccatcctatggaagagaaaaatggggacaagtaagaggaactagagattagtcttacttctttctttaactttagattaagtgccagtactgcatattcaaagaaattccataaatggggatgctcctgaaggcccagtgatttttattccttgaaaagttgaagatatcgagttttgaactccatgatccatgtttctaaaccataatttatttcatattaaaaaatcacttaattatacctagaaattgtaaacaaaacacacaaaatatgtaaaaaaggatattcaactctataaggaatgtcagtgttatgcttctcatgaatactgtctgtgcttttagatttaccagaataattctgataaaaacagatgttcaaaatatatgtattaaatggaaggagatgatataaccacaatgaaatgtaaaagaatagcataaaactatgagaaatggatttggaaagcaaaaactcaaattagatagattcagaggtaatgttaatttcaccacaaagctgaagtctcaataatgttccactaattactgcctgtttataagtgtatctctacactttcatgtgtggagaaactcttggttttcaaatctgtcactatttccaaagcgtatttccaaaacaggaggattgcaaaaaaaaaaaaaaaaaaaaaaaaaatggctaaaacctgcactaagtattttaaaagtatcacctcctttaatcctcaatacaagtttatatcattatttattttgttatcatacttattttatggttacaaaattataggcttagaaagcttctgcctgatgttattattctaatacttggtgaataatctgaaatgatataatttagattatgtatctcattaaagataatttattttgggcccctaagaaaaatgttttgggttattttacagaaggagaaataaattcaacttaattataaaatatctcaaataatatatggcacagtgtcttgtttaaaagtattcattcttaaacactgtgcaatatgttatttgagaaatgttagaattcactattaatgaacttctgaaaaaatgagaaataaacaggaaaacaaaatgtggcacataacagaacccaagattcacagacaatctgaaaccatataatttagattatgtattaaagataaattattttgggccctaagaaaaatattttgggttattttacaaaaggagacataaaatcaaattagccagtacctgcattttaggaaactcttcttcaaataattattactgtcagaaaaaaattggttctcagcaagcaaattatttaataaatttccaaattcaccatgatttcagtgtgcaaacctttacattagtaatcaaatctctattgctagaacatgcctaaaccattgaaaagcattcaataagcgctcaaggagcaaagagaagaagaaatatagccaaccacagtaatttacactttcctcaattatatttcaaaaaataatatttcaacaatcactaataaaaatggtgggtaaaagttcaatgagaaacaggatagttacagtcttaacctagttccccacaatatagctttaatacttattaagtattaagtacaaaattactggtaaatacagaagggaaagctggaagacactgttttgtcaaagtgataaaagccatcactaccaataatgaaacagatacattgtgtgtcttttgtgttacatgctatgataaaaacagtatcatttttgaaacattcatgcacaaagtctacgaatcatgagaaaatatcaggtgaattaaaatttagagacattttatacactcctctggtcctgaaaaatattaaggtcatgaaagtcaaggaagtattgtggaaatgctaaaattgagactaaaaaaattgaaaactaaacttggttttaggaaatacacaataaagtagtaagggctgaagaagtttcatattttcaacttaattttcattagtataaaatagttatgtatttatatatgacatatagtatacattatatataattacatggtatatatacacttaatgtatgacatacttatatatacatataatatatgctgtatatttatcatacacacaaaaatctacctctatgtgactatttatcaattagtaagaggaaagaaatattgtctgaccagtgagtctcaatactgtcaaggtcatcaaaaacaaaaaaaaagcaaaaactatcacagtttagaggagactgaagaaacatggtaaataaaagtaattgttattctgtatggggacctggaatcaaacaggacattaggtaaaaagcttatccaccatgatcaagtgggattcatccccgggatgcaaggctggttcaatatacacaaatcaataaatgtaatcccccatataaacagaaccaaagacaaacaccacatgattatctcaatagatgcagaaaaggcctttgacaaaattcaacaacccttcatgctaaaaaatctcaataaattaggtattgatgggacttatctcaaaataataagagctatcaatgacaaacccacagccaatatcatactgaatgggcaaaaactggaagcattccctttgaaaatgggcacaagacagggatgccctctctcaccactcctattcaacatagtgttggaagttctggccagggcagttaggcaggagaaggaaataaagggtattcaattaggaaaagaggaagtcaaattgtccctgtttgcagatgatgacatgactgtatatctgaaaaccccactgtctcagcccaaaatctccttaagctgataagcaaattcagcaaagtctcaggatacaaaatcaatgtacaaaaatcacaagcattcttatacaccaataacagacaaatagagagccaaatcatgagtgatctcccattcacaactgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctatgaatgactttcttcacagaattggaaaaaactactttaaagttcatatgacaccaaaaaagagcctgcatcgccaagtcaatcctaagccaaaaccacaaagctggaggcatcacgctacctgacttcaaagtatactacaaggctacagtaaccaaaacagcatggtactggtaccaaaacagagatatagatcaatggaacagaacagagccctcagaaataacaccacatatctacaactatctgatctttgacaaacctgacaaaaacaagaaatggggaaaggattccctatttaataaatggtgctgggaaaactggctagccatatggagaaagctgaaactggatcccttccttacaccttatacaaaaattaattcaagatggattaaagacttaaacattagaccttaaacgataaaaaaccctagaagaaaacctaggcattaccattcaggacataggcgtgggcaaggacttcatgtctaaaacaccaaaagcaatggcaacaaaagctaaaattgacaaatgggatctaattaaactaaagagcttctgcacagcaaaagaaactaccatcagagtgaacaggcaacctacaaaatgggagaaagttttcgcaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaatgctcaccatcactggctatcagagaaatgcaactcaaaaccacaatgagataccatctcacacaagttagaatggcaatcattaaaagtcagggaacaacaaatgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactagaaatcatgctgctgtaaagacacatgcacatgtatgtttactgcagcactattcacaatagcaaagacttggaaccaacccaaatgtccaacagtgatagactggattaagaaaatgtggcacatatacaccatggaatactatgcagccataaaaaatgatgagttcatgtcctttgtagggacatggatgaaactggaaatcatcattctcagtaaactattgcaagaacaaaaaaccaaacaccgcatattctcattcataggtgggaattgaacaatgagaacacatggacacaggaaggggaacatcacactctggggactgttgtggggtggggggagggggagggatagcattaggagatatacctaatgctaaatgacgagttaatgggtgcagcacaccagcatggcacatgtgtacatatgtaactaacctgcacattgtgcacatgtaccctaaaacttaaagtataataaaaacaaaaaacaaaacacagggaattaaaaatgaataaatttggttctctatatatgtacatagtgctctaactttttaaagcttaaataaacctttaaaaaactaaaaaaaaacaaaaactaaaaccatctgaataagctatgaatttgaattaataatgtaccaatgttggtttattagttgttacaaaaaatgtactatattaatttaagaagttaacaatcagggaactgtatatgggacatatgagaactgtacacttctattaaaatatcacttaggtctaaattgttctcatattatttaaataaataatgtaaaatatagttgtaaatagaccatttccattaccattttcattataacaaagctcaagacttgaatatatcatttaatataagaaaaataatgtttaaatgtaatatagctttacttctattacatttaatttttataaatataatgcacattgaaccaattatttgtcaacaaatttaataagatatacttatagaatgaaacagagtaaacagagaggaagagatagattttcatgtttttctgtgctttcatttggctgaagtttggttttttgtgtgtctgctaattgataaaatcattaaaaatgtttttagtcattcctttaaaatttcaaagaaaagctaaaatatttaaaaactcattgtttaaaattaagagctaattgatgcagtaggtattgatgaaagatatgattatgtcatgttaggagaaacaagcataataatatttaaaataaattaatatgcaattactaattaaatcagcatgtaataccaggtaagaagaaatactgaaactggtctaatcatcccacagaactgatgtttatgttttcgtctgaataaacctagaaactgatgctcccagttctgaaacttgcaaaagttacatttgccctgtctgagttcctttcccaggaaaccaaccattagacctcccaggtagtatcaaggaactggagtttgccagatcgccacatcaggaaaatgagatgccagaccgcttacctgtcttgattgtctaaccaaccacctgcttcctattgaccttcatttcccctccctaattcccattttcccacatatgattacttttcttccctgctatataaaccggcaattttagtcagccaaagaaatgaatttgaggctaatctcccatctttttggctgaagcacctgattaaatccttcttttctggcaatgtttgttgcctcagtgattggctttctgtgtggtgagcggcaggacctagaccaaagccctggcattttggtaaaaattacctctatggtgagctaactattatgcatgtagttgggcagggtgttcatcttcatgggtcccatttcattaccttttagagttttttcataaatttgtgggattctatagaaaagttattaaaggttatatattcagtcaattataactttttataaccatataatcacatctgctttttcagccattgaattttgatcctacatcatcatcatcatcctatcattctattcttcatcctatagctattattttgtaagtaaggtcttttacagtgtcccctcatgatcaattaaagggcattttctggttgctactcttacaaagtttgaatagaataaaaatcagaacttgtgttgatttgaattgacaaatttatcatagggaaagtgcccatctgtgaatagaatgaagtttaaaagtatgtttattagtcttgctgttatatgggatttagcattcttcattttgtttggttataccactatgttaaccatttatttttcttatttcaaaaatataactagaaatataattagaattgacatgacatacagttattccataaaagaaggtggtaaaaacaaaaatacagttgtcccttgccatagccagattattagttctaggattcatgtatataccaaaatctgcacatactcaggtccctaattgaccctgtaaaacccacagaggtttcacatccatgaatattgtatttccatctatgcttagttgaaaaactgcatgtacaagtggaccctcacagttaaaattcgtgttgtccaagggtcaactgtaaagtttaataaaatatttcctcaaaaagaaatgcttcatggtgaaaataggtgtattttacttttagaataatattttaggaatcatgattggatgaaagcagaaactgctggatataattagaaagctcattgtcatcatcgttcctaccattcaatgagtgttatctattcattgcatgcacccagcaccataggtctcatgttacattctctgtatcctttaacctttaataactaccctaaaagtattatagttttttttaattgagaaaactaagtccattagaaattaattaattttccattattatacaggtaggaagtggtcatcctaaaactgaaacctatgctgtgtgactcaatagattattcccttttctcataacactgaaccttgaacatgattattttactaaactgaatcaagtgcaacttttctgaaattagtattaatatttattcatattaatggtcttacactctacactttcagattttaagactcgggaaataaatatgaattttcaaaatcgcatggaattttctctatgtactcaagccctatcagtctcttgcctaatgtatgtatacaatatggtgagcaagtgctcagttttggagtgagaatgttttggttactgacttagattggctacttatcagcagtgagatcttgagcaaattcattaatgcttccctatttctacactttctcatctgtaaaatgaaaacaatgaacacacaaagtttgagtctgtgggcagctatctataagtactaagtaagttatttcatggaaaacacttagaatttgcttggcacacaatgcaattaataaatggtaactcaatggtaattattataattcacttattattgtaaaatacctttatttcattcaaagtcaggaggtatgatatcagaaatgtggtaaacatatctatgcagtattcttattatgaacaaatttggataagaacaaatttaaaattggtctagtatgaaattagttcctaatgagtatgcctaatgacaaaaggagtaagaaaaataaacattaaaattattataaatctaaagtttgaagacatttaacctggtaagcaggacataattttctatatacttgttatgtcaatatttaccaaaaaacttgattctttcagaaactcaaggttatttaaactgctaatactcaccttcctaaattgtgaatggcattttaaatgtaaatttatgaagcatcctttaaaatttcatgttattaatactgaaagaaacagaacttgattaaacacaaattcattaagctgactgtgaagcacttgggaccctttgcgttgatccttatagagccgtgcgtctagaaaaacctttcaacgaaaagaaaaggtacatttggtcaaaggggaatcatattaatgttgcttaatcaatgagtttagtatttccgggacatgaaaagtagggtaaaaaaatctcaagtggcatgacagtcatataatgaataaatacataatttctctctaatgttttataaatagaccgtaattcatatagttcatatttatcaagttttaaaaagtgttttttgttgttcttgtcattattcttgttttaatctatgtaatttattataataatctggaaaggttatactcgtttctttaaaaaatttactctatatgagcttcttcataaatttaactcaaagcaaactcttgctttctatctcaggaacatcagcgtagaaatatatatgttataggatatttttctgtatgataactgtgccattcctaatttaatgataaacctacttatagtacttctgtaatgtgccaggcactgttctactcaatgaaaaacaaagtgccagctttaatgcagattcaattttaaaggggtagatatcataacaaaaagcaaatacatatgcagtattgttgcagataagtggtataaagataaccagcttcagatagtctgttacaagagtcataaaatatgcaggtcatttatcatacatggaaaagttgtggggcttttttctttctattttaaaatttattatgtgtcttcattgaaccttgtgaggcaaaaattctaatactaccattttcgttttcaggtgagaaatctgaagtacagaacaaattaaatgaaatgtttttaagaaagacaaatgaaactaacaaatggtaatccagcaccagcatcactgtatatttgtattgtcagcagatttagctactatggaaaatctttgaagaatctttctcaacatgatttttgatatacacatgctctaatttattgtgggtatattcaacagagtagaattgctgagtcatagggtgtctgcctgttcagtttttgttgacactacaaaataactaatgtaattgtgccaatttacttatctaccaacaatgtatgaaagttgtgattatccatatctctaccaaaacatgagagtatattttctttcaattcaaagtgtaattgaacttaaaataaataaatataattaaaactccattttggtaggtattataatccatggatggattacttttaaaaatttcattttttatttgttgctgatgtataaaatttatttcttttaaaaaatattggacggtcacagtggctcatgcctgtaatctcagcactttgggaggctgaggcaggcggatcacctgaggtcaggagttcgagaccagcctgaccaacatggagaaaacccatctctactaaaaatacaaaattagctgggtgtggtggcgcatgcctgtaattccagctactcgggaggctgaggcaggagaatcgcttgaaccctggaggcagaggttgtgctgagccaagatcgtgccattgcactccagcctgggcaaaaaagagcaaaactctgaaaaaaaaaaaaaaaattgaccttgtctgcagtaaacttgctgaactcactttttaactgtaattttttttttctgtaaatactgttgggtagttctatatataataatgccatttgtaagtatttaatttaatgccattttccaactataaggagcatttctagtttgtatttattgattttaagctcaattgtttgatgattagaaaacacattctgtataattttagccatgtgggggacatgttgatacatccgtgaaaacccagcatttggtaaattattttatatgttccatccatgtgcctgaaaagaataaacttcatagttgttggatacatcattttaaaatacatcaggtcaatttcgctgatttcaatgttcaaatcttatgtttccttgcttttttttctttacttattttgacagttactgagataacttttgcattagttttctattgctgtcataaaaattatcataaattttgtggcttaaattaatataatttactctcacacagtttggtcagtcagaagtcagagatagctctcaccaagctaaaatcaaaatgtctgtagcactgcatttctgtagactctgaaaatgaattcacttccaagctcattcagattattggctgtatttatttatttttatgttggtagctgtcgactggggttccttcaagagtattcttgcattttcaggctatattatagctccactggtgttcaaaaccagcaatagtggctaagtccttctaagtcttagattgtctttgatctccccttatgcctcatcttatccagttcctcttcccttgcctctctctgactctagccagagaaaattctttccttttaagggctcacactgagattgggcctaccagagtaatccaggataatctccctattaacttccataaccttaatcgcatctgcaaagctatttttgccaggtaagtgtacagatatctttgggaggctttaattcaaattatatgacctcccaaacatcaattttctaatttctaaaacagggatattccttccttgtaaagctactgtgaggactaaataagataatgtgcataaaaagagcttaccacagtgctcataatatagatatagctccataaacaatacattttaatttattttaatatactataggtaacccatgctttagaggtttttatagttccttcctgtctgcctcaggatggtaaaaataaataaatattgactgaaaaattttctctcaatgaaaagatcattaaaaaccagacatatataagctctatattaacttgagataaattcttcacatgaccaagaaaacattatgtctgccttgacttgctcttgtttacttacatcaaaataaattttggggggtgagatgaacctcaaaaacctgccatcactgtcgagaaagatttgtctccaaaacttgcataagaatgatcagcaactgtgtaattttttcttgaaaccaggcaaactatttacttaatgatacaattgtttaaagctaattgagtcttcacttaaagagagaaaactacttcaatgtcttatgtcttgctcatgagaaagacatttgaaaccttgttataacccgtgttcaacatgtagatagaggaattaataatgttttggtgaattcttgacaaactaatagaagaacatgtttacgaagagcgtaagagggtagcatttaatgcatttataaaagtgctgattgtgattatgatataataccataaatgtaaatcatatttatttgtaaaataaggtacatgaaagtagttataatttagaatactagaatgtttattgataagtagtgaggggatgattgacctaaggacttgagttttattcccaacttcgtggtcaattttgtaaccatcaatttatactactgctccagttctcagttttctcatggtgaataaaaagagtgactaatcaggactttaattttggaagcttcttttataaatctgtgataatgactttattatacctgtcttttgtattttaatgaagtgtgaaatattttgacattaacaatctattaaactgtgaacgatttttttggaaaaacatttagatctttcttaattgcataaacttcatgtcttatactaaaaggacaaatagtatgaaaaataccttgcaatcttgcacagaataaaactcatttcatttaattttattacaaacacagcattgtagatgggcaagatagggatatctatttatacacatacacatatatagtatgtatgtatctaattttaatgtatcttcctaatacataattcataatagataaaattcatgtcaactaaaccaatagataattcataatttataattcattggactaaactaagtactagtactatggaagaactattcaaatgaaaaatgagaataatagctaaatttctattttttttttgatgctatttcaagctttaaatgcactgttttttttttcaagaaagtaaatataaagagtatgggcaaaatcaaaggtgaaaaatatgaccatcaagtacacacatttgatattatcaaaccatagaagatatgaccatagtgtcaatgggataggatgacctcagttatctaaaaggaaatgcattgtgagaaacttaccagttcaacaatgtattgacagctttgcacagtaatatagcttctcaaaataatgtttaagatcaaatctttacctttcctataaattttatcactctgatgtttaggagtttagggtttgaagaaattgaagatcaatacatgtaaatattgattatttcataaaaataaatcaagtaaaagagatgaacaaaattttgagacttgcatggtagggaggatcttattctaggcaaaatgaacagtgtgagcaaaggctaagaaagggagatatttatgagatgtgagagagttaatctgaacaggataaggcattatcagggagaatttgagaatgttcagaatacattgacaaatggtcagattatggaaaagcttgaaggtctgccagaagaagtgaccttttgacacccgacaataatgagaaattgcaaaacttttgaaaagtagagttgcatgattaaaatgatatttgagaagttactgtttaacaagacactgaaaagattagagagggaagtggaaacagtcaaatcacataggatgctttgaacttcaaattgaacattataaatttctgaaagaaggatgaactatgaagagggatccaggggcagttagtgacatggatgaggctggaaaccgtcattctcagcaaactaacaagaacagaaaaccaaacaccacatgtcctcactcataagtgggagttgaacaatgagaacacctggacacagggaggaaaacatcacacaccggggcctgttgggggagtgagggggtaggagagggatagcattaggagaaatacctaatgtagatgatgggttgatgggtgcagcaaaccaccatggcacgtgtatacctatgtaacaaacctgcacattctgcacatgtatcccagaactaacatatatatatatgtgtatatatgtgtgtatatatatacatatatatatatagattctgtaagtagatttgttgcctaagataattcacctatcactttataccaaaaataaagttagcactcaaccgaacaaagcaaatgtaactcaaagggtgtatttcaaaataagatcatttatatataattaaaactagttacttggaaattaattagtatctgtcattacagtagaaactcattaaacaaaagtgactcaaagaggtgaagcatttatcgaccagtaattcgtcttgttaaatttaaataggagtttgtattttgtttttaagttatataatttagaaagtctcagattacaaggaacataatttcttcaaactttcatgaacacaagaatgttgaaataactaaaaaatatttttagtaacttcaaaaagaatctagaggttaaaggcccaaatgatctgtttaattcacaaattacagttattctcctgtaaagcaggcatgcaaatttttaagattaaaaaaaaatcttgaaatgaaaagatggtctggtaaaatatgtactatcacattaatgtcattcattttttcatgtgtctaacatacacataataggtcacattagaggtactctagaaatattttgtagcttaattaactaaaaataattaatacagtaaccacggtttaaaaaaaaataaaagtggttcttcacttatgcactttagccaaaagagaaaataaaacaaagcaaaacaacaaacaagcatgtccttaaaaagttacaatactactttttaaatataatttttctaatttgatcagcatttttctataagaattcggttgtgatttgtagttaatttttggatatttcagaacttgattttaaaatccagaaaataactttacatttatagaaccgcagacattttcttccagtatttaattagtatgaccacctcagaaatacaaaggcaatgtatttgtattagataaatgccttaggataataataataactcgtgttatgcctaagtaagcatgtagatggatctaggcaataaattttcaaagatgatgaaaaataaaatatctattattataaatacattatttttcccatagttaaatgaattcctaaaataacatcggaagtcacatacttcttctgagtactatttttttaatgttttcttgatatttctaaacagttaagctcataattttaaaggaatcatttataaacatttattgtatatagttagatacatatatcaacagaaaggacagagagagagtaaatagaaactgacctcattcactgtggcatagtagctttcatgcttgaaagtgggtgagttgtcattcctgtctctcaccactattcgcacttcatggtagataatagtgcccacttttttgttgatgcactggacctgcaccacaatggagtgtatgttcatcggtggctgcaatgtagaaattgcatcttttaaaatactaattaaaaacaaagcttctcatcactgtcaaagcactcgttcattcagtacatttttctattcttgtttatttttaaattataataatctcaaagaaaatgatcattttaaggacaagagaagacaatcataattaatttattgtttaattttgtatctcagcgtgtggaattcaggtagcattatgctcacagttagtggatggctaatgagcgcacccacaaaattaatgcttagaattgatgggattaaacgaagtttgcccctccaaagattaaagaagcaataatataaacttttaatttgaagaaagtgttaattaataaattcctggagaagagagattgtttaacttttatgtttatttatatttttgctggaatattatatgttcattgctgatcaaattaaaaatactgattaccaaaagagaaaatccaaaagccagccaactaaacttactcattctacacatttaaatgcttattttgctaatctttttcactctctaaatatgtacatattatagacacacagacacacagtgaatatcagcccatgtttataaatatagatttactatagcattttttgtataatactatgaagttatgttatgtgacagcaatattatacttcattgtaagcctatagcataatgtatccaagtaataatttaaaatgaactactccaggctattatattttgtcattataaaaaatacttcaatacatagtatacataagcatatgcttacttatctaataatttttataataaattccttgaacgggaaaggtcaaagatatacttcctcaagtgccatggctaacagtttgcagagctggaatgcacacctacaaatatttgactctagagtcagagtattgaccactacaaagtatttctttgtgatttttaaccccttttgagcttatgcaactttatctctaaatatgtcatttttgcagtgtcctatcctgacccctccatcttaaaaaccttgtctccaacctgacatctcctttcaaatttcttccaatttatttttctttattgcatttctcaccgaaaatttggctcgttgtatattttatgtacttgttttggtttgtctgccttcactagactggaagctcaatacaacctgtgtgttattttagtcatgatagtatccctctttccagtaaccagccctatgcctaagacagatgatctggagtcaaactgcatggcttccagttccataacctactaactgtatgatccaggaaaaagtacaaagtatctctatgcttcgtttattcatctataaaattaaggctaatagttacaccaatgagaattgtaaatactgcatgtgattagactatactaggcatatgttaaacacctaagggattacatacatatcctattttatttattaaaaaataaatatccaaaatagtgaaaaaataaaatctataatgcacgacacatttgtaaatgagaaaaatgctacagaaactatatctaagctgaaggaaatcattatttagtttcaagatatttttatggccaacaaagaaaaagaaagttgacttgaatttgtagctgtctgaatgatgctacctagaaagaataaattgaggcatcattgacatacgaaaagaggtctctagtgaaatcacacatagctctgtgtttttatatctactctatttctcctttaatcactgatataaatgaaggcattaaaatcatgtgtataaaatctgtgaatgttacaaaccttggaaggatgtataaatacatttaatgacaaaagacatggttcaaagtcatcttaataagtcataataatgggttacaaaatggtaaatttttgcaataataaattttatcctccaatttgtaatagaaaaaaaatcacccaaatgtaatagacagctacaaacattaatgtaaaaatgtaattgtgaaattttgatagctaaaagctgattttacatgacagcactgtaaatgggctactggaacactaatgcatactgtacattaattaataatatcagataataatatataggtagattataacaggtaccattttacaggtgcatagaagagaaatttgaacacttttgagaatgtataaaatgggaggattttaaatttaacaacatatgatttgtcaaatatctaaatggttgtcatggaaacatccattagttgacttactgtagtttcagagagcagaaataagaaaaatagttgaaaaatatttcaaagcatgttttcaccataagtagagggcttctcttaatccaaatttgcaccaaataattatgtgcctctatcaaagtatctcatgtaactcatatgcacctactatatacccataaaagtttttaaaaaataacaaatagagcagagattcttatcagtagaagagtatagtttatgttagaaataaatttatgccttcgcacttccaaatacttttcctctgccattatgagctaaaatatttgtgatgcttcaatttctttttttcacatttgtctttgtataaaataaagaaaaatcaggaggaaaaagtgacatggaatagaacagactattctataaaacaagacccatcactgaaatatgccagtttgaggataaaagaccattgaaaaagactagctcttagaagtttcctggaaagaatttgaattagatgacctccatttttactaccagctttcaagtgtgtaatagaccttttaaggcatgtccagcatattttaattgtaaattaaaaacaaaataaatatgtgtactgtttgtccttggcacacctcttggaagacaatgaggtgaattatgcacttttaaagttatttatcttccaattattgcaagagagacctataaaaacattctatctcaacttctaattctacttggagtggtaccactgggaccaaaaggtcaaaatcttatcaaatagaggatcaaatgcactgtgtactgaggcctcacttagtcctgctaagtacccataaattagatctaaccaggtcacctggaacagttatcactctcaactttagctccctatgcaactgttagtggcatggctagaacttagagggcaataaattataaccataatggatcacaccgaaggcaaaaattccctgtggctaatatataacacacaatgtaattttgtattggcatagattcaattctgctgtataagaaggtcatacataaaagtacagttctaataagtccattagtgagagtttagggactctaagatgcttaagaatgcattagggaaattttgctttatctttcataactggtggcaaaaataagccatggtaatttgaccttttctaattttctttaattgctttattcatcaaacaaagaagaaaaaaaagctaggtagaaattgtgttcatataactatttaaaactattaccattcatatatacctaaacatgcaagctattctttcaatttaaaaatgagtgcttaacacaatactctgaacgtatacttgcacatttgtgtattagtgtacctgtgtataggttatgatatgtgtatcaggaatgatatatatcaacaattaaaggatactatcattaaaaagtgggtttgagagtatgaagagaaaaaattttcccacaaaaatgtaaaaattttgtaactctgaaaaagaaaaaaatataaaatagaaatttttgttatgaatttctcaatcatttaggattcaacatgaaaattaaagtttttataggggatttgttgatattagcagtttagattatagcacaaatcttcaatccaatatattttttttctagaaaccaaatgatttggaagtcaatgatttggggggcagggaatgcatttttggcaaatctgtaggaatttatttttcataaagtataggcaaagtttgtctaattctcaggagtgaattttttttgtcatgatatttctgtctatggacttaccacctttataacataatcattcctatttcacaagtaatgtggaagacagtgaaaggaaataagacactgtgtgttttagaaacgacttttacataaaaaagcaaacttaaaggaaatggctggccagagttgtcagtgtccttcacaaattaaattttcacaatgaatagtagcatatttactgaagatattacctaaaaagaaaatatcaatttgtaaatacaattatgcatatgtgacatgtagatacatctatagatttttcacagtgaattattaaggacattcagtctatttaatggtaggtatttgttatatgaaaagtttaatgtgggttaggattaatatgacttagtccttggatactaatagcaacttttataaaactgatatgaggtgatcataaataaagtcagtcaaaaatactattaaataatatggattttagaacaaggaattgcataccagtgttattagaaaataatttatacagaagcagcatttaagatatctcttagtagcacataaaattcaactgatagcactggataacagtgatttcaaagtttatgttcaaaagaacatcagggaaggtatggtaagaaaaaattggatatggtcatgggacaataattacattagttttcttagtttgtagttcatacatttctaaataaaaagaaaattatatagacagggtgcatcttgaatctagcaaaactcaagagacagatagaaaacagtttgcaatgaaaaggtatctgtgggcacagtctctgtttcagcactctggttgtagaataggttgaatcaagacaggtggtagacaacaattagtttatatgagtgatgactaagaggtcttatactaaagttatgttgactgatggagatgcaagatacaaggtggagataaaactactaaacttagcagttgaatggacactggcctgggcaggggagtcaagccccttttgcagctaccaagttagagtctgaaagaaaagaagctaagatatttgatgttgttatgaacataatttctctcgtttcaaaagcttttaaaattttgcccaggattttgagataagtattataggactgtaccagagtcatacttttctttctgttattattttaattattgatattgtcatgaccattattatcacatgcccaatagtgatgagagcattttggccatgtgagacaatcatttagcatttcaaaatttttatgtgatgtgcctttattactgagactcttcatgttcaccccaaatatcacattctggttgtttctcttttgtgacttttaattttgtaactcttcctttctttttttaatttttgggtgctgaaaatttatgtaactttagtgaacaaaaaaataaaaataagacataaaaataaatgatgaccataagggaaaatcttataaaccaagttttaaaattataaaacagttcatagtcatacaatctcatgtaaatgctttctaattaaatacaaatatctgagcgttgggtatttttattctttatattcttcctcggaaattttcatgaagatcatgtttatcagcttatttttaacacactgttaaaaatgtttctgtctatattgtttgcttttaattctattacagccataattattcaaacgtccccattaagagacagtttattgcctcaatgagaaaatgtagaaaacatgatttgcatcactttctctggaaaataaatttttctctaactgttgctaaaaagatggtataattggatatggatctaccatgtggccctactccttgctccctggctatagattcaaaccagtgagtatttaattgttatttctctcagaaattttaaaacaaaacaaaacacagtgactttaagccttctttaatggccactgcatcaaaagtttatgaagaactggcatggcatgaacacagaaaacacttaaagtcaaatgaaaaacaaggaagtggagtaaaattataagtgtataaaggaatctgctctgcagagagaaaaatagagaatatgcacagagaaaggcagaaactagagaccatatggtccaagaccaagtagttttcctctctccctggtaaacatacaatttccataaaagtaaattattttttatatctatgctattggtattgttaatattctctcccatcagctggaaatcatttgaaggcattgttgtgtcttccttataagccaaataactttgattaaaatcagaatattcttagaaaagcataatttcataacaaaaattcagtggaaaattttctataaaaataatttcaagagcaatttaccactaagaagggttaaagttaattataggctagtgattataatacaaagctttcgccattgttagtaggatcaaactcaaattgttggttctattttgatattcagagcatatatatatatatttgaaatggaatatatatatataatatataaataaaaatatatttttgaaatggaatatatatatataatatataaataaaaatatatttttgaaacggaatatatatatatatataattttttttctttttgagacggagtcacactctgtcacacaggctggagtgcagtggtgtgatcttggttcactgcaacctccgcctcctgggatcaagtgattcttctgcctcagcctctacagtagctgggattacagggtacctgccacaatgcctggataagttttggactttagtacagacgggttttcaccgtgttggccaggctggtcttgaactcctgacctcaagtgattaactggccttggcctcccaaagtgctgggattacaggcatgagccatcacacccagcccatattttttattttgattcattatattcataaaagaacaaccaaaaaactttgggcaacaatcaaaagaattacattttaggtaaatgccctatattttaaaagaaactacaaatattttggtatttatcataataatatagttatttaataataatgtatattttatctatatttagcttttgggaaaaaacattttacattaaataaaatttaaaacagtgtaaataaaggtatatatatttacatatatgaatatcatagtattaatatatatttcattaatactggagagcatattttcaaatacaatctatataaaaagtgtgcactcactttttttaaaatgaattctctactatatctttgtagaaaatattaactaggatcatagagaagcatacagaagaaaaaatatcttattctatatcaatgtaaataatgttaaaacaataaagtaaaaacatacaacacctctccaagtaaactaagattatttcaaatatttacataatattattattttatttcagacattacaattatttagcaatattggtatggaagcatatagggacaatatatcgagaggaccatttagtaaaatggataaaactccctagtccagtaatataatgatggtaaatgaatttatctctataaaacaactaaacaattgtagaaagatgcatgtacaaaaattttcactgcagcatttttgtaattcttaaaaactgcaaacaaacttgacttccaaaataggagattcattttttaaaaatctcttatttattcatgcaataaccaatcatgcagctaataaaaataattatataaatatacatttgtttgcattataattttacatgtattataaattttatgtaaaaagtaggccgacagcaaaatgaacagcataatccaatttaaattaataagtattataaatatacatatcaacacacataaatgcttgaaataaaatgtggcagaataaacattaaatgttattttccctaactgataaaattatcttcatatatatgcttcttattttctgatatgtttaccataagcatatattattttacaattaaatgagactgtaatttccagtagtgattagatttggactaaaagcccagatttacctcactatttgtctagcagtaatggtctataggacacataaaacagatgggcactaggttaaggatattcagaataaaagcccttatgctttgatgaatgaacccctaaaagcactgtggcagcaggaaaacataattcacaagaattcaaagaattcataagtaataaagcacatagtaaactgtagtaaaataagaggcaaattgagatttattaaagactccaaattttagacatgaaatagtataaagtatcaaccactccataacctattgtaaagtggatcataaaccctgagcaatgatgtgaaatgattcaggttcactaagctgagtatctgacatttggatttcataagctgggaacttgtgggtaagcatgtttagagttactctctgagttttcccagggcccagtgcaattactgattataatccactaccctctgcccctctgtactcaagaaagactgagatgcaaataagtgagtacaaagttactttagagagctacttatacctattaatttttttttaatttttccagaaatgaaacatccaactacgttggtaatttagcaatttttttttgaggtagtgtctcgctctgctgtcctggctggagtgcattggtgtgatcatagttcactgcagcctccactccccaaccccaagctcaagggatcctcccaccacagtctgcagattagtgggactacaggcacgtgttaccatgcctgcctagtttttcaaattttttgtcaagacagagtcttactctatttgccaggctggactcaaactcctgggctcaagcagttctccccactgggcctcccaaagtgctgggattacaggtatgagctactgctgtgccaagcccaatatagatattcttaataaaaaaaaatttatgctatctgagaactacttgactggcatattaccatgaaactttttctcattttttttttcttttttgcaactatgtaagacatttccacagttttgcccttcaaccaatgcttactagttgtaaaagcaggctcctgtgagtgcacccaccaaactacatcttcaagccggcagctgagtgacacacttacatgttgccattgttggacagaaatgagttatagccatgcttgtcctactttgccaagggtaccacctcttttttctaagcactatattttcttcttgttcagaaattgacaagcttccaggatattaaaggggaagtctaacggttctccaggacacagatgttcccttcctttctcattcttctttaaatgagttaaagaaactgttgttgctatactcaggaaataaactcaaattatgtaaataattcaatatcatataaacacacacatagacatttaaattataataaacttatattacaggggcaaagaaaaaaaatcactaacatctctatccagaactcttccggtgctgttcaggaaaagcatttgcttaacaggatccatcaacacccagtaatccacattatcctttaaagaaagttctatggtggggtctggtcctccagcagtccctttgatcagcatgttgtccaccagaattgtacctgcaaaccaaagaaaggtacttgaaaacatattctactcatatgaattctttagcaaagatcatgctcttaaaccgcggctggctcacaatcagttttaaagctgaaaatactcaactgtatatctagcataagacagaaaatattctttaccaaaaggccaaagtatctgcattatattatttataaataatatttttggtggaaggcagagatacagacatggtgagttccatcatccattttgtgtttccctctaacaacataaatctgtttccccccatctatcacttctcacaggagttatcactgaattttatcctgaacaaaaggaaatgcctgtaatagcagagtctgatgtctcaattaattctgttagacctctgatgtgaaaaaaagatattgtgaaactaagaaaggaagaggaaatagatttttaaaaagtagctgagcctcccatggtgagaactgcttctttttatcttagagcaaatacataaaacatacatcttgacatgaaagacaaaactagtgtgcagaaatggaatagaagccattcttctttaagacatgtctgggttactctactagaacaacgcactaggccagtgtaacatttcagtgattgctttcttattattttttttcagcaagctgaattgtagacagtttttgaataaaacttgaaaagattatgtctctaaccctttctactgtgttaaagatcccatgcattttacatgtcgaatgcaaacagcactgatgcaactcaaataccatttttccctcacgcagcaatgatctctttgccaaataataatgtaccatggcttagagcaatcattttcaaccgatccattttattaaacttatagatatagaagagatgtggctatgcaagtaaaatgtagcctccaaaaaaacactagaataaatggcaactatcgagagaacacatcgccttaggacagcactcaagaatatacagagaatccataaatacgaatctggcttgaaaaatataacgaaaaaagtatctgttgcattttcttaaggcatgaaattggcctaaatgttataccgttgcataattacaagaaaagtggaaggctctttaaaatattttctcagtaatttaataataactataattatctataatatttctttatcatactactactaccagtctttatccgcctaagaaatgctggaaagaaccatgaatcttttgtaacaagccagaataatgtttaaacacaaatgttgtctcacatacacatacttttgtaaatggcacattttttgcactttttcacatactaggacataattacatgaatattgagtggaatgagtatttttatttttgactgaaatggcaaatacacaacctacatacaatacactccaaagtatagatcagatattgatggcattttattgcctataaatatgttcaagaatgtatatatattcaaggccccagtacatactaatttacaaatacttcacacaactcaccatgaaaagatatttgatctgtatttcaatatataattgagaaattgaaagggaatttattttctcatcaagaaaacttatgtacaataggcaggtcaactaacattaacattaataccttgactcaatagtgtttaagagtagcaactgcaaatcttctgattgtgtgtatgcatgtatatatatatatatatatatatatatgctccatatatatatgctccatatatatatgctccatatatatatatatatatatatatatatatatatatatatatgctccaagctgcgagcagatacactaagggaaggagccattgaactatctttacaaagcaaatagtttataaccagataaagttttaatagtaactaatattaaagtagtgaaacaaaaacactgtatctggatttatattttatttaaagattctaactttcatggaaaagatctatagttttcttgctctcagctcactcctgagttcaatgattgaaactcaacaaaaaatctttctactgctggtgtgttgaaagagttttgtttgcttgcctgctttcccctttagaattgtccatttgtattgccaaaaagaaaaaaaaaagcctctcaaattttcatatacaagcttgctttaagccaaaatttaggggagagagagagaagagagcaaagcttaggcagacatgatacaaggagcaatatacatattttttaaaaattaacctaagtgttcactctgaattgcctgaacaactgtgcccatacccctctccttagaagaatacgtgacacccaagctatagttagcattaagccagaaactcctgtctctccctatcccagcagtggtgactgtatctttccacacatcctaagttttcaagatctgaaaagctagtgttctagacaatattggcaagcagctaaacaccagaatactctgggtgtattgggataatgtgctctctttcctccttcgttactttgcaagcttccctttttgccaataaaccttttgcttaatgtgtttcatttgatgtttaaatgtattctcttctttgacttcattttaaatattacagataagttaaaaataaaaagatgggaggcacgacacaacactaaataagaaaactggatggctctattaatgtcagctagaacaagcaatgtttaatagtggtaacgagacatatttaattataataaagggatcaacaggaataatcctgagtaggcctgtcttgcagaataggtaatacccaagatgggattcaccttacatgaaattttcctttcatcataataaaaatggtggcagttcagaaaatggaattaaatttagtttgatactcatataatagaagttaagagagctggccctggaatggataggcttagaatccaatccataatccaccacttaccaactatgtgaaagtggataaccgcatttaccctcgatttttctccctacaaaatcagtactataagagaaaaggcatttctactataatactatatgtatgttcctgaaaaagacttgttctcttgtatttagaataataaaaatcaaaacaatcacaatcgtgttaaaaatattagcacagttaaatatttattgacattttcaacacatttcttggctggtcaatcttttacagccttaaatactgggatttgtgcttcatcctttaagaagtaggtattgagggccatttacctctagggacgttttttataaaaatggaaaacttcctctttcatttagcctctttattagcctattaattcagaaaaataactttgcagcttctttttatgtacttcctgattctcaagagagattaacatattaaattacaggagttcatgtaactgctaatatagactctatttgtacagaataaatgttcttcaatagattttccattttttcttaagatcttctcacatagctagccctttctttttaattgtgacattagagcttgccacccatacaagaggatagtgggcattaagtatggtccaaaaaacctgtgacatgcttctaccccaaagaaaagtctatgtttctatttcccatgtatatgattatgtggttacataacatgagattctatgttgtatacatgtgtctatgtgtctgtataacatgagaacacaaactgtgttgtgttctgagtccataaggaatacataacaacctgattgaacttggaagcaaatgcttccctaaccatgtttcagatgaaatggtagccctgacaattccttgattatactcttgtgaaaccttaagcagagtacctggctatgctgtgtctggactcctgactcaaagaaactatcaaataataaatgtgtgttgttttaaattacctaattttaatgatattgttatacaataacaggtaatttacacaggatttaatgtcaaaagatctatgttcagaatcttggccgcacactattaactaactgtgagcttaagcaagttcccaagatttttacaatcagcaatatagagttctatgagaaaacaataaaaatgaatgtaagtggaggcacgcaactacccaatgaataacatttttcatcctacagctactagcaatttatatagatttgagcatataaaggagttatatattatttttcattaaattgggaacattatcaacaaaatgattttaaatgtaaaatgtactttctgtacaactgaaataagagaagcacagaacatacttaaataccagcaagaaaaaaaaaagactatgtatgcatatgtaaaatataaaacaaaaagaaggcaacagtttattcacagtaaccgttgataacttttcatgaaataaaaggccatttcttgctggcaaaagcaaaaatgaacaagataataagcaaaaaaagtcatactactaagatcaaaaatgcttattagtacttattagcatttgctgactgtattaactggactaagagataaaatagaaagacgttcagggaattaccatatttaattatcagactggtgtaaatgggaaaggtttataccctcagaatattgcaatattttattattttcaggccatcaaattgctgcagttaaaattaaaagtacaagcataccatgccgtgtatgtgtgtttttgtgtgtgtgtgtgtgtgtgtgtgtgtgtgtgtgtttcaacataatgattaaagtgggtaaaaaacaatcttcataccccactctcctcaaccaaaaaaaaaaagaagagtatagaatctaatcaggcagttctgttcattagaaaaatatgtcccaggggttgaaatcaaagaaacaaatattggttattttattttattttatttttgagagagtcttgctctgttgcccaggctggagtgcagtggcgcaatctcggctcactgcaacctctgtttcctgggctcaagcgattctcgtgactcagcctccataatagctgggattacaggcacctgccaccacaaacagttaattttttttttttttttttttttttttttagtggagatggggttccgccatgttggccaggctggtcttaaacttctgacttcaggtgatccatccgcctcggcctcccaacgtgctgggattacaggcgtgagctactgcatccagccaaaaatatggttttaaaatgtatgtgaaagattgatttgaaaagataaaagccaaaaaagccctgcttgatgaaaaagctcaacctcttaacctgtgtctccattagaatcaattataaacctcaaattttgggtttttcttccattccctaaccaaacaattaaatctctaccaagctgaagatccccccccttttttttttttaactaaaacttcatttcaacttgtgaaattcctttttttagtgaaaatgcaactgtagaaagttgttgttgttgttagatatgtgatttaaaatataaactttttgactgcgattttaaacactatttcaaagttttaaatgattcgattcagtaaatttgtaagtgtgatttattagattgaaagaattgattaagtgtcttaagaaaaaaatcctcttgggtatgcttgcctacccttctagatgtttgaagagtttgtattaaatttatcaacatcacagtagtttaattattaaagattgcatatatagtactttggataggggaagtaagtttgttaagcttatgagttaatagaactttaatcacagaacaaattaaagttttttcccttagtttttcagtcttcctacggttatagcaggaatgaaaatatttacgttatatttatggtcaaatacgattttgattttatctgtgtcatttacacatatttaatattagttaaaactcaagcaatattccatgaaaagacaacccacatattcaaaaaataaacaaaaacacctaattgactgtaggacaacaaacaattatataagacaatatgtttaagaaatggatgtggaattaactggtagtagtgaatcaatgaacatatttcaacaactccatttatttcattttttgagtttctggttgatccaaatccaagtgtatattccaggcagagagaaaggtcacatcataatcctcctccatttctcctctgatttcagatttaatttttaatataagatatttaaaaccttttattccatagataaatttgtacaatagaaaatgtggttttttagtacctctaggagaattctgagttgtcataaccctacagttaaatctgttttctcacctataaaatcattcagattaacaattctgtaaacaataaggcaaaattatttaatatgttattgaaaataataaaacagatggatgttatgacaatactaaatgtgaattagaactatgttacagaaaaatgttttgtttctataggtaatttgcttctggaaacaattaattggaggacatatttaataaccatacgtgctcaagcagtttgcttttttcatgtaaaagtgggcaagtattaagactaaattctgtcatttttttctatggcagtgcctatcgtagaaaaacaaataagcttaagtttgataattaaagcagcaaaaatgtaattaactaaagagtactcaaatattcaaagttttctgataggcttatcatttgagaggttaatccagccaaacaaatttaatttaaagtactctctaactgcaaatgaagtaaactttctaagtcatattccttttcaatagcacaagtacttgccctttttaaaaaatcaaataaactaactaaattaaataagattctttcaggtattttctaaaggtcattttattcatttggtctgtaagatgatgaaaatcattttacacattgaagaagctatttcaaagcctgacgaagtactttactttcaaaaatattttctaataatcattgcataaatgtttcacctccttggttaaattgattcctttgtgttttattctttttgatgctattgtaaactgaactattctcttaatgtcttttttagcttattacttgttaggtatacaagtacaactgatttttgtgcattggttttgtatcctactactttgctgaatttagttattagttgtgtgtgtgtgtgtgtgtgtgtgtgtgtgtgtgtgtgtgtgtagactctttagggcagggatgtccaatattttggcttccctaggccacagtgaaagaagaattgttttgggccacacaggtaatacactaacactagcgacagctgatagctgatgagttacaaaaaaaaaaaaatcccaaaaaataatcttatgctgttttcagaaagtttataaatttttgttgggccacattcaaagttgtcctaggctgcatgtggcctgcggatcataggttggacaagcttgctttagggttttctatatgcagtgtatttaagaaagaggaagattgtttaacttcatataataataatcagatacttgaatatgttttattatttatacataatattattcaaatattaatcagagaaccacctgaaagtgattatctactttctcaacataactttttcccactataaacattcattgttatgcagaatatataaagaacttctgaaatccaacgaaaaacaaatgatctgattgaaaagtgtgtaaagaacttgaatcaatagtttttcaaagaagatatacaaataatcaataaacacacagaaagatggtgaacatcactaatcattggggaaataaaaatgaaagctacaataataaaccacctcacattcattaggatggctactagacaaaaaacctaaaaaatagcaagtgttggcgaggatgtggagaaattgaaacactacaatgttggttggaaagtaaggtggtgcagcccaaaatttcagttacacaaaagaaacaagttcaagagattaattttacatcccagtaactatagttaataacaatatattgtacacttgaaaattgctaagagagtagattttaagtgttgtctgtacaagaagtgaggtaatacatatgttagttggcttgatttaaccattctacaatgcatacacatatcaaatatcatgttttacaaaagaaatatatacaatttttattaataaattgaaagtttaaaataaaatcatatggaaattgtggaaaacaaatgtttcctcaaaaattaaaaacagtattaccacgtgattcagccattttacttctgagtatatactcaaaagacttgaaagcagtctctggaagaggtacttacatacccatgttcctggcagcatcattcacaatagctaaaacttggaagcaaattaagcatccatccatggataaatcaataaacaaaatgtagtatatacacaaaaggaatattattcagccttgaaaaagaaggaaattctgacacatgctacaacatggatcaacagtgaggctggtatgctaagttaaataagccactcatgaaaaaacaaatatggcatgattatacttgaaactgacccaatacttccatatattttttaataaacatagatgtgtactcttctgatctgaaagtttgaaatttaccaaatgatcttcaggcctctcaaagtatcaaaaaactcaccatatcaccacatccagacaatgagatgcaggatccctcattcattatgcttgcttccttgcccctctgtaattcctgtttcttgcacattattgcatttcttccctgctatataaacccctagttttagtcagtgagggagataaatttgagacagctcccatctcctcggcagtatcacctgattaaagccttcttccttggcaatattcatcgtctcagtgattgagtttgtgtggcaaacagcaggacctagaccaaatccctggtgttttggtaacacacttatatggggtacttaaagtagtcaaaatcattgacaaagtaggttgttaccaaggacttggggagggagtaatggggagttattgattaatggtatagagttttagttttacaagatgaatacagttctggaaatggatagtggtaatggctgcacaactgtatgaatatacttaataccactgaactgtacactcagatatgtttacatctgttcctcttgcttcacttgtccttatcgtatttgctacaaggcattaggatcaattatcccccacaagtatggaaagtcttttctctgttcaaacgttcatcagcatgaagggtccaaaaatggccagaggacaatctgagcttccaattagtcagaacaatagttgagtttcgttgtcaaagcgttcaacttctggtcctagaacccaaatgtcacccagctgaaggtcacagacaagaaagccaaaattattcacgaagatcattaagtaagataggaagagagatcactttcatcttcacttcaagttgcccaggctctgttatgtcatgccatctcctgcatagctattcaggagagggcatgccttcgtgacctctaatttaaagcatacgccacatactgtaagagaatgaccaaacctcatagaagttcatcttctactagccgttatctgagaattaagaattctatcccaccatcttcttctgctagctgcttctgaatggtaggcattgtagtaacattattggattaagctgtggtgtgagctctttgctatgatccttcaccttaaaataaaataaatcaccttgttggaaatgaggttgtatgtccaccagataatgatcaaaagcattggaaagacgttctctgagcacatgaatgttgtttcaggtagaaggtctacagacaacacaaatccatactgaatcatatttatccatataaggaccctcctccatgataaaagtgggtttaatgccactggtcagtgagctggttccctgaggaatgataccataatagggattcagatttgggttctattactggcacattgagtatcagcaacagaagtaaccagattagccttagtaatgctatcttcttgagcccacatattaatcccatttaggtcactatgagcactttacacacagggtcatttatttatccctattgagaccaggaagcccattctgttacagcgtccctcactgacatccctaatctacagaggaaaaaaaaacaaaacaaaacaaaaaaaaactgtagggctcttcaaggaagccagatgcccttttaccaatatacttgttaaatcttgctgaagtgcatgtcctctggttatcttagaagtgtatagataaaggctggtttatcagattacacatgaagataaattcattgcacatttccatcactctgaacttttaaactcctctaaaatagggcttctcaattttaatgtgcccatgaatcacctagagatcttgttagaattataacttatgatttagtagatatagagtaggagggtagagccgtctagttgatgctgcttgtctgtgtgtctcactttatgaaagcaggctttatcacaatgtttctaaagtgtggtcccctgacataagtatcatcttcacacgagaacttgttcgaaatccgtatttgcggctccatcccaaactattgcattagaaactcagagatcccatttcagcaatctgtgtttaaatagccatccatgaggctgggaatggtggctcacgcctgtaatcccagcactttgggaggccgaggcgggtggatcacttgaagtcaggagttcaaaaccagcctggcaaacatggtgaaacaccatctctaataaaaatacaaaaaaaaaaaaaaaaaattaaccaggcatggtggtgggcgcctgtaatcccagctacttgggaggctaagggaagaaaatctctggagcccaggaggcagaggttgcagatcgtgccattgcactccagcctgggcgacagagtgagactccgtcttaaaataaaataaaataaaatagccatccatatcattctgatgcttgttgaaatttgagaaccttgttttataatgtgctgtaaaagttcagacattttgacttcattaactataagctattattgagacttggtttcagttagccaatctagcagactattaacgccacttttcattgtggtagccaaaacatcacaccctgaattcagggtgaatgcattcatgcaaaagaattcagcttcagcaagttttgtattttgttgtccattgtctaacgtctttagaattcactcccatgcatgatttctagctccctgccaatagtgacaatgacctataccttttgttttgttttgttttgttttgttttgagacagtctcgttctgtcgcccaggctggagtgcagtggtgcgatctcggctccctgcaacctctgcctctggggttcacgccattcttctgcctcagcctcctgaggagctgggactacagctgcccaccaccacgcccggctaatttttttgtatgtttttagtagagacagggtttcaccatgttagccaggatgatctctatctcctgacctcgtggtccacccacctcggactcccaaagtgctgggattacaggcgtgagccaccgtgcccagccaacctatacctgttttgtagtataggctatcttgttttaaaaaagatcttatattcctgtcttgactaaaagctaacatttcttatggccctagaatcaatgagagatggtataagtgggtcatgaaaagaattgacattagctcttgaggaaactgtccaaatatagttactgtaaggctattaggcagaagaggactagagaaagtgagagggtctatgttcactagccagaaagttcatgaaattgagatattcaatgttttcaccattatcattttcccatctcatgtctcaatgtcccttttcttccccagtgccaattttcagtgccttttctataggttaagaggatcaaaagggttgagagttccaagtatgttgcatctctgcaacacttataatcataaaaagatgggctccttcaaagctgccctgatgaccttctgtttccccatgtgctcttattgcattttatacctgttagtttacattttccctatatacattctcaagtatatagagaatatacacttggttgtcatgagaaaccaaatgtaataataattacaactattgctacagtgagtaattgctgcagccacttgatcatccaatactctatacctgcactcatcccatgccaccacaggtgtcatttgagtaattgtgatgccacacctggcaaaaattagccacatgctatgtgaatctcccacctccacgaaaggagtttatgcatggatccttaatatgcacactccaatccaagaatctcattttgagttattttttttttcttagagacaagtcaagcaccaattactataatacttggtgtaccagcaagaaaatgtcaccctcaaatttagataaaccaatgtgtttttagtaaaggaaagcttaagagaggtgtgagtagggtataggggaactataagaggtaatgtcatacactgacaaacaaggaatacagaagaaaaatttcatcaggaaaaaaaaaaaacaacataatctaatggggaaatgtcatataacatgagccatgtttagaaaagaaggcagccagcttggagagaacctatgcaacacatacctggctattatttacctctttcccttcatattctcctttctttgcccatttgtggaagccaactgaatgtcagatggctcaggagccttctgatgcaatccatgcatctctgagaaggtgaagagtggatgtaaaaggcaaacagatgtatctgcacattacctcctcaaggcattgtcttctgaattggtcttgtcaagagaatctcaatcaacaatgggatatagattcgggagaaattgagaggaaatttatgagttaaagcttaagtgattggcttaggaaagcaagtgccatatagtgtgaggcataataacactgtggtactggacattgtttagttgtagtttcctttatgtgtctgtataaaatcaacttttagttatataatttgctctatagtacaggtactttgtttcaatctctctctttccactataagaattgcatacacatttgaaagctagtttaatttaaaaaaaagtactaatttggccgggcatggcggcttacacctgtaatcacaacactttgggaggctgaggcaggtggatctcctgaggccaggagttcaaggtcagtctggtcaacatggcgaaacccatctgtacttaaaatacaaaaaaatttggtaggcatggtggtgggcgcctgtgatcccagctacttgggaggctgaggcagaaaaatcacttgaacccaggaggactatgttgcagtcaggctagattgtgccactgcactccagcctggcttgggtgacagagtgaggctgtctcaaaaaaaaaaaaaaaaaaaaaaaaagaaatgtattaatttattagcttttattgtgagtaatgaaagattatacttctgtccttagatcatattgatagtatttataacgttacataattctatattttgctccaaaaaaaaatctgtggccaggcacgctggctcatgcttgtaatcccagcactttgggaggctgaggtgggaggatcacttaaggtcaggagtttgagaccagcctggccaacatagtgaaaccctgtctctactaaaaatacaaaaattagctgggcatggtggtgcgttcctgtagtctcagatactcgagagtctgaggcagaaaaatcgcttgaaccctggaagtggaggttgtagtgagccgtgattatgccactgaactccagtctgggcgacagagcaagactcaggctcaaaaaaaaaaaaaaaaaaaattgcattgctgcaacatgagaaagctgctcctctagtcagagtatggctaagggaagtacatcataacttttaatcactgatatgtgattaaaattttaaagttttgataacattttaattaatgatttaagatgtttggctaatttccatctgaatttagattcaagcactttgcaagcctgttttaatctctatgcttaaaaaatctacatattaataaaatcagccttactacatacaagctgtcaacaaactctgttctaaacacagtggtggtatgaagtcaagtacctttctagctaatggtagtcagcttacacagttgttcaatggggcaacacaatcatatctccaactgttacagagattgaaatgattatcatctgaactactgcacttgtggcaaagttttctttctcaagaaggtttttggtaaaatacagatctatcaacaggagataccattacatttttagcacttaccatatcatttgcagagggatagactcagaatatgatagttgccatgaaaaatagtgaacagtaaaaactgaactaaatggaatatagaacacaagtattggaatgggaggcaaacgttaagaggaagagatatgggaaaatatatcaactcattattcaagcttatttaagcttcatttacatcacaaaaagtttccattcacaaccttttcaaataaaactgaaaggtttccatgatattttaaaaatataatctgtattttatcttaacaagaacttggaacaatattctatccaccattcctgatccaaacaagtgcccaatcttcatctatcttgcctcatattttcagtataaagagcccattcactttttagggaaaaaagacacaaataacacaatggcacaattgttaagtttctcattatatacaaccctatagctaataatgcacatgtcatttccatttctaggttgactaattttgatgggcagaagtgctctaaagtatgcttttataaacctcatatcacgtggtactccatggctgaaacatggcttaatgcatgttttaggatggtgaaggaaggagagaagggaaaaagaaaagacgaagaaaagaagaaagaaaaaggaaggtgaaggaaagaaagagagatgaagaaagaaaatgaaaatatgaccatgttataaagaaaattgaaaacatataattattttttcttaattttagcctgtgtagaaactcttaaggctgatgatgagatagatattttttgccataaattacatgaatctattcatttttacattcttattatatagcattagaatatgttgcattatatgtagactccttagaagatacacgtaaataaaattatcggggaacctgccccgatattcatgtaggttcttttctgtttttcctaagcatctgccagcttgagaagtaaagggacagagtacaaaagagaaaaattttaaacctgggcgtccaggggagacatcacatgtcggtacgttccgtgatgccccacaagccacaaaaaccagcaagtttttattagggagtttcaaaaggggagggagtgtgcgaataggtgtgggtcacagacatcaagtactttacaaggtaatagaatatcacaaggcaagtggaggcagggcaagatcacaggaccgcaggaccgaggtgaaattaaaattgctaatgaagtttcgggcaccattgtcattgataacatcttatcaggagacagggttttgagatcaactggtctgaccaaaatttattaggcaggaatttcctcttcctaataagcctgggagcgctatggaagactggggtctatttcatccctgcagcctcaaccctaagaggcaggcgcacctgggggcgctgtttataagcctatacctccaggtgggtattctctttcccaggaatgtttcatgctgagaaaaagaattcagtgatatttctcccatttgcttttgaaagaagagaaatatggctctgttctgcccagctcaccggtggtcagagtttaaggttatctctcttattccccgaacaattgctgttatcctgttcttttttcgaggtgcccacatttcatattgctcaaacacacatgctgtacaatttgtgcagttaatgcaattattacagggtcctgaggctgtaattacatcctcctcagctgacaggattaagagattaaagtaaagacaggcataggaaatcacaagggtattcattggggaagtgataagtgtccatgaaatctttacaatttatgtttagagactgcagtaaagacaggcataagaaattataaaagtattaatttggggaactaataaatgtccatgaaatcttcacaatctacgttcttctgccatggcttcagcaggtccctccgtttggggtccctgacttcccgcaacataaaataaaaaaaaaaaaagatgctttcaacttagtgactattattcctgtctatctctatgtgcatgtattacacacacacacacacacacccacattaagaacccactaaatattgttaagttcttggaaaatatgaccttaagtgaaatgacatacaataggtccttgaataacatagtcatttagatataattataatacgcaaaaaatggattttgttatgcatcgttttgattaaagtcacagtttccaagaacctactgatgacattaagtttatacacacacaaacatgcacacacacaaacacacacacacacctacacacacaaaggtagttatacacaatatactgactgccttataagaatgttttttctatcttgtaataatacatgagtaccacatttttcaatgcatttaatcatgctgtatctgagaatgtgacttattaagtcccataaatatatctaatacattttagagtataaatgttcaatgtattattgtagatataatatgaaactgtgcatgggagtggagtgaggaataattgaagaaaaggctcttgctgaaccaatttacctatgggagatcagaatatgccaccccaatttaggatggtttggcataaggtttgttgagctgaaggcaattaagaagcagatgaagaaaagctctctgcctctatttacctaaaaggacgatatacatttacaaagacaaaaaatatcccccttcccctctaaaccggggaggacaaatgttatccactgaagagaactttagactgttatgggcctggagatggcaccagaggaatctacattaacaagctttacttagcctttatctgccttttctttgccttgcctcaagttgctgtctttagaaattcaaaatccttttcctttgtcatgtcgcttccctaaaactttactgttctttgttgaacaatgcgttatataagctgaaattcaaactcacctccttggcggctactcattcccttgctgtcttccatgtatatatgaaatacacgtcaataaacttctctggcttttctcttgttaatctctcttttggtccatgggtccattccaactaatactttatcagaattgaggaaaaaaatattattcctcttccaaatagctatttagtattttctggctgacagagcaagtgtcttgacagagaactcacatttcattctctttccaacactcttcttttgatacactttaattataatccttaaaaatcagtctctgtgttagaagttgacatgatatatgaaggaaaagggccactttttaattctggaagttaatgcaataacataaagtagaaaaatagcatattttgaaatatatttcatgtcaaacacagacatatccttctaaaatgcagcatcaggaaatacttaggcataataacaaaagttcaaactatgatttcaaaacagagaatttgacaattcaagtatggatatgataagcctttattctgatttttttccaaatattccgacagtggaaaatgttcaaacaaaatttgaaggaggaggactgtgtactatcttattttccctcaatatttttcttatatactttaaagtaattttattctgcaatattgtgtcgaactatgaatttctcaaccattgtttctgaattgcaataaagtcaaaccgagcaagatggctttaatattgccctcatcttgacgaaactttaaacacttttcttcctgactgcatgtcctgacctttattttcttagagtgtttacttcagaaaattttccattgtaaattcttcctatgactctttgagatgtaaatagtctcccagccacttgtgagttttataacccagggatgtcttaaaaaacttggagacatccctttgaaatattgttatccagaaagatattttcccagtctcccagtttgtatggataataggagcctaaattccataagcaacaattaaacaattaaatgtggtccaaactcagggaacaaccttcccttcacttcctccaatgcttttccactaaaattttcttgcattgtgtttcaaaagaactgagttcaatttctatccactattgcaatagccttgaataaagtcttgcctgtttaactctatctggtataatttttcttcaagagaaccttaattagtcaagttctattttggcaatgggattcatattggaacttaattttatattataaaaatggataaataatcacaaacataaaatatgaatatatgtttccaacaacattgtgtgcatcaaaccaggcactaaatggcaaaggtataaataatcataataacaacttttgtggtgatagagttttttctagatgcactagatatgctgatattcttaaaataaaaattcttacatattagccaaaagatacttctgccagacaaatgttttattcattattacaaggattctagaccttttaaaattaagatattctgtttcaaagtcaatgtacaaattcccctaagttcttaaaaaataggggcaggtttcatggtgacctgttcaaagatctattgctgagatagattttagtaaatcaatttggttcactatcccagttggtcacaaatatgagtttttgttattacttcaattatcttattcattgcttactcaaaataccttttaagtcttatcccatgcagagatcagatggtaaggtttttaaagtaactatatgactatcagacttatttccatgtaacttgctttatttttgcctgtctttaagattttattacataaaaagtaataaaaattaattttaatgtattcctaaaatttcaaaatcttgcttgtttaaaaaaaaattagtcttaattaaaaaaacactatggaagaaaataagcctttaagtgatctatattatcctaatgatgttgttatgttacttaaatcaaaatttgtgaaaaaaataggttcacacttctgaatctcaaataaactttatagatcaaaaattaccaccaaaggtgctcagaaacaatgactaaaatttccatctctagcaattttttatataacaaaattgtcctaacaatactagctaataaattagagtttggttacaaaatgaaccatgataaaatctatcacagcaggaaaattttagaaaaggtcaagaccacttatgtgatcttaccttcaattttagaccaaggaaagtttgtaagtgaaatttaacccttcaaaaatgccccccaacatagtatcttattcttgtgcaacctggaaaaacaaaaaaaactgatattagaacctaggttattttatttgctgctggattatttgcttatttgttgttttaaatcagaaaaaaaaccccaaatattctggtagcctagaaataatcaatagccttgcagacaaccaagtatccgggttgccttatgaactaagcataggatagaattaaactagacactgctaaaatgaatggacaatttttagtggtatgtatacaaaccttaaagttcaaataatgtaaatggccgacatcaaacatattttctaaactatagaattttacaccaaacagtatgttctgccacagtaaactgtctctggctttcttaaaagtgatttattttatactgcaaattattctgtcatgtccacttggcatatatgtgttcctttctgattttctcaacaactctctcttagaaggaaagcattttctttttagaaaccattttgaatacataatcacatacatgtaacagaacatttaaaaagaaactgtttcagccaaaactatgctacctactctcagtgaagagagttgcagacaacttttgtaggacatggaaaagaagccactgaagttcagtgtgtaacatttatatgattaaatataatataaatataaataatataatgattaaagatgggaggctcaggtagcttggacactgaggatttgggaggaaagcaatattacagtgtgataattgcaagttatcaacaaagagtcatcagacttcttgcatttctccataagcttgatgacaagaacatcaggtgggtttctctgaaaagaactaaatttacagaagttagagaatttagagaaattagttgaagggtgtctgactttcacttgacaattttaaagggtgaaagtctaaatgaagaacttttgcagattaatggtctgcggttaggaaataactgtattccaactagagatgagtctcaagtgagtatttcccaccagcaaatgtgggccatgcaagagagtagacaagaaggagatgatctcaagcccagcccaagagaatcaccatgaggaatgaggagacctcagcagtaagacgctgggctgtgcagccacatccgcgggaacagcaaaagttagtgaccagaagacaaattctccagccatcccaggaattgccagaaacagctatccaaatttggaggtctccaaagaatctgcctacgtggttcacaatctcaggagttgccaaaatcagacctagagagtacagcaatgcaccctttcttttctttttacctctaatgctttttccagggtcaaacctggaggagatgaaaatcagtatttagtaagttgaagaaacagagatgaataaggcagagagagagcaaggttgttgacacccaggttctaaggcagctgggatgcctacaaaaggatatccaagcggaaaaaaattgaagtagatttctagccaaacttagaagtcctctgtgtctaatgtatttcagagtaggagataaagtatttgttggattagcacattagcaaaattatctagagaaaggaatacatgtgtaatgtccaataaaagccagtgattctccaattgaacataaaatggactaagttgataagaaatgtggggctctttcaacaaatagtttaaaatcaaaatcatgaaggtggataaaatatttctttacccccagaaaataaacggataaagctacttctactatctttgttatttttcactctactagccctaattatttcattactaacttatcatcaattgaaagttataaaatgcatgtttccatcatgatactatgtcatatatattttaaaagatggttataaaagtcatctgtcattattaaattaaattttgagtcaatatatatttgtattgggctatgaatatgcataagaaattaatattctgaataatatgtactctttcagtgccctggaaaagacaataggagcctgatacaatttgtcattcttgcacagtgacagttaatcgaaaattattaattcattatcaaagtatcatttccatgacaaagacgagaggaaaacatgcagactgtgtccagatttcttccagatatctaccagcaaaatatcaccaaaattaaacaatgaaagatagacgaaaagagaaaaaagccagagggagaggagagagaaagagagagaatgattatgttttacataaaaaacagtaaattgaattccttacttgatttttataggtattgttcatctagtttgtagtaaagggaacatagctatagacaggaaactgtcattgttgagaatttggagcttaaaagtattcagtaattttaaatgcaggacatgtattttcgaaaccattcataattaagaaattaaaaagattttagtaacatttgtgaaaaacagaaagaaaattatttaaaagtctttgctcttcagagatagtgcctggctcttgtagattcctttcacctctacactatgctaaaacctggctttgtctaaaaacaactttagctatagatggtcactttctgtaaaggcttttctttgttattgtcatagcattacagaatattgatgacttcaatatcacctacacagaaaaactgtatatgacttttggaaaaaaaatgagagatttagggcaagcaaagttatgctgttgtagattcaaaaaaaaaattgacattttaggttaagtatattttcaatgtttcaattataactgtaaatctataaatgctggtagaggtaacctcattagaaataactccttattctaagagcaaagagaaacctgaaatgctaaaatggatactcattcttaataggatcaagaaacaccaaatacccgtcaaatatccgaagattatattcaatgactctgaacaaggaaaaaagcaaaaaattaagtgaaacatgaatgaaagaaattacagaaatctaaacaaaggtataatctatattaatggattgtaaaactcagtagcttaaggatgctaaaatctcctcatgtaatgtcaataaaaatttcatcaattttgaataaattgaagaattaagtctaaaacatatacaattcaaattacaaagtatatgcccataatttatgactttactgcttaattctaccagcatataaagaagaacacatcttaaacaaactattacaaaaaataataggaaacacatactattttggtttttgatgctagcataaccctgataacaaacctgacaaaaatacatcaaagaataaaaagtacacatgaatatcctcattaacacagatacaaaaatacttaatgaatttatttagaaaataaatcaaatccagcaatctataaaataatgcattatgaccaagttggttttaccaagaatgcatggttggtttaatgtataaaatacataaaatcttattaacagagtgagggaaaaaaacataactcaaacaacacagaaaattcatgtatcaaaagtaaacgtgttcaagataaaaaatattaagcaaattaggaatagaaagtaacttcctcaatctgataagcaaaatatttacattaaagaaaacagaactaaattaaagctgacgggaagaagaaggcaagattatacaatcttataatttctattcatcatggtagttggaattcctagccactgaaataaagcaaggatcaatgacatatattaacaacaaagaagaactatgctcctatttagaaacagcatgatcgtttatgtataaaatattaaatacagataggccaccttttattgctttctttattagtttattgaactccataaatacggcatttttttaaaagtttgaagatttgtggcagtccttcaaataaatagcaaatttattagccattttttccatgtgctcacatcatgtctgtgtgtcacagtttggtaattcatgcaatatttcaaattttttcattgttatatctgttatgattatctgtaatcagtggtttttactattaattactattataattattttgggatgccgcaaaccattcccacattacattgaacttaattcatgaaatgttttgtgtgttctgattgctccacctactggccattctcccatctttctccatctcttcaggcctctgtattccttaagacacaacaatattaaaattagaccaattaataaccctacaatggcttctaagggttcaagtgaaagagttgcacatctctcaccttaaatcaaaaactagaaattattgagcttaatgaggaaggcatgttgtaaccaagataggctgaacgctagacatcgtgcatccaacagttagccaagctatgaattcaaagaaaaacttcttaagggaaactaaaagtgctattctagtgaatgcacaaatgataagaaagccaaaaaaccttattggtgataagtagaaagtttgagtgatctgaatagaagatcaaacaagacacaatattttcttaagccaaaacaaaatccagagcaaggacctagctctctacatagctatgaaggctgagagaggtgaggaagccacagaagaaaaattggaatcttgtagatgttggttcataaggcttaaggaaataagccatctccataacacaaaagtacaaggtaaagcagcaaccacatgattacatcaatagatgcaggaaaggctttcgataaaattcaacacacattcatgtcaaaaactctcaaaaaagttaggtattgaaggaatagaccttgaactaataagagccatatatgaaaaactcacagccaacattatactgaattggcaaaagctggagtatttcccttgaaaaccggcacaggacaaagataccccctatcaccactcctattcaacatagtattggaagttctggccagagcactcaggcaagggaaagaaaaaggggcatccaaataggaagagaggaagtcaaactacccctgctagcacaagacatgaacttatattcagaaaccctcaaaatctaggcccataagatccttaaattgataaacaacttcagcaagtctcaggatacaaaatcaacgtacaaaaatcactagcactcctggacaccaataacattcaaggatccaaatcaggaaatcaatcccattcataactgccacacactcacacacacacacacaaacacacacacaaacacacacacacctagaaatataattaaacaggaaggtgaaagatctctaccaaagaactacaaaacactacttaaagaaatcagagatgatacaaacaaatggaaaacattccatgctagtgaatagaaagtattatttttgctaaaatacctataatatccaaagtaattcatagattcaatgttatttctattaaactaccaatgacattcttcacagaactagaaaaggctattttaatattcatattataaatattcatatttattaatgataaaatattctattttaatattaatattcaggccccaaaaaaggacctgaatagccaaggcattcctaagcaaaaaatacagagctggaagcatctggctacccaacttcaaattatactacagggctacagtaaccaaaacagcatggtactggtacaaaaacatgcacatagaccaatggaatagaacagagaacccagaaacaaggtcacatgcctccaactatctgatctttgacaaagctgacaaaaacaatcaatggggaaaggactccctatttagtaaatgtgtagggagaactgacaagccatatgcagaagattaaaactagaccccttccttataccatatacaaaaatgaactcaagatgcattaaagacttaaatgtaaaaccaaaaactataaaaacccatttctctggacacaggaacaggcaaagatggcatgaccaagatgccaaaagcaactgcaacaaaagtagaatttgacaaacgggatctaattaagctaaacaggttctgtacaacaaaagaaaccatcaacagagtgaacagacaaacctacagaatgggagaaaattcttacaaactatgcatttgacaaaggtctaatattcagcaactaaaaggaatttaagcaaatttttaaggaaaaaaaccattaaaaagtgggcaaaggacatgaatagacacttttcaaaacaaaacatacatatgagcaacaagcgtatggaaaaaaatctcaacatccctaatcattagagaaatccaagtcaaaaccacaataagataccatctcgcaccagtcaaaatggctattattacaattaaaaaagtcaaaaaatagcagatgccagtgaggttgcagaaaaaaagcaatgcttatacactgctggtgggagtggaaattagtccaaccactgtggaagagagtgtggtgattcctcacggacctgagaacagaaataccatccgaccctgcaatcccattactgagtttatacctgagggaataaaaattgctctatcacaaagatacatgcatgtaaatgttcattgtgtcactattcacagtagcaaagacatggaatcaacttaaatgcccatcaatggttgaatggataaagaaaatgtggtacataaaccaaacttggaatgcggtacattccatgtgtaccacatggaatactatgcagccatataaaggatgagatcatgtcttttgcacgaacatggatagagctggaggtagttatccttggcaaacaaatgcaggaacagaaaaccaaatactgtatgttctcacttataagtgggatattaatgatgataacatgtggacacatagaggggaacaaaacacactgaggcctattgaagggtggagggtgggaggagggtgaggatcaggaagaataactagtaggtactaggcttaatgtctgagtgatgaaataatctgtacaaccaacccccatgacacaagtttacctacataacaaacatggacatgtactcctgaacataaaataaaagttaaattaaaaaaaaaaactaaaaattacatgcaatatttgtagtggtacaaatatatttatgtaactgtaaaaaagagagatgtataagaatatatacaaaatgtaataatggttacttccaaacaatacatgaaggctagaagttgaggtgttttttttttaatctgtaaggttttaattcttttaaaaaagaaaaagtattagtgtattgtttcacaatttttaaaaaatgtacaagaatgttcttatttctaccatattggtctgcttctttgtattttttctggcccaacccaaatcagtcttttcaaagtttatctacattggttagagatggagccttatagaacattgaattaaaggcagacatccaaacagttattgtatggaacagatctgcgtactaaatatgaatgtgtgtattgtgtgtgggcttatagtattaacaatacacattatgtctttttgttttttatgtgtattgtctgtgtacctgtgaatttcagtattcgtgagctatgcattaatgtataccacagttaaataaatgaattagttgcagaaaaaggaagatcaaagttggaaggctttatctatctgattttaagatgtactaaaaagccacagaaataaataaataaatgaataaataaataaataaatggactagaataggtaggaattagtcaactttatccttaagggccagatattaaatatttcaggccttgtgggacacatatgaggtgtctgtcactttttgcccctcttcctcctcctttctcctcttctgcctctttttctacctcttattttgacaatactttaaagatgccaaaattgttattagattgtgagccacataaaaacagcccaggagtcataatttggcaatttttggaacaaaggcaaaaaacagaaccgcagtagcctttccactaacacttcacaggaatttgatggatcaggaaaaacctttgtaacacatgatgctaggacaactgggtatccatatgaaaaacaaaagttaaccttaacccctacctcctaacaaacacgaaattaatcaaagaaggagcaaacgtaagagtaaaaggccaaactacaaagtatttagaagaaaacaggggattatcttcataacctgctatgaaacaacacagtaagaaacaaccataaaagacaactttaatatattagagtttcttaaaaatttaaaacttttattcttcaaaagatacctctacattaattataaactggaagaaaaatatttgcagaacttgtgtctaacaaacacttgtatgccaaatacacaaaactctatgacaactcaataacataaggacaaattttaaagtggacaaaacacttgaaagaaacttcctgaaggaatgtgcatgaataagtaataattacatgaagtgctcaatatccactgataaaaatttcttaaataggcaaaatgaatctatagtgatagaaaacaaatcagtggttgcttggggaaaaggatggagaaaattgattggaaaagagtacctgggaactctttagagtatttaaatgttttataccttgtcagagtggcagttacatgtgtgtatatacttttcaaagctgtatagttaacgttggtatatttcattgatttcaatgtaggtaaatctaacctcaaatatccataaatataataatcatatggaaggtcacttccaaattggtggaggaatagttgaaaaaatagtctaatattatcattttttaatctggataatggctccaggatagtttgttatggcattcaatttattctgtatatgactgaaattttaaaactcttaagctaaaaagcatttgtcacatgtttttgctgaaatattggttccttgtaatttctcacttaattcaagcagacatctaaaggtgatttattttccacccagaaaactaagagtacaaggattcacttgtgtccacaagggaatcaagtgatccaggagaacgtgcttcactattttttgcttttcctgacccttaaacagcttctaattcctcttgctaaaaaaggaaaagggatggctgggcgtggtggctcccacctataatcccagcactttgggaggataaggcgggtggatcacttgaggtcaggagttccagaccagcctggccaatatggcaatacctcgtctctactaaaaatatacaaattagtcggggtggtggctcactctcgtaatcccagctactagggtggctgaggcatgagaatcacttgaacccgggaggtggaggttgcagtgagtggagatcatgtccctgaactccagcctgggtgacagaatgagactctgtcaaaaaaaaaaaaaaaaaaggaaaaggaagcaaagaaaatagaaaagttacttcctctaaggtaaccctaggagttttcttcactatatttaggaacataattagctgtttttttaaaaaaaaaaaattgatgcatgcttgctttctctctatatagaactatattttgcagaagtgttaatgatgttttgaaggtgacaatgttatcccacaacatataatttcctctcttaaaagtactatctttgaaatgggctcacataatatgtaaatatatggggataaatgtatagtctcattacaaactataagaattattccatatatgtaaaatatgaactactataattgggtgtaaaaccaaggttgtaaatttaattttaataatttgcctataatatttatcagtccaaagtgatttgaaaagaaaatctattaacatgttttacaatattcttacattatttctatcattatgtatgagacaaatcatgatgtgacagcatgtgacaagtgtagcagatgctgtggatcagcttacacaaaacttattccaactacctcctttgcacatgtttctgaaccgcataactgagaagctaaaattatacttaaaggattcaattgcagctatgattctatgtatgattggggttactctgacaagattattttttatataagacattgttcagaatgtactatgaaggggacaggtgttacactttttgcagttacaaatcggggtggaagtgctgtggttctggtgttagctgtggttctgtagttggcaatgttggcatcagctttctggaaccaggcatctggatcatgggaaaggcagcatttcctaggtgatatggcttggctatgtccccactaaaatctcatctcaaattgtagctcccataattccctcatgttgtgagagggacccagtgggagataattgaatcatgggggcagtttctcccacagtattctcatggtagtgaataagtctcatgagctctgatggttttataaggggaaacccctttcacctggctctcattgccttgtctgccaccatgtgagacatgtattttgcgttttgccatgattgtaaggcctccccagccaggtggacctgtgagcccattaaacttctttcttttgtaaatcgtccagtctcaggtatgtctttgtcagcagtgtgaaaatggccaaatatactatagcagatcagttatgttgtggttttgcatctcattcctggcaggtcaaaacagaatctatttcttccaccctttcaatcatatgtgaactatttatgccacttaataagtcccttcagcttgaagaagctagggtatattgttttttgtaactaatatccctaactgatattgcagacttcacataaaaacatcctgttgaagatgaggaactagaagattctttccccagggacatatgatattaaaaaaaagctacaggtagctggtctttactgtgtacattatcaacctcttacccaaaatactatagtggtattcactgctataactatttacagtatattcagctgttttcttacagtcttagcaaaaccatcttctcatctgttatgacttgcatgtaccccccaaattttgtgtattggaaactaaatgcccaaactcatatgttgatgatatttggaggtggggcctttggaggaggtaatcaagattagataaggtctttagagttagtcccccatgttgagactggtggctttagaagaaaagaaagatgtgagctgacttgggtgctcttgccctctcactatgtgctgccctctcaccatgtatgatacagcaataaaaccctcaccagatgccgatgccatactcttggacttccaagcctccagaaccataagaaatattttttttctttattaattacccagtccacagtattctgttacagcaacagaaaagcaattaagacaccatctcacacctggttttgtctataccttgtgagaacctcacaactgtaattcttctgtataacacatcaattaaaatagaatctagacaaaatgtcagtattaaaacaatcaggaaaacagggctgggttgataataaggccacaatatttgctgcctctgagaatttgggaagggatggatttgaagaagaagttttctgcttgcatatctagttcttattcatatgcacacaagcctaaggggaaaaattcaggctcatcgtccttttgattgcttaaaagcatgtagcagcttccaatttacctttcctaaagaacaagtcaggctgcagaaagatcatggttttgaattcagccatggcttttaatttatttcttttagactttgcttgactggaaagctctggaagctggggttcaaaggcaattgtgtttaaagaaaatacttagttgggaatattctaacagcaactgatgggtttaataattcttgtagatactatataaaattttgaatagctagtatttaggtaaataattgcaaagaaacactcttcttttggaataaattacatggagtcctgttgctgtctacttgcaaataatctcattcacgttttgatgaaactcacaatgtacacattttctgaggaaaatggaaacaggaggcctcctgaagatacaataagatgattatatttattttcaaacctttaaggaaagctcctgcaagttaggctaaaatgtaaattttagtgaggattctattagaagttccaaggcaacagttactttcaaaaatgatagacccactgtgagcaaaagagagaagataaggactctgaccgagctggcattgttgaataaggggccctgatttgctgctcaatagctgactctgcaggtttcaattataggaatagctggaataatactgctctacaatattactggtagaatttgcaaagaattgatatatagagtttaagtatgtgtctctgtatgtgtgtttgtgtgtgtgcatgtgcagcacacagacatgcattatgaaaagggagttattcaagtaaaaagcacctgccgctaccataacaggtatgatctaggctgacccatgatgcttgggtgggtggtgggacattaagaatagaacatttaactacaggcatgcttatattccagttatatataggcccactgcacctctaaattgttgcactagagtctttattttggctggatttaaaggccacttcccaaaatttgtgcagaatctttgtagttacataattaaaaattgaaagaatttaaaaaatgacaactgtagtctcactgactttttaaaataaaattaaaagaccagtataactgtaagcccttgttcagaaaaatgttaattccttacgatctagactcagaatgtggggtttgaatcacaattctatcagtcactagcaatgtgatcctgagaagattacttagtctctctgtcccacagtgcctggtttataaactgggaataatatttattttaaaggattaaatgataagctacagatatgtctttttgcagtgtgactagaaaatagtaaacacgtaataagtgctggttgctgctaccataatgatcagtgtatttctatattgtttatttctggatatcagtacttttgatataagactagacagtgaattcctcaattacaggggctatgtctccagtaaacaagaaaatgcctgtcacacagcactcacattaaaagcttagttgaattgatacaacttgtcagagagactaatactgagggcacgatggccttatcatcagcatatcctcattactttgactagattatttaatttattctcttttactccttcttacttctacttcagttaaaggcaactggggagtatagaaatttgaatatttagctttttggggctatgtccgtagtttattcactacttagggtgacctgtgcacatgctaaatgattaaagaaggcaaattctaggatggtaagtagagaaatgtgcattatagattgaaggcatgtgatgggcaaaagagcctgaggaactgacaatagatggaggaactgacaatagatggaggtcagtaaacaaactgaaaaacaaatgtaagggaaaacatctgataaaattaaaaaataaatatcttatttaaaaatatacatcttcttaaatatatatttatattttaatatatatttaaaattatatatatgttaagtaaaacagaagttactaaaggaacttccacctttgtatgtttgcttgaatattacatctttaaaatagcttttgcaagagatgtttcacaaaagaagttgatcttacaggtattgtagttttctctaaaatgcctaaagattaatactccgcaaagtatttcagtcaatttcaagttggggaatttggatgaccaagacatctctgttctctcaattcctcagaggacatacaccgaagttagttgtgatagtagttattatgcctattaagggtgagatccttccaggttctaacttctattgtcctcaaacacagcactctgaaattctagcattaatgactgttactggctacttacaacaagcaacttcacttggatctaccatccagtttccaagctaccaacattaccttgttgcattgtttttgttgctgttgtttctttttttgcgacagagtctcgctctgtagccagggtggagggcagtggcgtgaccccggctcactgcaatctccgcttccctggttcaagggattctcctgcctcagcctcctgagtagctgggattaaaggcatgagccaccacgcctggccattacattgtttatgtacaagctagatgataaggaccaggcaacacttgtgctatcatattgcatgtgtgcaaggctacacagcctgttgatgcacacaggagagactaagaaaggcagacctggccatggcctacctacttgcttactgaactttgtattccacgaaagaagggagcatgaacatatgtttagcaggaaacttaaagtctagcaaatttcctggcccatagtattgtattctagttgtttgttaaataaatgaatggtctgtatacaatatagcatctctctctctctcaacgaatagcaaaattttttaatagacaagtaacgaagggccttccaatttaatgataataatacatggttggctatctattacagctctttgtgattgttggtttgtgaatctgaaggcactatttctcaaagtgaagtccaggaaccacttgatcaaaggtcatctgagttgctgtttaaaatttcagattcctggggtcacttcctgcatctccacctctgacaacaatattcaggaaactatataatcaacagtctaccaaggtgattttatgtacactactatttcaaaaccttagtgctagctcattctctaggtgaacaaatgaaacaagtataaatatgataaaaagtaagagatctattgatcatatttctacatgaagagattttctatttcagaaattgaagtaatcagctttttaaaaaagcctttttgggaatcaatgtaagtttcataattcagccagctgaccaataaatattaaaaaatgtttaactttcttatatttcatcatttaaaaaaatgagaaattattccatagtctatgtctgtctgtatacattattcagctcccacttataagtgagaacatgcggtattagactttctgtttctgagttatttcacatacgataatggcctacaattgcaataatagacattggagacttagaagaatgggagggtgggaggagggtactggatgagagactgcttaatgggtacaatgtacactatttgggtgatgattacactggacatttggtaatcatcacccaaatcattacccaaatagtgtacgttgtacccataaagcaatctctcagcctctcactactacacaatatatacatatgacaaaacaacacttgtaccccttaaatttacacaaataaaacactacaaaagaaaattgaagaatgatcctatttataatagtgacatgaactaatttgaaaccatgtactcataggagatataagaagaaacaataacatgtcctagaaggccaaaaactgaagacttgaatcaaatgaaagacatatcattatcttgaatgagaagattgaatattacaaacgtgttcatttactcgaatctacaaacttaacattaatctacaaaattaacataattccaatcaaacatttttggagggttttggacctggcatgtttacatgacggaataaatgtgaataatcaccaggtaactctataaaaagaaagttattaagacagagttctcctataatgaatgacaaacataatattgggctacagaacagaagtaggtatacaaatatggaagaatatattacatttattttgaaattaaatttttgataaagttagaattttcagtcagtgaatacttgatactttatttaaaacacagttgtcaactttttactatacgtcaggctatatgaaaatattaactgatttaagtctctttacaatcttacaaagacttacaagttaaaaattttaaatttataattttagatacatgccattatcagcattatataacacatgagaaaacgaagcccagagagtttatgtcacttgctgaaagcaacagcaatagtaagtagtagagccaggttgtctgaatgttctttaataccatgatataagatttaggctggcacttgaagaaaaagaattaaaatcatactagagttcttattttaaaagcagattaaaaatagaattttatttcatttaaatgaacaacataaaaccaggaacgtattagaaaaaaaattggtaagtatttgcatcaattgatgtggtaaaacgtgaaatgtgatatcaagttacataaaggaaaaatattcaaccagaaataccatttcacatagaaatgtttaaaatgtttcatatttcacatagaaatatttaaaatctatacctctaaagtatttatgaaaaaattcaaaatatgataagaaagtacattgtggtatatgtttaaattgtggtaatatgtttgtttttttcctattgtcacagcttaattattgataaggtctttatccacaaaaggggttcaaactgtgcaatacatttttgtcacactaattacaaaggttagtattactatgaaacaaaagtttcaagatcaattaaaaaatatggatgttccaagaaaaattgaagaaatttttaaaaatagtcaatagtttaaaaaaatcagacagagaaggaggtaataaaaagagagaagtactaaagtaagtaacaagagaagaaaaaaaggtagaaagaagaaaataaatattccatgttgtcaagaaggcaggagattctcaaattttagcaatgggattatttgaaagtaatttagaaaatagttaagtatttatgcaaaattattttaaataatattcacagatgtgatatatgtgaaaagaaaatagttgaacataatcaaaaaaattcaaagattataaaatgtattattacaatctatataccacatattatattggccactagggatgatataaaggtaaatttagtgtgacagacaaacaatgaaaatattagaaatggtagaaaggtgactttattgacataaacaaaaatgacaaaatgagaaataaaatgggaaatgttgtatgatctcgattgggtaaaagacaatttatctacatgtgattttcccatacaaatcatttgatccaaatggtatttccaatgacaactgaaaatataaagtgaatttaaggaggtgaataggtataatattttttaaaaaatcgacttttttattttttaaagacaggttctcacttggatgcccaggctggagtgcagtagtgtgatcacagctcactacagcattgacctccctggcgcaggtgattctcccacctcagcctccagagtagctgggactacaggcacatgccaccatgccaagctaaatatatatatacacataaaatttttaaaatttttactttaagttctgggatacatgtgcaaaacgtgcaggtttgttacagaagtatacgtgtgccatggtggtttgctgcacctattgacccgtcctttaagttgcctctcctagctccccaccccccaaaaggccctgatgtgtgttgttcccatccctgtgtccacgtgttctcattgttcaacccccacttatgagtgagaacatgcagtgtttggttttctgttcctgtgttagtttgttgggcatgatatcttcgagcttcatccatgtccctgcaaaggacatgatctcattcttttttatggctgtgtagtattccttggtgtatatgtaccacattttcattagccagtctatcactgatagacatttgggtttgttccatgactttgctattgtaaatagtgctgcaataaacatacatgtgcatttgtctttatagtagaatgatttatattcctttgggtatatacctagtaatgatattgttgggtcaaatggtatttctggttctagatccttgatgaatcaccatactgtcttccacaatggctgaactaatttacattcctagcagcagtgtaaaagtgtgcctatttctctacagtctcacaggcacctattgtttctgactttttaatagtcgctattctgactggcatgagatggtatctcactgtggtcttgatttgcacttctctaatgatccctgatgttgagcattttttcatgtttgttggccatgtagatgtcatcttttgagaagtgtctgttcatatcctttgcccactttttgatggggttgtttttttcttgtaaatttgtttaagctccttgtgacttctgcatgttaagcctttggcagatgggagactgcaaaaattttctcccattaatatgtttttgtagagatggggtttcaccatgtttcccaggctggtctggaattcctgggctcaagtgatccacgcaccttagtctcccaaggtgctgggattacagatgtgagctacctcatccagcaaccaaaattttttagtgttattcgccaatgctgctattaaagaattacatttcagtttacacttacgtcgatctactttaggaatttgtatactgatttgcatttatccaaattggaattttttttaaatactgggacttttctctcacagaagaggtctgagatcttagtctagcataaatgacgaaatggggagtgatagaatagaaaaccaagagaaaagaagttatttaagagattaaaagaaataattatctgaccctttcacatagtcttgggtgctgaattgcaaattctgctgtttctgctgtgacagaataataataattttcttttcaatgatatagagatatttaacaatgtttactatttcatagcactagcaaaacaggaaaaaatgcttgatgtaataaaattatttcacccgattattaatcaaatatagaatgggagaatgtatattaacattatttgtcttttgaaataatattatcacaaatattaacaaactttggatagctttttgatatcttaattcctgataattgctactaattcatttctaagtaacaagtacaatataaattccagatttaaattaaaaatatttgatcattcacaatgctatgactgtattacatttcaatattttacctcgtgttattttctccataaatagagtggttatggttcacaggtacacatgctatttgtttatttatttcattttgtagagagggtcttattattttgcccaggctaaaatgcagtagctattcaaaggtgcaataaagtgcgttacagcttcaaactactggcccgaaaagatctggtttagcattctgagtagctggaattgcaggtgcccagccactgtgcccagccacaattgccactgtgcccagccacagtcagctttttcaagaactgtttaagataacaggttagggaaaatcaggataatattttgaggggaaagaaggtaaaatcaattaagacagggtgcacagagtacttgaatggtacagctgatgtttcatcctttgtactaaatggtgtgtatatgggaattggttatattattttgactgtttgtagtcatattatgtacatatgtgtatacataatttaaaaataaaagacaaaagtaatataagctaaaattatagatattaatattaattttatttaaatataacaaagatttgccagtattcaaatgtctgcaattatccttaaaatgcacagaacctatgtttaggtatagtatcactgttcatccagccttcattcactctaatctactcttatctaaaatttgtagtgtaagtaaaattacattcggtatgacagaagacaaattacagtattagaacattatggaaaattggcataacattgtacaatcacccataactttattatttatcattttgtaacttttttattatattagtcaaaaaatctaactgtacttaatagctaatacatatattatttgattttttaaagactattattaaaataataataatttgggggtgagaaggcctattgaaaaatgaccaacatataaatcataaataagtttgatgcaacaaatatttgtaagtcttataggtaaaaatataaaaatttattctaaacaaagctaaaagacaataatatgcattgggaaatatttgcaacattcacttcaagggttgatgtccgtagagaatttttacaaattaataaacatttaaaaagttgaggagtggcaatagctatgagagataatttacaaacacataaaaaccaatattaaaactgtttaatctgtaagtacatcaataaaaattttattatagtagttattttatctattaaattagaaaaggtcaatacaactgataatctcccaagggaatatatgggagaagcgctttctcatacacttataatatattgttagaatgccattaaataaacatttggcaaaaatctatatcctctgtcaaaacaatttaagttctagatctctagaatccacatatacatatacatatatacatacacacacacacacacattcacacctatatatcaacaactcaaatccaactccaattctttcataagcagtattttgtccaacaaacaaatttatctaaaattcttcttggcttttctccattatagagccagcaattttgtgtagctctacctctaattccttcatttgcatttatttctgctttcaagcccttatatgaggcaaatgggattaatttatttcattatcttaactagattcattgctttaatttgtcaaactctgattgatttgctcaactcaatcttgtgtgttcaagaacttaatgtggatttctgttccacctcatgaaagtcttttccaaaaacttgctaaattcttgactcaagacattccagttagtaatgcatttctctgctcaaatacaatagaagtgtgctctaataaatactcttcaacaatgtgcagttatttctccccaactatcaattccccttaaagcagaattttactaaaaatggctttatccttctgggaataatcagtaaaatggcaattggagggtgaatttaaaatatactaaaagcagatggcagaacatgagtgcagatttttactacaaagcttaggaagaacaaaaggaacctgaatagagaaaatgcagaaaagctctccctgggctattaggatgtagagagcagaagtatgtttaggagcttcaaagagtctgtctctttgcaactgtttatcttaggactttaaggaaataaaaggtgcaagtgaaccactctggattataaaatagaatttcacacagaaaaatcaactcagttaatatgcatgttgcttacatggaaatgttgagaaatttttagcaaatagaaagtggtagatggtaggtatatataaaataattgcagaaaaaatgtgaaatgaagatgtatggtattacttttatatttaaattgttaatatgttgcccataatgctttatttcaaagaatgaaaaaccggaaaaatagttccttcctaacttcccctgcagccttgtcttgtggagcttgtattttacttcatgagaaatgccaaagatatgtcatttaagctgaaacctccagcagaattagccagaatatttgggaaaaagatgtttccagaaaaagagctagtataaatgtccttaagcaagacggagctcatgatgattgaggaacaacaacaacaaaaagattatttcacccaagaaaagtgaattgggagtacagatataaatgatgagatctgaatacgattcatggagcaggtcaaactaggatgtttgggtgtggtctaaatgaatgggtggcatgagttgttttaaggagaggagtgacatgatttgacaagttcttaagagatccctttgattactctggggagaatagaacataaagtagcagaaatgaaagcaaaggggagatagtgggaaataattgcacatttataagcaagagatgatgttggctgggactctgattatagcaacagatgaagaaaaaaggaaatactgagaatagttgattggatttgctgacattctcaacataaatggaaatcagtatttttttctaataaatatgatatgcataaatatttttaaatatttaattcttttaccaccagtggggcatgagtagacttcaggaaacatgccagtacagaaccatataaatgtgatcattggtagagataggctttaataggcatttgaatgtctccctcaacctggaataccacgaaaaaagcttttcgcttcgcatgttgcattattatcataccctatagctttctaccattttcagttacttaatattatgttttgcctcaataaataatagtactttctcttattgtattgtattgtatttgcagcaattattagtgaagttttacgtttcaatattacatctaaaacaaaacaaaattgtcccatactattttccattaaaacacgagatcactatgacaaaaaaagctaaaatgtcatgaaatgacttaaattggatgagagtatatgaaatacattaagaaataatctctgactctgtagtttttttatttgtaggttttactagaacatgaaatcaatatgtgaatcctggctggagtttgcatctaaatgtaataaaataaaatgaagtttaatattatcattgaaccattagtgtacattagtgagctggactatataaaataaactttattatatttagcatttgatttttatttatgtatattataaaatgaatatagtttatattataataaaaataaaagaagtagtatgttaactaattcgtataagatgcctacaaactacatacctgcctaaatttttgacctgtgaaacttcaatggtttgtgttagggcctacatttatatatgtacatgtgtagtgtatatatacatatatatatatatatatatatacacacacacacacacactatatatatttttgtgttatatatacacactatatacacactatatacacactatataggtttgtgttagggcctacatttatataggtacatgtgtagtgtgtgtatatatatatatatatatatacacacacactatatatatatatatacacacactatatatatatatacacacacacactatatatatatatacactatatatatatatacactatatatatatatataaaaatatatatatatatatttagggagggcattgttaatcctttaattttaaaaattttaactttgcagacaaagttgattatacctgtggcagaacaatgcatacagcaataaataaataaataacttttattttctgtggagctcccagaattatgaattattggatagattgagatttgccgaggtcattttcttagagttgcaagagcataggagaaagtcaagggaaataataagcagcacttgatttcctttaccacagaggatgggattctaaaaccaaattatctgactataaatcaagacctatcttttacaggctatgtgattgtggatgttacctcctctatgcttcaatttcctcatctgtaaaatggaattatagcctaccctattttgtagtatagtgaggataaattgagtgaatgtatgtagttcctagaatagagcatgacacatgataagtggtcaataaaatattgtttactactagttatgtgacagtcacttcacacatagtaatgatttaataaaggagcaagaagaatgtagagcacagcttctcaacatcggcactacgacattttgggtcagacaattatttaatgcagagggggccataggatgtttagcagtgtctctggccagtagtgtacctcctcctctccaagttttgacaattgcaaaggcttccagacattgacaaatattccctgaaaagtaaaattgtcccggcttgagaatcacaaatataaagtaaccactcaaagattacattactaattttgattgaatttgaccagcattatgaaatcaacataagcttaagtttctacacttgattttgtcattgtcagttagggcagcagagaactccagttctgaaaattctgagcatgtgctaatagcctataatataatcaaaactttcattttgaattgtatttcttaaaaaatagaaaacgtattaagcagcaacatggaataattaaccacaaaaatatggaacataaatctcatttgcctaatatctcttttgaagtcctgtttcactgtataagtattatgtgttttgtttcacagctagatacagccagttttttctctaagcctaaggttactcctcaaatttatggtggctttttgctcttctaagtttctataaaacttcagcaacctgcagcaggttgaaatttattgatatttagttattcaccaggccatatttacagtcagggattgacttacccaaaccagatgctccccctgccagcagatcactaggagatattgcaataatttccctggttactaaattagcaaaagattctcagggagagagaagggcaagatggcacagtttaatacttactattattcttttattctttaccatcattccttttgaatggattaagaatctgacatacacataacttactaacgaaagggagttaggtgagagggaagacatatttgtctaagaaaagtcttagagaaatattttgaaaagagatagaaagaagagttggattggagtgggtgggtagggaatcacagtaaggagatggatcattcacaatttctttagacatggtgaggcagccacaggaagtctgaacttgttgaaaccctaatccgaagccaaaaaaagtgctcaataaggtcatactttgatcacctctgcctaaagcagttattcacaccctacttttgggagaggaaacatctacaaacctttgttctctttgtttgttagcagagggatgacatgaatttgggaaaaaagtttgagagacagaatgagatttagctcaaacaaatgattgactcatgctgggttgaaaatgtgctctagccgtatgtagaaagctgaaactggatcccttccttacaccttatacaaaaattaattcaagatggattaaagacttaaatgttagacctaaaatcataaaaaccctagaagaaaacctaggcaataccattcaggacataggcatgggcaaggacttcatgtctaaagcaccaaaagcaatggcaacaaaagccaaaattgacaaatgggatctaattaaactacagagcttctgcacagcaaaagaaactaccatcagagtgaacaggcaacctacagaatgggagaaaagtttgcaatctacttatctgacaaagggctaatatccagaatctacgaagaactcaaacaaatttacaagaaaaaaacaaacccatcaaaaagtgggtgaaggatatgaacagacacttctcaaaagaagacatttatgcagtcaacagacacatgaaaaaatgctatcatcactggccatcagagaaatgcaactcaaaaccacaatgagataccttcgcataccagttagaatggcgatcattaaaaagtcaggaaacaacaggtgctggagaggatatggagaaataggaacacttttacactgttggtgggactgtaaactagttcaaccattgtggaagacagtgtggccattcctcagggatctagaactagaaataccatttgacccagctgtcccattactgggtatacacccaaaggattataaaacatgctgctataaagacacatgcacacatatgttcactgtggcattattcacaatagcaaagacttggaaccaacccacatgtccatcaatgatagaatggattaagaaactgtggcatatatacaccatggaatactatgcagccataaaaaatgatgagttcatgtcctttgtagggacatggatgaagctggtaaccatcattctgagcaaactatcacaaggactaaaaaccaaacaccacatgttctcactcataggtgggaattgaacaatgagaacacttggacacaggaaggggaacatcacacactggggcccgtcaagcggtggggggaggggggagggatagcattaggagatatacctaatgtaaatgatgagttaatgggtgaagcacaccaacatggcacatgtatatatatgtaacaaaccggcacgttgtgcacatgtaccctagaacttaaagtataataaaaaaaaaaaaaaaagaaaagaaaatgtgctttttcaacaggtaggttgaaaatgtgcttcagcatttaggataccagatgtaaacatccatgcatagaattagaaaggttcaactttcatggctgctatggtttgaatgctccctccaaaacttatgttgaaatttaatccaaaataggataatattgagaagtggactttttaaagaggggattggatcatgaaagttcctccctcatgagtggattaatccattcgtgagtggattaatgggttatcttgggaaggaaactggtggatatataagaaggggaagatagacctgagctagcatgttagcattctcagccctctcgccatatgataccctgtgctaccttgggactcttctgagagtccccacaagcaagaaggctctcaaaagatatgccccatcgaccttggatttccaagcctccttagctgtagaaaataaattcagttctgtataaattacttagctttggatatactgctataagtaacataaaatggactaagacaatggtcttatcctgaactttgtaaactagaattggctgtttagcttcagcatgtatttttttatagattcaaaataatttcattttgaattgcataatgaaggaatgtcataaggttttcagcatatagaggctctaaatatcagtctggcattgtgataaagcagagagtttaaaccaagtcctatttgtgacacatgacctttctttctggttacagctcagtaacataggaatggatacttaactcaaggataagcatataatacatgaggctttttttcaaaattttgatttagaaaatgaagtattctagtatgttaattatagacatttcaactgagaagtctaatagcattggaccagaatagtcacagcagtccaaagccatggataaacttaagttaaaggcaacaaataataagagccttccacattaatctctatcagagaagatgataaacaggtgaatggggactagaaaccatgcagctttagaactagacataaaacaaacagctatctaatgatttcctatttactatgagcccaagatattcttgtatcctctcagttaagctcctgttttactaaggaaatttaagtaagattctgtctcttgcaagaaaataacatctaagacatcttcgaatttaatgctgctttaattttgtttataccagtggtccccaacctctttggtaccagggattcattttgcggaatataatattttcatggacagggttggggggaaggtttcgggatgaaactgttccaccactcagatcatcaagcattacactctcataaggagcgtgcaacctagatcacttgcatgcacagttcacagtagagctggtgcttctatgataatcaaatgctgccagtgatctgacaggaggcagagcttaggagtaatgctcactcatccacctctcccatcctgctgtgtggcccagttcctaacaggccacggaacggtaccagtttgtggcctgggggttgggacccctgttttacactataacatttgcacacgtctctcatggcctgtctttcagatctgctgtttgtctcgactcaagtctagctacctgaaaattagattttttttttaaattgaatttgaatatcttaaagttgaatacacagtctccacttttacacggcccctactgtcttacatcatacctctctagccctggaagatagcaactttacattcacttttcctgttttagggctattattttatcttcagttatcaaaatctatctacttttaaatactttaacttgaaaatacatagtaagcaattatggattatttaaaatagttttcccatgagtataaaaaaaaaaagaatagcaaaagcaatatttgttgagtatttaaaagtgccaggcactgtgcaacatgctttgcttaagtaaatgtttgacaaaatagaaggtcttttaaaagttccatgttttaacgttaataaccatatcaagataaggttagatattctatcaaattaccatttttgtgaagataggccttttctgctatatagaatctcctcaaacctgagtgttcacattatggattatctagtatactccacagctatcaagtttgtttgtgtttctttctcaagtaagctatcttatttatcttatttctccttatttcttcagacttttcctctcatttctttctctttttctggttttttttttttttttttttttttttgagactgggtttcgctcttgttgcccaggctggagtacaatggcatgatctcggctcactgcaacctccgcctcctgggttcaattgattctcctgcctcagcttcttgcatagctgggattacaggcatgcaccatcacatccggctaactttgtatttttagtagagacggggtttctccttgttggtcacgcttgtattgaactcctgacctcaggtgatccgcccacctcagcctcccaaagtgctgggattacaggcgtgagccaccatgcctggcccctatcctctcatttctaaggaaatgacaaattaagtattttatgcaaatacagtgtagggtcatttaaaatattttttgtaatagatgtctctgtacataaatctatttaattttttcttttacaataaaaaggtattaatgtgttttagtttcaccaaaaatttcagtagaccaactgtgtaaaggtacacatttatatcaatttttttgacctagtaaaaactaaagagggaaagttattcaaatatttcagcataaattccctttccttgaaattgcaatcgtcatgtgtagctacaattgctcagtattactctgtagtatgagtagctacaattcctcagcataagaaacactgaagtagacaattgttaagaaaacaaagtcataacaaaacaacaaaaacaacaaaattaaaaactaggatatagaaacattaactaaatgttactcttgaagccgatataagagaaattattgtactagacactgtggttcatcatccagatcccatcttcatgggaacacatcaatcccacactcataggggatatcagcagctgaccattcacatctgtacctttcacgaaatattgccctaagacaaactaaaatgaactaacctgcccaaagcggtgtctcctttcggagagcatccattgactcatagctggctaatgtagtgatacaaagatgcaactgctttgcctcaatttgggacaactctgaaagatgcccagtaggactggctgaagactcagttcaaagttgtcaaataaagtaaaccatgcccagttgaatttacattgtttagtatgagtatgtcccatgaaatatttaggaattacataaactacacattattcatgatttatctgaaatttaaattcaaccaggcaacttgtaccttcacgtggtaaatctggcagcttttacttagttgcatctgcattgtaggtaagcatgtcggtatgcacagacctctcttccgtgcttccttacaagtgcgtcccagaaaacaagtattcatctcagagccaacgggcattgaggcattcgataatcatactcccaaaggtcaaggataaagaaaatatcccaaaagcagcaagagaacaaacaagcaaacacataacatacaatggagcttcagtatatctggcagcagattttcagtggaaaccttacagccaggagagggtggcatgacacatataaagtgctgaaggaaaaaataaaaaataaaaaacttttaccctacaatagtgtatccagtaaatatatcctttgagcatgaaagagaaataaagaccttcacagataaacaaaagctgaggaacttcatcaataccagacctatcaaagaaaaggttgttagtgagcaagaataaattatctgaggatacaaacctcactggtaatactaagcacacagaaaaacactgaacagtgtagcactgtaatggtgatttataaattactcttgacttaagtagaaagaataaatgataaatcaatccaaaataataactacaataacttttcaaaacatagacagtataataggacatcaagagaaagagcaataagttaaaaagcggggggagattttcaagtgtagaatttttattaggtttctttttggtgtttgtttgtttatgtaaccagtgtaaaattgtcatcagtctgaaataatggtttgtaagataatatttgcaagcattgtggtaacctcaaattgaaaaaattacagcagatacacaaaaaaaggaaaagaaagaaattaaatcctactgccaagaatatcacctccactattgtaagaaaggaagaaggaagtgaagaccacaaaatcatcagaaaacaaacagcaaaatggcaagagtaagtccacacttatcaatgataacttgtaatgtaaatggactaaatgcttcaatcataagacacagaatggctatggctgaatggatttaaaaaaaaagacaaattatctgttggctataagaaacatttctcctataaagacacacatcgactgaaagtaaaggcacggaaaaatatattctatgccaataaaaaccaacgaaagagcaggagtatctatactcatataagacaaaatggatttctcgacaaaaactgtaagaagagaaaaagaaggtaattatataatgataaaagaagccaattcagcaagaggataaaatgattgtaaatatatgtgtacccaatactggaacacccagatataccaagcaaatattattagcgataaagagagatatagaccccaatacaacaatagttggagacttcaacaccctactttctgcattggacagatctaagacagaaaatcaggaaagagacattagacataatctgcactatggacaacaaggatctaatagatatttacagaacatttcattcaatagctgcaaaatacactttttccttcttctcctttttttttttttttttttttttaaagacagagcctggctctctcacccaggctggagtgcaactgtgtgatctcggctcactgcagcctccaccttctgggttcaagtgattctcctgcctcaaccttctgcttagctgggattacaggcatgtgccaccatgcccaactaatttttgtatttttagtagagaccgggtttcaccatgttggtcaggtggtcttgaactcctgaccttaggtgatccgccagcctcagcctaccaaagtgtttggattacaggcgtgagccaccacacccggccaaaatacacatttttctcttcagcacatggaacattctcaaggatagaacatgtgttagatcacaaaacaagtcttaaaacattcaaaaaaattgaaatatcaagcatcttatctaaccacaatggaataaaactagaaatcaataaaaaattaattttggaaatttaaaatatatgctcttgaatgaccatccagtgtttcagtgaaaaagttaagaaggaagttcaaaaagatccaaaacctatgatataacaaaagcagtactgagagaaatttatagcaataagtgcctacatcaaaaaagaagaaaatttcaaaataaataatcaaaagatgcatcttataaacctggaaaagcaagagcaaaccaaacgcaaaattacttgtagaagaaaataaataataaagacaagagcagaaaaaaaaattccaatgaagaaaacaatacaaaagaataatgaaataaaaagtttgtttgttgaaaaaataaacaaaatggacaaacttttaaccagctcacttagcaaaaaggagaagacccaaataaataaaagtggagatgaaaagggagacattacaactcataccacagaaattcaaaggataactactggctactatgaacaactatataccaataaaatggaaaatctagaggaaatggataagttcctagacacatacaagctaccagaatagacgcaagaagaaataaaaaaactgaacaaccaataacaagtaacaagattaaagctgtaataaaaactatcccggtaaagaaaagcccaggacccaatagcttcactgctgaattctaccacacatttaaagaactaataccaattctactcaaactattctgaaaaataaaacaagacagaatacttcaaaactcattctatgaggccagtattatcctgatatcaaaatcagacaaagacataaaaaaaaactataggccaaaatttctgatgaaataaatatcattgcaaaaatcttcaacaaaatactagctaaccaaattcaacaatacattaaaaagattattgaatatgacaagtgagatttatcccaggtatgcaaggaaatctcaacatatgcacatcaatcagtgtgatacagcatatcaacagaatgaagggcaaaaactgtatgataaattccattgatgttgtaaaagtatttgataatgttcaacaacctttcatgataaaatgtctcaacaaactgtgtttagaaggaactaacctcaacacaataaaagctatatataacagacccacagctagtattatactgaatggggaaaacctgaaagcctttcctcttatatctggatcatggcaaggatggccactttcattactgttgtttaacacagtacagaatgtcctaggcagagcaatcagacaagagaaagaaacaaagagcaccccaactggaaagaaataagtcaaattatccttgattgtagatgttataaccttacatttggaaaaacctacagactctatcaaaaatctattagaactgataaacaaattcaggaaagttgcaggatacaaaatcaatataaaaataaaaaattttagaaataaaaaattcaacacatttacaatagccacaaataaaataatatacctaagaattagccaaagaagcaaaagatctctagaatgaaaactacaaaagactgatgaaagaatttaaagcatacaaagaataaaatggaaagatattccatgttcataggttggaagaataaatattattaaaatgtccatagtacccacagcaattcacagattcaatacaatctatatcaaaataccaatgacattactcacaaaaatagaaaaaaattctaaaatgtatgtggaatcataaaacacccagaagaaccaaagctatcaaaaaaagaaacaaacaaacaaaaaaaacctggagaaatcacattacctggcttcaaattacactgcagtgctacaataatcaaagcagcatggtctgggcatacaaacagacacatggactaatgaagcagaatagagaacccagaaacaaatccacacatctatagtgaagttattttcaatgaagatgccaaaaacatacattggggaaaagatagtctctttaaaatatggcgctgggaaaactggatatccatatgcagaagaatgaaacttgacccctatctactgccatataggaaaatcacatcaaagtggattaaagactgaaatctaagacttcaaactatgaaactactacaaaaaattgaagaaactctgcaggacattggtctgagcaaaagttccctgagtaataccctacaagcacagaaaaccaaagcaaaaatggaaacatgaaatcacatcaagttaaaaatcttctgcacagcaaaggaaaaaatcaacaaattgaactgacaatccacagaatgatagaaaatatttgcaaactaaccatctgacaaagtattaataaccagaatatataacaagctcaaacaactatataggaaaattgataacccagttaaaattggcaaatatcaaatagacatttctcaaaagaagacatacaaatagcaaacgggaacatgaggaggtgctaaacatcactgaccaccagagaaatgtaaatcaaaacaacaatgagatatcatcttacaccagttaaaatagttttatccaaaaaacaggcactaatgaatgctggagaggatgtggagaaaagggaatcctcttacactgtgggtgggaatgtaaattagtacaactactatggagagcagtttagaggttcctcagaaaactaaaaatagagccaccacatgacccagaaattcaaattttaggtataaacacaaaagaaagaaaatcagtatatcagatatatctgcactcccttgtttggccagcactgttcacaaaagccaagatttggaggcaaagtgtccatcaataggtaactacatttaaaaaatgtggttcttatatacaatggagtactattcagccataaaaaatgagattctgtcatttgcaacaacatggatggaactagagctcattatgctaagtgaaataagccaggcacagtaagacaagcataacatgttctcacttatttgtgggatctaaaacttaaaacaactgaactcacagagatagagagtagaagccttggaagggtagttgggggtggagggaggtggttaatggatataaaaattagtaagaaagaagcaacaaaacctagtatttggtagctcaacagagggactatagtcaacaataatttaattgtaaatttaaaaataactaaaaaagtgtattggactgtttgtaacacaaaggataaatgcttgaggggatggagactcaatttttcatgaggtgatttttacatattacatgcccgtatcaaagcatctcacataccccataaatatatacacctattatgtacccaaaaatattaaaatttaaaaatatttaaaaatttacttgtaaaacagcctcaggccaatctttcaggagatattgcacaagaaggcattgttattataggagacaacagctccatgtgtgctattgccccaaacacctttcattgggacgagacgtggacgtggaagacagcgatatagatccacatcttgtgtagccctaggctaaaatgtgtttaacaaaaaaatttaaatgttaaaaagtatacatttaacaaaataaaaaacttatagaacaaggatataaagaaagaaaatatttttgtgcaggtgtacaatgtgtgccttaagctaaatgttattacaaaagagtcaacaagttaaataaaagtttattaagtaaagatacagtaagctaagattaattactgaagaaaaaattaataaatttattgtgatgaagtgtacagtgtttataaagtctacagtaatgtacagtaatgtcctaggccttcacatttagtcacttctcattcactgactcacccagagtaacttccattcctgtaagctccattaattgtaagtgccttgcattggtgtaccactgcttactatttatacagtatttttatcataacttttccatgtttagataatcaaatattttccattgtgttatagttggctacaatttccagtacagtaacatgctgtgcagacttgtagcctaggagaaataagctataccatatagcagaggtgtgtagcaggctataacatctaggtttgtgtaagtaagtacagccaatcatgttcacacaatgacaaaatcacctaatgcatttcttagaaactatgcctatcatcaatcaaggcatgactgtatatcagaccactttacttatccaaaatgagccttgtgacaaattcactctctagaacaaaattggatgatgaattagtaaaaagaatcccttaacacaaaaattatgacattttcttacatcttttactttgttagaccaagaatagaagacttttcttctcactagtaactgcaatcaattggtatgacttggagtaccaggtatatcactcttggcaacacatctatttttagtaggacaaaactgatgtgaaaaactgaaaatctcttcaataagagcattgaaactaggaaaggggtttagtgagatttagtatatgtatttatttacttctctgtggtttttaaacttatcttacttcctctttttaaaactctgtcagatttatcactgatttcagaattacaatctttaccatagactacaaatccctgagtagttatgtgatttcctcccttctatcttcccagtccatctcataccatacatttattggtcttctatgtcctagacacaccagccttttaagaggactctttattaatcacaaagatgttgaacagatgattctgacagcctggaattttctctctccacttttctttttcttttacctaggttgaattcattgtttagatctcaactgaaatattccttctttgtggaagcttcaccacatgacccagattatgctaggtctcataacatgctggggccttctcaatattgtgattaaccatgagcatgatgtattttgcctggactatattgcagacaaagggcggactgcaaatgcagctgccgaacaaatatctgtggaaagaaaaaatgattccttattttagacctctactctgtctcattagcattaaatgtcacacaagtcttccaagcttatttatctgattttccaacctgagataaaatagaagcagctaatagatacacagcacagtggaaaggcaatattagaaataggttcagcaggacaggcgcggtggctcacgcctgtaatttcagcactttgggaggctgagaagggcggatcacgagatcaggaaatcgagaccatcctggctaacacggtgaaaccccatttctactaaagacacaaaaaattagccggtcgtggtggcgggcgcctgtagtcccagctactcgggaggctgaggcaggagaatggcgtgaacccgggaagcagagcttgcagggagccgagatcgtgccactgcactccagcctgggcaacagagcgagactccatcttaaaaaaatgaaagaaagaaaagaaaagaaaagaagaggagaggagaggagaggagaggagaggagagagagagagagagagaaaagaaagaaagaaagaaagaaggaaggaaggagggaaggagggaaggagggaaggaaggaaagaaggaaagaaagaaagaaaaagaaagaaagaaaggaaggaagaaaggaaggaaggaagaaggaaagaagttcagcaatggaaaagaaagtaagtcataaaagtgaattagaatgcaaagtcaaagaacacatccacatttaatgggtttttttttgtttgtgtttttgaaaatttaattgaagaaagtaaagttaccctggcttataataaagttagatattataacaaaagataagtcagtgaccttaatatgcaatgtgttttggtttactcatcagataaaatatgttattaatgaacaaaataaaaaaatctaaaaaaggaacatgtagagaaacctagagcttagcagtatagttctctgaaatattaataagttaagaaatatacaccaatgagaaatgacttcagaagtttcactccaagggccattatagctctggaaattcttaaaggattcattaaattttcaagcacagaaatttgttcatttaattgatttttatatatgctttttaccccttttgttagttctgatcatccttaacctacacaccaaatatgctacaattaaaaagagaaagctcataatattttaatccccaaacataaaaactgaatttattaagtacctactaaagtctagaaactttgttacacataccacataattttataactaaatatgtaacatcacaaaatcgagattcaaaatctaacattggtggaaaatgcaaagcatgagtttaataagatattaaccaaaatgcacacctctgtctctgctataactacctcacctctggtttgcactagacttgggttgccacttgatccatagagaaccgttattaaaaacaaaccagagagtaattatgtcaaaactcacaaagccctgatttaaatcatgagaaatctgaataaagcctcccttgtcacacctgtctaattagcacggactctaaattgaggaggggagccctaaaaaggaattttgttgtagctgtaaaaatgtatactctttaccagcagttacaaaaacaaataatcttcatttgaagcaagctctccaatttttcaccaggatagtgaatgagcaaagctacatatatcctgcagagttgctagacacacaaagcaaaggatataggtattacactaattaacaacaatgggacaaatcattaaacatcaagtagaacattcagccaagatgatgaacaaattatctgtaagctaagattaatttgttactgaagaaaaaaattaataaatttagtgtgatgaagtgtacagtgtttataaagtctatagcaatgtacagccatatcctaggctattaaatgttataagtattagtagtagcagtattggtagtattatcctcttttcaaattttaaccacagagcttacatatgtataatgataacatgataaataggaatcagtttttacattggttttgatggttcacactgtctcaactcatggtatcttgttagcaaaagtgcctctattgtccagttaggcctgattttagtctggcatacaattaaatctaatatgtggatgcacataaacagtttgattagatttttggggaagtaggtttctgcagacatgagccactgcttgaatatgcaatatactaatccaatcaatcaccttgatacatttagttgttttatttttataattctctataacaggtttatcagtcaaatttattggttatacttattggtgtaaatgaagaaatactttttttgttccctctcatcactacctttaaatatgctcgttggaatctctttttcccatcacttgagaataactccagccaatctccagctatctagcaatttccaaacacactttcaataaaattgaaagacaataaatctatttttggtaaatttgacttactttcaggttttaaaaaggtctagttgcatgtaaattaaaactacaattttgcaaccaaattaaaacattttccctacctgttcctcacctagctcagaattgatatgtaacaggaagacctgtggttgtttatccagatgtccttcttttgtctatggctccattaggattgtaatggggaaaacaagaatcatagcaggaagaattaaaagaaaagagaaaagctttttttttttttttttttttttaaataatctcatctttatttctattgagaggcaggcacccaaatgcttcttctgtcggggagtgaatttgtaagttctttgtaactctgtgctacctatttgttaacctgagtaatttgttctcctgctcacttcttgctaacacttgccagcggatacctgaagcctcttacatcttctgtggcatgcacttggcctatatatagcatattcattcacctaaagtgggaagaataatctggcatcttttctctttccccatcttgccatcaaaagctgcctcaacgagcatgtagccttcagaattttgaaagccagaagcaggtaacaacttgccatgtttagcttcatcttgaaactcttgaggacacctatcaaactttcccaaaactgtctcatcatgtatggttccattgcaggatgggtgcaatgctgagtgccagcaggggaggaatatcccattctttccttcttgaaattgcccccagtctttttgagctctcttcctatttggaaggagaactaaagcaagtttagttctcctcacaaaagagaaaataattgaaagcactctcacttaggcagctaattcactgtctatatgataattcttagaatgcctagtcctctctttacataagagcacaggtaattgaggtcaatgaaggttgtagagtcacagaacttgtctggctactttttattaaatcctgcaaagacttaactattcttctgtaatttagggataccggtcatttaatagggaataaacaaaaatctgagacataaggaaattctgtatccattctatatatgtataaattatatatagaaaaatagtttagaagagttaatatcaatttgaaaataggaattttaaagctgtgaataatacatagcataaatatgtataaggattcagcaaaatgttagttgacatgtggctaaataaacttaaagtttaagaaagataagaaaagaaaccaaatatgcataaatctggggacaaaatttgatattgctgctaataaaaaggggaggggcatcatattgggaagcttcattaataaaagtaacaaattatgagaacaaatagtcttattatagtttatctggtgaagcattttaatgaggcgtagttgtctgttccattacggaaagagttttcttatgtgtgctctggtagattttcatgtggccacactgaaagatactcccaaatgtctgactaataattctatttataggcaactgttctgaaggtttaaagtaaggaggatgaagttcatttggaagcagtggggaaaaaaatggtaatgctgggctttgaattttatggatgctgtagctgttctttatttttcaataaataaatgttttaaatgccatgttttttagctattgcagttaaactgccctcatctttttgcccagcaaaaaacccattaagttattcactgagattgactctagattttttataaaattaataactttgctaccagtttctcaaaaatgagtagaaacgacttttcaatgcaaatgccagtttttgctacagtgaaattattctgtctgtagtgactatttgaacatttatgggcaataggacattgagagatttagtatatgaactacgaatagatttatccttagattatctaatacatgttttccaccttgcaacataaaacctgatctctttttaaagtcctggttgttctgaaaaatgaaatgaaattatagtaaatggaattttgactggggggaaaaaaacttcacatgatttaagagaatggatgctggcaattgactatctactgtttattcaaagcttatagattagcaaccagatgtggcagaaagttggctgtttttcattcacaacaaaaacgatgctgtgcttaatgaacggaggtttgttatcccagtaataagtaaaaggaacatgaaagcccttgtgtttaatgcttatgcaaataagctatttgcaggtggcttttgggcagaaggtaaaatagtttcaaaactgggtcaagttttttaatcctcaaaaattgccagctagaggaaaacctcctaaaatctttattatgctatttgccaagtaaatgaaatgacatcatttatcatttaataaattacatatgaaaattcttttccttatgatttcatcaatcaacaaataaattctagaggattctagatacatttatttggcatattttttaatgcggtatcaaattttgtggatattcttttagagaatcaatttcttaaaatggcattgaacatttaatttaaaatgcccttcttgaaccatacatgtttattagaaaattattttatataggttgtccattaaaaaacaattttctatgtatgtaaacatttatgataactgctcaatattttggtccatatttatttatctacctatttattacacaatacaaatattacactttgtaaaattaaaggcctagtctaatattactctatgtcggaagtaaaataattcagagaagtctatattaaaagacaagataaaacacaaaatgatgagaatcacaaaaccattgccaaattttcagctatgacatttattctccatgtggccttaggtatcttactctcttattttaacctttgatgactataaaaataatttgttactaagaagccctctcgctttagtagctgtgactataaaattaagaacataattcacaaaaagtgtttgagtcttcctgaaaacattttaaaatatcaattaatcattgcacaatacacaatcgcctgatcatttgctaaaagagggttgcattctcatctctgttcactctgtcctttctgagactcatataggtgtgagagctagaaaaaatattaatgtgtagcaattcagattttctcattgatgaatcacttcagcagtgcacagaatactttgtaattttaaaaaggtgtttttattaatatacttctactattctaccccaatcaacagcaaatttacctaaatcatgagactgctggaactgctaagttttataaataaaagacttaagaactactattaaaccctgtgaatcctttatctacaatgagaatgtccatgagtcagctcttctgaccctctggccagtgttctggagttactgatctgcaactttctaattgaactctagcttggtatgtgagagcagctgtgggttaaccagcggggcgacatttaagtcttgacattgccattaatgattcaccacctgttgcaagttcaataagttattcacacaccaaattgtggccacagaattcattgagataaactaagttagaaggattgggtgtcaataaatgtttgctaaatcagaattgttaatgatagaaatccgtagcttaacaaagttgagaaatcttgtcttcttaacgtgtatttattgacttcccaggatatgtcttagtgaggaaacatagcttctggcatttattattagagggataaggaataataaaccacagtgattgagagacagggaaaggccgggggacctagagacacagtaacagaagaagtttaattggctaatgaaataaacttgagataagagagcagagaggaggttcaagagatgaaaccacatattcctctctatctgctcccaccatcaagggaattaataacatattttataatgaatccctgataaatattagtgtataattgaaaatctattaaaatgactatttctcagggtgcagaaaaatattaaaacaagtaaagttgccataagatggaatattatattttcctgcatgtctgcttcaaggctgaatcctaatggtcatgtatgtaggtaaattattcttcctacagcaacttctgggaggtggtatgtggtggggtataaaaggccaggggtgtagtgagggtaaagtgtaagtactttgatcttgagccttgactatattggacttgggatctcagaaatcttggggataaaccgtggattaaatccataaattcataaagtgttggttatacaacgggtagaaactacgtgccacttttggagggacagtctcctttttttttaaaaaaaaaaaaggccttaaaggctatatatatatatatatatatatatatatatatatatatatatatacagtcttttttattataataaatactattttgttttttttaaatgaaacaatctgcacatatacaactccactctgaaggcaattatttacataattatgcataaattcctatagttatgttagtagttgcctttcttcagagtggagtcatatatgtgcagattgtttcattttaagaaaagaaatatttatttatttgattaactgaaattatgcttaaaaatgattaaaatgcacagatctgtcttcatgaagtttaaatgtcttataagaaattaaagtaataaagactacaacatttattatttaactgtaactgtagtgggtagtaaaagagaaagcccagtgtgttggctttcagtagtaaaaaacccaacttgtggttaggaaacgccattgtttattgtatctaaattaatcaagttgtatcctgtaacaggtttcctgttatccactcgtcttccaacttctgaagtatgctttaaatgacaagggagaaacccagacactacattttctaggatctcagcacaacagagctccaggtgaaattatgctaaatagtggcatgagcgtgagatgtgggtggcataaagaagaggtttagagtgtttttctggtgacctcctgtttaagtttgacaagcatctgaaatcactgctagcaactttcccataattattgtgtttccagcctttatgaaaatagcagcaattttttttcctttctttgcctatgtacaccatctaatcatgagataagtctccttcttagtccctatattaaatatctttttacatgaaatacatagattgggatctttttctgacctgttcctgtctgacatattcttcaactctaagatgagttcatactcatcttcggaagcccctgggaaatgggaagttttttttcatattagatgttggtagatatagaggcccatcctttaataaacatctatgtgccagaaaatgtactaggcacttagatacattattcatgtaactctacacaaatgtatcaacaacacaaaaaaaaatctgtataaaataataattattatatcccttatatggaaacagatccagagaggaagatacactagcacctgtaaatagaggatccaagaattaaacatccatctgtcggactgactacaagctctttctttttcataaaatgctaatttctctcctgcttctaatatttgtatcaaaatttgtcatctattgttattgggtttataggtgggtagtgactccttggcttctattttgttctagtggattactgtcttctttattttcattctagtgtttattgagagtcctaattaatcaacctggctgctctgacttccatcagctcaccattgtctcttttcccagctcataatttctgtaacagagctctaagctatgctaaacttctgctatatgctgtcagcctctctaaatccaagtgctcttatctgccaagtttacatacacatgtttaaaatcttcttattgaatctacatacaaagtcttcatgtcttcctccttgaaataatagcattgtgagagaaaaaaaatcttcattctttttaaaactaattcagaatgtctaggtaacacaagaacactctgcaacaaacaagaggtaagggaatatttacctggtatttctgtgcctcattatcattctcactcattataaaattggtatctgaaaaaaatcttgctgtaaaaacaaaaagtaatgtatagagagtataaacaaagagtttgcttcacatcataaccattatgcatcccattgccaaagggaagatagtacactacatgattccggggaggagcatcattcacatagactatagtgtgcatggcacatgcaagagaccccacagtactacccgctttgttctctttgtagacacactcacggatgattcatactccctgacctggagtagccaaataaagagttgcatcagtttattatcattctttccagaccactttctaggtattcccattatacattccttcaaatagaaagattttattctgtaaattgcatcgcactgtacacatttttttctgaaatctgaataatttcatacagtttcaactgtgagagtacctgacagactgacctaactctaagctaaaacactcataaactagcacagaagcttgtcatatcattacacatttatccattgctctaaattacttatagtttttcctgaaacatctattaatattgcagttatttgagatgactgtgagcttactatttgccagtgatgacatgagcaccttggtttagtctagtgcctggcatttaataggaccattctatttattttcctaaactctggcagcaagattagctctaagcatatttttttatcacaacaatcgtccatctttaactacatgtgaggaaagcactttcttatattgcattacacatttttatatggccacagaaatccttacttaatctgacaaaattaagataaatttctttctcctaagttcaaggaaagaatcattctctactgtttccaaggagatgattctccttttctcaattgccaattgtctactgcttgtcctgggttccatcttttcatatgtcatgaggattctcaccccagtgttctgctcctctgagtcaaagcccttgacttttcacttctcaattgttttgtttgtaatttttttgcttttatttttttctccataaatgctatgaaagtgtatgtaaaaatttacccatcttttattttatatttgttatcacattttattcacataccaaactatacaggaaatgaatataagcacatctttcttagtaggaggtagaagtaaaattttgtttagaataaaaacagaaaaaaagagaatccaattccatatcaccagtttgctcctgaatgtgcaataagtttccacttatgagcttgctactgtacacaacgcaagagcttttaaaaaattgtctacatgatagtggttaagagcgtactttaggctaggttactttaaaaaaatatgtcatcattacttctgccatcaaaagctaattcaatgtatcataattgttaaagttgagtagggttaaggattcttctcattctatggtttccttataaacacagtttctaataaatgtctatttttttctgtgaaattaaaccactagatattgctgaatgtctgtatatttcttacatttctagaatctcattcttaatttttttcttatatttttccttcaccaaagtcttaaaacctatgcacctggtgtctattatttaaattctgtgatgtattttatttgactttatttgtgtttttagtcttttcacagaaattagtttattgtgatcttcttttccaaaaggacttaattcatatctcttttccatacctatcttcattagcaggttgcatttcagtttcttcagtgcttttttagataatatattttactacatctttcttcacaacactgtatatgctctgatgatcaggtctctcattttttttaagttcttgtcccctttgggacccatgacaaagtaaagggcagattttttctcacctggcttaaaagtaaaaagccttcatatgtttctcctctgattcttcttaggcccagcatttccaaaaacaaactagtacacaaaacattagagttgcaatgatacttcaaaaggttcaaatactaatttttgtctgctttctctctatagttttcttgtagagaaattttctgttatgaaggttgaactatttgctatatgttaatattttccaaataaagtttccaaactgatatttaaatacattctctcatattcaaacatattctgaactactttctgttgtgtctctagatcaatatttataaaactagacagttcatataatttttttcctttgctaactttcaagatcatatcaaaaagtactactgttgattcggttttttgtgtttcattatttgaaactgtattgacctttttcctcttatttctttatcatttcctgttatttcatctttgtgagtcttcccattaatgtctttttctttttgaattatttattttttaattgacaaataaactgtatatatttaagatgtaccacatgatgtcttaaagtatacatacattgtggaatggctaaatcaagctctttaatgtatgcatatttaatatatgcattaccttgtaattgggccccttgagattttagtatctcagcatttttagtgcctgagatttaaaaaagtcggattaggctcttgcttgcttgcacaaaagccaacatcccttgttctcacaatacaattgcaaactgctgatgtactgtttctttgtcaagcaggagaagataacttcaaggtaacaaaaaacattcgcagaaggaaagaatgcctataagattgttgcaactaactgttgagacccagaagtctggttgctcaggatgttatcagagattaaagaaacacaaacttccccattggttccctaaaactccccctctcttactctctggctgcaaacaaacctctctgctttctcttattgttaagacatatctgacagatcttgccccgttctcgctttggccaagtggaataaacttttatctatctctaagcgttggtgtgtcagtgtttggtttcgactgagcatctggtacatgagcctgaatttgggtctctacaacatcttcacctagttactatttttgtgtgtgtgtggtgagaatacttgaaatctactccattggcaattttcaaatataaatgtattgttattcactgtagtcaccatgatgtgcaatcaattttttgaacttattcctcctggctaactggaattttgtgtcttttgaccaacatctccgcaatttcccccatgccctagcttctgatgatgaccaattaactctctgtttctatgagttttacttatttaaactctacatataagtgagattatgtcatgtttgtttttaagtgcctggcttatttcacttgacataaagtctcccaggttcatacgtgttgttgcacatgacaggatttctttcctttttaaggcccattaaccttttgtagatctgttactgaggtaatcaaagcttactggacaattatgttatttgagtaaattgaaacataacagcttataaagggtcaaatggtagtaatagcctaagaaataggtttggaatattatttcttagcataaaagacaaagataatattggtcagagtcttctaggcttgaattcttggctacttagattttatcaagtaaattgtaaaaggataaccaatcaatatttcacatgtatttctgtatgaattttgatttgacaagaaagactgtgaaaacaaaaccactattatctgtgaactacctaatgtggaaataaatatccttaaataaaaccttgagaaagtatattactcaattttttttctacagatatcccatatgttataatatttaactgaaaacaaaatctttcttcttaagaaaagattttattcagttttagaacgttaaagtttctccactctaatatatacagaacttctctaacctttaaaaatactgctttgcttattactcatgataattgggccacatacataattaaaacacaccatttattattttgccatgtgaaagtggcatctggttccccaacttgacttcaaactgtaattttaaacaaataataaagtgttttgaaacattaatgtcattaattgtcttatctattgtctatgttcatcaggagctgtgacatgcccaaaggaaggtaatcagaggaaggaagagaagaagctaagttctagagaatccattaatcattccttagatgactgaccattttattattttcccaagtaagctgaggctgacaatatcatgaatcatttacatatatcagtattcaaatgttccatttttaaattgggagggggtatgttttagaatagaataatgaaattccctccatctcctcctaatgtacatcattaagaagaatctaatggaaacataaggttctaaggctcttgttggaaaccataatcagaactggaggaattctcttatggaaaacattaaaaaaaggaaattctagcaatagaattcattgttaaagctgtaagttacaacaatattgtctctgcatgctgactgtaatcctctataatcttcaaaggcaaacaggaacagtaataatcttttcatgtactcttaacttccttctctgaaaggctagaaaatgtcttacatgtagcactcatagtgtcatttaatcaaacccagtttctatttttcttcaacttctagatgaatggatgcttagtctttcgggcacaatgtgaatttcttaagggtctgtagactacatctcctatttttacttctcaaagtttctctcaaattgtgataaaaagtttcactctattggtactgttaactgccaaccactttgaaggcctcctcctccacttttttctttttccccatatctaggcaagcagtaagaaaactcagagtctctattccttggctacggcagggaagttcaaaccatttaaatcctgaactattggggctgagggtaagggactcacttgggcccaacccttaaccccattaaataccagaactccactgactcttccttaggtttcacttcccactgaacctgagccctttttgttgtggattattttgccctttagtaggtaataataccatgtaagtaataaatttgtttcatttcctttcagtcttgatatccataaattactaggggcaggggtggtgtagagttgcctagtattcaccaaataaagtaaaaacaacacacacactgagagaaaaatctagagaaacattcccacattgccacacacagttttcttgcttgcttctggtaaatataaccttctctatccatgagttcaattaacaactttggataggaaatattcataaggaaaaatggatggctgcatgaaaggagagtgttctacctgactttattcactaatcaggatatgcctaaaaactgggtggcaaaaactgaactgtaggttttgagaaagattctaataacaagaaaaatgtacaaacatttttattgttgtttatccctaagcaagacagcataacaactatttatacaacatttacattgcattaagtattacaagtaatctaaaatggatttaaaatatatgagagaatataagtaggttatatgcaaatactaggccattttattaaaggacttgagcatctggagattttggtatctgttgggggatgggaggtagggcggcaggtcctggaatccatcccccatggatactgagagacaaacatacatagaagctacaaaagcaaattacttatttcgcctcttgctgttgacttaaggaaaactatgcactgtatcatcagtatagagagttcttgaaaagcctagatcctcccaaagtttgaataggtgttgcaaatagcgagatgtggtgatagctcaaatagagaacctctcgggaaaaccatttccacatttagaagcaagtttgaagtggcagatgactattccttttttataaatatatatatatatatatatatatatattatactttaagttctagggtacatgtgcacaacatgcaggtttgttacatatgcatacatgtgccatgttggtgtgctgcacccattaactcgtcatttacattactttttctactgaaaatattttcttggcttcctgtcaagtaatgtgagttgcaaaaggcattgaagattggaccaactaatgaaatggaatcaggacatggtttcataaaataagagtgtttttttgtaattatttatagtttcttcctttttttatttttttaacttatttatattccaaatacggtttgtcatttagctcaactttttattttgccccacatatcttcttacggcttcttggtttaataggataataaaatttctaaagcaggctggtctatggcttccttaaattaaccctgcctcttctcttacaaaagttactaaaggcaaatataaataatcatgaccaacatataaagatatgaatgagatttacagagaataactttactcagttatatagcgttacccacaaagggaatttactagcttcaattgaaaaaaaaatcccatgacacctatgatatttacttctgtcatctccacattcaaaagaaaacaaacagattacccacatatttaatcactttttattttacaaatgctctgtaaacaaaatgcttctcagacctattcaatacaattaaaatataacatagctttgccaaaaggtgtattccaaagttatcagttagatttattaactgataaagattagcaatttaatgtgaatgttttctttagtgaatatacagaattctctcaaagttaaattattaaaaacatacctaaattcacctaactcaaaaatgtagtattcttatactcaatatctgcacattctcacatatacaaaaatataatctaaatgttatttttaacaatataaaatttgtttctctctttgttattgccaagattgcactgactgttgaaatataaaagaaaaacagcattaaatcaggtgtgataaaatcacctttttctgtttatcttcactactggcatttattggcacttggaaactatttataaactcatattcttattgctaacatcaattattatgcaaatacttgaaatttttactgacttcataaataatgcatgaaagtctatagacttcaactagtgagcattatcttttgtggtttataaatacagaatacagaataaggtatagtttggatgagtctgaacaacagatgtttctgctttatgaattctggtcaaatcatttggaaagagttttgtttatacaataagcatctgcgttttggaaagttaaactaaaaattattttgtcattttctctaatagcttgggacctacataaatctgttaagttgaccttaaatagaactgaaggtgatagtagaggtatttaaaacaagtttggatagtttttacacatgtaaatctataacatacatttaccaaaatctaatatttaagaattaatggaaattatacagttattccaactctaaagttttatgacacaaatatattacttagatagtatcttcacattaattttgtttaaaaatctccattatgctttagaggggatttcagtgagaatatatataccccatcatattttatcaagctgaaaactgattatgcaactttttgtaagtacagagcaagtttaatccatttaactcatgccagacttcaggcatttaagaataactatcaagtattcctttaagaatttttctttacaggctagtcatccttacttccttcaagtaattgttaatttgcttgatgccaggagctctaaattatgtagaattcattttactaatttccattataatatatatttcgtatatatcatttgcttcctcaaaacccacagttcagtttttgccacccagttctgaggcatattctgattagtgaagaaaagcaggtagaaaactcttttactaaaaataaccaaaacatagttgggaggaggtgcttagggcatacatttttgaccttgtttacctcttagccaatactaagtgctttcacatataatcctataaaatgcttctcctccatgctacacttgaataatcaaaattttgaggttatatatatataatttcacaattgcctttttctttctctattcaacaaattctaccccttagacactggctttctctgtttcttctgtggtagttgatagaattttacctatatttatgctaataaatcaattatccagctatattttgcacaggggtcctgctaatcttcttgaattcttccaattttagtatacgtgctgccaaagcaagtgccagctatttttgaagaactgatatgtactcctaagaacacaagataaagagaatcctaggactaaagttggtaagccagttttttttttccatttcctattctttctttttacttctcgtcttccattctagagctgattcacaggaatccttcaaacacttcttggataggtctttctggagtcccttcaaaagttcctgtttatagatgcacataagatatgagagggtctgaattcttcatgagtccatctcttttgttggaactcaagaaaagagactagactggagagtagaactagattttttgagtcatgtgtaaataatgactacaccgcatgtacacatttagatgctgtccccagttcaagagttctgtccactgtcaaaattcatgtccacctggaacctcagaatgtgagcttgtttgtaaatcagtttttgcagatgtaactagttaagatgaggtcgtactggagtagagtaggccctaaatccaatcactagtgtctctataaggaacacttttacactgttggtgcgactgtaaactagttcaagggttgtggaggtcagtgtggcgattcttcagggatctagaactagaaataccatttgacccagccatcccattactgggtatatacccaaaggattacaaaacatgctgctataaagacacatgcacatgtatgtttatcacggcactattcacaatagcaaagacttggaaccaacccaaatgtccaacaatgatagactggatgaagaaaatgtggcacatatacaccatggaatactatgcagccataaaaatgatgaattcatatcctttgtagggacatggatgaagctggaaaccatcatcctcagcaaactatcgcaaggacaaaaaaccaaacaccgcatgttctcactcataggtgggaattgaacaatgagaacacatggacacaggaaggggaacatcacacaccagggcctgttgtggggttaggggagggggtagggatagcattaggagatatacctaatgttaaatgacgagttaatgggtgcagcacaccaacatggcacatgtatacatatgtaacaaacctgtacgttgtgcacatgtaccctaaaacttaaagtataattttaaaaaaaagaaaaaaaaaagaaagtgaaattcagacacggagacagagaagcacacaaagaagaaggtcatgcaaagaaggaggcagagataggaagaaagcagctacaaaccaaccagaaccaaggatttctgagagccctcagaatactggaagaggcaagggaagttccttccctagagccctcagaggaagtacagccctcagaggaagcaccttctaacctccagaactatgaaagaatacatttctgttatttttaagccaccatgtttgaggtaatttgttacggcagctctagaaaacaaatatacacaggactcttctttccaataggtctgaaatataaatgtatatttatatacatctccttgaatatataaatataatagagattaaatataacagatttatagatttataaacatataacagatttatatatttataaatataaaacagatttatataattttgtaaacacaaaatagatttatatagttttataaatgtaaatatatgcatatatatttaatttttaattactaaaattttttctataggctctcaataaggcaaatacacaatgaccaaacagaataataattgcttttcatttatagattataaatgcttttaattgatagattataaagaatttcatttatagattataaagaattactgtgggcaattaaatcaaagccttttcaaaaatggtgcaaaactaaatctatagtattcaactgatgtttaataaatattaaacattattaatatttattgttaattttaattaatttttaattaataattaaaattattaatatttaataaatattaataagcatcttattcaactgatgtttaataaatatttctgtggattattcctctgaaataatattttaagaatacacatgcatagacataaatgtacatacatggttcaatgtggtgttttattccttgcctataattacacgggtaaaaagaatgcatatttatgctgaaatgaaaccattttgctttctaaaaagaaacccagacacacatttctaagtgcaatgacagcaaatactgatacattcacatacattcttttgtcttttgaccttttcaagcaaaatcgtgcaagtatatctaggttacatctgattagctttcacatgttttagcaggttttgagaaattttgttttataactttgataaggtttggctgtgtccccacccatatatcatcttgaattgtaattcccataatccccatgtgttgtgggagggatccagtgcgaggtaatttaatcatgggggcgattactctcatgctgttcttgtgatagtgaatttgttctcacaagatatcatggttttataaggggtttttccctttttgctcagcacttctccttcctgctgccatgtgaagaagaatgtgtttacttccccttccaatatgattgtatgtttcctgaggcctctccagccctgtggaactgtgacttaattatacctcttttctttataaattaccaagtctcgggtatttcttcatagcagcatgagaatgactaatacagaaaactggtagtgcagagagtggggcgctgctgtaaagatacccaaaaatgtgcaaacaacattggaactgggtaacaggcagaggctggaaaagtttggagggcttagaagaagacaggaagatttgggaaagtttagaacttcctagagatgtgttgaacggttttgaccaaaatgcttaaagtaatatggacaactaagtcaatgttgaggtcttgatggagataaggaatttgttaggagttggagtataggtcactcttgctatgcagggagactggcagcattttgccccgcagaactttgaacttgagagagatgatttagggtatctggcagaaaaaattctaagtgctaaagcaatcaagaggaagcagagaataaaaggtttgaaaatttgcaacctgatgatgtgagagaaaagaaaatctcattttctggggagaaattcaagccaatagggaaaatgtctcgaggacatgtcagagaacttcacaatagcccctcccatcacaggcctgaagccctaagagggaaaaatggttttgtgcccctcttccgacaacccatgcagcctcaggacatggtgctctgcatcccagctgcttcagctccagccatggctaaaacgggtcagtgtacagctcaggctgttcttcaatgggtacaagccccaagccttggcagcttacacatggtattgggcctgcaggtacacagaagtcaagaatagagctttgtgaacctctgtctagatttcagaggatgtatggaaatgcctggatacccaggcacaagtttgctgtgggagcagagccttcatggagagcctctcctggggaaatgtggaaaggaaatgtggggttggagccccacacagcactgtctagtggaatagtgagaagagggccaccatcatccagaccccacaatggtagatccatccacagcttgcactgtgcacctggaaaggccacagacactgaatgtcagcctgtgaaagcagctgaagggggggcataccctgcaaagccacaggagcagagctgcccaaggctgtgggagctcacctcttggaaaggcataacttggatgtgagacatggagtcaaaggatatcattttggaactttaaagtttaatgactgtcctattggattctgggcttgaatggggcctgaagcccctttgtgttggccaattacctctatgtggaatggatgtatttaaccaatgactgtatccccattgtatctatgatgtaactaactcacttttgatttcacacgtttgtaggcagaagaaacttgccttgtctcagatgagactttggacttgaactttcgagtacatgctggaatgagttaaaactttggggaactgttggaagagcatgattgtgttttgaaatgtgagtacgtgagatttgggagggactaggggtagaatgatatggtttggctgtgtccccacccaaatctcatcttgaattgcagttcccataatcttcacatgtcatgggagggacacagtgggaggttatttaatcgtggggttggttaccctcgtgttgttcttatgacagtgagttctcaccagatataatggtttataaggggtgtttctcccttagctcagcacttctgcttcctgctgccatgtgaaggacatgtttacttccccttctgacatgattgtaagcttcctgaggcctccccagccctatggaactgtgagtttattgaacctcttatctttataaactacccagtcacaggtgtttcttcatagtggtgtgagaatgaactaatacaatctttttcagcttttgtttcttagggatgcaattcaagttaaggtaagagagtagtgtagtataaatcagccttgctaagacttctataaatcatgaattcagcagctaattcaaagcacaattttgtatatggtacaaaagtatctattgtagatgactaatttcaactctaactatcaaagtgacaaaaaaacgagctatcaacatcagccctcctcaaaaatgtatgcactattttactaatagtaacaactaaacaatgagcaatattaggaagattaaaacccataatgtaatgtactgtttgacagccaaagactttaacaatgtcctattctttctagtacctctggacgctttattcttctgctaacgtcagccctcctaatctttcacattacattcctatattgcaccatttcagaattttctgcctcacagttggaatgttaccagatactcctcagtgtatggaccacctgctattgctctcagctcatgtttggagaaaactggtttatgtaaaattttattttttttcttctggtaaatgaaagctaatttgcaatatgtttccatgggaaaattctaggcataaaaattatataaccacatctaaaattgctaaacaatattttttaaaatacttaaaatttaatgataaatcatagtcataagcccataaaataaagtaatatcaaaatgaaaattaggaacacaaaactatgtgctacagggaaaaatataatccaaaagttctcaaacagtctacaatatctataaaatctgtgtattgagtttctactctgcattcagcactgttttatgcccaaacataatacaatattcctgtttcaagtggagaagtttgggctgtatatgggatgttgtttccatacatcagtggccactgaataacaataaaactcacattctattctcatgaaggcatgcttgtaatggctactgccaaatgagactctattttacaatagggtgtgtatttcttatgtatgttttatgtatctcccttatttaaaggatttctttccatatgcttttcttttattaaagttgaagattctgttctactttacttttagacaactaacttttgttgtttattccatagagtctctatttgtttctcaccaatcaatgttgggcatgaagccaggcccaacagaagcccttagtccatggagaattacttttattcacactaccgtaagaattagtatcttaaaaattttccaatatgtgaatgtagtgcttagaaaactttaatcattctacattgcctttggcattacaattaaatatctggcttaatatataaagcctttcacaatttaacttaatggcagttatcttctctccatacaattcactcaacctcaaaacttaaaactacataaccattcgtggttctttgctttttttttctgtttgccaggctgtatctaagttatatcagattactcaagtgtcatctcttttatacaccctttgtgatgcttgcagggtgaatctttcctatggctaatagtttatataaacatctatcatagcttatgtttttagttatatatttacttgcagaacttgttctttgattacaggcattcaccatacatgcctccctctgacttccttcaaaacatacttcagtgactgaactcaacagtcattgtagcttagtagtaaaaacaacgtattcaggggccaagattcttgcctttggatcccagggtcacgtactagctgtctgaccttgagcaagttacttacttaaactttcagtatcataagtttcattactagtgtgctcatactagtgtacagcaggttcttaaataatgttgtttcattcaacatccttccattgtaacattgatgagaaaaaacaaattcctggtgggatccactgcatgtatacagtttgcaccttctccccatgtctgcgtgggttttctctgggtactctggcttcctttcctatctcaaaaatatgtcgtgttcattggtgtatctacatggtgctaaaatgacagagagagagaaacagagaaagagagagagagagtgtgtctgtgtgagtgtgcccttgatagaacagtgtcatgtacaaagtttgttcccaccttgtaccctgagttgcccagaaaggctttggacacctgcgacaggaacaagaaggcgaataattatcttacttgtttttattaatctttcttaaaagtacatatagctcatgtttatttcaatatttaatattataaatatttttatctttatttagaagcttgatgttttcatgaaaagaattatgtcataggaacttgactcttgtttatatcaattaccctatgatcaagtttgttcctatataagttgttttgcatgaagtcgtagttgtcaagaacctatggaggatgttaagtgaggatttgcagtataaaattcttaggttatttggagaaaaatgacttaatataattagtcccataatgtaaagattttagagattgacgtgaagtcagtgttttatgaggatattagaaaaagacaggtgagagacaggatagaaataagaaaaataaatattgaaaacatcgtttccaagaaagaataatttctatatgtaatcataaaattgcagtaatggatggatttactaaaaaatctattccagtgctcagatgaaggaactgaaggcctgtgaagtcacacaagtttaaagcagatataggaataaactcctatttcactggtctcttccagagaggtttttgttttatccttgactaaagtctgcaacgtgttttccttatgtcaaatcttgctcttaatgtttttaggcattctgtgaccttttgttgactacttgacttagctctttctatttgccattactttaaatgtatattataagcctgcattgaagtttttcaaaataaaaacatacccaagctgttcttttccacagatgatttggggaataaaaaaggagaaataatacagtctaatttcactattgaaacagagatcagttgaactaaaacagaagaataaatggggtataaagcagtccactaagatattcataatttcatactgaactctttaggaattgtgatttcttaactagattcatttatttatttgataaagttttactgaataccggctatgtgcctgactcatctattgattagcaagattaacatggttcctacactcacaatgctcacattttgctgtagaattcataataataaaaatcatcataatcataaaacttgaaatagggacaactgatagccatggaagtacttttctgaaaggagtaatattaccatatttcaggttttaaaacgtcatttcagaaaaaatatttggagacagttggaaggaaggtagagtatatgcaaggagaaggagacaaacaagatgctaatgcaacagggcaccaaacaccaagaaataagcaagtaaaacatggagcgggaatcccagttttttgcagaagattaaaagagaagccttgagagacatgtatttggtataatacacaaaatatcatcatgcatttaatatagggagtgagggaatgaaaggcatcagaaataactttcatctctctggcttgagaaacattgagtagacaatggtggcatttaatgagataaggaaaatggagaataatatattttatcgaggtagcgagttgaaggatgatatgaattttgaaccactgagtttgaagtgcacttgaggaactccaacgtgggagagtgttaaatagccaatgctaattagaaacattcattgaaaaatgtatttttaggagaaatcatgacattaaaactagaaagaacatatttttgaataataccatttatattaatgtctgataaacagatacaaagtgcctaaaggattcttttttataaattattgatcattcatttaaatgatactagattagagaatatttacatcacctgctataagagtgacagcatattagccaatggtattcatgctcgactatgcaattcagaagcaacatcaaagaatattcttcattgtgttcataaactttctcttaagtgaataataaagaaaatgtaatgcctagcaacattttctagcaattattcttctgcaatgcatgaatacatatttgtgctattgtagcattaggttcaacctaattaactcagaaaatcatttatgcacaatagcctatctttcatgtacagcagatcatgtacattttctttactttttgcaagttgtatgtaacattagcacacaaaaaaatagtggttgtggttctcggttcttagcactgctgtttatcacatccatgtccatgctagtttttccatgtgtgatttaactaccaagttaaccatttgagattagaccatctcttggatttatgactctgtgcctataatattcgagctgcctataggtctttataagcatatatagcaacacatgttgtcaacaacaacaactgcttagatattaaatagctgaaacctctggaattaggcaaactgtgtgcaaatattaaatattgcttcagaccttgagaaactttttttcaactacctgtgcacatatttcctcacctgtaaaatgaaaccaatgataaaacagaacctccttctttggactatagtaagaatttaatatttaatttttaacaaattcttatggtaaggacttaatatttaattcttgacaaattcttatggtaatgtttaattcttaccaaattcttatgataaggatttaatatttaattcttaccaagttattagggtaagaacttaatatttaaaatattcatttttcagcatatatgaagttcttagaatacctactagcatatgataaaatcttagagaaatttaacaattttattataaattagattgcttaatatataatcatgttacatgagttgagatagtcaatgcaaataaaaaataatcttcactggttatccttttatgttactcagctttcaatttctcataccatctcaaagaaaatgtagctagtagttatttttcagaatctgagaagtgttctgcaaatgtgcgtaataatttttgtcaatgttgaaaatctttaggactttctgtaaagtcgatatttaatgagttgaactattgtctttagcatttatgtcctaatttttggaaggaaacacacacacacatatatatatatataaaatgaaatcctatcttacttgacctaaaactgcacaaaaatttatatttgctgcgtttattttgcattggtaatatcaattttcttccatctgaatacaagtcatttggaaaattccttacatccaagttcttcagctcctatttgttaatcctttctttctttcttttcttttcttttctttttctttttcttttcttttttttttttttttttttgagatggagtctctctctgttacccaggctggagtgcagtggcatgatcttggctcactgcaaactctgcctcccaggttcaaggaattctcctgcctcagccttccccagtctggaaatacaggcacgtgtcaccacacctgcttaatttttttttttttttttttttttttttttttaagtagagacagggttttgctatgtggcccggctggtctcaagttcctgactttgtgatctgcccacctcggcctcccaaagtgctgggattacaggtgtgagccacctcgcctggactatttgttaatcttgatcttgttatatatcaactgctgggttgctccatgattttcacattctcttcctttagtttgtattgtgttggtttttgtttctttcataaaacactaaaaatgtttacatcattttaaaacatttcaaacataaaacaatatcctaagtagcttaacagtagagtccacacatgttgggtattaacgtaaaaacttttaagctcgttataagatcaatcagtctgttcatatcagtactcaatgagaacattaacatgttcaactctgttcagtcattagagaagcatatataaaacatattccaaaaatctaataagctgagtgaatgccaataggccagtaaatattgatataggatgttgctttgatggtaccaatttcattttatatattgtaaggacttccacctactattagagtaaatttcaagctatataatctcacattaagtgtcatttgcaatctgaacccaacaattcaaaataattatgttttaccaactctaataataataagacaaaaaataatggctattacttatcagtaagcaatctgagacctagtaaggatagatgacttatccagggtcatagtgttagctggtgagagagccaggagttgaaatgaggtggtttggcctcagaaactttgcactaagcccctaaatgtattaacaacactacgccaaagccttgccaggaagcgtttcaccatcttccagtgggaagccaagtaaacataaacttttaataaaactgtctgagtactgtcagagaggtataaacacttctaccagacagtaatttttttcaccatcctggaagaccctcaaggtcagggattatattttatttgactttgtattcccagagcctcccatgacacctaccccatagaggacctcattaaatgtgtgctgttgttttatagcaaagtgattccaaagcggtagtagggctagagaaaaaaaaaggctttacagtatgtacgagcgacatttgaactccgtcttaaaaaaataaatataggtactcaaggaagaaacacagagaagaggacatttgagacagagaaaacaacatgtgtgaacaaggcctgaagtgggagaacaatggatatatctaaataataggcgtttggatgtagggaagccagagatagtgtcgggcaagattctggacaggggtttgtggcggtttaggaaggaaaacctttatgtcaggctttcaccttcatagcttcacctgcacagccagggctctgttgcactggaatcagtagagggaatgggtacagtttcaagaagctctccaagagctgggaacaccctatttgtgcctcagcgtggttgaaatttagtctctccatttatgagcattacaaattttaataaaatgcaacaagggcacagttggggagaggttataaatgactaaaacaaaaggagattttaatattgaagagtatagaattaagttttcaaaaagttcgaaacagagtgcttatatataaatataaaataaataaatgtgattgacattaatttattaataacaaaacttgcaagaagataaatctgcttacctggttttaagcattgagaggaactaggagtttatatgcattttgggggaaatatatttaaataatatttttgtgtttacacagaataattataatagcttacagatagtaaaactatcatatttggggttattgtctcccctagacaaaatctataactaacatctatatttacaatgtctaggctctcatcaaataataaatagtgaagtcaacataggtaccttatcccatgtaattcattaatctttacacaagcctcttaaacagtgctccagtatgatagtaaaataccatgtcttccctctccggttgaccttatttccaaggttgagtatctagctagctagctattttaaacaagagcaacctaattctattgatttaaaagacagaataatgatcactgcaggagacagagaaagtgaacagttaaaaaagatgtttcactaagctaagggaggaaggagggcctaaatttagtgttggagattgaggttatgatacaaggtttacagactaaaaagcaataacatgccatgaagtagtttaaccttttatgttttcttgcctctgtacttctgcaccctctcacaccactacatttgtctgcaatatatttcccttatcctttttaaaataaagtttcacttttaataattaaaggtacataataggtatatatatttctatcttattattgatacatagcatttgtatatatttacaggggacatgtgatttttttgttacacgcgtataacatgtaatgatcatgtcatagtatttattccctagaatacttttcatctcaatgcgttaaaaatatttcaaatactctcttgtgtctatttagaaatatacagtacattgttgtttagtaactaaagtttactctcaatcactggaaattattctttctgtttaaatgtatgtttagacccattaacctactctctttatccttcccacatacatttcctagcctctggcatctagcatactagtctataccttcatgatattaccttttttagccccacatatagtgagaacatgtgataattgtttctgtgcctgatttatttcatgtaacataatgacctccattttaccccatgttgctgcaactagtgttatttcatgcatttttatggctgaatagtttttcattgtgtgccaataccatatcttctttacccatttgttggttgatggacacttaagttgattccatatctctgttattgtgaatagtactgtaataaacatgggggtgcaggtatctttttgatatactgatttcttctcttttgaatagatatctgttaatggcattgctggaacatagagcagttctatatttacatttttgagaaatcctcatactgttttccacactgactgcactgattgacattgccaccaacagtgtataagagttcttttttctccacatcctccccagcatttatatatattttttgtcattttgataatagccattctaactggggcaagatggtatctcatgattttgatttacacttccatgatgattagtgatattgaacattttttcatatatatgtaggttctctgtatgtcttattttgagaatgtctagtgcccattttaacaatgtgttgagatccttgtataatctggatattagtcccttgatgaaagagtagtctgcatatattttctcccagttctacagattgtttctttactctgttgattgtttccttagctgtgcagaaatttttctgtttttgttgcttgtgtttttttaggtctcagccataaaatctttgcctagatcaatgtcctgaagtgtttccccaaagttttcttccagtagttttataattttgggtcctaacactatgtctttaattgatcttggctgatttttctatgtagtgagaaataagggtccttttcattctttccatgtggatatctgatcttgccaacaccatttattgaagagggtgtattttccctagtgtaggttcttggtgtctttgtcaaaaatcagctggctgtaaatacacagatttatttttggacaatctatttctgttttatttgtctgtatgtctgtttttgtatcaacattatgctgttttggttgctatagccttgtaatatcttttgaagtcatgtagtgtggtgactccagttttgttcttttcactcaggattgttttgaatatttggcctctttatgggttctacataaatatttttctatttttgtaaaattgccattggcgttttgatagagattgcaatgaatttgtagattgttttggtatggtcactttaatgatgttaattcttccaatccacgagcatggaatctttccatttgtttgtgtcctcttcaattgcttttatcagagttttgtaattttccttgtagaagtatttcagctctttggattactttatttctaggtattttattgtagctgttgtaaatgggattgccttcttgattcttctttcttagctaattcattactggtatatatgaacaccgatttgtgtatgattaatattgtatcctgtaactttatttaatttatatatcaaatctaagaaattttaggtaaaatgtttagattttcctagatagaagattatatcatctgcaaagaggaaaaatttaactttttcttttccagttcgaatgccttttattttttttaatccatctgatgatgctggctaggcctttgagtactatgatgaactgcagttgggaaagtgagcatctttatttttttccagttcttagaggaatggctttccactttttccctttcagtattatgttagctatgagtttttcacatatggcctttgttatgttgaggtatgttcatcctatgcctaatttgttgagtttttatcttaaaggatgttaaattttccctatttctctgtgtctattaagatgatgataagattttgtccttcaccctctttatgtgatgtatcacatttattgattagcatatgttgagcaatctttgcatctgtggaacaaatcccatttgattatggtgcattatcttttgttactgtttgtttcaatttgatagtattttgttgaattattttgcatctttgttcatcaaggatatcaagctgtagtttttttttttttttttttttttttggttattgtttttagactcttgtctggtattggtatgagggtgatgctggcctcacaaaataaattggctgaaattccctcctccccaaatatttaaaataatgtcaggagaaatggtgttagatcttcttcgtaaatttggtcaatttgtcagtgaagcaatccagtctcaaacttttctttgttgggagactttttattgttgatgtaatcttattactcattgttgataagttcaggttttctatttcttcctaattcaatattggcagattatatttttccaggaacttgttcattttttctaggctttcaaattagttagtgtagggttattcgtaatcgtctctggtgatctcttgtatttcagtgctatcagttgtaatgtctccatttttctgatttatttgggtcctctttctttttatcttcattagtctagtgagcagtttataaattttatctttttttggaaaacaactttttgttttgttgaccctttgtattattattttcagcctgtattttgtttagttccactttgattttttattatttctttccttttgctaattttggtttggtgtgttcttgcttttaaaatttattgaggtgtatcattagattgtttatttgaaatctttctactttttaatgtaggcgtttattgctaaaaactttcctcttagtattgttttttttctgaataccatagtttttggtatgttatgtttcaattttcatttgtttcaatacattttttgattcctctcttaattatattcttgacccaatggtcatttagaagcatgttgtttaatttccaaatattaatatagttttcaaagttcttgttattttttattccactgtgttctgagaagatacttggtatattttgattattaaaaaaattgagacttgttttatgtcctacaatatggtctattcttgagaaagttctatgtgctgatcagaagaatgtgtgttctactcctgttggatgaaatgttaggtaaaagtattttatgtttattgggtttaaagtgcaatttaaaggcaatgtttcttttttgatgtttttgtcaagatgatctgtccaatgctgacaatggggtactgaagtcccccaaatattacattattgcagtctatttgtccttattgatctaataatatttgttttatatgtctgggtgctccagtgtttgctgtgcatatatttacagttgttatattcttttgctgaatttattcctttataattgtataataaccttgtctctgctgtttttgattaaaattcaactttatttgatataactgtagctactcctgctcatttttttgcttccatttgcatggaatatctttttccatccctttacattcaatctatatgtttctttacaggtgagatgtgttccttgtaggcagcatatggttgagactttgtaatttttaaaattcatgtctttttgtttgtttgttttagattcttgctctgttgcccagtttggactgcagtggcacgatctctgctcactgcaaattccacctccaaggttcaagcttttctcccacctctgcctcctgagtagctgggactacaggcacgcaccaccacatccggctaatttttgtatttttgattgagaccagattttactatgttggccaggctggttttgaactcctgacctcaagtaatctgcccgcctcagcctcccaaagtgcagggattacaggcatgagccagcatgctgcccccatccctgcctttttttaactattaagccagtctatatcattgaactacaaaatttaatcaatttacattcaactttatttttatatgtgagggcttagtcacatataattcaccacacatacatgcaggtggtggtgaagtcttgctggggacagggccatcaggtgggccagtctttggcccccattggcggcagtgcaggtcaattatgtctttccctaattttcagggctgcatacactagcactggtgtcagcaggtctatgtaagcaggtctatgcaattctgttgtccctgtgtggcttgcttgggtgttggcagtgacagtgatgaactgggtgggtgagtgggtcctctggctccaaggcagtgggtttggtggtaatagtagtggagggtcaatcctctgactctcaagccatctgtactggtgttggtggtggctgtgacaggctgcaatggccagtctctaggcttgcagttggtgcatacatgcgggtactagctgtggtggtagcataggttgagtggactcattttcaagcccctggaaatagtgctcagctgctaatagtgtaggtggggcaggatgatacacaggcccttgaagggtgtgcttgtgcactcaggagggtagagctacatcacatgggccttccctcagccccccggtagtgtttacagtcactggctgtggtatacaggggtggagtgatccccaaacccccaacagaatgtttagatgaaggtggcagaagctgcacttgcagcactgctgtggggttggggtggggaagcagaggttactttcagttttagtacacacgagcagatagctgaggaatgcaagtttcagccctaggtgacagctataaaccgggcagcctttcttcggggtgcttttaagcgtgtggcgaccctgctgctaaaggttgctgggtcactgtcagtgcctcatgctttggtcctagcaacagtagccaccagtggtgcctggctgcaggtgggggaggtcagtggcgttctaggaatctggagaggcagaagttggactctagggcaggatgcaaactggtggggactgggctctcaaaatagcactctgctgtggctgcttaggcttcagtgtgggtatggcacccattcttaactcccttcccagagcaatgctcttgccatccccatgcagcttcctatgatagtttcagtgcccatatgggttgaaggactctaccatggctaagatttcaggaatctgctgtggaaatgtggaccactggggagcatttgcttactctttctccagactaaggagcctctgcatactccttgccaattgtagccaagcgggctgcctcgctttggtctcctttcttgccttaggtgttttctgtcacatctctgttgaattccagcattttttcttaggtgatctattcaaagtgtcattatctactccttattttgtgaaggaggtgagtaccggatgctttccatcagccattttgaaggcgccccttcatctctttattcactgatcaggtacaaagacccttgaaaaatgaatgggttaagggcatcaacaccccacacaattgaaaaaccatacgtgatttttggctactccaaaaattaactaatatccttcccttaactagaagtcttactgataatatattcaattaacatataatcattctgtatgttacatgtattgtacaatatagttttacaacaaagcaagctagaaaaaatgttattaagaaaatcacaaggaaaagaaaacatatttattgtgtattaagtggaagtggatcatcataaagaacttcatcctcatcctctttaagtatgccaaggaggaggaagaagaacaggggttggtcttgctgtctcagtggtggtagaagcagaagaaaatccacatataagtggatgcacaaagcccaaacttgtgttttttaacagtcagctgtattttttctaaaaacgcttctcaggctatccaaacctaaataaacatgtatttattttaactactgtagaaactattgccatgcaatcatttagcaattactcatacaatgtcttatattagtttctgttttatgtgagcagctatttagatctacttttgtttaattttctgaaattatttaatagaagattttatactattggcatatagtaggcatttaaaaaatagctgacttattgcagaatcttctattttaaattttatttatattttttgattttttttttactatagaatatagtttcctgcatattcattacaaaaacatgaggtatgataaaagagcaaagtgttatatttaaaattaatccttcaaacaatgaatcaagtgtaacaatatttccctaggtcagaaactttaaaatacttaattttataagttaaaaagaatgttttggtaaatactgcaaaatacttttaaaattagagctgtatatttttaaacatctttttttcaaaaaagtaattatacatattttgagtaatgctcagtcatagcacagaatataaaacataatttttatatgacactctgatttatgagagcacaaattactttttagcattaagccagtgcaatcatgtgggtcaccttccaaatataaagaaatagggggaaaggaaagtgggcaacttagtaggctatgaataaggtctaaaagagtgtgttcttatatttatgttacaaaaataaagtgtgtcctttttgaaaacaaatcttaaatatattttcaggcagattctacatattgttctgctgcaaaaaatgttgttttaacatgtttcccctaaactgcatgacttagaactaaacataaaaatggtatttggttgctgttccaaatgttatgcaaaaaaaaaaaaaaatcaatttgatgggaaaactagacaaattagtcagtgggaattaggtttattaagaaatttcacctaatttttgttgcttttaatagttgcagttttaactgagtgtgaagaaaagttgccaagatgacatatgtcacatgtttcttcaattcatacatcctcaggcactagccaaaagccactgtatgtgtgtttttttcaaaacccacgtatgaaacaacagaaattcctttaataaataatgattgttatctactatgtatcagccaatgtgctaagcattggaaccctcaagaacgtcatgatctgcaaggaacatataagagacacaaatccagaaaaattaaaattaaaataaaaacgcatggcagtgatagcaacaggcacagtggattgtcgtcaggaaggacgtggggtcaaaagaagatttcagaaggaaataataactgaccacagttttagaaaatgggagcgagcctggaaaggagtggacaggtgtttatgcagacagagttgcacataggtagaggcatgggaagagaggaatgaccagatggtaaaatatatcctatatacagaggagcatgtaaattatcttcacagttgaaaagagttattttttaaaataaactcttctataaccattcttcaccatttttagagtaaaaaattgttgatttaaaaatgtgaggaaacacagacttctacataattgtgtactttgtttcacctaaatgcaggtgacagatagacctcagtgaggtggctttctttttaatacagaatttttatagatcagttttagataatggccacaggagtcattaagagccggaaaatggtaagaagagacaacactagcttaaagtgaatgcaaacacatactctttgagattttgccagatacgagtcaaaaataccttttgaggaagaagttctaagaaagtaaaacataagcaagaatatcttttttaaggggatatttggaagcatattgagcaagttattgccaactaaaacatatccaaagatactggatattgtccttgataaatgttctagaaacttttaggactgagaaatactagggtaagcaatgaagaaagagttggagagaaaaaatttaatggtcattttgtttgagatgagaatgaattttctcgtctgtctctctgtttctgagcacgctatgactgtatgcaagattttcctacttaacttcacagttttccttctattttattgttaacacttccattctcactaatgtggttggtaaaataagtactttaattatttgcttgcacattcaatattaaaataccatgctgtcttcagtttattatgagttcaattttcaagacactataaaaataatataacaatccattaaaagggtattctaaaatattttgtcattaggttattattttattatcttcaagtaaacaagaaatacatgagtaaccctcagcatattataaaaatgtgccaataaatttaaagaaaatttataaacataggaattctaataatttttctatatacatgaaggtgattattccaaattccattagattttctaaagtattatatattttgttatttttaaattctctataaacataattgtgaagccactttaatcaaataattagaaacaataatttgcaagcttgcaaaagaacacattacatatacatcttttaaacaattaaaatctaaagagtgattcctgataaagtaaatttagtgtaaacagaaatgcaaataaataaaactttcatttctatattcgaattgcaaaaaaatttgcaataatgaatatgctatttttcttgcttgtaaattatggtcaaaagatgtctgctgaatccatcacaatagtatcctaatttctcaactagaagaaattttagcaataaaaattaagtttagaatgataccaaagcttagattcttcaatacaaagaaaaaaaaatagtctcaaatcaatccttgttttacagatgaggaaaaattggatccaaaaatattaagtgatttgttcagttatccaggtaggaatttcaggatcaaaacaggaattgggtttgttatgtcaaatcctatgctaaagcctgtaaataagcttcttccaggtcattaagtcacctctatgaaagtatttatctcagtagttcatatgatgacgatcctttttaaatgtaatcaactaaggtagtactccctaaggatagggttaaacacagcaggttctcaggacaggctgctgataaatagacagagatctaagtgtgtagtaaggaagaacagtctatgactgagttagttaatggacgaagtataatccataggaattttttatatgcctttgaattacataatttattaacaaaacactaaacaaaacataaacctctctgaagctacaaatgtcacatgactgaaatcctggcatattttgctaaatagaatacagtaaacaatcaacactgattttgataaaatgtttcgaggtttttcaatgaaacaaattctttgaacagagtgaaaattaatttttacagattatatcaatacaaatgttacataaaacaatttcttaaaaggaataaaaactaagttctacagattatataaatacgtccaacctcttttacatggaaaacagtatgaaatttagcctattctgatatgttttcacaattttatataatctacaacttattctcctaaacttttttttaatgttagacttttaattgggctacttacaacaaagaacaaaatgttttatcatacatttttccaagtattttatataagtgtaattaagtttcatcatgcaggttcaagtcgcattgccacgattaagtggctgtgaactattgatttgacttatttaacatttcagtaacgactaatgccagtgattattgcactgtatggaagttgcaaaaaataattataatattcaacgtttattttacttgaaacttaaaactttatttaagaacatgaccagccatcttaatttaccttctaactaaatcattgtttgagttgtatatgtttggaaaatttatgtaacatttttaagccttaatatcactatttataaaattccgattacaattcttacttgcaagatccctatacatattacagattatgcatgtaaagcaactaataaagtgtttggcacccaaatcttaattcacttgcatttaatcatgctggacctatacagacctttaaacagtacagcaattataatcatattatatttttttctgaaatatatcttatttatacatatttattcagataagcaaaacataattagcagaaataaaaatcagtgtcatttattatcatttttgcattgcctctgagggcaagagatttctattagaaaactggtatctgtgatatttatggacatagctgcaggtaaagatgatgatgatgattgtgcaggaatgccatatgaattatttcaaaagtggtaataaacttatattgatccatttttacataaactgtcaacaaattcccccaaggccaggccttaacccattatatatatataatgaaagtgttaaagcttgtagcataggtcctggaagtgccctataaatgtaatcactatgcatattggatgtaatcactatgcatatgatatatatacatatatgcatatatatatgcatagtgattacatatatatatatatatgcatagtgattacatttatagggcacttccaggacctatgctacaagctttaacactttcattcataataagttacatggtctttttataacactatgataaggctattttctctacttaataaatgaaatacttaagtgcctgactgaagattacacacatagcataaccagattgcaaatatagggagtctgaatccacaaggcatacactcaaggcccctcatgctgcctgatgttgctgctgtagaaaggacacagataaatagaaagtaccatgactgactgttgtctagagttctttatctctgtattttgaaatcaacagattatctaatggattaagataacataatcattttctttcagatgaacagctgtgatcaatttagcaggtggtaactttttttccccagtgaaatgggaaaatgttagggtacattacaggtaataaggtaaattatttgataaaattttcatttcagttgcatatatgcatgtatgtatactggatcattatataaaaggtgtttcttttaggttataatccaaagaagttttgaaagctgagtttttttaaaagggtgatcagaaatttggaggaaagacagaattgtttgttcataacatgtactttcaattttgtggttatgtttcaactctttacactatttaccttcagacttctagaaaccttttctacactccaggttctttttgtggtcatctgttattctgtggtcatctatgaatgaacaagcatacaggcccatcatggggtcaaacctgtaatcctgattccatcatcactcttctctcctatcttcaatttgtcatcaatttctaaagatatattagatttgcattcttctttccagtatcaaattttcattaatttatttcagacaccatttctctttccttaatttctgttccaacttccttctttgcctccagcctatcttgtttaatccattctccttagtgctactgagggagcctcctaatccataaataggatcatgttacctccctgataatttatttacatctttctcattaagctgacaataaggtgaggctcttcatggttcagctgtaacttactccagccttatctctcagaactcatgacttaaatactacaaaatagttcatgcaaaaatctgaaattttctcagagtactttctgctccatttttctgaaaatgttctcccttttcctttcctcacacatactcctctttggccaattcctacatatcctttagtcctcatatgataagccattgctcaggaagccctcctggatcctttatttcttggttgggcatccctattagtgttctttttatttttattactgttcctataacaacactcatcatgatgtgctagaattgcatctctacgcatctgcgtccatcaccaaacagtaaattctttgagatcagtgagtatgtgttttgcacacagagtatggcatagggcctgttgtgtactacattcttataaagcatgtgtgttgaatgaatgaacgaatatattttttaacttttattttttcttcttgagacagagtctcactctatcacccaggctgatgtgcagggatgcaatcttggctcactgcagccttcgacttctgggttcaacaattctcacgcctgagcctccccagtagctgggattacaggcgtgtgccaacacgttcaactaatttatgtattaatatattttagtagagacaggctgttctcaaactcctgagctcaagagatctgcccaccttgtcctcccaaagtgctgggattacaggcatgagctactgcactcagccaaataaacaaataatttttctttttaaaatgaaatacttacttggcagagaccacctactgttacgcaatcattctatagtctttaaaatctaacactaatttcaggtatcaaaatttatatttttaaatgtttatatatttattgtcatgtgagattttatggtggtcaagttcaaagggcccaaatatctagtcgccctaataatattttcagtgtttttcaaaagcttacagattttgatcatttactaatgacactccactgctcactcaaagctacactgactagcacaaatatcctgcttctttgcttagagtgaggctgctagttggcgcattttgatgagaaattccaatcggcaggcatatgcagatttggatattttttaaaaaatgaaataagacattttaaaagtaacaggtttacagagaaaaagtttactaaaacaggtcctaaggaaaaagactttgaaaccagttacctagcaaactataaaagctaaatgccccaaattgtaatgatagccagttgcaccaaaattcaatgttattcatattttatttttcaagataaaaaagttactatgtattgccaagtttgaaactgaatgctctatctcattcctttaagccaaatctttacaagaaaaggatttctacttcaaaagaaagtgacacaatactcataattaacataaaaataagcatttgcctaatttcaggagagtacattaagtcattagtataagtggtgttttgctttgcactctctttacattattccatctctttccatctgggagcaaacttaacaagcaatttaaaaataattggtgaattaaattgtcattggtggcctcattttcctttttcgcgtatgtcttcaacagacttactctagcagtaccattaatacagctgcggtaaaaaaaatctgtgcaaatggcatgttataaaattaaatggtaacatattgtgttgcttgggatcacagtcaagtctagaggcaaaatagaaataacagatgcaatacaaatgtagagttattatgtgtgtcatactggaatctagcctcacaaaattagcacaatatgctctacctgaggataagctagggaaaagaaaaaaaaaaaaaagaaagaaagaaggaagattgtgccagcaacataaatggagacatagaaacattttaatcttaatatggtaatacgttttgaaaagaaattgtacatagattttttatttaaaatttcagaccaagagaaatgccttctatattaatatagttctccaaaatgttttttggatcatgaaatttctgacattccttttgaatttagtgaatttactagtttgaatggtcctaattaaattcttccctaaagctatttacagaggtacctcctgattttattagtcctttagtgatgctgcatgtctggtttggagagtaacttccagcaaatgaatagtatttatgcttaaaacttaaatgtgtgtgtgtaacatattgaatacgtaatttaatataatatctttaatactatgctttactaattatctaatttatgtgtgatacatcatatcatcatatagctgcctgggtttgttttgaattgtaatccaaaattaattatctcaattataataacttttatctttacattaaaaagtaaaagatcccttttcctcatcctcatagaaaaaaataagaatgttaaaaagaatcaaaactatgttttttggtgaaattactggctccatttatttgccctcccgctacttatgcttttttccatataactttgcagttccttctctaaaaattccctctacttacccgtttctgaacaaaaatatctcacttctcacagaaaaaaatgagggatttgaaaaaataatactgttaaattatataaacatatagtaagcattttcttacaactgtgagtgtaaatgatgtcacattgcatttactatccaccattcactacctcacttcaccgcctcagctaccacaactctcagaataagtacccatctccagaaaaaactcttgagtctgtttttagtgatttgatttagatgagtgttaaattatttgcctcgaaatataattatgactcactagagttgaaaataaaaattactattataatgagttctatgagctagatgaacaagtctacacaccatttgtaaagtacagtggttttgctagctagttggtagaatcacgatcaagtgatgccatcttggccagccatcagcaaactgtaatagctgatactgataattatgaataacagcaaacttgaaaataattacataattaaatacttatttgtgtaatgagctgcttttagaatctatgccagtgggtcaagtaagaagaagtaattggatcagtaggagacatttagtagttaagagacttgcttgtgcacacctaaaaactcaatggaggttaagtagcatatcactgccaaagagattctctagcactggtgggcctcagcaaaaccgtaagtggccttgtgagactgtgggactttagcacattactgcaatagactcataatcttatctaaatcaaagactctgaaaaaaagtgttatttgctacttaaaatgcaaaccattctacttcaaaatatatagaggagaaagaggacttgtcccaagataaaatgtgtcacatttgacaactatcaaccttatcagagtctaaaacttatatgaatacatgctgaaagtggatgctcttagttgtatttatccccattattaaacctaaatagagaagatcaaagccaaggactggaattttgaattattagtagctacaaatttctttcttaaagctttctggggcaagtgattgtcaacttcatagagtagaaaatcaaattaaaatggaataaatattattattctgaagacaagtgttccttttttcatagaaacattaaaagtatttgctaagtatgataaaacacgtatttctagaaaacagcagatataagacagtgattttcatttttttctatcgacagtataaacattagtatagaagtatgagagcccgtattgctgatgtttggagactaacattccttgcaaagagatgtctatgtcctttccaactctaataatctgtgattctataatttgatattaagcgaagattttagtaacacctaatttctgaattgaaaagaatttttaaaattctcacccacttactcaatacttgattttcttctatatgaatagcacagtcatatagttcatgcttgagccaaatttatattagcctaaatacatttttgatgaaatatttttgtttcacaaaaattcttatattacaaaattttctctaatatatatatgcttactgcattttaaatcggtctggcgctactggaaattgcttcatattaaattataagaaatttaataatcaataataagtatttggctgggttaaccatatttcttacataacaaatgctgataaatatatgtgtgtgtgtgtgtttgtgtacatactcttgtcaaattctaattaacaaaaatgtttaaaatatgttgataaatgcaaataaacattcacaatattattatgatttcatacatgttttgcatcaaaaatggcaacttgctattatattaatagctacattttaattggggtctcactaatctagaggctactctaatagcttccatgtattgaatgcttcctttgtctggaaagatagacttttatatgttaacattggtaatttctgggtgatgggactgcacatcattttatcttgtaattcttgattttgatatttctacaatgaacaaacattaaaaacacgattttaagatgttataaaatatatattatcctatttctcttttatttttatttttcaatagtttttaatttttatacaagctttggtcagtgagtaatggtacttccacagagtacataagatttcaatgtccaaagcaagtcagtctgtattgcatatattcagagctccatcaagtaaaattcaatgttaatacagaggtaagtgttaacagagaggaacaatgaaaaatcctatttaggacctgacttcaaatctcataagggatcagaaataccactgtactgctgaaagtgttttcctaggaaaaacagttttcatagcatagctcgctgagaactaactgatttttggcaattagatcacccatttttgagttaaaaaaagataacaattgaatatcatttgaacttctaatacctattaagaaaaaagttatttaaaaatgtttggaatttttggttggaaatctatgcagttttgaaattaaaatatcgattgtgagaatagtctcattcaaagttgaaatacactcttcagtaacaaaataatactgaaaagggtgagtgcaatgacaagaacatcatatgaacagatattatattctggaaaaagtataaaagcagattcaagtgatagagattgatatcccaattaaattaaaagaatgcccagaaaatcagcataattttcaataaaaatgatactttattatgagtaggtaagtagagagtgtatttatttagatgctccccactggtgtccttgtgaaaatggatgtcaattgtgtcaataataagcaatgctacttgcacctcaatttctcagaaggtgttcaggaaaagaaggtaccaggtaccttagcaggcaatgggaatgaggttgggatatttgaaaaataaaaaagggaaagattaactgaaacacttgtaaggagatttagatctccaaaattcttctttaactcacaatcaattgacttcagatttgcctatgcccatatatcacccctcacacatcaagattagaagcaagcacatatagcagtggcgaggtagtgaatagaacaaagtagccatttgtagcccagaatcagaaatgtaggaagtgatccagagaatagagcttgcatactgactgcagggggactatgcaaggagtaaaatattaatttctaggcaggtaccagaatctaaacaatgataagcaggtatatatctaccagctatcagaaacaaacatggcagagattcaaagtagagagtcaggcagactaataaaagataacagtagtcaaacagtatagaaacaatgtaatgatcacaaatgattctgtttctgccatccttcttctaaaattctatatgtgacagaaagtctaaaatgaaacaaaataatatggaaattataattaaaaattattcttgactgagttacagtcaacatgaacatagggatatggacaacagcaacattagaggggtcatatttgcagggtctttctggagtcaagtgaatttggaattacaacatggtatgtgtttaatgctcagcaattatgttatgagcaaacaacaagttatattggtgtgggattttgagcaaaattgctttatttattttatttattttatgaagggagaggaccaaattttaaatttcagttgaggctttccatttgcagaaatggtagattttcattttaggaatcttccattagataatgtcagctcctaatacttctcattctcttgtaatttctttttttattaaattgagattctcagtgaggtcatagtgtaatggagaaaaaataggtctgcgagaaaattgtgatgtctttaccaacagaaggtgataggatcgcaggtgataaaaacaaatgaaataaaagaaacagaaaacctaaagaaatcaatcctatactttgtccactccattttttttctcctttatttcttccactttttcttttgaaaggtacccttttagttccaaaaatgtagagaagagtatattcattattttagtttttgttttctttcaattgctttaaaatatttttctatttgatcctaacattcaccctatcaaaaagatattttgaatgttttgacaaataagggtgatgatgttcagatttcagtgatgcacttagtaattagcagagcctgtatccaaacttgagtttgacacatttttaatacctatgctattccttacaagctatgttaggttatagatgatttttcccactgtccaaaactaattttttatgtccttcataatcttcagaaatgtgttttgccactttaaggaggaaaaattgtctgtaaaatccaaaacagcaattttgctgttgcaatggaacccaacgagtgatgccagcccactgaattgaacagaaagacagtgatgattctttgtgaagagaaaaaatatacatacacctctataatgtgaacagagcataataagtggcatttttgcaatttggctgcttgacatcctgtgtgaagttctgaatatcctttttttgagcataaagcaaggacatggctttttttccccttcatgcactcaagggactcactcaaacacctaataatgctgttcaacctttaatacattcataatggaattccccagttagcgtgttttcacttgcctgggtagaggcaccagctacaacctcttcaaatacttaaaagaaaatactgttcacattaattgtaagaatcttcaaaagaatgctagaatacctcaaatggaaaattcacaagtagtagcagacaagaagacatagagcataggagtgaatagtagctataaatcagatacaagccacattaatgaattgagataagaagtgtgaaataaaatcgatccccgctcatcagagaaggaggagagggttatttttaatcttgggatgaatttaaaatcaataaaaaagtataatagtctcataaacagaaatcgaacgacaatgcaaggagttggaaaaaaattaaaaacaaagggaaaaaagtacaccaatttacttcaacagttacaagaagccttgtttgatagtgttaactgtattcataatgaacatgtgtatagagccttttaaaacatcccatcaagcactgcacagctgaatgtgaccactcaaataatatttggtgaacataaagaagaatgcccataaataataatcttccaagtcaaacatcttagatctaaaagttaaggctacaggaagagtgagaactctttgtgtgaagacactcataattaacaatatataagcaactacataaggctgaaataggcagggattgtgaaattccacaatatgagaacacttattttcttcttttcctctcataaattttgttcagaataccaatttggggaatcaagcagaagtaatccctgctaatagtgctgacactatgtcaaaagttttgagcaataaaaaaaaatctccgactttctatataccagaaactttcattttaccctagaaaatcaaaggacccctttaactaaaaatgtgtttctagaaaagtgttccaaaatacgtcatatggggatctagctcctcagccaagcaattgagcctcttttccttttgtaagcagcatatcaaagtaaggccaaagttggatactaagaaaagaatggagttacttatatttaatatttaggatacaaaataagagcaaagtataattgcataatgcttgctacatttcaaatttgtctccttctggaaggaccttcatctctgctccctgaaagccaaaaacaacaggctactatttttgtttttcatgaagctagatattagccagttgctagacttcaactgtgatatattcatgagaagacacaagctggagaatttcagcctagtctaagcaggacagatggagttgctttttacctttatacagatcacgagtttttagccatttatttttcaaaagtctagccttcagcagggagcatccatatgcgtgtgtgcaattcacattgagttctgaaacaagacttctggtttatccataaatctggcaaaataaattctcgaggcatagcctggcaacaaagaacttgaataaattctttaaagctcttttgtagtgaaataatattagaagttggggcaaagacaaagccatgagaggtgttgatctctaacagttttatgaaaagatgtttaagtaacttttcagtggcatcaatttaaaaatctagtcaatgatgtaacgttgaggatggagtttgctgacttttatcttccatgagcagtcagactaaccaggtgttagtaatttgaatctaagcaataaagactgtgaagccacattgatatagttaccataaatgggaatcagtgagtcccaccagcgtcacagagaacaattcagtcagtagcttgggcagggccctgctagtcattaacaactccattaagctaagacagaaactggaagcattgcccagagaggtaatcagaagcactatgctcccaagactttccttaacaggtgctcattttcatcctggtaagatttagaactaagcatatacatatttaagagaatcatattagagtatggatatttgaaatctatcaatatttactattttatattcttaaaatatttcagataatttgcctttttgaatcacatttgtacttatgatgtataattaagtaatttacatacagttatattaaacttagatctattaatttcacatagtagaggctactagttattcccaaatatgttcattcttcctttctttcttcctttcccttccttccttcctttcttttctttctttctttttaaaatactgctccttcctgtacactgattttttttcctttcttgttagcagtaaaaatcttgattttttttgtaagtctaaaagactgtaaaaccttccattctctgctcagttatttgtgatgttaggactgagttctaactacttaaatgtatttatagtgctatataaaacttccagaaagcatctttgggggaacaggggcttgcccttttcttcttctctccattctctttcttgggactctactttaatgattccagtttaagcagccattatagaccatgagattaaggattagaccgtggccatggaataatgttgatctgggaggaaggtgagttaatgaggtcttcagagagctgcagtactagctgctggtttcatatatctagacttctttcataaaacgcaaactgccattcatacttgtcattattatatatttgggaggttctatatttcaagaagctaagccatataataaatagtttgtatttaaaaagtcagagtattttaaaaggatatatgcataatggaatactattcagccataaaaaggaaggaaatgatttctttgcagcaacatggaaggaactacaggccataatcttaagtgaaacaactaaaacacagaaagacaaatatcacatgttttcacttaaaaatgggagctaaataatgtgtacacatggacgtaaagtgtggaatgattgaaaatggagactcagaagggtgaagaatgggattggggttcaccatgggaaattaattaatgtatacaagtgtgtgttattctggtgacggatacactaaaagccctgacttcaccactacccaatgtgttcatgtagcaaaattacactgttgtcacataaatttatacaaataaaaataaatcactaaaattacaacttttcccttattagctttatgaggtttatttaagtactcatgagtggtgtctttcagtcaaaataactacaaaggaaattttctatctagatttatataactgatataaaatatctctatagatctatccgtacatcaatatctatcaattacttctaaaggttattaactatacagttttctaaaaggatccacacattaatcaagtccccttctcctcttaaagtcatagtcaaaagttgttagaagttgctataaatataagtaaataatatggttttgtaggctaaacccagatagtaaaggaactaaactaatattgtaatgtcctagcctttcattttaaacaaacaataaaaatgcatatatacacaaaactgttttcttatgcaaaatgctgataagcattttttctaaaataaatcaaggtcacgtgatcaaagtgaagcttttgacaaattagactagtttgataacctgggttttaaagaaactgtatcctttttccttgattttagaagagaacagcaaaagataattataaattttattttaaaatataatgtgtatttttctcactaaaagacgagttaatatgaaattcctaaacttttcatactgttttactattgagctaacattactttcacatataagtaaaataaatttaaaactatgttttcaatcaaattagattataattttaagaaacatttttatagtaatggaatatagttttgaacttatattaaacccaaattaattggatacttggattatttttaactaaagtagaatattaaaatattggttaccagcgtaattttgacatacattcctttgattcttatttttacatgttatagagtagcaataacttagggccgtgtttgaaaatgtcttaatgtttgcctttttaaggtatggtaaaaaaaaaaatgtgtatggccgtcagatatcatactatatgtattcattagcatagctgtagtgttagacaaatctaaaccccatttcactccatgatgtagaagttaaatactaaaaattatgttaatatgggtaatttaaaatatactagaatcagtactggcagataagaagaattgtgtatgaaaagaaagataatgcacttttgtttattaagggaaaatgagagcagttttatcctaaagtgaagtatcagttattttcagatgtgaaatagaatagtaaatgataaaacctaagcaaatacaggaagtcatagtttttggaaacgagaatttaattatcttagattataatatcaaaaaataaggaatctcaaaaaatgtagtagaatatgttaaaattttcccaagagtaggttagttttcatggttggtcagttaatactgaaagcataaagaagcttgtgaatcttttactgccaaatattaacagcgcaaaattagactatttctattgaaataataaattaatcttgaattacttagtctgattttaacaatatataataattattttccttccatgtaaccttctgacatgaatggctcaccagagttgtttcctgtgtgttgtgctgaatttattatgccctggatcaatcaattctgaaggagctaagataccattaaattgggttaatactttctgtttatttaaaatattgtattttcccttgattaacttgtattcaagccatgaccttttattgttctcaaatactgatattaatattctaatcaagtgaatagatccctctgataactcttgacattttcttctcaaaattaattcctaaatttagaaaaatacaatttagtgtgccttttatacctaatactatcttcgtgatatctcagatgatcacagaaaaatcacaaatgtttgtcttttactctataaaaaagagtaatgctgaaaataattatagttgttggatatgctcctcatttcttacatagctcaacactatgatgagagctacaagaggagttgttaaacaaaagccttctctaagatagttttgttcaggaaaaacatatattgataattctctggagtgtagagtctctgaaatacatacatcatacacacatacaggcatacattagagagaagagagagatgtacatatacatattctggagactacattctggagatttataaatatccttatacttatttttaacctcagaacataattactaaatacccttatgactaaatatatattataccttaatagatcttactattctttatccttatgtgttggtcctctaataaatttgccatagccatttaattctgtctttgccaggttaagatttgcttgcttgcttgcttgcttgcttgatttcaactgtcctgtcttcaatttcaaatgaggaaaataatatccacaagtgcacctaggtaaaatgtttagttcaataactggcatgtgatcagaattaaattataaatctgatcctaaaatgaaaactcaaaatgagaaagcattaggattatatttctgcttctctgacatgaacactttataattaattgaagagaaatgttgagtggctaacagccagaggaacaagcatggctgtcaatgcatcttgactttctaattcctcatacaggaactttaaaagttagcatatggctgagcatggtggctcatgcctataatcccagcactttgggaggctgaggcgggcgaatcacgaggtcaggagatcgagaccatcctggctaacacggtgaaactctgtctctattaaaaacacaaaaaattagatgggcgtggtggcgggtgcctgtagtcccaactactcgggaggctgaggcaggagaatggcatgaacccgggaggcagagcttgcagtgagctgagatcacgccactgcactccagcctgggtgacagagcaagactatgtctcaaaaataaataaataaataataaataactaataaataaataaataatgtctcaaaaataaataattttttaataaaaaaatttttaaaaaagttatcatatgatatgtcctcaagtttatgttgaaaatgtaaatcacaggtttttaaactttgccacgtaacagaatcagctgtataactttaaaaacacacatatgccatcccacccgatccgctgaatcagaatgtctgaagtagagtattttacaaatcttcatcaaaaatatcaatgactagtaaaagtcaaaatactgatcatattaactgaatatttcatatgtagggctttttgtcaatttactattttttacctgaaataaatgattttgtgaagatataaaattaggagagaccattttacataggtgtattccaaaaatatcacctttccttaagtcagatactgaagtaatgctccaaaacccaacaattacatgttactccagatgcattagctttaatggcattgggtggtggtttaatttttagcccaccctggccagggatatttccttagtgacagcagtatggtctgcagcaaatgtgaactttaggaaatgcactaacgtataagggaaaggcagctatcagcattcagtcttctctgaaggtaagtatagcaaattaagagagatgtagtagaaatgcagtagcagttaagggatcaattcaaagttatcagaaaagggtatcttgtaggacaagttcaaagctgaagattgaattttaaatgttattgtgtgttacatgcaagtctcttctcatattttaaatttcttaacaaaatccactaacaaagtattatccctatgatgtctcaaaaaaaaaaagaaagaaaagttaaaaaaaaaaaagaaatgaaactccaagaaatatgatcaaattcacacagttaacaactggaaaattctgaatgtaaagatagctttttcaagtatctaagttctttcttcaacagtccacatagttttaagaaaccaaaactacattaccttgtaacttcccaggttaggtttatagagtagatgattagaaagtaataagttcttaagaggttaagaagagaaatttaacttattcctttgatattgctagggaagaaataaagaaagcagtggggacaatttcttgtagttggaaccccttatatcattttttatttttcatttttaagagcaatacagagaagattcatcaatctatgttcaggtagtaattgctttttactactttaagctcatctgtaaaaatcaaagtgaaactgactaggttttacgatattttctgaaaagtcaaaattctggtctttgctatcccttttaggaatatatggtaaaagtttccctatttgctcattactgattcatctgcataatgaagagttaaaatcttattgagaaatgccttgcaatcagttgagaatctaattgtacctgtttggaaaggttagttacaaaagcacccacggtgatccaaacttatattacacatcctctgattatcacatttaaagtaatatgtcatttgttattcatatttagtgttacaactctttaataaccactcaatctatttccctttaaaaggacagctgcaataacagcaaaattgtaaaccttaagtgtagcgtaagaattcaaggtgaaacacattccaagtagtagcttaaaatgtcagtatcatacatggctccctgaataaaagaggcaagacgtgtcaacctgaacagacattcatctctttgcactaaagtgagagatacaaagacctgtaccactcccagtagagagatgtgctgagacattcaagagtcaaagacgctcagctgtctgaggcaaatactgtgagtcttcaggtctctgtaaattgttctacagctgtgaaggattcaaagtaaaatttcagaatgatcataaatgaataaaatgtggtggattatagtagttactgtctttggctgtccgtaatttattatgttgctacttcttgtaactgtacagtagttctcctttattcaagtgcttgctttccatggtttcagttgcctacactcaactgtgttccaaaattattaaatggataattctagaaataaacaagtcataagtttcaaattgtgtgccattctgagtagcatgataaaatctgttacacctctccattccttttttatcacaagaataaggatgagtacagtactataaggtattttaagagacagactacattcacataacttttattacagtgtattgttataactgttcaatcttattattagggttgttaatctcttactgcctttaatttataaattaaactttatcccagtgtactagtctgttttcatgctgctgataaagacatacctgagactgggcgattcacaaaagacagaagtttaatggacttacagttccacatggctggagaggcctcacaataatggtggaaggcaaggaggagcaagacatgtcttacatagatggcagcaggcaaagagagagaatttgtgcagagaactcctctttataaaaccatcaaattttgtgagacttattcactgtcactagaacagcaccagaaagacttgccctcatgattcaattacctcccactgggtccctccctcaatacatgggaattcaagatgagatttaggtgggaacacagtcaaccatatcacacagttatataagtataggaaaaatgtagtataaatagggttcagtattatccatggtcttaggcatccactgggggtcttgggatatattgtctgtggataagaggggactaatgtattttcatttctctgggggtgggggcaaacaaaactcatagaatggatagattatggtgcctcctacacctacccaaccaagtgaaaccagcattttacatcagagtaccttattttcactgaacacagatattggcatattgtatcctgtcacccctgcatagaattttctaaattagaagagatggatacatctattttgctctttgattgtgaactttaaagtgtatgtttggagagaaccactctaaagagaaaacatctagagtgggagatgacaatcttaaacttcacccaaatccagtgaccctgaaaaaaaaaatgaaggttaagaaactcccccacccgactgtaaactagttcagccattgtggaagtcagtgtggcgattcctcagggatctagaactagaaataccatttgacccagccatcccattactgggtatatagcaaaggactagaaatcatgctgctacaaagacacatgcacacgtatttttattgcggcactattcacaatagcaaagatttggaaccaatccaaatatccaacaatgatagactggattaagaaaatgtggcacatatacaccatggaatactatacagccataaaaaatgatgagttcatgtcctttgtagggacatggatgaaatcggaaatcatcattctcagtaaactatcgcaaggacaaaaaaccaaacactgcatgttctcactcataggtgggaattgaacaatgagaacacatggacacaggaaggggaacatcacactctggggattgttgtggggtagggggaggggggagggatagcattaggagatatacctaatgctaaatgacgagttaatgggtgcagcacaccagcatggcacatgtatacatatgtaactaacctgcacattgtgcacatgtaccctaaaagtataataataaaataataataataaaaagaaactcccccacccttttgtattccagagaatggcttactgcaaagaatcaccctttcccatacaacttagataagacccacagatggatcccttttttatctatgaaaagatcagacacagatcctccaaattcacattgttgcctcataaatgattggctaaactgttttttctccactgattaactggaacaaaatagattttaaccaatttcggttaagtttctctctttctgccacatctctaaactttgacccatcttcagcctgaatcagtgtagcaattctccggagattaggtaggccgcagagtaaaactttctctgctctatgatgcagccaatcatgccaccctttcatgccacatataaccttacctacttctccctagaaaagacataccctttttgcctaacccttgtgaggctggcagatattatggtcatagtttttttctctattttaatagtccctttcttcacctcacaataattcttttgaatagggtctctctttgctaaatccagattcctctttttgactttgaaaatgaaggccacagccaaggaaagtcagaggcaaggaaggacaagaagtaaaagaggatgtcttggtggggttgaatccattgctcaattctggaggccctactttatgcagccctacagttgtctaacccacaacctttgactttagcatggagttcatgctctgatagctttcaactaaagcagccattctctcctctccccagctcttttctttctctgttgatacagataatattttgtatttgagggtctgaaacttttcaaaattcaaatgtcatggattgaaactactgtccttgcacagagtgtgagaatcaggtggtgtggggggaagtgctaataatggtctatgatccccagaaagcaacctatgttctaatgtaatttctacattcatattaaaatttagagatgattttatgttaataactcatctgcaaaagtgcaaatatatgtggctatatataatgtatatgaagcagtatgataaagtaaggagatatgtctcatgtagcaatgcaaatttgagtttaaatccctgttgtgtaatttttttctaaatagcttctgcatctataaaagaaaatatatctcctttattaagagattgttgtgataactacatgagataatactgacacgttttacatagaactcgatccataataagtactgaataaacaatatttgctactaccatttacattctaagtttaagagtagcattcagaaataagagaggatataatttccttgagaagaatgcccttgataatctctggtccttccatagagataataaaagttagagaaaggacaaatggggagcttttcttttttattcatctcatatttaaactttgtaatcacctttggattctctcttattaaccacctctaacttatcttcccccatccatgcaatatttactggatctatttcaggtctgtgtccaaaactttagttttctactctttgagttcaatgtcacattacttgtctctcaaatggatttcacaatagtctcctatttggtccttttcaagtcagattttgctttcacacactccactgaatgtgctctcttcttaataaaaaatctacaagcattcctctattactttaaaatcatttcagaaatcttaagaataggactctgtttcagataagggtaaaattctggacttcaagtaaaacatgaaaactagattaaatttcaggttattgtttctcacaggggaaatatgatgggaggattgtgctttacatatccttggaaagatgtttgccttgggatgttttttacccaaaacggtgactatagttatgttacctgcgactcaatatgcattcttcttttcttcttcactagtattacttcagtttggtcaggggctggcaattttttcaatttaaaatttcatttcctagatttacatttccatgaaactaagtttccaagtggaaacttccagtttcctggagaggaagtcctttggagagagttttgttttctttatgtagacaccaccactctttccttcttgctgcttccaccttcctcataatgtctgaaattaaggtctggggttttgagatacaggaactattttgcaaccatgaaacaagtcacacattgaagatggcacagttgaaagagagaagctgatactaggacatttgtgatagcatcaagccactgcatcacccagagctgcccactccagagttcattcaactatacaaaacaaacctttatttgataaagctaccatctctgaaggttttcttttcatgcattttatctgaataccaattgtgataggatgcccaaatagttttcaccttttctccaacatttatactaagctcaactctgaacactgcgatgatagaaatttaaaacttgagagagcttatctcagcctctcaatacttcccttattttaaaagttttaatggaaaaatttcaaacatatatttaaaaatagtaaatactatgaaatgcagtcacttatccattgcccaaactcaagattatcagcttacgaccacccttgttgtatccataactttacccgttctgtattattgtacatagagagggtaatgtatgcctaaacacattatcacattaccaaggaacacttattaacccacgcctcactgcagtgcactctcctgcagtcccctggcactggaccatagtgcttttgttggcagcacttgtgggagtgttactgccagtggacttggaatatcttggcctttccagcacatcaagcaattgacctcaaggggccagagaacaaagccacatcctggtccaagccatccagggttagagcaggaagcccaggagtgctgagcttagctttagtcccctgaaagcataaagaaagaaagccaattgactaaacccaatttgtaccacaggaaaaaaaaaaaaaccctcaagggcaccaaacaatataaaagcacaaatccccatccaaaggaaagaaacttcaaagattaaaagaacattagcccccacagctgagaaagaaccagcacaagaattctggtgactataaaacccagagtgtctttttacttctaaatgactgcactaactccccagcaatggttctcatgcagattgaaatggctaaaatgacagacatagaatttggaatctcgatgacatgtaacctcaggaagatacaggagaaggttgaaaccaaatccaaagaaagcagcaaaacaatccaatatttgaaagatggtacagctattttaagacagaaccaaactgaacctctggaaataaaaagttcactacagcaatttcagaatatgattggaaacaataataaagcattaataatagaatggaccaagctgaggaaagaacctccagggcttgaagactgtaccttctaattaatgcaggccgaaaaaaataaagaaaaaataattaagaaaatgaacaaaacttttgataaatatgagattatgtaaagagaccaagtctatgactcattggcattcctgaaagagttggagggagagcaaaaaatttggaaaatatatttgagaatattgtctatgaaaatttctccaacttgctagagggggtgacatgacaatttaggaaactcagagaaccccagacagagaatatataagatgactatcgccaagatatatagtcatcagattcttctaggttaacatgaaagaaaaaaaatattaaaggaagctatacagaggggaaggcaacataaaaagggaacccaattaggctaacagtggacatttcagcagaaactttacaggccagaacaaactgaggtcctatatacagcatacttaaagaaaagaaattccatctaaaaatttcatatccagccaaactaagcttcataagtgaaggatgaataaaatctttttcaaataaacaaatgttaagggaaattgtaaccaccagacctgccttacaaaaggtccatcagggagtggcaaacatgtaaagaaaagaatacctgctaatacaagaatgcacataagtacatactgcactgacactacaaaggaactatacaattcactctacattaataaacagctaacaacactgtgatgacataaaaccctcacatatcaatattgaccttggatgtaaatgggctaaacacagaatggcaagttggataaagaagcaagacctaatggtatgctatcttcaacagaaccatctaacatgcaatgaaacccataggctctaagtaaaggaatgaagaaatatctatcaaggaaatgaaaaacagaagaggcaaagggtcctattcttattacagacagaacagtctttaaacctacaattattaaaaaaaagatgaagaagtacattacataatgataaaagattcaattcagcaagaagacttaactatctgtaatagtctgttcttgcactgctataaagaaatacctgaaactgggtaatttataaagaaaagaggtttaattggctcatggttccacaggctatacaggaagcacggctgggagggcccaggaaactttcaatcatgatggaaggggaagtaggcacttcctcacatggccagaggaggagagagagtgaaggggtaagtactacacacttttaaacaaccagatctcatgagaacttactcactatcactagaacagcaagggagaaatccgctcccatgatccaatcaccttccaccaggcccctcctccaatattggggattacaattcaacatgaaatttgggtggggacaagaatccaaaccatatcactattctaagtatgtaagcagccaacaatggagcatctagattaataaaacaagtacttagaaacctctgaagagacttagataaacatacaatgataataggagacttcaataccccaatgacagtattagacagatcactgaggtagaaaactagcaaagatatttgggttctagagtcaacacttgaccaaatgcacctaacagacatctacagaacactccacacaataacaatggaaaatgcatccttctcatctgaacacagaatgtactctaagatcaaccacatgctcagctataaagcaattctcaacaaattcaaaaaaagcaaaattataccaactgccctctcagacaatagtgcaacaaaaatagaaatcaataccaagaacatctcttaaaaccataaaactatatggaaattaaacaacttgctcctgaatgacctttgaataaacaataaaatttaggcagaaataaaaaaaattatttgaaactaaggaaaacaaagatacaatatgccagaatctctgggacacagctaaagcattgttaagaggaaggttcataggactacatgcatcaatcaataagttagaaagatctcaaattaactatctagcattacaccaagaggaagtaggaaaaaaagatcaaaccaacctgaaagctagcagaagtaaagaaataaccaaattagagctgaccagaatgacattgagatgtgaaaattcacacaaaagaaaaactacggaaagcagtttggtgatttctcaaagaacttagaactaacatttgacccagaaatcccattactgggtatacacacaaagcaacataaatctttctaccaaaaagacacatgcgcacatatgttcattgcagcagtattcactacagcaaagaaatggaatcagcccagatgcccaacaccagtgcactggataaagaaaagatgatacatatacagcatggaatactatgcagccattaaagaaaaacaaaacaacattctttgcaacaacattaaagcagttggaggtcattatattaagcaaataaccacagaaacagaaaatcaaataccacatgttttcacttataagtgggagctaaacattgagttcacaaggacacaaagatgggaacaataaaaacaagggcctacttgaagggggagggaggagggcaaaggtcaaataactatctattgggtactgcactcactaccttggtgacaaggttatttgttcaccaaaccacagtgacatgcaatttacccatgtaataaacctgtacatgtatcccatgaacctaaaagttgagaatagaaaaaaacaaaaacatattaacccccaaatgatttactgtcacttaggagaggacaggggtctaggatatgatgattcaccaaaggttccatagtcaggcccggtggttcacaggtgtaaccccagcactttgggaggctgaggtgagcagatcacttgaggtcaggagttcaagaccagcctggccaatgtggtgaaaccctgtctctactgaaaatacaaaaattagctgggtatggtggtgcacgcctgtaattccagccattcaggaagatgaggcagaagaatcacttgaacccaggcaagagaggttgctgagatcatgccactgcactccagcctgggcaacagaagtgagactccatctcacttggaaccaactcaaatgcccatcaatgatagactggataaagaaaatgtggcacatatacaccatggaatactatgcggccataaaaaagaatgagttcatgtcctttgcagggacatagatgaagctggaaaccatcattctcaggaaactaacacaggaacagaaaaccaaacaccacatgttctcactcataagtgggagctgaacgatgagaatacatggacacagggaggggaacatcacacaatggggcctgtcagggggtgggaggcaagggaagggatagcattaggagaaatacctaatgtagatgagttgatggtacagcaaactaccatggcgcatgtatacctatgtaacaaatttgcatgttctgcacatgtatcccagaaattaaagtataataataaaaaaaaaaaaggttccacaaggtacaagcaagggtgatcataatggaacactttcacgttggatatccaaaggtataggaataaaaaagatttgagaatattgggaaataaaaaaaagatgatattcagaacagactaaattatctctctaatttggcataaacagtctgcaaaacaagggtgttttgttaattcacaacttgtaaaataaacaccacattattccatctaaagtgataattgatttccacagtgttaaaccaacaactttgaaaagaatttcatagtccagtctgatgccagaatccttatgcttctttctactttttgatcagtgtatattttgtaaacatacacaatgacaaatgacagcaaagatcactattttacattctcccttctactcttctacttctccatttttaatttgttctttaatatgaagttcttaaactcattatttaaagatatccaatgctatgaaaatttgatgtgtataattctccatgattatacatataaaagtatataattatatatgatttgttttatttgatttttaaataagtaatattctatacatattagtctatggcttggtttttaatgtgttatgataattcccccaagggtaagaaaatacttgtattttccaatttttgcatgcatgcatgcatatccatctgtaattataaatgaatcagtgtaaataacacatgctagattgctcttcttaatataatatgttagctgttcttttttccttcttttctcctgtttttccttttcctcctccttctcctcccctttcctctcttcctcctctgtctttatcttctttgatcagaccactcccttcttctggctaacaagtgtggaatgagaatgcttaaattcaaacatttggtcaagcagatatgttgcctagagcaagataacatttcctcacttgtaaaatgaggataagcataggccctacatttgaggttttggtattagaatatatattcatatacaaaaatgtttaatataatgcttggcacataaagagactataatcagtgtaagcagttattaactaccctgcttatctttccagccattctatttatatttttcacttgtttcgcagtgtttcagttataacagccttttctctcttccttaaataggccaaactttctcttgccttagggcttttgcactggttgtttcacccttaggtattttactatgaacttacttacgcatctttttctgcttctttttgccctctaaagtactatatataagttctataaaagttggaatctggtttgttgtgttctacactgtgtctctacagcctaatatcatgcatgacacagagtttatggtttaacatgtacttgttggatgactgtaaaattccatttgatatttagtatcagagtaacccataaagataggtattatttcctcaattttataaataataaaagtacaacaatgaggcttaatgctttattgatagttaagctgttgaattgggcttgaatgcagtttccttttctgtgtgttgtattctttccactgtttcctatgtgttatgcatttttaaaatacacagaaaattagctttatgagattgtaaatctcttcgaatcatgcattttactgtctctatgtaaaaattataagctcacaataagtacataatatgcattttttattactaatgattttcttcccttcatgggtttatgctttttctaaatgtaaaatatttgtctaatacatatatgtaaaatacatagtatgtgtaaaatatccttttctaagcttgctataaaatcttacttgtttatttaggtgttgatagttaaaattaatttggcaataggtatgcaggggatgtctctgaaacccttggaagacattgatggtttctgaacttcaactggtgtagcagattgaaggcaaatcccaggccaaatatacatatatatgtgtgtgtgtgtgtgtgtgtgtgtgtgtgtgtgtgtgtgattatatatatttatatataatatataaaatattatataatatatacatgttttatattatatatatataaggcataagacaacacagagagaatatgtttaatacgacagcaatttagaagtaggaaacagtcattgcttgtgaaataagggaggctatggtagttgctgtgctgagcaataatgaccaagtgaacataagtgggatattgcagccagaaataggaacaaaaacagaatagatagaatatttaaaaaaaaaacttgaaagctactgcttagaatgggcttgactcacatagctgtactgaggtgaaactaaaccaagagatctttggaaattttctcccgagacatacaagaatttacctagcaatatacagtatgcaccctttaaatcatcaggctggcaaaatcatggtttgtgtaatacttgacattgaaagttaaccccttcttttatttataattagagacaaatgaagaactatgtagaatgtgaggcaacaagaggtgtttagattgttctttcaacacttaaagacctggaatgtctggtcctttttctccacttttactgtaataaaggcagtccaaattctcatcatttaacccctgaatgaaaacaggatcccaacaacttgttcccctgatgcctgaggccaatgcacagtgtccggaattttcctcttaaatgtgaactgaccgtggtggtccaatcctaaaatctcacttcaggctcctagtgaagaactgttagttcttagctaacatcacgtttctcttggacagctcacatattcatagttgtcttctaatcttaaaatacacataaattcactcagcaagcttgtaaaaatgtacatatttggacctcaaattcaaagattctaattccatatttcttggatgtgacttggcaatttacttctaaacacatgctccagcaagtgaaataaatgactatataggcatgaagaactacttagatgccctaaacaccctgctattttacaactatttgccaagaacatcttccctgccaacttggtctttttgtcttggaaaattgctacaaattcctcacaaccctgttcaggtattgttcaggtactgatcacttctccaagctttccattattcctccttccctccactagatggttaatagattccttctctatatcaattctgtgccttgcagatacttattttactgcctattttatattttggctttattgtcatcttcacaaataaagcgtaacctcttgaagggttgaaaattacttttggtattagtggttagcaaactacttggcacatgttaatgaagaattaataattgctgaatttagcatttttacactgaccctaagagtaaggaccaagttctggttctatcacttttgttcagctaattatatgtagagatacagatatacatatacatatatacatatataaatttgaacacagggttctcctaacacacatcttaataggtacagaggagaaagatcttggatgtttgaaaaggtagagttgccattttctctctgtactctctctgtacatgatttttggattgagaatatatctagaatgtcaccaacaataaataaactatgctgggaaaatcatttataatagacagatttataatgtcaattattaacatactgcagactttttcaaataggggagttcacttggaaatttaaaaaatgccagctggtcggttctgagatcacagaaatgaagattcctttgcaataaaaagaatcactttgtttttttgtttttttcctaaatctccacttctgcttatagtgactgtacccaaatcaaggagttataaatattaatctggtaacttcaaattgagaattcatagccactaaaatgggttgccttaagaaaaatcttttttccatcatccaaggtcatatgcctcttatcaaaggaactacacatatattacaaagttattttcagtttttctcatgaatttctatgtatacacaggtctctgtatgtagctaataacatacttagggcaaaatgaaagaaaggaaggcaatatttcccatgctcctaagttaaaaaccctatttgtctgtgtgtaatatggaaatatttacatattatctgtacagatttgatcatatgccaaaacatgtcccccttcaagttctatctgctttggacatccaaatacaattcaaataactttcaacagttttacatgtaatgaattctcagcaaattaacacaagaaaataaaaccaaacaccgcatgttctcactcataagtgggagttgaacaatgagaacacatggaaacagggaggggaacatcacacactggggcctgtcggggggtcgggggctagggaagggataccgttaggagaaatacctaatgtagatgacgggtcgatgggagcagcaaaccaccatagcacgtgtatacctgtgcaacaaaactgcacgttctgcacgtgtaccccagaacttaaagtataataatgaaaaaaagaccaaagacgttttgtgtgtttaaattattcttaaagctgtataaaattagcttgtgaaagttgatctaactaagatacaacaaataaaatgatcagtgatatggtagatctctcttcctatagagtagcgatattatttaacatgatcattgtttagttataacaattacttaaaaagaaaattttgactcccatttggtataatttttctggaattcggtattaaagtgtaactcatattgttagatatttttcaccttgcattgtccatcacagtatctactgtatcaaatgcacagttcatgaatcagatcagctcttttatatatctgatatatcatagtttattaaacttgaaatttttgcgtggaaaatatcacatctgagccacttggaactttggagtatagtgaaactccaacacactgattttttttctcaatccaaataaagcatattggaaatatgtatacttgcttaaaaatcgtttctatatagtcagtatttaggtggataattcaaaagtactctacctaatataatgtgaatactaaggactaaaaaatatgattaaatttggaatctcaattttagagtttttgagatgagtttttttttgagaaattaacattaaatcattttcatgttttataaaaatggaacaaagtattctaaaatgtaaagaatgcttgtcctaatacctagtaagtaatccttaacatagagcttgaatcatgtaataaattgccattgttctgccctaaattttcaatgttaaaggttaacacttttgggtctaatagaataacaaagcagaaggactcctaagacattcttcagttgactaaactgtgagttggtactgaattgcctacaaaaactggactgaaaaaacagtgtttgcatttcagtaaggtgaatgtaagaaagccaattattaactcattagtattccgcagctttactttcaaagggtaggagacaaaaaaatgaaagaagaatgtatatataattttctgtgtttattctattgactgtgtgaaggtaccaggacagaataacatttggaaaaaaacaaatatgtattcataaattcaggagacagattctttttatgggcaaaacatgatttttttttgatcaactgattcaaaaaaataataatatgcaaagcaatggttatttccatataaccttaggctttttcttaataacaacacaattctaatttttgcctttaggattcctttaataattacatggctaataaactattgcttttcctcatgcatatataaatactgacttgttccttatgagaacattccagggtattattagaagcatttgtcttgcactttactctacgcaagcactttaatgatctcacattgtttggaaatcccaatgagcttttgaggtaagtctcctagccttatcattttacagattttcatttaaataataataatacttttattcctgcatagagtattatgtaatatatttaatacatatataatttatacaaaaatatacatgctatatatatatatgcacatctcatatgcatgctttttaatgcctttacattttttccttagtgttttattttataatcagtgctttataaaaggatgcattccttttgaaaactatgcttccttcagctactaggaacacagtatggtatatggaaagaaaaaatgaaaacctctgacaacacttgcagctaatatttattagattctttttgcttcataaagtgcataacaaatttgcatgcattttactcatatgatctctcacatcaagcggtaatggtggatatgtttgttattgctcctatttaacagatgagagtactgaaatataaaaaggtaagtaagtttcccaagcaactaagcaagtataagtcaagatctgaaacataacaatgtgtctgtggaatctgatttttaaatactgttaatcactttaacagcactaatttggcaataacttatttcaaaagctgcttcctttctctaagcctcaatttcttcatattaaaatttcagtatgaatattgcaacttttaggatactcatagcacaaatattatgtttaaattagtgattatcttagtactgagagtaatggtgccaataataatagtttccatttactaagtctctactgtataccagaagcactgtgaacattacttcctctaacctgcataacacatccccaagacgaacatttcacattttatagttagaaaaattaagaatcagagaaattaattttcccaagatcatgtaactaggacatagagtatctggagttaacatcctactgtatgtgactcaaagatatttattttcttatcaccaaacattgtaagtaatttttactgtattttacacatcaaaaaccttagccagcacactatcatacatttactgaaacagagtagatatccttatctttcacttagaggcattgcagcatggttaagggcaatgctcttgaagtcaatatagtaccatggaattaaaaacaagaaaaaaactgggcaagcctcagtcatactctactacagatgctctttgacttatgatgagattatattcaataaacccatcataagttaaaataccctaagcctaagatggatttcatctacccaacctactaaatgtcatagcataacatagcctaccttaaatgtgctcagaccacttatattggtctacatttgggcaaaatcaaatgcttatttcataattaagtgttgaatatctgatgtgattcattgaatatggcactgaagtgaaaaacagaatggttataggggtgttcatcatttatgtacataactgaaagcacagtggacataaagagtgtttgaagcattgaactaaaattaatcgccggatgatggagatgctacagcaacagagtcaccaatttctccttcttctgatgaggttcaaaaatagctggtacaggttgagtaacccttacctgaaatgcttgggaaaagaagtgtttcagatttcagatttttttgaatattggaatatttgtattacataatgagatatcatggaaaggggacccatgtcaaaatgcaaaagtcatttacatttcacgtatacacacatagcctaaaggtaattttaaatgatattttaaataattttgtgatatttttacatgaggtcgtatgttgaattttcttcctgtgacatcatgttggtgctcaaaaattttcagattttagagaatttcagatttcaaattttcagattagggatgttccacctgtagaagaaactggttattgacacttattgatggtctagagtttgatatggtttctctgtgtccccaccgaaacctcatcttgaattgtagctcccataatttccacgtgttgtgggagggacccagtgggagataattgaatcatgggggtggtttcccccatactgttctcgtggtagtgaataagtctcttgagatctgatggttttataagggtttcccctttcacttggctctcattttctctcttgtctgccaccatgaaagatgtgctttttgtcttccaccatgattgtgaggcctccccagctatgtggatctgtgagtccattaaacctctttttctgaattcacagtgttctttggaaagatagcaagtattgattgtacagcttatttcttattattacatatctttctgtaacaagcaagagcactgtgtctctgcctgtcagttctcatgagtctctcctaatcgacgtgccatttctttaacatctgtatgccactgctgaatgcagcaaaggcctccacaggtttctttgctgtacactttcttggttcctccggtttaacttcttcctctgcctcaacttctttacttctttcttcctacagtttgatcacttgaaaactcagtgccaacaaacccatgaatatcctcttcatcaatacccaattttagctgtttctcaagtgctaataacttgttacctactattcatcaacagcagagtctttgttaaagcttttgaatgtgttcacatatgtcttcgaaactttcttccacatgccgatcatgcactgctgtgtgacttcttcccatgctgttgcgatgttctggatggcacttaggatgtaaaaacttttccaaaactcttggagaagtcagccagactcagtcacttcactaatctacacaaatccttggcataaatatactttgaagggagctattgctccttgttccattggttgaatgaatgtggttttgttcagtttcaaatacacagtcaaaaaaattgcttttatttctgtttgtttattcacttttcctgattgtctttatgcagagccctaaagaagttagtggtaaagccaaacccttgacatcagcagaactttgagcagcatatttggttcttcatttctcctgaaaagagtgatagccaaagaacatatctaccctgatgccctgggaaaagttaatagtttggctgacagtacttgaacataattggagcatcggtgacagggaggactgaagaagatttatgtgattaattctctctacttgggtacagagcttaaacacatttgtgtcacatataggtgctaaccaaagagtaacttcagcagatggataagtgaaaccatttgtaggagatcaagtgggtccccttagtactcccttgtgttgtgatcaaagttattggaaaactacaatggactaacacaggaagaactactaatggccaaggctcttcaggaacaaaatttcaggtcattgtttcagacaaaaggacctgatgatctggttaaaataaaagtaataatgaaataggtagtacaagaaggaagctataaacaagctatgaccatgtgaccaattgcaaacataagaattgcgataattatgaaaagttctttcttattttggtgtgaatgtatttcaaaaagattaaccaaagtttcccttttttccacgtctcctgccatctaacataaaaatgtgataatagtaattaactttatgtcaccgtatttaactcatatgatactaaagagggagaagtgtatcagaagtggaatgaacatcgaccactggtgaacaaatgacttttgtgagtttgtatccactttcagagtgatggttagcgtgctttcagttggtagaagtatagatgcgtcaccttggaaagaagcatgattttaccgttacctttatttggaatgtaaacgtgatttaaaatggaatacattgatgtcaatttgagaggtaaactttagtgaaaccatatttttaagaataatttttttcctgttaaaattgctgcagcacccattgtacctcgtgtgggtaccctgttctgctcttgcatgctgttgctgatctgctgactttccttgtcagtatgaagtagttagtagcatacaggttaaaggtggtaacagatatgggttacaattattgtccccatggactctaatttggcttcatggatatcagtttgccctcactctcctctgattcacactaacttttccttcccagctgccagcctaggtgacctgcagattcttcacgcctaccaccagaaacagagagaatagcacttcacagattgctacaacagatcccagttttatagagtttattttttacagaaaatcttgattcatattgattattgtgttgtttgtttccatattaagtctcaactgatgtcttcagtttatgtgatatatcatacggtcactttatggataatgcatttgggtgatcacattaaatttggaaaatagtctttgaactcctggaattttaactcttagtctcaaaccaaacacatatctagtctaactttctaaaatatgactgaaatagatttatatagctactatatttttagtttcaaattttctctatacatttttaatagcattgtttaatacaagtccctggatatgttttctatgacctcaaaatgttttgaaattttgggtcaaataaggtatgtgagtgcttatttttttttctttgggggagtgttttcaaatgaactttgaagcccagttggacactaaccaaacatttaagaaaacataccataacccttgattttataaaagaactaatacctgctaatccagctcaataatgaaaacccagagatttcatctttcaaattccaagttgacatttggtgttgttatttataatgtcaaaagccagcaatttatttcttaagagaaaattcaaaacaccccttctagggttcttgacctccggatatctttctgtccaccaagatgtctaataaaacataaagtttccatgatataaatttaatatggattactgaaatttgagtaagagttcttattaaatttaaaagtacagagtattctttcttcactagtgtagatgcaggtatggtttcaggaaacctatcatagcttgaatattttaaaactctattgatttttgaacatggtatagacatttctggcattgtgtgtgtgtgtgtgtgtgtgtgtgtgtgtgtgtgtgtgtgtattattgggggatgatgcgtatatgtctaccaattaactgtacatacaataatatcttgctatcctacaaaaatggcattacatttcattttaattttttaatgaagaaagggttatcaaaatttagttactacttctgaaaatttaatcttaattttaaactagaaatgtcaaatggcaaatgggttttttcctcatttcatgaactgcaaactcacataacatattgatgtttgttaaatcatttgcagtttcttagaggttttaaataaaaatatttactcatgcagaatagttattttttaaaattactaacacgtagaatagacagcaaattattaatgaaagtataatttgactttccattattttctttaattcaaaatattatattctgtctaattatactctttaaaaatgtcatttcatgatgcacgtgtctactttatctaacttcccttaaagcctaaaagacctaagtgaagattttaccatcaaaagttaaaaactaaagcgagccattttccaagaattagacagtatttttacacagccattaaatcataccacatgacaaggctgataaacttcatctgtcatatgaaattatctaatacccctaaaataaaatataattttataaatttacctggttatctgaataatcagatttttcattttatgaaatattcttaaatgtacaaaacattttaaaaatatgaatacataaaatatgtatattttatactttaatttgtgatagtatgggttttaaaatattttagtgttagatttctttttctttgatttggccaaatattccatttcatttatttttgtttatttatttatttatttatttatttatttatttatgagacacagtctcactctgtcacctgggctggagtgcagtggtgcaatctcggctcactgcaaactctgcctcctgggtttaagtgattctcatgcctcggcctcccaagtagctgagattacaggtgcacgcccccatgcctggctaaaataatattcagtctaattttatatgtctacacacaaacacaccagtattccctcacattagaatattgttatattattttctattatttcaaaaacatcttattgaacacaaaacaaaatttttgtcatcattgtagacatgacaatgcaagcaaaaacatacttgaaattaaaaagaatcacactatgtatttttatacatgcaaggtgaattttgattaaagattaattatgttaaaaaatcttaatcatattaatactccaaactatcctaaataggcaggtaagtctcatttaagtctgatgcagctgttatttgtgaaactcatgttaatgttaatggttcactttctcaaaaaacagtatttgaaatgcctactatgtacctggagaaattcttggattacagcaatgaatcaaaaaagatagtctttgccctcacagaaattgcatgtaatataatgatccaaatattctctattctgagataaaaggtgctgacagttgtttgcagaaaaatattagccacaggcttgcatgtttaccttccatctgtcttctccctagagcatggcttcgtattcacaggcttacaaaattctgtctttttatatagggaattcttcttgttttctaaccactttgttaacatgaaaacaattatgtgctttactcatgtaataagatttacagaggatatttcttttacatattgttaaaatgttagtgctatctctgaacaactatatcacagaatgaagaaggcacatctttgtgtagtcttaattttaactaatagtcaataattgaaaaacccagaaataaattaatctctgattccttctaaagaaaacatatatataattataataatgttcacacagcttcctatcagtgttttacttgccaacaataataaagactttatacaaaatagtgatttttaatcagataaatatataaagttagcaatttaggattatgtgaaaggataataattatctgttaattttaaattgctggtattttagtcaactgaaaatctatcatgaatattagctgatttacctctcctgaaaaaaaaaatgaaagcaaggagtagcacacagttagtttttttaaaaaagtatgaacaagtatgaataaaaattatattttgtgagatttagctggaattttgaaattggctgaaataaaattgaaataattgcttttctcctgggattcaaaatagacttcaaaaaaaaaaaaaaaacagttttaactgaaacaaatctattcattgtgaaacattatttcaaatccatcagggtccaaggtgttaaaagaatattcaaataatacaaataaaacatttacttagcaaaactttcatacttgctatgcaatacagaatggaaattctaatagaggtatcaatggttcatcagtaacagaaaaacaaagaaaacatttgttataatagtgttccataaaacttactcatcgaaaagaaattttagactgattgtttctaagatttggtaaagtctcaagtgtagcatgaaaattaatcacttgggggatggagccaagatggccgagtaggaatagctctggtttacagttcccagcgtgagtgacgcagaagacaggtgatttctgcatttccatctgaggtaccgggttcatctcactagggagtgccagacagtgggtgcaggacagtgggtgcagcgcaccgtgcaccagccaaagcagggagaggcattgcttcactcaggaaactcaaggggtcagggaattccctttcctagtcaaagaaaggggtgacagatggcacctggaaaatcgggtcactcccaccttaatactgcacttttccaacgggcttaaaaaacggcacaccaggagattatatcccgcacatggctcggagggtcctatgcccatggagtctcgctgattgctagcacagcagtctgagatcaaactgtaaggcggcagacaggctgggggaggggcgctggccattgccgagttagttgtttgattaggtaaacaaagcagccaggaaactggaactcggtggagcccaccacagctcaaggaggcctgcggcctctgtaggctccacctctgggggcagggcacagacaaacaaaaagacagcagtaacctctgcagacttaaacgtccttgtctgacacctttgaagagagtagtggttctcccagcacgcagctggagatctgagaatgggcagactgcctccttaagtgggtccctgacctgcgagcagcctaactgggaggcatcccccagtaggggcagactgacacctcacacggtcgggtactcctctgagacaaaacttccagaggacccatcaggcagcagcatttgcagttcatgaaaatctgctgttctacagccaccgctgttctgcagccactgctgctgatacccaggcaaacagggtctggaggggacctctagcaaactccaacagacctgcagctgagggtcctaactgttagaaggaaaactaacaaacagaaaggacatccacaccaaaaatccatccgtacatcaccatcatcaaagaccaaaagcagacaaaaccacaaagatggggaaaaaacagagcagaaaaactggaaactctaaaaagcagagcgcctctcctcctccaaaggaatgcagttcctcaccagcaacggaacaaagctggatggagaatgctttgacgagctgagagaagaaggcttcagatgatcaaactactctgagctgacggagaatgactttgacgagttgagagaagaaggcttcagatgatcaactacgctgagctacaggaggaaattcaaaccaatggcaaacaagttaaaaactttgaaaaaaaaaattagatgaatgtataactagaataacaaatgcagagaagtgcttaaaggagctgatggagctgaaagccaaggctcgagaactacgtgaagaatgcagaagcctcaggagccgatgagatcaactggaagaaagggtatcagtgatggaagatgaaatgaatgaaatgaagcaagaagggaagtttagagaaaaaagaataaaaagaaacgaacaaagcctccaagaaatatgggactatgtgaaaagaccaaatctacgtctgactggtgtacctgaaagtgacggggagaatggaaccaagttggaaaacactctgcaggatattatccaggagaacttccccaacctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaagattgggttacccacaaagggaagctcatcagagtaacagcagatctctcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccccaaaagagctcctgaaggaagcactaaacatggaaaggaacaacaggtaccagccactgcaaaaacaggccaaattgtaaagacgatcaaggctaggaagaaactgcatgaactaacgagcaaaataaccagctaacatcataatgacatgatcaaattcacacataacaatattaactttaaatataaatgggctaaatgctccaattaaaagacacagactggcaaattggataaagagtcaagacccatcagtgtgctatattcaggaaacccatctcatgtgcagagacacacataggctcaaaataaagggatggaggaagatctaccaagcaaaaggaaaacaaaaaacggcaggagttgcaatcctagtctctgataaaacagactttaaaccaacaaacatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaattgaactcatctctgcaccaagaggacctaatagacatctacagaactcttcaccccaaatcaacagaatatacatttttttcagcaccacaccacacctattccaaaattgaccacatagttggaagtaaagcactccccagcagatgtaaaagaacagaaattataacaaattgtctctcagaccacagtgcaatcaaactagaactcaagattaagaaactcactcaaaaccactcgactacatggaaactgaacaacctgctcctgaatgactactgggtacataatgaaatgaaggcagaaataaagatgttctttcaaaacaacgagaacaaagacgcaatataccagaatctctgggacacattcaaagcagtgtgtagagggaaatttatagcaccaaatgcccaaaagagaaagcaggaaagatccaaaattgacaccctaacatcacaattaaaagaactagaaaagcaagagcaaacacattcaaaagctagcagaaggcaagaaataactaaaatcagtgcagaactgaaggaaatagagacacaaaaaacccttcaaaaaattgatgaatccaagagctggttttttgaaaagatcaacaaaattgatagaccgctagcaagactaataaagaaaaaaagagagaagaatcaaatagacgcaataaaaatgataaaggggatatcaccaccgatcccacagaaatacaaactaccatcagagaatactacaaacacctctacgcaaataaactggaaaatctagaagaaatggataaattcctcaacacatacacccccccaagactaaaccaggaagaagttgaatctctgaatagaccaataacaggagctgaaattgtggcaataatcaatagcttaccaaccaaaaagagtccaggacaagacggattcacagccgaattctaccagaggtacaaggaggagctggtaccattccttctgaaattattccaatcaatagaaaaagagggaatcctccctaactcattttatgaggccagcatcatcctgataccaaagcctggcagagacgcaaccaaaaaagagaattttagaccaatatccttgatgaacattgatgcagaaatcctcaataaaatactggcaaaccaaatccagcagcacatcaaaaagcttatgcaccatgatcaagtgggcttcatccctgggatgcaaggctggttcaatatatgcaaatcaataaatgtaatccagcatataaacagatccaaagacaaaaatcacatgattatctcaatagatgcagaaaaggcctttgacaaaattcaacaatccttcatgctaaaaactctcaataaattaggtattgatgggacttatctcaaaataataagcgctatctatgacaaacccacagccaacatcatactgaatgggcaaaaactggaagcattccctttgaaaactggcacaagacagggatgccctctctcaccactcctattcaacatagtgttggaagttctggccagggcaatgaggcaggagaagaaaacaaagggtattcaattaggaaaagaggaagtcaaattgtccctgtttgcagatgacatgattgtatatttagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctagaaatctgacttacaagggacgtgaaggacctcttcaaggagaactacaaaccactgctcaatgaaataaaagaggatacaaacaaatggaagaacattccatgctcatggataggaagaatcaatattgtgaaaatggccatactgcccaaggtaatttatagattcaatgccatccccatcaagctatcaaggactttcttcacagaattggaaaaacctcctttaaagttcatatggaaccaaaaaagagcccgcatcaccaagtcaatcctaagccaaaacaacaaagctggaggcatcacgctacctgacttcaaactatgctgcaaggctacagtaaccaaaacagcatagtactggtaccaaaacagagatatagatcaatggaacagaacagagccctcagaaataaggccgcatatctacaactatctgatctttgacaaacctgacaaaaacaagtaatggggaaaggattccctatttaataaatggtgctggtacaactggctagccatatgtagaaagctgaaactggatcccttccttacaccttatacaaaaattaattcaagatggattaaagacttatatgttacacttaaagccataaaaaccctagaagaaaacctaggcaataccattcaggacatagtcatgggcaaggactttatgtctaaaacaccaaaagcaatggcaacaaaagccaaaattgacaaataggatctaattaaactaaagagcttctgcaaagcaaaagaaactaccatcagagtgaccaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggatataaacagacacttctcaaaagaagacatttatgcagccaaaaaacacatgaaaaaatgctcatcatcactggccatcagagaaatgcaaatcaaaaccacaatgagataccatctcacaccagttagaatagcaatcattaaaaagtcaggaaacaacaggtgctggagaggatgtggagaaacaggaacacttttacactgttggtgggactgtcaactagttcaaccattgtggaagtcagtgtggcgattcctcagggatctagaactagatataccatttgacccagccatcccattactggatatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacacggatgaaacgaaaacatcattctcagcaaactatcgcaaggacaaaaaaacaaacaccgcatgttctcactcataggtgggaattgaacaatgagaacacatggacacaggaaggggaacatcacattctggggactgttgtggggtggggggaggggggagggatagtattaggagatatacctaatgctaaatgatgagttaatgggtgcagtacaccaacatggcacatgtatacatatgtaacaaacctgcacattgtgcacatgtaccctaaaacttaaagcataataataataaaacaaaatagaaaattaatcacttactgtttttaagtcatttataatatttactctgactgttgtcaataagatccctcatatctctaaataaacccttttaaagatactgaataaactccttagagaatactgatgggatgctatttgctattttctcacaaataatgctcactccttgcctgtcccgaagtattaagataaaaccaagcacattaatcaattttcaccaaaatatattcaataaagaagatcattttatcaagcaaagtaaatatatttgtaaggatttatctgaaatgtgaagctgctactattgaatcttccctctttattaatgattttttaaaagagaatgtaatataacaaaaatcacttattaattttgatggtaccacactatgaaattttctgacactaagtattactttccaatagaaatcatcacattcatattgacctttggtatgactgtaataatcctctactttgtgttaaatgaggcagtgataccactgagccaaattgaatgacttaatgcattttctgattttttctgagtaaaatatatttttaaataataaagttggccgggcgtggtggctcatgcctgtaatcccagcactttgggaggccgaggcgggtggatcacgaggtcaggagatcgagaccaccctggctaacacggtggaaccccatctctactaaagtacaaaaaattagccaggcatggtggtgggtgcatgtggtcctagctactcgggaggctgaggcaggagaatggcgtgaacctgggaggctgagcttgcagtgagccaagatcacgccgctgcattccagcctgagtgacagagtgagaatccatctcaaaaaaaaaaaaaaaaaaaaaaaggaataaaattatctgtgattgtgaacaaacatctacacacagttgtgaatttgaatttttaattatgcgctgctatgacattgagtgatgaaaaaagaattattctttgtaaattatatgttactagatgaggtcaccatcaactgatttgttggcaaatcaattaaaaagtcaaaaacatttttgactaatctacatacattcaatcaacatccatcttctctatttcaatcacatatgctctttctcatcttctccagctatcttcttgccatttcttaaacttatcagcatattcatcttcagagtctttgaatttattcctctgtctataatgtaaattccctggatgaatgcatggctcacatcttcagtcttaactttatgcagttttgctctaatgtaatttcctcaaagaaacaagtcgtctatctgaaacagcatcactgcctcctcagttgttaatcacaccttggtttcttgctctgtttcgtttttactccctgtctctatctccatgtggaaagtggttttgcctgttttcttctctgatgcatcgccagtaccagaacagattctcacacaatatagagtgtcaataatcataccttgaagaaataactaagcaaacaaatgattaatgaaatgactgattgaacaacaaaattatgtattgggcatgtgttcaagattgtttgtaacagggaaggagagaattgcaagcaggtggtctttacttacattctatttcagctgttttgttgtaaaaatgaagacaaatttgggagaataattttaatactaaactttgactaggaactattgtctttcttactcaaaaccaacttaagaagcaacactctcaaccacacccaggtctgacaactcaaagcactgctctgtaaaattgtaaattttcaaaagcaaacacacaaatgacagtaaaagcaatatcatagtttccaatgtgtcctgaggtacatgaaaagagcttagtgctaaccaggtcagcatttttggaatgagaaccaaggattactgtatgacaaaatggagaatctagaaagcaaaaacttggatcaataataaacaaaatcttgattcttgacatcaatggcaagttgctttggtggattttttaaaaaagcactcaatatattagtatatatctacattttgttgaataaacccatttgaatttaaccaaaagtagtgtactttaacagtgcgtagattataacaatttcataaaaattttatattgagtatacttaacagattcatttctattcatactgaaaagtaattatacattctttgcttaaactacactacctgatataaatataaaataaatgctcattttagtatatatgtcaaatttgtatgaagtagtcatagatgaagggatagcaagtactttcatgttctttaaatcacatgacatacttacatttagttgaattacataagtaattcaatttaggaatacttggcatttgaatatttgttttgaaaactgctgtaggaaatattttaagtccaaaatattttcaagatagtttttgaattactatttatatctagcaattgctaagaaactttatactgttgattactgcactctattcaaaagtgaaggtagtgatcagattttcagtgtcttaacagggaagaaactcacagtccaattgtctcagcaacacaaatccgaagtctaacagtcaatatttgatcataaggaatggaagaaatgaaataactgtttacggcaaaaggaaatttagagaagaaaggccttaaagacagggaatggtaaaatctaagacctcaagagagcccgtgtaaggaagagaggatggagaaatactgcttaggaaagttctgtacaaagaaaatcttcatgacctttatttcaaagccagtaattgaactttggtgcttcctcccctcttacatcgataaatttccacaagcaactcactccccaaataacttttaaaaaattatacaatctaaatgtaaacttcttcattgagtccatcatggcatccttggttgatgttgctttcaaattatggagacaactcagatttacctttcatttcccaaatttactgagagtgtacaatatattttaaactttaaattcatgaagctccttcagggtgggttttctaatctctcacgtagtgatatccttttgtctctgcatctgtccatttctgtacagtcacagtggtgtgttccaaccatgacttaaaatcattttctccttctctttacgtagcagtgcctgtacacttcggcagattctgagaattagtttgaatgagtggttccaaagtatgtttaatgtcaatctatagttgctgtaaagcagccaaggactctgatgtggctggcactcagtggcaggtctttaagtagtcccagagtaactgtccccacctctcttctttcagtaaggcttcaatgctataagcaacttagagtcaagagaaactagaaaatatctgttcagaaaggtattttagacattctcacttaattaaacatagataatgtgatctgtttctctaaatccattctcccctcaaaatgaaattacatactaaatacgctctacatgctagttcaagagctttctggtggtagtcaggaactaacatatctctttgtgtgtccactttgcccctttacaacgtaagcttagtattaccagcaattgtgatgaaaataatctcttgttcagcccaagatgatgtaatgaatctgtcattaaggtgctgttgaggacaaagatcaggaattgaaagcatctaacagagcccaggatgagaaagaagtttatggatctctgcctgttaaattcataattcttccaagcatgcacatatgtataaatgcacttgacatatatattcacaaagaatatttctgtcccacaaattataaaagtctttgagagatagagacatgtgtataaataagtgttctataaatgtagctcaatgacttacataaacaattagctataatttaaaaaatgagctatttagatgctttgctttagtagtgaatgtatttagatatagagattatttagcaatagacatcagttaagtgagccacaggcaatttgacttcaagtaaatttactaatttagctgattaaagatttgttaggcctttcttttcaaagaagcttcaaagcctttaaaaatgagtgctcatcattctggtaaaataggaaacccacatgttttattactaccaattaaaagatactggaaaggagaaattaagagagtatagagcaaggctaaaaataagtatttcttttctttctttttttcagacaggatctcactctgccacccatgcttcagtgcagtggaatgatctcagcttactacaacctcccctcctggcctcccaggttcaagtgattctcgtgcctcagcctcccaagtagctgggactgtgagtgtgtgccaccacacctggctaatttttgcatttttagtagaaacagggtcttgccatgttggccaggctggccttgaactcccgagctctagcaatccagctgcctcagcctcccaaaatgctgggactacaggcatgagccacccaacatggccaaaaataattgtgtcattgggaagttttgattgcctaaagaaaaatataaaaacatttgcatggattgtttcccttagatttttaagacaaaaatgattaaagcactacattataatatctggcagaggttcatttgatcaccatatttttagaaatttaatgcaaaagagaaatgcaaaacatttactctctagatcagtatttatacttcttgtgatgacttaaataactctggcagctttctgagtagttggcagtttctacaaaatatgccaagtaaggagcacaacattagtatactatatcatgtcattttcttctaaaacacaaatattgaacttttaccacctgctactgtacagcagtgctatggcaacatcttcgtagagttcctaagctcctttgaaaagtaggatctaatcagcacaaaaggaaataaactatcatcattgctgttgctataattacctagttggcaaaataagctctatctatacagaatcacacattaaaacaaatttgcttaggaaaactaaatgttttatttcagcccagcttacattttcaaatgaattggttaacaattagaaaagaaattgttgataaaccttgcattatgtttattgaatttttatttctggttaaaaaggttaactgttttcactgtggaatatttagaaaatatagatttctttctttaaaaatagttagccataaggaagccataattcatcactgtaacagagaatcttttttcatatatcttttactttatagtattttaatattttttctctactgtagacacatttgggatttatttccaacttacataaatgcatcataataactgtaactccatatgattttattatgaataaggatagattttaaaaacataatcaaaatgttcacatttttgtaattacttaatgtggcaaatattttattaatacttaaatttgtttaatcagaggccagcagtactgtagatatttctgagtgatttcacagaatgtgtgggaatatacatctgcgtcaattctttaaatgagtaaaaggagcatctgtaatgcagcaaaatcaatcatgaagaagtaactgatgcaggaattgcctatacaggtttccaaagtacatgtacgcgtgtagattgagttacaagaaaaaggtcactttctaataaggcaactgacaattattttgtaaaaaatatgaaagtgcaagcacatactttagaacaaatattaggtacaagcttaatggaagagtctatcatgtaattagcagacaaaatgagccacagaccacatttacatacttagtttaaaatagaaacagagtcccaagagataaccattttactgctgcccagttgaggagaaaacactttcaatatttctacattaacgttcagagagtcaaggtggccgatgcagaacaaaaacactaatgataaggaaaaaaagtttttccaaagaagaacttggtatgaattagatattaattgttaattacttcagaaggcccaagtgaaaattcagacttctttctctgctcttggccttatttcatgttcccgctttctaagcacattaggttttcctattaatcagtcacaatcaccatgtctaatcggctgtggatctagatccttaccagatcccagccaatagaagttagcaatgtaaggcttattttgtggaccacttctttggaggaatacgttgtgtttctgttagatgactatacacatgatagtcaacttccagcccatatctggatgcattcttgagatgactctgaatcaaataatttcttttaaaccaaaactaaatatttatattaattgaatgagacttttataaattattccaagtaaagcatgaatttccagagactggcataatttaaacccatactggaggggaattatccatggatttgggttgaaactttcattttagtacctctactcatagtagattgagaattaaaatctgaagaaaaccctcttagataagacatttgtaaaataaaaaactcacttaccattccgactttcttcatcaatagcaactatggtagctggtggtcctcccctagctagtttgcaatctaaagagagaaaataaccaaaagtaataattgactgcaggggcacacacaatgagaaaaaaattcattgagatgtatattaatatttaaaaaggaaaatcttgcaatctaattaatatgcatcactacaattaatattatttaaaaacattttataataaccacatagattccttaccacatcataatacagtcactttgtgcatcacaaaactactcaaatcttactgagaaaacaccagcagggaccactggagagcagaagtccttcaggacagagataatgggatggaaatttaacccaaagaaataacagaaagggatgattaacaaggataaattgtaattaaagcatcacaacagaaacaaacataattggactttaattgtgataaagggtctaattagagagagtgaatagaattttaataatgttctaaagagaataaaacaaagacagacaagcaatgctcatgaggttgtttggggtttttatttttgtcatcttaccctcatattgccagtctggagtcaaaagtatagagtcatcaatggaagcagatcagaaaaatggaagaaagaaaggaagagagaatatatgtatatatttagtgagagatttaaggatataaaaagcattatacaataacattatctaatgatttgtggaaatagaatatataaaatccctatcagatttcctacttctaatataatgttaacacattcactggataatacacatcattagcattttaaaagccgttacaaaaaagactagaaaataacataaagtaaattggtatttttcttacgaaaaggtaaatacgaattacttatgaacagtctgttatctgtatgctgaaaaaactttaagaatagtgcctgtcaatcagtagtgatgattaattcattatttcaaacactgctaatatccttccaggtatcacatgataatgaacataaaaaatagtatgagctataatatccatgacagttgaaatgtgaaaactttgcctgcaggatgtcaaatgtgcacctctgagacataaagtactctactaggaaatactttgtgaggcagagagggctatgtcatgcagttatacatacatggcacactcctgtacagcagtgcaaattaattttgcttgaagttttccaaatttgtgtgttatttgggaaataatttcaaggtttatttacttattaaaattctgccatttattatgtacatatacatgaataattaggccttcaggaagcactattctgtattgtaaggtatgtacgctctcatatgaagcaaagaagctgggagatctacacattttctctctttacacttgtcaatattgaaggagttccaagtcataacattttcagatctaaaatatctcacactcattacgcctcttcctctccttatgccctcctacagagcccagcactacactatttgtcatctctgctcttgatttagtttcctcgctgatctcccagaagtcttgttctcatcctgcattcatctattcctttcatgagaatgattttcatgtacccaaatcaaaagtgaaataatagcattcctctgaacaaaaaccttacatgtttcttttggagaaaatgaaaaaaaaatcagaagaacaaagtttcttcacatggccttaacatcctttattgagaattaagcaacctgtccttcaattacatgaatcctcttactgttgctggaatgtagcctgtatttttagcaaaattttgttatctaaattcattgttgcctttttttgcctagcaaatctctgcttctttttgtagaattagatatttcacatatttgcacctagtgcgaattaattttgattaaagccttccaaattttcatgttacttgaaaaatgatttcaacatttctttatttatttactgttttataaaattcctccaattattatgtacatagaaatgaataattaggctttggaaagcactgtattgtaaggtatgcactctctcatatgtacacacacacacatatacacacactcatgtcactgtgtgccaatgccataatacctactgaaaatagataaaaattatgtattttagtgtgaatgttggtagaggaataaatatttaatcaacaactttatgggcaagcagaatatagaataataaaagaaggggaaatttggatataaatatttttgaacctttttacagtttgttactattaagtttaaaagtaggctttatgaagctaagccaaataatatcttcatattccagcccttcctcactctccgcctttcccattctcaaagttaattctccattcataccaaaccaaatttatgttttttgcatcaactgttaaaatatactttccactcttcttcccctggttaattttattcctttttcaggaatctgcctacgcatcacctcttcttgaaaatccttctcgttgtcattctagattaagtccttattctctgtattcctgcagtacacactgtatcccattggactaattgccccattggcacaatactaatgtgtctttctctctcacaagagcttcttcagaccatgcctgcatcattttcaccttggtaacctcagaacatgatactggtcctgaaagaatgtttgttgactttttccacaatgtagtctgctaagctacaatcttccattaaaacctctccatgagagcagctcagaagtctctgttctcactaacccctcaatagcagaaacagcccagaagaagctgcttaactacattttctcctgctacagtacccttagataattcccactacgatttattattttagtagattcaaaattctccccaataaaacattctttatatactacatatacttctggataaatacaaaaataatttaaacttttttaagactcaaaacacaaaatgaaaagaggttaagcagacacataataaataatctattaataacattgttcataacaaagtgtttgtttttaaacgatgcattcacgacagcataattaattagttttgaagtgcacaaaagcatttttaataagaacaattatatttagaattgtcttggaaagaaagtaatttggatgtaatagccaactatatattatgtatgaaaatatccaaatgtaaatcaaagggaagactagaaagcaatttgggggatggggagattgtaccctatggtctgtggatcatctgtctgccacaggaaagtcaggtgagctgctgatacctgtaccctggaaatggacttccttaatctatttaatttcacccttgactgtcctggttaaatcacaaattcattgtttttcatgcctaaagtttctagcctgttaggcctatactcattttccatatccaatttgtggtaaagtacaggatatgaataccaataactgaatgctcagtgtggcttatttctgcaaacttgtcacaatgctaaaaataagccatatatttaaaaatattcatatgcaatagatgggatttaaaatccaaagaggagaattaaaaagacaaataatgactgatctcacagatactaagcctgtgatactctgttgtcattgtagcctgaattttaagagcatgttacagacaggtcagacaaaggcttttgaaaatctaggattttccgaatatgctcatttcgtagaaatgagagcaagcacccaggaattcaaattctattcccactttagcctattctcaaaatgttcttttaacgttgatcaatgtgttttcaataagacttcaaaactatttactttaaaaaatatattaacatagtaattgcccttatatgttaataacttgtgtattgaatttcctacccatatttatcttctgagcctgggtcccatttgcccagacaacttctgtacttgcaatttcaaagttgtcttaaatgtagccctccaaatcgcatcccagttgctatcatagccgaaaactggatattttcaatatatattatttcagtgaatggcataattctgcaccaagccacataagtcagaaaccaggaagtcacatttcattttacccatgtttctagctttccaaaatgtaccgatcgataagtcttgaatttaattcctaaagaaaaacttgtcatatccactcactgctttcaatctgcagtggtaccaggctaatcttgtctcttacctaatcaaataggttttcctaactgctttccttacaatcaatcttgcccttactctgagttaattttctgtctttaagcagagtgatctttataattaaaaccttgcttatttttaaaagaatttaccatttattttaggttataagctaaaatattttggccatctacaactcatcacaaatatgattctagaatgtaaactaacatattttatataacctacaaagtcctccacaatatgccttctccttccctctccagtctcatctatttccatgtccctcttttcccaaagcaaaatagtttttgatcccttgactaggtaaggtttcccaatatatactctcataactctgcctcataatatcaatttatgattacttgattcttcacagaaagaaaactcagtgataacattgaccttgtttctattcctcacggttgtgtccacagggcagattttcctggcacatttttgattccaagcaattatttactgaatgcaaaaacaaagggcctcaatcaaatttgtaacaataaaattaaaacaacactctgtacattaattcccttttttctttttaatttttcaaatgtctttctcaagtgcaagtacagcaggtccttgaatgacattgtttcattcaatgtcatttcattataacaatgaaaaaaaaaaacaactaattccaggcctgagccactatctgtgtggattttgcaagttctccccaaatctgtgaggactttccctgagtactccagtctcctcccacatctcaaagatgtacatgctaggttcattggcatggctacatggtaccagtgtgagtgagtgtgggtgtgtgtgtgagttgccctgagaaggaatggtatcctgtccaaggtgggttcctgccttatgccctgaggtactgggctagcaggctccctgatgggaggccctgaactggtaaataattatctcactttttttgattaatctttcttaaatgcatgtatagctcacatttacttcaatatttaatataagaaatttttggtctttatttagaagtgtggtgatgtttttgtaaccataactatgtcataggaacttgtttatattttgtttagcctaaaataaaattggtttcattttatgtcatttcattgaaagtctcaatttccaagaacctacggacaatattaactgaagacttactgtaatgaggaaaaaattgacagataatttgttgtctaaagataaggtcattggtgacaactcagcagatgtgaaaggctaccaataaagtaagaaaggtgtagataattctgcaagaatttgaggttatttggaacaagttatgaaagattagagagagctcacaataatagacaaagtaaagtgatgaaaaaaaaggagaaaatgttcacttgcttccaaatgtctataatttctattagaattccaagatgttttatgattttaccaaactgtatcttaaaggaataaaactaagaaatttcaaatactaaagtttaaattatatcaaagatcaacttaccttttttttgtcatcttagaatttttaagctatttccttacaagctgcctaaatcaccagtgaactctgtggcacctagtagagtatttgacttaacataatcatttaatttatttgctgaattaggaaatatcttcctctatggaaaattaacaaaatgaataatccatcaaatccttagctttaaccatttcaaatctttgggggagtgttttaagatgttaaagaaatgggtttctaatatattatagtggttgtgaacatgtgctttggagtcacaaaacctaacttcaaatcctaactttggtttttaatagttgtataatattggacaaattatttaacctcttgtatttcattaatggggataagagtaattacaactaactcatatatttttacaacaaggacaaaatgaggaaatctatggtaatttcttagaagagtgtctggcaaaatgtatagacagactaggcctacatttgcttttattagtatccttattttcattaggaatatattcgaataaaatgttttttctatttttttcctttcatgcaagggctgatagtaaatatagtaaataaaccctcagctctcccaaatattcagtgagggcagatcttagttatatatgggattgtgaaatatattgttattaagaataaaagtaattacatgaaatgtcactggtggtctgtagggacaaaaatttgcttgaattcctatcccagataccaagctagatatactctgatggattaaatttactagggaaaaatagactccttgaacttgaagcttaaaaaaagtaatggggttctcacagtcctctactggtcccagtatgcccctgatatgagttggtgagattccacagaaagatcaaggaagagttgcagattttgtgaaacctctattcctgccaacatttctctattatctgtttcgttattcagagtaatctagtctcttgctcatgtgtttgtatttacacagacacacacacacactgaatctattgctaagttcaaagcaatttggcacctcattcaaagaaggtactgtgttctctttaaatttcatgctacacaagcattctgttttcaatttgcatgtcacaagcagcaggagagggacttttctcatttttcctgttgatctttggtatattcattttcaggaaaatacacacaggagtgaaatcttaagacagatactacttattttacattttgactgcttcatccaaaagaaaaagtttgatcttgaatttataaaatcaatggaacaataatctaacttgtatgatctaaagttacagtcaacaaactaatggaaaaagacaatgatagaacaaaagcaaaataaactgagtaaatttaaggacagagcaagtaattcagttccaattcaagaacaggatatgctacttgtgttactctcttggcattactatttgcagatttcagatttcaccatgaagggagcaaatgatattttatgtaccttagtgtcattattaattgaattatataatttgatgaagactttaaaacaacattgtctagtaatatccaccaaattcattcatggtaattactcaacatcattgctttcatcaatacaatttactctagagaccatagctacctcaatctgtacttttaaaaaaaacaatttcttattattttattttattctaactggtctatcaacaacagcagacttgaacataaatggcatttggtcagagaccagaagcccatacttagtcttaagaagtttggccggatgcggtggctcacgcctgtaatcccagcactttgggaggccgagacaggcggatcacaaggtcaggagatcgagaccatcctggctaacatggtgaaaccccatctctactaaaaatacaaaaaattagctgggcgtggtggcgggcgcctgtagtcccagctattcgggaggctgaggcaggagaatggcatgaacccaggaggtggagcttgcagtgagctgagatggtgccactgcactccagcctggcagacagagcgagactccacctcaaaaaaaaaaaaaaaaaaaaaaaaagaagtttaaggttctaggggctttaggaaaaaggcagaatatgaaataaattgtcagtagaaggctgctccaaagatgaagtatataattttaagattgcttttgttgattgaaaatattattgtactttattttatagttttatgtaaatacattgtcaaaacatgttaatctttgtattcatacataattctcttacatataattcataccacatgagttagaaactgtttaggttttccttccattgtgggttacaactcttcttttcttgtctaagcttccagcaagcaaccatgattcaatttgaggaatttaagatgaacagaacaattcttggtccaaggtgtaatattaccactgacatcaaaagaggccatataatgttgtggttaagaacatagcctttgagacagactgcctaggttaaatactagtcacatttaacaccttgctcactcttaggacctttgaaagttaattaaattttctgtagctcagttgcattatttgtaaaatagatgttgttttagagtagtgtctggcatatggaaatgctttctatgttattgtgaggtaaatttttattctaaccaagtgagcaaatcacttaaaatatgtctgttttttaaaaagcaatgactgtcatttttttttttaatatttcagtagaagtttcttccatttttaacattcaaaggaaaaccacattttattagtagatcaaataaggaatggggcatatgttaactttttaaaaaataatttcaaattttcttttatatttaggaggtatacaatatgcaggttgttatctgggtatactgtaaggtttgggatatgattgattccatcatcaggtaatgagcacagcactcaatagttgttttttaaatacttgtccctcttccaccctctccccttttctagatgtccagtgtctattactgacatccttatgcccatggctatgcaatgtttagctgctacatataagtgagaacatgaattatttggtttttctgttcctgtgttaacttgcttaggataacagcctataactgcatccgtgtggctgcaaacaacatgatttcattctatttttatggctgcatagaattctatggtgcatgtgcagcacgtttcctttatccaattcactgttgacgggcacttacattgaatccatgtctttgttattgtgaatagtactgcaatgaacatacaagtgcatgtgactatttggtggaacaatttgtttcctttttttttttttttttttttgagacggcgtctctctctcgcccaggctggagtgcagtggtgcgatctcagctcactgcaagctccgcctcccaggttcacgccagtcttctgcctcagcctcccgagtagctgggactacaggcgcccgctaccatgcccagctaatttttttgtattttcagtagagacggggtttcaccgtgttagccaggatggtcgcgatctcctgaccttgtgatccgcccgcctcggcctcccaaaatgctgggattacaggcctgagccaacgcgaccggccgcaatttgttttcttttagatatataaccagtaataggattgtgagtctaatagaagagctggtatcaagtctgaaactactctaaaatatcaaggaggagagtctgctccctaactcattctacaataccagcatcaccctgataccaaaacctgtcgaagacacaaggaacaaagaaaactataggtcaatattcctgatgaacatagatgcaaaaatcttcaacaaaatacttccaaggcaaataaagctgcacataaaaaacttaatctaccattatcaagtaggcttcattcctaggatgcaagattggttcaatgtatgcaattcaataattgtgatttatcacatggacaaaattaaaaccaaaaaccataaggtttttgagaatctccaaatttccacattggctgaactaatttacattcccaccaagagtatacaagcattcccttctctgtgcagcattaccagcatcttttgttttttgacttcttaataatagcattttgactggtgtgaggtagtatctcattgtggttttgatttgcgtttctctgatgattagtgatgttgagcattttttcatgtttgttgtctgcttgtatgtctgtttttgagagaagtctgttcatgtcttttgccaatttttcaatgtggttatttggtttatgtttgttaaattatttaagtttcttatagattctggagattagacctttgcgggtgcatagtttgaaaatactttctaccattgtgtaggttgtatttttactctgttaatagtcttttctgtcgggcagaagctctttagtttatgtaggtcccacttgtcaatttttggttttgttgcaattgcttttgaggacttgccataaattctttgtaaatgcaaacatcaaggatagtgtttcctaggcttccttttaagattcttacagcttgaggtcttacacttaaacttttaatgcatgttgagttaatttttgtagatagtgaaagtaagggtccagtttaattctgtatgtggctagccagttaactcagcaccatttgttgaatagggggtactttccccattccttatttttgtcaattttgtcaaaaatcagatgattgtaggtatgtggctttctttttggattctcttttctgtttcattggtctatgtgtctattttgtaccaataacatgttttgttaccagtactatagccttagagtatagtttgaaaaaaagctatgttgtttttgcttaggattgtgctttggtttgaacttgtgtccccatccaaatctcatgtcaaattctaacctccaatgttggaggaggggctggtgggataaaactggatcatgggtgtaggatttgcccttgctgttcttgtgatagtgagtgaattcacacaagatctggttgttttgaagtatgtagtaccttccccttcattctcttcctcctactttggccatgtccccagccatgcttcctgtacagcctgtggaaccaagggccaattaaacctcttttctttataaattacccagtctcaggtagttctttataatgatgcaacaatgaactactacagattgctttgtctatttgggttctttttggttccatatgaatttcagaattttttctaattctgtgtaaaatggcattgaaagttcagtagcaatagcattgaatctcttgattgctttagagattatggcaattttaacaatattgattcttccagtcaatgagtatgaaatgctttttccatttgtttatgttatctatgatttctttcagcagtgtgcagttctccttacagaggtctttcagcttcttggttagacgtactatctaaaagccctacttaaaaggcacagagtgatgggttggataaagtaacacccattcatctggtatcttcaagagacgcttctcacatgtaatgatccccataggctcaaagtaaagggctggagaaagatctatcatgcaaacagaataccaaatggaacaagggtcactattgttatatcaaataaaacagcttttaaaccaacaacaataaaaaagaacaaagaagggcattacataatgataaagggttcaattcaaagacaagacttagttatgctaactatatacatatgcaatattagagcatccaaattcatgaaacaaggacttctaaacctacaaaaagactgacatagcacacaatgatagtgggggtcttcaacaccccactgacaacattagacaaatcattgagtcagaaaacttccgcagaaattctggaattaaatttgacacttgacaaattgagcataattgatgtttacaggacactccatatatcaaccacagaatatacattcctctcatctgcacacagaatatactctaagatcaaccacatggttagccataaagcaagttggaaaaaatccaaaagaaggtctttccataaaacaagtctcaaagaaatcaaagttataccaatcacataccaaccacagtggaattaaaatagaaacctataacaagaatatctctcaaaaacacacaaatatatagaaattaagcaactttgctcctgaatgagttttggattgtaaggcagaaattttaaaaaattcttttaaataaatgaagaaagacacgcaaaataccaacatctctgggatgtgggaagagatatgttaagaggaaagtgtatggtgctaaatgcctaccttaaaaagttagaaaaatctctgattaacgatctaacaccacatctagagtaactagaaaaacaagaacaaactaactcaaaagctacctgaagaaaataaataactaaaatcagggcaggactaaataaaattgaggcataaaaatccataaaagcatcagcaaaaccaaaagttggttgtttgaaaggacgaataagatctatagaccactgactatatgactatataaacaaagaacaaaacagagaagatccagataagcacaacataaatgacaaagatgacattacaactggtccaacagaaacacaaaaaaatcctcagagactattatcaacacctgtgttcacacaaactagaaaatatacaggaaatggatatattcctggaaacacacaatctcccaaaatttaatcaggaagaaattaaaaccctgaacagaccaacattgagttccatattgactcagtaataagaaacctaccaacgaacaaaagccccacaccagatgaactcacagccgaattctaccagatgtacaaagaagagctggtaccaaatctactaaaactattccaaaatatcaaggaggagagactcctccctaactcattctacaatgccagcattaccctgataccaaaacctgttaaagacacaaggaacaaagaaaactataggtcaatattcctgatgaacatagatgcaaaaatcttcaacaaaatactttcaaaccaaataaagctgcacataaaaaacttaatctaccattatcaagtaggcttcattcctaggatgcaagattggttcaatatatgcaattcaataaatgtgattcatcacataaacaaaattaaaaccaaaaactatacgataatcccagtagatgcagaaaaagctttcaataaaatccaacatctcttcatgataaaaatcctcaacaaactctgtatcaagggaacatatctcaaaataataggagccatatatgacacaatacagctaacattaaactaaatgtcgcaaaagctggaaccattccccttaagcactggaacaagacaaggataccattctccattctcaccacttctatttgacatagtactagaagtcctaactacagcattcaggcaagagaaagaaagaaaatgtacccaaacacgaaactaaagaagtcaaactatctcttctataaccaggaaacctcgatgacatcaccaaaaagctcctgaaactgataaatggcttcagtatagtttgaggatacaaattcaatctataaaaatatattaacatttttgatgtgcatttaacatactaaaatcatgacttaatatatttcagtatataaccaccgattgtttaaattacatagtgataatggaactatactttctttttaaaaattatctgaggaatgtttataaataaactaaaaataaacaactcttttttgatacatacagtagacagtatacagcttctaaaagctctttacatggtgaaataagatctgttattccaaaatctttccaaaagaacttttctgttattagcttgtttttcaacattatccaacttgtctctgtgttttgtaattgaaatataaaggagaaaggaaaaggataatatttgtgtccatgtggaaaacaaaattattcatcaaacactttatgaaaagcagcttttatttccatcttgtttctgaaagctaatttgttattttttctaattattcttaatgaggaggctcagaggaaattcttaatcatgattcttactaagacactcaacaaggtcaaaagataaaagctgcagaatcaatgtcactgtttaaaattacactcttccaacagagagattcttaataagtctttgtttgcagagtactttgactactaaataaaattctttgccacaagacagttatgtgtacttaagctgcattaaaaaaagcaaactgtatggattaatttttgaaacaaaaattataagcatttaattacttattaaagaacatatccatgtaaatatgtccttagctgtccagttgtgacagatgttagcatgaaatagatgtgccacatttacaaggtacgggatgttgaagcaattttcctacttaagtgaagtaatataggcttatatttctggaacttcagaagactgtgctaatatttacctttctgtttcatcatctaggatataactatttttcacttatgtgtgaagcaggaaagttgttagacatagcaggaaaaagtacttcgtatcactggctggcagagaaagtttatatatttgagtttatacaggtaactggaaatttagaagtatttttcattgccttattttcttattccttgtcatgaagagtgtttggactgaggttctactatgaaaggtgaatatccaagggtggaatgagtagggactgtggctgagagttatgaaagaagatgattctgaaaaaaataacagaaagcataaagcaaatatttcctactttttccatacatcacatcttgctttctcagaaatttctctgctacaaacccacctgataacaccttccttagagccatagagccaaagtcattacagaggaatgtttcatatagaacaggaagttccaaatgaacctatgttctttttgatacgggagtactgggaagggaagagcgtggtccctttaaatgacatggaagggggaaagggaagtgctgagtggagaagggcgtggtccctggctagggctccataggtgaagactggcgctcctgcttttgtgcccaaatgttgcattttccaagaccaccctggcctgccatgcccccatcctgggcctataaaaagccaagaccctagcaggcagatacaaatacaggtggatgtggtgaggaacacattggcagaagacataagcggctcctagactccaaaaggatgtcgagggagcacaccagcggaagagcacaccgacagacactggcacgcgtgcaggccacccactggtggaaggaggcggagtttggtccggggaagttggaggagagccgtggccccccaaaactccgaatggcccactccaagggaaaaccatctcccttctggctcccccattggctgagagctacttccactcaataaaactttgcagttgttctccaagcccacgtgtgatccgattcttccagtacaccaaggcaagaaaccccgggatacagaaatccctctgtccttgtgataaggaagggggtctaattaagctggttaacacaaatcgcctatagatggcaaactaaaacacatgccctgtaacacatgcctactgggccttcatccctagacactggggtcagagccccacatcctgcccatttgcatgctcccctagaggtttgagcagcggggcactgaagaagcgatccacacccccaacgcatgccctgcgaggaggacaagggaacctttcccatttcgttttcattgtttcacaataaagaagtgacaagggatggatgtctacctatgtcaactgtttttaaaaataatatttcatgtaatgaactggcctatgaaatttgatcatatgatttggatcattcttgtcacacccaattaaaagaaagttgactagccaggggaaaaaaaatcaggacatgtagcatcgctctagaaacgtaattttctgcaagtctggctgttgaaactgcctattctaacccgagacagttttatttataactgctgagacaacttgcaactccagggctaattttccccaccgctgttgctcaccaaacagagtttgccagctccccagaaacttactagtcccaatgcactttctctaagagcaatacataacatttctcatttttataaaatcaccaaccttctctttgttcttcagacataccgaagaacacctgacccgtgtgtatgctccaaattgtgattctttattctcaaagaaaacattgaatttagagatccatctccacatttctattttgacttcaacaatcccattctgcatcataaaccttgagagaataatatccaaaccaagtcagatcagtaatttgatctgacatttcttggggtgaaagaaaacttttgttggcaagtttagcaaaagggactttggccacatgctgaagtatgcatatgtacaaatgaattacttcaaggaaaatgagctaggataacagtttttatattggccataaggataaaaacacattattgattaactgcattttttggagcttggaagttttcttaagaattctctaaaactgaatataataaagtgctaagacaagtattttaccacccttgacatttagaaatgaagtttttgatagtttgttatccacatgtataacatatgatgtggaaagttttatgtcctgctgagcttagttctcataggctcaattttagacaatttctatacagacgcctgcaattttgaatatctgctgctatttatgaggccttcccaagggtggtactccatatttaatttaattgtgtttgcatatatcatacattttgccaacagtaagctctaagagcactttatagttgataacaacttccttcattgctttccaagctatatgatttcttactataaaaccagccttccaccttcagtattgttagttctaacggcatacacgcaatggttttctctactatgttcaaaaagagggtaaaactactaagagtggaaattaatctgttaaaaatttctgttacattaacagcattttattatatctctcctcaaattaatttacttgagtacagtgctagaattgttattctgttgttagactttatgccataaattttggtaatatgtctatcatcaggaggttgggattttcaaaatttttcaattatcataatcagagacaagacctaggaaatgagatcaatttagtccctctaatcacaaatgtctgtactctaaagttcatgaacttgacactaagggaaagccccagaatggattagaaaatgctaataaaagtggagaatgtgtgggaaaaaaagacacctggctaaaggaaggcatgtttccaattttagagcaaggacagagaaatttttacagtagatataagaattcacaaagcatagctgtctggagcaaataatgtctttctctactaaaatagcttcaatactactttgttgcagattgtactaattaacagttatgttaatgatggtaactcatcatcacaatttttattttatgcaaactctttaaataatagaaaagtatgcaatgtattttagaaagatttgtatccatggaacttataaccaaaacaaatgttaattaaaataaagtaatatttttcttctgtcaaattgtcaaaattttattaaaaataatagccactattggttcaagtaaggaattaaaattattttataattttggtgtagctataagttgtttctatataaagaaagaaaggagagaaagcaaggaaggagggaaggaaggaaggaagagaaagaagacaaaatggaaagccaatataccaagaacttttaaaaactgtcctttgaatgaaaaattttactttgggatctatagcaatatagagataattaaagaagtatatattgctgctaaaagtacttataatagtaaaacattatatatgtttattaaatcattatgatttaaacacactctgtaattgtgacagatactgtatattggaccacccactctaacacctcttcttgtatttttctttttgtgcactattgaggcagataaacttaaaactgcacttgccagactcatttgcggatagggtctaccttggaatctgcgaagcagaagacactctcatgacacaagaacataaaggaacaagtgagccaaagggaagtcagttaatcactgggcaggaagtgtatggttctttgggggcagctgtggtagagaaattagtgcaacaccaggttatgatagttgccatgatggggattgtacctatgaggtttccactagaaagttcagattcgtggttaggtatctatttggctctcatgatcttgccgctgtggcatccaagcttagttttctgatgcttctaagtcactagaccacattagtaaattcattacagatgaaagaggctacctggattctatgaaattggatgaatgaataagccattaaaatatatattcatgttgttaaataaattttgatgggatgagtaattctcatggaaagtcaaaaaattataaagcaggttttagaactgtctgtacattcttagttttgagtgtgaatatataaagtctttttaatattaaagactaaataaatgaaacattattattgttattagtgatttcttattgaattcctaaattgcttttaggaatttattataagaaaatagtgtcctttgcatttttataagaaataaatgcattgcatttattataagaaaacatgacaaacacaatttggaagcaaaaataaggaacttcatttgtttagaatacttatagtaaatatcacaaagattctaaatagaataataaccttatcacaatataacgtaagaaacactgtaatgtgaaatctgttttgttaaaacacatttagatttaaaatttcttaagccattggatatgccttgttatcagtgtcacacactgaaaacttctagaagttgtcatttcatctgatacatgaagagcaacagttattccttaacacctccttcaacaccgcatgattctcctcaattcatattttgaaatttgacatatggcactgatggtgatatgacagagagaatctcaatgtgtcaatgacttcatcatattcatttgggcaactgagctagagtcttctgctccatgaagtctgtaatgacattgtgggaaagctgtaggcaggagcttcatattcagatcaaaggcaaatacaaaccagggaagagctatcttccagtcaatatttgttggcatttgctatattataaaacttcaagcactctcccatttttctgctcaatttttcttccattcattgcacggtgagatatgttccaccatgaacaaaggaagttaataagagttttcaaagatacaataaaatagatgaagtttaatatgacatttaaccctattgcttctcaaacaaaatgctttatatacatagcaagctggcttgctatccatcttctgtcactattctctttgtttactattattttgttttaccttttctaaaatgtcaaatatatcagacacacaatagagtatctgatatatttgtagagcttaaaaatcaataatactacaataaaatgaatatttatgtcaccaccacctacaatcagaaataaaatcctgccactatcttataaatcttctgtgtgcactttgatagacttttgcaagttttagggctgtataaaatagatttacacagcacaaattctgcaacttggctatttctctgcattattatgtttttaggttaatccatactgatgtatatacctttagggaaataatgctgtaaagtattccattatataactggatcacactatttacctgttctttattggagagattactgttgcaataatttttatttgtattatgaacaaagaccagatgcatattctggcatatctctcttggtgcacaatttgaggaatattttaggacatacccttaggaacgaacaaaagtgctgtgtcatgggtatagtatatatttatatttacttagttaaaatcaaattattttccaaattggctatgccattttctcagttaccagcaatttcagaattcctctttctccccatcttctataagatttgatatgatattaaacttttgtcattttgattgttgagacttgatattttatgtttttaaatttacatttttttctgactacttggcaacttctcatgtgtttaatgaaaacatgcgccactgcactccagcctgggcgacagagcgagactctgtctcaaaaaaaaaaaaccaaaaaaaccaaaaaaaacccatatatatatatgttttatatatatatttatatatttacattttatatttatattttatatgtatatacttatatattttatacatatataaaatactcacatgttttttaatgtggcttatttaaggaaactttactgatcatagagacataaaaatatttttcttaagtttcctttaacagttttagatttttgtctttcatatatgtcatccatatatgtgaaattatctattgtaattatttattaagtgttgaagaaccattttaattttccacatgagaaataaattatttgaaaaactaaggaaagttaattatatccattttcacctctaaatatcacctatttatacttctattttccatggtatattatggatccatttctgtacctttatatatatatgtatatgtgccttatataaattattatataatatatattattgtatatatttatattatatatttaatatatagtatatattatatataaatatataatacttatataaatatatatacatatgtttgtttcacatatatatacaacattgcttggttcaatttgttaataatttcttaggaaaatttttatccctcctgactttctatggtttttggtgacaacattttcctgtgtctttgaaggctgaagaacattgtaattttgttgcctagatgtttcttggatttcttccataaaactttttgagcctggggtttattgtgtagggaaaacataattgctagtgctagaatttaggttttctatcatgtcagatgtcgctatgtatagttaatgtttttctagaaatgtgtctattttgtacttttttcaatttattaacatatatatttcatatcatctttatctaaaaatctcagtctcttctgcagctataatttcggcaataccagttttaatattatttatttggcttctttctttaatttctatttttcctgttcattttaattataaattaaataatccttggctttgttaagtctgcattattttgatactttatgttttttattatttatttttatcttctttgtccttattctcttttctttacacacacacacacacaatatttcagatagatgcttattttgttgattttcagcctttcttcttttcaaccatgagaagttaaggctataaattgccccctcaatgcttttagaatcacatttcaaaaatgttgaaaatttatattagtggtaatttagctacaattgtcttctaattatgatttcttttttacccataggttatttaaaagatagttttaataaatacaaatgtatttattttacatatttttattactgaattactaatttatgtagatgtcagagaatgtgggtatactaatagattcttttgtaaaatttatcgaaaccttctttaatgcctagtatatggcccatttttaaagtttcatttgttattaaaaataatgtatgttctacaacttaacagtagtagtagtatcaaacctatacctttggtataggtttttatatatgtccactggaaagtttaagtatattttgatatattcagtatcttattgagataggatattgtgtctgctaatctatcaattgttgacaataatgtgtttaaatcttctacagtgatgtttgttaaattatttttgtacgtctgcgattttttaatttatattttaaactatgtagctaggtacatgcatatttagaattgctacatcttcttagtaaattgaacctttataattactgtatagtggccttctttatagctagtgtatttttgccttaatgctttatgatctggtcaggcaccagattttatctcctaactcctatagactctttaaaactcttaaaatcttaaaatataggatccagaccacaagcaatttacagacgctccaaaacaaatgtggattttaaagctttcttacatcaatagactcatgctttcttatcttatctgattgttgaatgattctatttctttttccatgttatcaccacattttaaaaagagtttgttttgttttgttttgtttttgttatccgtgtttttagggagtagttttctgaaattccagtcagctaaaatcctgaaataggaaaccaactgttattcttacaacttccactatgcaacctctctctcgctagaaaaatagtatttgcaaatatcaaaatataatcccctttcctgttaggtgagctgcatgcaattaaactaaacataatttatattttaaaaattattttttgccattattttcttgagccagtgagttctcttatttttgcccctgtgccttagtgtatgtgtctgtgtgtgtgtgtgtgtgtgtcacatgtgcgtgcacacacatatacaatgtttgttgtatttttttctggttaactgagactaaacttgaaatttaaagctggccttccatgaaaattatttaatgatgcaatgcaaagacaaattgctttctacatcaattttctatgcaagtacctataaatgttagataactaaattatcccagagttttcttcaggaaatatcagccttttattcaagtatatgattttctataaagtattgctattataatcttttaatgctaggtgaatccacatcaagcattcaatatttgttggatgatacaattaaatttctctctgcttaggttgagtttacattgtctttaaaaatgtcttttaggcagggtgtagtggctcacacctgtaatcccaaaacttgatgaggctgaggtgggaggatcacttgaggccaggagttcatgaccaacctggcaaacatggcaaaaccccacctctactaaaaatacaaacattagccaggcatagtggcacacatctgtaatctcaggactagagtggacgaggcaggagaatctcctgtacctgggaggcagaggttgcagtgagctgagatcacaacactgcactacagcctgggctacaggctgagactctgtctcaaaaaaaaaaaaaaaaaaaaaaaattaatatcacaaacatggtaaacataaaaattatcacagtgtaaaggaaaaagtaatatatactcacaaatataaacagacagtgggagtggggacaaatttgcattcatattgaatcaagacatttatatcgcctctatacaaaaacaagatgaactaaactaaattaaagggatgttaatctagaaattaaatgtatcatgtcagctagttttaatatatggatgctttgggcattgtaagattaaactttctgaatcataacagaatgaagctcattaaaataaaataaacttacccaaatggaagatgacctaaaagaataatttttgggcaaaatattataaaaatagctacacagatattagaaaatataacaagcaaaatttgatttttactttggtgtacaatgtcccaacattctgaataatacatacccttttctcttgaaaaatatgtatatactgaatgactttaaaacaaatctagaaattaaatgtatcatattttccatactgtttttgtttcaatcagattttttaaaagaactttcatctctaaatttaggaatctctttttacaattttttcatttacagctacctcaaaaaatagtatgtattcctaaaataatatagtataaatttattttgaacatcaaaaagaatctgagctcacctatagcccacaaatggaaatgagaaactcatgtgttttcatatttataaacacatattacatcttatacaacacattatgaaaaagaaaataaataaaagcatgctaatataatttgaatgaacaagaaatgctggaaatatttgaattctacctttcaaccacattaattagagcttccactaaatcatttccagactcatataactgtaataatttcacacctataattatctctccatgttccctgctatgtttattttacttaaattagacatatttcagtatgttctgaagattttgccttatattcaacattacatatttgtttaaactcctcccttcatgaatgtactctcctctgattctataggaccacccctcatctatttttatgcactagctccattatgaaacctttcaaaatcataaaaagtagaaaattttattcatagttcacagttgaagaaaaggcagctcataaccttgaagcctatatcctactgtgatactctttgtaaatgatagtatgagaattaagcctttatttaaaactttttcatgtcaatgtcagttctgtctccaaaacttaaatggcattattaatgaatgtgttacaggcattacaatgcagtgattaagaatacagccgctaataccagcttccttgagtttgaaacctagctcatggctccctcctcctttgttttgggaaaattacttacactttatgtctcagcttccttattggtaaaaaatgtataatatgcaagtctaccttatagaattggtggaagcattaaataatgcagttgtgaaacatacaaaagagtatctagtggatggtaagtgtaaaagtagtattaactattagtatctactatatggggttgtgggttgaagtccactaataatttgtgtcaacattactctggtaagagttcatggcaatgacttgttgattctaggaaatttctgttcatcaatgtattgtaaaaaataaagaacttcactgttttttatttttccatgaaatgcctacagatcaatttactgaagacaatagtctgcttatttgtgcaaacagttcacttatgaaacaagtttatttcttcactatacctaccaattctaaattattatgtcatggattttttccattcctaatcagttccttctcttgaaagatctgcattacacaacttgagaccagactccaaagctccataaatatcccattctgacctcttttaaacacttctaagattctgtcagggtggtgtgctttttgattacaatgtattccaataaattcaggtgtactttacttacagattatctggtgatatattgaggagagcaatgaactgtaagcaccactgtgttctagctgagatcccctctctgatgtgtcttaagatccttgacttgcaaaatgaatgctctactggggaagccttgagagactctgcaactgtgatggtggggtctaggtattgatattgtgtctcaactttggtcactgtcaagttcccaaatgttagttttattttgtctaatgggaaatagaatctattttaggactttttctgtgatctgtttagattggaaaatgttaatgtttgatttaaatctgctttattgctaaattactcaattgtgtccttctgtcctcatttttgtgagtctctaagaggaggtttatacaaaaatggccagacatggatcctgataagttgattcctagagccagctctggaattaataacttcagaaggttcctcctcggactggtatccctcacataaattttccctggagtcaactcttcaaaaccttaggcaaatgtttcttattcttatcctgttcagtctttgagagtcaggttctgtataaaatctcccattaaaaaagtttatgttatccaagaacctcagattatcgaggctgggattaaaaaaaaaatcattaacttggaggcctgaaaacactatgcaaaagcaacactttctactgcttgttgctagattctcatggctttgaatcacactaagtgtatgccttctgtaggctgaacccttgcctcatatatgtatctacattataaatctaatttccatgactgtctttcaaaaaggcataatttctttacaaataatttacagttaagaggctacttggtgaaatttttatattaacagaagttgttaatttgagaggagtcttaaaatggaaaggaggtaaaattcctattacaatgtgaacttaatggccttttccctactttttattttcccctgtctttgtttactcaatacccttttgccttactccattttctcacctggccccttacctcctggattacacaacctgagtttcacaaatctcaattgcctcttaaagttaagtcctctttagacatcaacaagcttcttatagtttatttttagccttcattctcagtctgaactaagaatcaatgtaaaagtctggacaaagtacagaggaatttagaatcattctaacaacatatatcgtaggtttcccagatctacgtaagtgattcttatgttagtaagaaaattaatgtaaaaaaattggattaaaaaatgaagacttaggataatctaaggtgaatgaaagaccctgaatattagagaaaaccagaagtatttaggaaagctatacacagtggagaaaatattttggaggctaccccaagactttcctgaaaataggttggacttccatctcattataaaaagagaaagaatgaatcaatttgaaactttaggaacaggacctccaacacctttagaaaatattcaggagtagatcttgagacagacaggacctaaaccctctcatcatttttgcaaagagccctaaaccaaaattagggaatgtaaaatggaaaaagtacatcggaaaatgacttcattgacaaacagaactccaattcctaactgaacattttgaaaaagtcatggaataaaaacagaataagcctctgaataagttaacagccttacagatgaaacaactggctatttctcctcaatttatcaagtatcagaggaggaagcttcctgaatacaaacattgatagataactgtaagcagaaaggacattggaaaaagattcataaaggacattggaaaatagctattctgcactaactgtgaaactaaaagaaaatttttaaaaaggaaggatgtgataagggaagttgatgctgatctgtggggtcattaattccctgatgtcccatttctctaaacattaacagacagtatcaaggtttctgattgattcaggcacagtaatatagtttacagaccctgccacacatgcattcagtcactcccctagagtcaataaagtatttaggagatgagtatttgcaaaaatctacagattattgtgtatcactctatagcttttgccctcagatctttaacatcgtttgctcatttgagacagcacttcccctcatttaataggtagggatttcctatgtaaacagaattgctaatttaagtgctctcttgatgggctttctcttgagatctctaaagaatcacctattcagcagggcacggtggctcacgcctgtaatcccaacactgtgggaggccgaggcgggcagatcacgagctcaggagtttgagaccagcctgaccaacacggtgaaaccccctctctactaaaaatacaaaaaaaaaaaattggccgggtgtggtggcaggcacctgtaatcccagctactcaggaggctgaggcaggagaatagcttgaacccaggaggcagaggttgcattgaactgagatcatgccactgcactccagcctgggtgacagagcgagactctgtctcaaaaaaaaaaaaaaaaaagaaaagaaaagaaaaaagaaaaaggaaaaaaaagaatcacccattcataatcatatcacacctaatttggactatggagtacaaggagcctggtatcgacatcaaactcaaattgaagatctactgatattggctgaattattggggaagaacacctcacatttctcactgacccatttaagcctccatctacacttgccctctacaaccaaagggaaaggacaaaagccagcagttgtgtctaacagaaaaataattacgaatactatgcactagtccttggaacactcctattcttctgatcaagagatcccagtgggctggggtacccatttatttcagaccttgcaactataaataaaatatttagccctgttttcctgtggtgccaaaattctatattattttaatttccatgctacctgagattatgtattttagcattctaaatccatgttctgctgtttgtattgtcccttttagatcataatagaaaatactcattagtctttctctagaaaaatcaatgatgtacctggacagttttactgcagaagtgtactgaggcacccaggtaccttatacaagtcttctgctagacactgaaggaccttgaatctctctataattctactcttatccaacatgcagacaatttttgctatgttgtcaagatgagataatttttcaggttgattccaactactacttatagctcagaaagtatataatgtgttcaaagaaaaattagaattttgtaagaagaaaatgcactatttagaacatgatttataatccatcactctggagagattacaaaacactttttttttttctaaaactgttaagaaaatatacttattttaagagactttttttttttcggctgtagggggtgaattttttttttttttcagtgagagcaggttaattaggaaagtaaaggaataaagaatggccactccatagagatttcataggttattacatgcaatgggttcccaatattactgaaattactgtacctctaaattttaacttagttgttagtaactcaatctctttgttgtattataagcataattagctgtaggggtgtgtctctgtgtgccctgggagtggcagggttggggttgggggtgggaggagtaggaggctgtgtgatttaaaattaattatttggccttcctaattatcttagatctttttaccaatttgtgcatgatcaatttggacaagccattggtgttttgactttactttatcagaatctttaaagactattcatctttaaagttatccataaatttttcatagactcagtggcaaaaggctactcaccttgtctaagggcaacagccagactagtgggtaattacagtgggtaatcttctgatgtttctgcattatattctctactcttcacctaattacctctgaatgtcaccaaaactgtacagtaaattttaatcacacaaggaaggtattttggacaatgataagtctttgggtagattctaaagaccagtgttaggtttgcaaaacaaaagtctattgggtgtggccaacaaattataccaaaaaattgttatctttgtaaatttagacactatactttcagaatggtgcctaatattactcatggatgatttgggcacatttccccctcaaaccctagaaaaagagaactctagataatttcattcaagaaagagaaaaacagggcctcattttgagatatacaacattactcatgtctaattctgaatagttttctcctgtctttaaatcatactatctgtgcttcagatattatcaggaacactgaacaatttcagtgaggccatagaaatcatcacctggagatttcataatactgaggaggtggtacttcttcaaaacatagcagtacgagaaataatattggcctgtcaggatgaaacatgaggcattttacaggaggaaagtttactcatattcctatagttctttctgtttttattttattaagaaaatatgggaaattttttaaaaattacaagacaaggtgataaatctagtattcccacatctgaccattaaaactttttggtttggtcatgggttccattgtattgctttaatttaggcatttttggctcttggcttagaatgtaaaatacttctgttagtatctgtctgtgattcagcattcaaatatcaggttttcataatcaaaaatatttctatgtagccactctgatatgacaataaatgatcatgcagccaaaacaaaaacaaacaaacaaacaaacataaaaacctaatgtatatgatagttgaaatgatcccaccagaaatctgatatgcaatcaggaccctgaagacagtggtattgattttgattgattatttgtgcagatgattattatttatcctccagcttaggttgaaaaatgactacaagagagttctgagaaataagaaaccacctatgttaacaaaactttttattgtttgcttcaaaaatattttctatgaaaggataaaatcataagccaactaattttattattttcttcaggaaatttccacagatcaatttattagagacaacactctgctcatctgaataaataatttatcaaacaacagtttacttattgaggctgcttgtttccacatgcatctcgctctgcccaccagtcttaaattactatatcataaactctgtataatctcagttaattccataccttaaatgactcagtttaaatcactttaccacaatccccacacacgttaagtacctcagttttgacttccctcttctgaaacattgctatatcattgtcaaggtgatgtttactcttacctattgtagtaacttctataacatttaaattttattactacattatcattcttggactaaacagttaaattgtagttattgttctttcttctattactattaatactactattttggtatttctccatcatttactgttgtgggaaaatgtgagaaatatgactgtatatattttattttattcacccaaactagaatatttgtctcttttatacctctccaaagaccccacttctatttttaaaaattagttgatatactattttgtatacatgtttgtttctatctgcttatttagtttacatgtttccttttattctttaccatctaagtactcaattcaaataagatacagagataaggtcagtttctgatagccaaagaatagcaataggtttggcacaagaattgcgcaggttcctcatgaatttgactctaagaaattgtgaaatctcggggaagacacacgaaggcctctgcatcccagttttcccttatctcacttttctcttctcttttcttttatcatatgtatgctatgtgagaattacaataattaaaatatgtaacatatgagaattaaaatatataataaggatagagcttactacaacacctagcacatcctaagtgctcaataataatccttattactttgtaatgctcctgtgagtctgaaaaataatgtatttaaggctcctagtagatactcttttaacaggaactactaatcttgttattgatattaatatagcttggctatattaatccaggtggatcaacatcctctgtataaatgaaaccacctatttacaaggtattccacaataattcaatgttgcatcttcagcaagaacaagccataggtctgaaaatgtaagtgcaaggcattgagtatgcatttgtgtatgtggtctgattattgctctgaagataaacaactactgagaccatatattctgaatcctcttacaggaatacagtatatgattgaattttttttctatctacagcttgcaatgactaaaaaaatgttggtttgttcccacaataaattccctccaagaccacaaatgagaaataccactttacatgtgcataccttaatgatgacctcttcttgaaaacaaaacaagcatgctttagacagaattagcttctcactgtagagatgactggcttaaatgagaattctgtctttgctctaataagtttatttgacatcttggtttgtcttatagtaaaaaaaaaaaaaaaaaaaaaaaagaaaagaaaaggtggtttgctccctttccccatggtgttaaattaattccatgagcagttttgttactctacacaataatacagtgtgtccccttatttatgtcataatgtgtcataatgtctattgggaaaagagatcaatttatgtaactcaatttgttgtctttaaaggagtttaacattgtatttgagctggacattggttgccttgagctttgagaatttaggctgattcatcatgtgaacctgttgtagaaatgaccttctctaggcttctgctttagtttttacatgaatggtcctaatgtccgcctatagaagattttgtgcacatgatgaccttagggttaatctacatcgggaaacacttaaattaccataataatgttctctcgaaattcttaagtatgattaatgttggttatgtatcggcctagatagagatttctaaaagtgagtgttcctgagtgctttggatgatactttgtaagcatatagacatgaaactatttaaaatcattgcataatgttgcaatatatcaaattattttcctcttgacgtatatttagattgttttttgtcactcattaaaagaatgctacaaggagttttttttatgtacaacactttgtgaccatataaaggcagttgcctagatttggaatttgtatataaaaaatatagatacacacttttgttaaaagcttaaaatttgccctttcaaaagaatgtacatatttaatttttcaataatcatgtataaaggtgtcagctgtattttcataagtttaaatgaaaataactgcttgcgttatagatttttcttttttatgttataaaataaaacttgctctaatttatgggtagaaagaatatgccttacaaatttaattaaaagttttaaatgttaggatataatgaaaatcaccccattcttttttatttccgaaacaagaaagggatgttaagtttttcaaaattgattcacatgagctaacattaaaaccattggatgggttgtgtttgtgtccttgccagttagtaactttattataaaatctctaaatctattaccttctgtaaaatgattttgaataagcatctgtgtaaaaattgttttctttttcactggattagaaactctgttaatgtgaacacagtaaatgaacttaaagaaatagtcaagagtaagaaaatatgagaaaataacttttaaaaataagttggcaagtcaagttctatggaaaaattaaaagacgcttaaacatcttaagtaaaatttcaacatgcctgttacgacacatccccaggaagtttattttcataatatttgatgtgattttaaggtcatcatttaagagaaaataaaaaaggtcatgaaagggattttccacatgagggcttccaattgaaaatatttacatataaaatgttaattgtagaaatacaatccaataatgaacaaagttcaaaagtgagtaaaccctgaagcaagacaaggcaagatatgtaatatctatcaataaaactaaaacattttcaaacatttggtgggaaagactatcttagttaatcagggacttctggcttaaggaaagaaagcaacttgtcagatttaatcaaattcatgggaatcaatagaattgttttcttttgttggttttcccagatatatgtaccaatcagcagtggtgataacttagatgaaaggaattggtggaaggagaaaggtctcttcaaaataggatattatctcacttcctaggtttcataatctctaataaagcactcctaatttaaattgaaaaacatcactgtttatttcatgcaataaattaaatcaaaatatataactggtttgatatttgtttccaagtatttgtcagtctttagtcaacaattcattaaaatgaaaaaaaccttaattctgatttacaaaatgaaaactatcaatggtaattattattattattattatttctatttttagtagcgacagggtttcaccatgtcagccaggatggtttcgatctcctgacctcattatctgcccaccttggcctcccaaagtgctgggattacaggcatgagccaccgcacccagctttttttttttttttttttttttttcctgagattgtatctccctctattgcccaggctggaatgcagtggtgtgatcttggttcactgcaacctctgcctcccaagttcaagggattctcctgcctcaacctcccaagtagctgtgaatacaggcgcctaccaccacacccagctaatttttgtgtttttagtagaaatgaggtttcaccatgtttgccaggctggtctcaaactcttgacctcaagtgattcacctgccttggactcccaaagtgctgggattacaggcatgagccactgtgcctggcctatcaatggtaataccttattgtagtatgtaaggattgtataattctattggatcttgaaaggttggtaagaaatcactgaaatgagtaagaatggaattcagtaactcaatattgatatcaagaaattagaagagaaaacaatacattgtgcataatgaagccaaagataagttaattattccttttatgaaaggtctctcatggcatacaaagtcatgtgatacacagtagcacacctcatctcttacatatgaaattaactaggaaagtgtgtttttcaaaatgggcatgaagacattagtttcacaacatacttatatataatacctagatatacatacatgtaacatatacaagtatacatagcacatgcttcatatatatgtacatatatgaaatctcactctcagtctctctctcttgatatacagacagaaagacagagaggtagagtttcatgtatagagagctatatattataactctttatatatagcacggaatgattgaaaccaaatcatttcaggtccaaaaacatacaagtaagggccccttttgtcagtttagttaggtcaatattatacccacctctctatttgaacttgtctacatgaactgtctctatgaatttcagtaaagtggtaacatgaactctaatgtttgttggacttaaccttttaggagcaatacggaacactattaaatgtttatttactcatgtataggagataaaagatagtgaattcttagcaggcttcaaactaacttttgagcttgaaggtacttatcaaaacttataaatgataaaggaaataaaaaaagtgctatcaaggtggatttttaaaacaatttacattttgcttatcattttgatcttcctcttatgatctatacatttgaaaaataaatacgtctatattattgcccaggttttgaaataagcccagttactaataatgccacaagctaagactgagtctactgttaccataaagccagattagcaatccaagggcctggggaacttccgcttttttagcgcttttcctctggtgggtttgttcttgcatttgaacaaagctatgggtttacatgagtaattgcctaagtatctggacttgccgggtatcactgacaacaggcccaaattataattaactcaaagtaccgtgttaactttttcagccaaaaatacatagaccataagatattaggctttctggaagagtctaagttattggctctggcagcaaaagagtaacatattaactgaagagtaaagacaaagcttcagacaaaggttctctataaataattgtgtcaagatgtcattacatcagtggaatgtagctcaattaacaatatcttttaaaggacatcaccttgccctaccaagagaaggtagctgttaaattgtggctccagcttgaggtttgataatgtggcagctataggatccatttcctgttctagttgtgtatattgtggtaataagaaaagcaacagagccccaccataaccaaatacttttaaaaatacaaccttaccctaagaaattaagtaaaaacaaatcttattcctctggtcagtgttgaagaaaaaaacaaacattcgacttcgactggttgcctcacagggggagaaaaataatagtgcataaaagcaaagcaaaacaaacaaaaaaccttagtgagcctagctgacttgttctcaagaacacagaggaacatggaggagaggcaaggctgttgcctagttctaaattaattaattataaagaattacccccaattaaacactaactcactgcactttttttgtagattccttgtttttcccccccacatcatactgaatccaccaaaattatcatcaaaattttaaagcttgataaattattttgtctatccacttcaaatgattatacatcagacaagatccctaacgacatatcagaatgaattacatatctggatatgaaagaactaggatgtctaatttaaggcaaaggtggagtttgcaatattttagtgagaggattgagaagtatggctaaataggaattaaagtcagcataatccttacattaacggaattttattaaaattgtaccatgttatgagtagcagaaagtatttggaaagctgtttccatgtttacctttagtgtagtagataaaggctatctcaaataaaatgttcagtctaaaatgacggcacattttttcttacaatgattaattttagaaaaatctataatccaatttactgcttgaatttacatggttgcatataaatgatgtgactcctggtgtgaattaggtggcaaattagaaaagggctttttatttttattgttttttagtgagaaagcaggtatcaatataactcagagaaatattccctacatcttagagtgagattaataaatatgtctttgttatcaataaaatgggaatataattctatctctttgtattgttataaagattaagttgaaaaaattatgggaagtccatagtataaaactgagtaccctcaaaaaattactctacaaattattgtttatttctatattattttatcatgtatcaatacatattacattttcaaaaatataaaaatacctcattcttggaaaaaaatgaacatttaagagagacaatatgtcactttctcttcagcaatgtcaagagaaaggaaattttaaacagaaaactgcagatgtctattcctgtaacacaagtggatgcattgatctagcaaaatgagatgaacccaaaccattataagcaataaactcacttcattcacttggattctaatcacatctttagaattgaaatttggcttccaacttccatgttcctacaaggagaaaatgtaccacctaatattcaaacattccaacacctttcctttgtcaattatatttcttttattataaatcaacaaatttgcatgttgtcacatagttgtcttgcatgggtttggttactgtgatcccttctcctgactccaatcacatccagctatggagacaaatataaatttcttgatctgtgaatcaacctctggtccttgatttccccagacaagtatttctacccactgaggcctgaccttaacagccagccagtctctttagacagcaattatagccagtctgtttctaactattgcactgtatttataggttgaaactttttaagtagaaactagatatcaacagggctgcctagggtatttctgaatgatgaagacaatgaggatgatgatgatgtcaacaatgggagagaaaattgtctggaaagagcatgctgttactttctggaattatgaaaatattttattccttgtttggggtggtatttacctagctgtttgcaattgtgaaaactcatgaaattaaaaacttaatttctcgtgttttcttttatgcagattatatctcaatatgttcaggcagtagaaataactatgagatttcttcttcttaaataaaatggaaggccaggcgcggtggctcatgcctgtaatcccagcactttgggaggccaaggcaggtggatcacttgaggttgggagtttgagaccagcctgaccaacctggagaaaccccatctctactaaaagtacaaaattagccaggtgtggtgatgcatgcctgtaatcccagctacttgggaggctgaggcagtagaatcgtttgaaactgggaagcggagtttgcagcgagctgagatcgtgccatttcactccagcctgggcaacaagagtgaaatttcatctcaataaataaatacatacatacatacataaaatggattgtgaagatttgaatatggactattcaatttgtggtataattttttgtcatatttgaagaattttcttcacagagaagctttaggtttacaaaaaaaatgggaggaaggtatagatattttccatatactcctgtccccacccatgcataacttgtattatcagcatcccccaccaacgtggtacacttgttacagttgatgaaacttcatttacacatcattatcactcaaatactagtttatattagggtttattctttgtgttttacactctgtggctttgactaaatgtataatgagatgtttctatcattatagtatcatacagacttattttcactgaccaaaaaatcctctgttctctgccgattcatttttccctgaccacaaccccctgacaatcactggtgttttcactttctctatagttctgcctttcacagaatgtcaaataggtgaaatcatagcgtatacagccttgtcatattgcctttttccatttggtattttgaatttacagtttgttcatgtcttttcaaggcttgatagtacacttacttttagcactgaataatagtccattgtctgaaggtaccacagtttatttatccattcacttactgtagaccctcttggttgttccctcccaagttttgaaaattgtgaataaagatgctgtaaacatctatgtgcagatggatgttttcagcttctttgggtaaataccaaggagaatgaccgctggattttatagtaaaagcatctttagttttgtaagaaactttcagattgtcttccaaaggcactgtgtcattttgcagtccccagcaatggatgggacttcttcttgctccacatgttcaacagcatttggtgtcatcagggtttagaattttggtcattctaataggtgtgtagtgttatctcattattatttaaatttatatccccttgataacatctgatgtgggacatcttttcatgtgcttatttgctctctgtatatcttctttggttaggtgactgttacggtttttggcccatttttaaaatgagtggtttgttttcttattgttaacttttaacagatctttgtatattttgcatagcagtccttaatcagatgtgtcttttgtgagtattttctcccagtttgtagcttgtcttctcattcatttgacactgtctttctcagggaagaagtttttaatttcaatgaaggtcagattatcaatctttaaatgaatcctacttttgatgttgtatccaaaaagtcattgccatactcaaggtcacctaagtataattgtttttaatagaaatcatatttttgaaaaagaaatatagttaaattatatcatttcacattttttatcaatgcttttagctcttccaaaccattatgaaatagttgtatttttattgtgttataaaatcaaatcataattaagcttttcaaatgcaaagctaaaaaatgaaatagcataaccttttgaatcgaattgaatagttcaagatctctatgctctatgttcaagcattatgttaaaactgctgtcttactatctacagaattttctaattagcctaaagagatttttataatttacctataaatatattttgagagggagtgataataaaatcaaaataggtcaagatatccaagtaactttattgagatgtcaagtggcatccagcagaaggtgaagaagtcacagagttacatcatagaaggccttcctgctgtgctatttccttcaacagaaaaagaagctttcatcctctaaggcttccagcatctgctgaaactactttgagtaattcaatcttgtaaaaattatttctgctacgtatacttatctaacacataagtatacttataaaaaaataaaaccttgggcccacttgagaaactaaattatatttagtaaggagatcaattttgcacaccttggcttattgtgctctatttaaaaacatattttcaaaacgtagctcttttttttccctgtcatacacttggcttcagtcattttgctgtaattaaacatgataagtacttccccatgttagtaaggcctgtgaatttccttctgcttgaaatggctcatcttccagatgcctacatggcacaaggcctcctttagttcctgtctctactcatgcactgcatcactttctccaagaaatctacttcaccactgtctaaaatagcccaccacgcattccctcacatcttatcccctccctttttgtacataatacatatcactacctgatatattacatcttcatttgtttattcaaaaaatggactttgtagacttttaaaaaactgtaaaatatagtcttcaacaaatagtatgctttgtttctattttattgtggtataatttacattcagtgaattgcactgatcttaaatattactgttcaacagttttgatgaatggctacaccagtgaaacctgctatactgagaggacaaagagcacatatacttctcttccccaaccactatctaccccaccctttccataaaggaatacaggtagcctgatttatttcactattgtttacctgttacagaacttcatataaatgaaataatacagtatatcaagtttatgctacatgtatattatctaatggtacctttttctattttaaatatatagaatagcaaatatgagaatatttttaaactcatcatcatcattctaaattgtaaactcaatcatcaataaaaattaagatcttagtaaacctcacaaaccattttgtaaaaaatttttgattgccattttgtagtctgtaatatatgatttatttttgaaatgtgggaaacagattcaaaacctagtttcaaggaataatctataaaaattgctctaatataattttaaattatttattttggaacaatcataatgttttcagagaccatagaattttagcacaatatcctgatatttaaaaaataaaagaaaaaaagcaaaacccaagaaattaaaaaactacatatgctaatacagagtcaatatatacttggatagtttgttattactattgaactttttataaaattaaagtatatatatgaaaacagagaatttactaaaaactatactgtgaagaaaatatgtaaagcaatattcttgcacaataggccattcaattatcggtgggttttaatctcattttttatttgatcatgcttattgcttaatggtcatagaaatgttcctttatcaattttcatgggaaagttttgcagcagagaagttccctagaatcaacatgtcttagatgtttgtaaaataagtgatttctttttccaaaatgttaaaatcattagtacacaaaagtcattactacgttaatttattttaaagtgttccatttcagtaagcaggtattaaggaagttggtgttgggataagataattgtgccaaagtaaattcttaatggagttcataagagaggaaatacagtaactgttctactccaaggttggctttgggggatttttcaaaccaacttaaaagtcttggatgttatatctgactggaaattatttctactccctgagaatgaacaacatgctggcaacagtgaaataaggaagcttgaaaaagggaatgagttattctatgaaacagtctgtcctatacatcaagattcttttagtttctcactcaagactttaagatacacaaaaatcttgccgcaagatttctcgtaggtggtgtgacctcagtatacgttgaagtcagagattacattgggttctaacaactcagggtttttagataagatctaaagttaaaagctataaatcagacctctagaggagggctacattggtccaaattttcatgaggaatagactctctttgccaatacaattaggggtgtgtgtgtgtgtgtgtctgtgtgtgtgtgtgtttgtgtgaatgcgtttatctcactgtctcgggagtatgtaattgtgtgataggtggaaattcataaggagaatggatcaactacaagtggtcatgggtagtgccatgtggaaccatactggagcctaaggcaaaaggaaagtgtctggctatatacgtgacttcctgtgctttttaatggttatttttctcagaacacaaaaatagttttaaaaaataatgaaaacctggaaagtagagtattgaaacatacaatctagtttttaggtttaaatatctcatttatacctaaacctgaatatattataatattttcaaaatgtactcttttgcttactcatttttaattgagagaattgctatgtttgacaatttctcttgacaaatgtcttgattaacttttacttaatttcaacttactgatcctttcttttagattttgataaactatttcttgtgggattttcacattggatttctattttttaaatattgcattggaatatatttattctattattaagttgtgttggcattccttaaattctgcacccgaagaaagtgcttcacttgtgtccattttttttcctttcttttttgagatggagtctctctctgttgccaggctggagtgcagtggcgtgatctcctctcactgcaacctcggcctccaggattcaagcaattctcctgcctcagcctcctgagtagctgggatgcaggcatgtgccaccacgcctggctatttttttttttcttttttttttgtatttttagtagagacggagtttcaccctgttgctcaggctggtcttgagctcctggcctcacgattcacctgcctccgcctcccaaagtgctgggattacaggtgtgagccactgtgcccggcctcacttgcatcattctagttgcagccctgatgatgaattcttaggtttgaccttggattgtgtgtatccaaagtgaggcaaaagccaccagaaatgagatcaaagaactgagagcccaatgccctaaaacagactttccatgtagacagcaaatgcacaacgattataagaggaactgatgtagagtggagggcctcgagccagaaatttgaacgaggagaaactactggcaagacaggagatgcaagcaacaacaaagttttggggtacctggggcttaaaagagcagagatcttggcaaatgagaagataccagtcccaccctcttgctctgaggtgctgaagtacgagacaatagacaaaatttgaaaaaaaaaaaaaaaaaaaaaaaaagctgcaaagaaatggtttcctggaggaaagcatgaatgtcttaaatataatgggctttctgttcagtatttcagtatctggtaaatctcatcattagaagcaatgcagaaaattaatatattaccttcacaataccctcattagaacacaattataacaaccgaaaaggcaatgtactaacccatgaggactcacttaactcattacaatggtttagtgagctatattgagcttaaaacatatgctggaatggaaataaaaaaatgaaaaccctgaaaaataagctcttcagaggtttagaaatgaaatgggagtgatgaatagctaggagcaaggacatgggagtatacatggtgccaagagagaaggtatcattttactaaacacatacttcacctttttcacatttcatctaattttagcagcttaaaaaaagcttttgtttttagcttagacagaaactcttaggctttggacccatgttccaattctatacatcaaaaattgtgaaaatttctagagggaatgatggcaggacttctcagaaggttggaaaatggagggtgtgagttgaagaacagtggttaatgacaaaaattgtagatgaggtccacctgatcacaaatcatttctaaaaccatatttggggatttggataatttatttgcactcctaaacctctgtttcttcatcaataactgggcataatgatactactcaggtttcttatgagaattagatgacgaaataccgtgtttgtcatgtaggaaggtataataaattttacacctgcctacatgacatatatggtataattaatttataattaataacttgacttttataactaatttactgacaattacttattgagtacctgctatgtgttagggtaaagcaattcaagaacctaactgaactcctgatatttgtggcttttacattctagcaggtgtgccataatgagtgatattatttataacatcaaacgctaggagaatcacaaagagctgactccaccttgagtttgccttctagaaacagaaaaatagcatgaatcctaattttcacaaagtagatgaagatattcaatttgatactttaagaactttccaaatgaactaatttgaaaggaaaacgaaaagagaggattgaaagaattgtcattccctgttcaaatatttaatcttgtcaagttctctttaaatttgagtggaggcaaattcctgaagatcaagcacctggcctatgaaaatgtattaaatatgttttgatgataatttcagtgatcatagaaggcatttccaaatggaatccattacactgcttcaagtattattacaatgagttctagttctttcactaggttaatagattaataagttttattatcttgcttgtagaaagcattgaaaattcccaaggaagaaaaaataagttcaaacaagtaaccagaaaaataaaagagaaaaaggataattcacttctctattgtaatttatgtgtttcttgtatgtgggattagacccagcaaagctaaaagaggcaactaaaagctcagccccagtgctaattttgtatccttgaggaaatcacataccctttcaagttttaattattcatctgcaaatccaagattataaaatgacctcatattctagttgacaatgtttttatatcaatattttatttctttactttttcctcatactgtgccttgcttctcctttatatgtaaagtttacatatcaatttatacatgcgtatatataatttttctatcaatttcaggagtggataaaggatgtctttgacccaaattcttgccaaatctccttccaagagaagtattgcctattatactccaaatgtacaataccatagcattagtttagtaaaaaacaatatgtcttgtttctcctttatttttcttgatgttttcataattttaataaaaaacacttaaccaaagtgctgaggctgtgtttacaataaggtatttttaaattttatctctcctctaccaacacatacacataaatttaggaggaaaataagattaggtagcatcaatttggtgctaatgaaaatgaaaccagcattgatattttctaaatctaataatgcatgcattttgaatagttttctttgactcatttcccctgaaggtgaattcagattctttaggcattttcccaaaaataatttttaactctctgccttgtagtgaaattttccaaattgaaaagccatgtagaatacactgcgaacaattttacagccttcattaatatataagtcaatgtctaggtcacagcttctattaggtagccttatctttatcgatagttttccccaacttcagattctggtaattgcatgacttaccctaccctctctgtgtttaaatcctagattaaaggaggaaaacagcgtcctgtgaacactagcctcaggtgctgacagcatcatcctttgtagcagtccctgcaccttatccttacttagtaaataatcctttatttaaaaaaaatttgtttgagttcattgtagattctggatattagccctttgtcagatgagtaggttgtgaaaattttctcccattgtgtaggttgcctgttcactctgatggtagtttcttttgctttgcagaagctctttagtttaattagatctcatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcccttccccattgcttgtttttctcaggtttgtcaaagatcagatagttgtagatatgtggcgttatttctgagggctctgttctgttccattgatctatatctctgttttggtaccggtaccatgctgttttggttactgtagccttgtattatagtttgaagtcaggtagtgtgatgcctccagctttgttcttttggcttaggacatgaacagacacttctcaaaagaagacatttatgcagccaaaaaacacgtgaaaaaatgctcatcatcactggccatcagagaaatgcaaatcaaaaccacaatgagataccatctcacaccatttagaatggcaatcattaaaaagtcaggaaactacaggtgctggagaggatgtggagaaataggaacacttttacactgttggtgggactgtaaactagttcaaccattgtggaagtcagtgtggcgattcctcaggggtctagaactagaaataccatttgactcagccatcccattactgggtatatacccaaaggactataaatcatgctgctataaagacacatgcacacgtatgtttattgcggcattattcacaatagcaaagacttggaaccaacccaaatgtccaacaatgatagactggattaagaaactgtggcacatatacaccatggaatactatgcagccataaaaaatgatgagttcatgtcctttgtagggacatggatgatattggaaaacatcattctcagtaaactatcgcaagaacaaaaaaccaagcaccacatattctcactcataggtgggaattgaacaatgagatcacatgcacacaggaaagggaatatcacactctggggactgttgtggggtggggggaggggggagggatagcattgggagatatacctaatgctagatgacgagttagtgggtgcagtgcaccagcatggcacgtgtatacatatgtaactaacctgcacaatgtacacatgtaccctaaaacttaaagtataataaaaaaaaaaactgaaattggcctgttttattatttctcgtcagttctttgatttaataaaccagataaaatctcattataactaattcctaatattagccaagttattttattaaaaataactaagacagaaaaaaattggcttcaatatttggttataattttagaatatgagattacaaagaaattgtattgtactcatgatgttggtagcagggtttaacaatatatcttgggaaataaaatatttccatctatatcagaatgatatctagatgcttgtgtttctcttaatcttttaaagcttctttttaaatgtcttgttctactgggcttactctacagtgcaggtagatatattgaaaattcctaatttttcaatatatgaaagaaaaaagcaaagaaaagaaatatcagaacaaaacaggtatttagtaataaacaagtcaactgctttcttaaaactagagttgtaaattagttctcagacacttccacataagagtcacatgacacttactaattttaacagaaggctagccctgaagcagtgacacatgtttttgtgccatatttaattccacacaacattgattttaatgggaattgctagggagtaactacagttttgcccatggtcatcaaagtcactacaacatgtcttcaggaactatatagtcaattcatcgccctggccaatggccaatttgtaagttagatacatatcttttaccttgttattaaacaaacaaacaaacaaacaaacaagctctattcttctaagtgagttggttacatttaaattatcatttatctatgtatgtacgtatgtatccatctatctatctatctacctacctatctatctatatcttttgctgatgtagaactgctgcttttccagttgtatccaagtaaagttccatatcaatgcaatgatcccttttgtacagttattaagtataagttttctataaaaattagcattggatatgtagactactcatgtagttagcgatttaagttaagaccagacttggagaaataaatattaagtcagaatgaaaatcactgatcagctgacatcctcctttaaaagtgagaatatttcccacagaatactaatcatttaaagacaacttgctgtaaatgaaagacaaagatgaataaagccaaacactggtatgctgcagggcaagatctttgtatatattctatccggtatttgtttttgaaaattatctttattcatgtcatgaaattatcaaagaaaagagtgataaaggatctctgggttatgacagcacttctcctgcgatttttttaaatgtaaggaattcagtcagactcagtcagtctaaaaagatgcaaattcttgggaattgtatccagatcagataaaacgttggacactggttaacacagtatggtccacgtcactgactctcacagttacagtgtagtaatacatcagattatttgccaaaaatgtccagtgatgtttgttccattagtactcaaagtaaaagagtgcatctattctctcaagtaatattgaatgtacagtgtgtttcagacatttgtgaaaaaaatacattggtagttccgctcttgaggagtacgcaatctgttaaagaccaccaagttatttttttttactggaagtctttatgcaaagatagagaaaaatgtctacattgatggctgaacacctaggggattgaggtgtagtgaagataaaagaagagcacagaatgtatacctgaaagacctgaagaaaattttaatttcttttttttttttgagacagtctcactctgtccccaggctggagtgcagtgacgcgatctcggctcactgcaacctctgcctactgggttcaagtgattctcctgcctcagccccctgagtagcagggactataggcgtgcaccaccacgcccagctaatttttttttttttttgtaatttttagtagagacggggtttcaccatattggccaggatagtctcgatctcctgaccttacaatacacccgcctcggcctcccaaagtgctgggattacaggcgtgagccaccgctcccggctgaaaattttaatttcttgacccatattcttcagttccctctaaactatgctttcaagaataatgtaaatgcaagttaaaaatgtagtgtccaactgttctcacattaagaaatcagggttacatttggtgagaatacaaaaaaggaaaaaaaaataagtcaagattaattgatcatattaatttcatggtatcactccacgaaaatccagaataattaaattaaaaacaaaagttcaaggcaaagcattgctacaaaaatttcttataataattaatttactggttatgccccttacaggagtcaggaaacaggttagattccttacccagtgtgcccactaatagtccctttataaaaccatctcctggaggcactagtcctccctcagaagaacagtaggtgaaggagttctctggtttctggccttgaggccagttcctgtttaagcctaaataaatgaataaataaataaataaataaataaataaataaataaataaatattcctcttccaagaggcatctggcagttccccttatccctgatgagtccttcttaagaccatgtcgaattaagttaaatgaatcgaaagtaaattaggattaaattgtataacattgattcatacattgccttggatgatttatatacatttggaaagtttaatactttatcacaatggttaagttttaatgcaaaataaaattatctatgtagtgttttaaaatgttgattagcctactccttagcctttttgaagtactttttaaatttctggtgtaaattctggcatgtagttctttaaaaaaatcctgcaggaagtttttgtgcctttcaaagtttgagggcccctaatcttgggcatacaaatcagtctttcttctgattaatgtggcattgtccatcatttttataaatatgagtctcaaacccttgattgataaagaaaatgctcattataacattgtgacatttggaaaaatttaatattttgtatttttaatataaattaattctttcagaactattaaccttataggaaaacactagagagaatgattttagcagatttttgtaagaactcatctcctaaggtttaagaaatacctacatggtttaaaatagtaattataaacatagtaattttaaaataagatactattttgtttaggtcttccaagtcagttagctggtgtcagttttatggtcagaatgacaaaaatatataataaaaatgtgcagctcatttagctgttgaaggctaatgaacaattaaagcattccataagaacttaatctcacccattttttagtcctatttaaatctgctcctcctttccacaaagttcgaatggcataaattatttaagtcatatacaaagggaacccaatcaggctggcagaagacttctcagtagaaatcttgcaagccagaagggattaggggcttattttcaacactctaaaagaacttaaactaataatttcatattcctccaaacttagctttgtaaggaagggataaataaagtattttctagacaagcaactgacaagggaatttgtaatcactagaccagctttacaaggcaacctcagcggagtcctaaacatggaaaaaaaggacaatttctgccaccacgagaacacaattaaatacatagtctgcagaccctataaagcaaccatataatagaaactacaaagcaaccagctagcaatttcacaatgggatcaaaacctcacatataaatattaaccttgaatttacatggtccaaacaccccacttagaaggcacagacttgcaagttgtataaaacacaaagactcatccatctgctgtcttcaagagacagaactcccatgtaacaacacccatagttcaaggtaaagggttggagaaagatgtatcatgcaaatgaaaaacaaaaaagaacaacagtcacttgtgttagataagacagaatttaaaccaataataataaaaaaggataaagaatgtcattaaataatgacaaagggttcaactcaacaagtagacttaactatcttaaatatgcacacactcaatattggagcacccaattcataaaacaaatacttcaaaacctataaaaagacttaggcacaaaacaataatgggagacctcaacacatcaatgacagcattagagagatcatcaatgcaaaataacaaaataatcctggacttaaatttgacacttcaccagttggacctagtagacgttacagagcactctacccatcaaccacagaatatacattcctctcatctgcacacagaacatactctaagggtgaccacatgctcagccataaagcaagtctcaataaacacaaaaaattaaaatcatatcaaccatactcttgaaccacagtagattaaaaccagaaaccaatactaagaacatctcccaaaaccacacaatgacatgcaaattaaacaacttgctcctgaaggactttcagataaacaacgatattaaggaaatttataaaattatttaaaatgaagacacacaacatttcaaaatctctgagatgcagcctatacaatgttaagaggaacatttacagcactaagtgtctacatcaagaagttagaaagatctcaaattaatgatctaacattacacctatgggaaccggaggaaaaggaacaatctaaacctaaagctaatgagaggaaagaaataactaaaatcagagcagaactgaatgaagtagagacccaataatccatacaaaagatcaacaagaccaaaagttgggactttgaaagcataaacaagagagataaacctccagctagatgaacaaaacaaaaaagagaagatccaaataagcccattcagaaacaaggatgacattacagccaaacacatggaaaccgaaaagatcctgagaatattatgaacactggatgcacacgaactaaaaaatctagaggaaattgatacattcatgaaaacatacaacctccccaaattgaatcacaaagaaattgcaactctgaacaaatgaatcagtcataaaaaaccctatgaatcaactaatgtccctgaccaggtggacataattcacagccaaattatagcagaaatacaaagaagtcctactaccaattctactgacactattacaaaaaattaaggaggaactcctctgtaactcattctatgaagccagcatcaccctgataccaaaacctggcagataaacaatgaaaaaaagaaaaactacaggctaatatccatgatgaacataaacacaaaaatctccaaccaaacactagcaaacctgatccaacagcacatcaaatagctataccatgatcaagtagcctttatttctgggatgcaagagtagttcaacatgtgcaaatcaataatgtgattcaccacataaacaaaattaaaaacaaaaaccatgtaattatgatcatctccatagatgcagagaaagcttttgataaaatctaacatctcttcatgataaaaatacttaaaaaatgagtcaccaaaggaacatacctaaaaataataagagtcatctatgacaaacctatagccaacatcatactgaatgggcaaaagcgggatcaatcccttgagaactggaacaaagcaaggatgctcactttcactacttctattcaatgcagtactggaaatcttagagcaatcaaagaagagaaagtaataaaagacatccagatatgaaaagcagtcaaactatttctctttgctgactatatgtttctacactaaggaaacctcaaagactctgctgaaaggctcctgaaatggataaatgacttcagtaaagtttcagaataaaaattcaacatacaaaaatcagtagcatttctataatgttcaagtggagagtcaaatcaagaacacaatcacatttacaatacccacaataaaaattaaatgtctatgaatacatccaacaaagaggtgaaagatctctgtaataactacacaatattgctgaaagaaataatagatgacacacacaattataaattcattccacactcatggaaggtaagaatgagtattactcatggtcatactgcccaaagcaatttacagattcaatgctattcctgtaaaactaccaatgccatttttaacagaaatagaaaaataggattctaaaatatagaacaaaaaatagcctgaatagctaaaggaaggtaaacaaaaagaaaaaagccagaggcatcatattatccgacttcagctatacaataagtctacaatatccaaaataggacggtattaatacaaaaacagacacatagacgtatggaacagaaaagagaacccagaaggaaagctgcacacctataatcatacgatctgtgacaaagttgacaaaagtgaacgctgggtaatgttcaatatatggtactcaaaaactggctagccatatgcagaagaatgaaactggactcctacctttcaccatataataaattcactcaattcactcaagatggattaaagatttaaatgtaatacttcaaactataaaaaccctagaaaaaaacccaagcaacatcatttttgacattaggctaggaaaacaatttatggctaaatcctcaaaatcaattgcaacaaaagcaaaaattgacaattgggacctatttaaattaaagagtttgcacagcaatataaaaaaattttaaaaagatcaacagagtaaatagataacctgcagaatgggagaaaatatttgtgaattctgcatctgacagaggtctaatacccagaatctataaaaaacttaaacaaatttacaagaaaaaaataaccctattaaaaagtgggcaaaggacatgaagaggtacttctcaaaagaagacatacaaacagccaacaaacaaatgacaaaatattccataaagattgttaagttccattggatcgcatgataatttcattgaatctgtgactggtaaaatttacagcttcagtaacaccagatgtaaaatgaagaatctatatgttggtcaggttataatcaagacattatttttcttgtcataattacacatactcttttatcatgtattttcttgaggaaatacatatatgcaaacaaaacggtaggtgctcttattttctttttaaacaatacaatatgaaatataaatgtacactagatgccacccaatttaagaaatagaacattactggcaaggtgtggtgtctcactcccgtaatcacaacactttgggaggctaaggctggaggattgcttgaggccaagagttcaactagcatgggcaatgtagggaggccctgtctctacgaagaaaattaaaaaatatagctgggaatggtggtgcacacctctcggcaggaggatcacatgagcccagaagttcaaggttacagtaagctatgattttgccactgcactctaggcaatagagcaagaacctgtttccaaaaaaataaaaataatgaaaatatttgatctaaagaaaggaatataccatgttttcctttatttagcatattaataaaaacaataaagatacacatatttcagttactggtatcttagaatatcttgcatatatacaatctgagctttttgatcaggaaaaaaatttaaaagaatctcttgcataccttttcttacactatcctgaattttgcgttattacttgccatagttgatagacagactataatgtatgcacccctaaacagtatatagtttttccttttttaactttatgaaaataaaattatacccttgaatttatacccaaaaattctcatatgaaatattttatccatgcaattaacaaatttaatccaatggctataaaatatagactattataccaaacaattgaggaattagaatgattctataatgtcttttatttacttgtgctacttggataattgttattttcctccattttattttactaagtggagggctggtttatgttaccttttcatggagaggacaaaattaaaggtatctcaaggcaagactaggtgtgggcctgtagacaacactaaaatgaatataaggagagagatatgctagtaagggataccacaatgggcaaatgcttttatttttgacctatggatgggaagggatacacagacctgtagggttaatggtatccaaacacatagaaattctaacatacaagcattcagtagataagattatcaactcccaatttctactaaaaaaaagttcatatgctaatcaaccatatcagttgcttcaattataaacctcatttacaagtcttaatagaaaaggaattgatttttttctgctttcaaagagaaaatgagtgaaaatagacaccctctaaagcatattcaacacctacccaacaaactttcaaaggtagatctatttagctaccaccatttacttgaagttaaaatggtacacaaaaatctattgcctaaatggtagtcttcattttatcatttaaaattaagattcgactaaaagatcaatagaaaaatatttgatctaaagaaagaaatataccatgttttcttttatttagtatattaataaaaacaataaagatacacatgcttcagaatggaaagaaaggtgtttacttttaacggcagaacatatcaatcacctcattattacataatatattatttaaggtcaagtgtagatgctcaagcttgtaatcccaaagctttgggaagctgaggagaatgacttgagctcaggaatttgagaccactctgggcaacataacaagaccccatctctataaaaaggaaaacaatgaaaataaaattagtcatgtgtggtagtgcccacctgtagtcctagacccttgagagactgaggcagaaggatcacttggatgcagggttttgagtctgcaaggctgcagtgagctataatcatgccactgtactcaggcctaggtgacagagcaagaccctgactttttaaaggaactgtatttgcttctattaaacaggtcacaaacactctcaatagttttttttctcaaagttgagatatatggaacaagtttttaaaatttcaccatattgataaaattatcccctaaatctatccagggtaatatattatccacaataacatattttcatatcttctttcttttactccttactggttttctactgcttcaataatttgtttttctctttattctatcttgattcatgtctagttcttgtttcctatgatatcctccttgtaattttaacccagttcatccctctaatcttccattcagtatctctctgctgtgtaggaagcataactgtgctgagttcttggctggaccactgaaatcaagtaatgactgaatataaatcagaatcatggctgtaaataaaaagaatgtgaccaaatgtccattagcaatgatagtctagtcatataaaaatgtggctattttcaattaataaaacaaaacaaggaagaaaaagtaaagacaatgtcaggaacgatgataagaataagcatgtaacaagcaaatggtaggtttgcttcaaccaaatggtaggtttgctttcattacatgaaaattttaccaaattgtacatataaagtcttctaagaacaatatacaaataacattttagtatataaattggctcaagaaagtcatttttcagggactctagatttataggctctttaagtctctttaaaactgtaaatgacccacagaagttggctgccctaaaggtttagattaaataaaccatccagtgcacaattcaaatataagctgaacaaccttaattggaatatctatcctgtgcggttttccagtttctgatttggtactccccaagtagcaatttcctatgaattaccgtttcccaactaagaggtacagaaattcccagtttctttaggaggctgaatattttaaaacttcggctttattaaggttttcaacaaagttctaattaaactacacttcattaatggcttacccccctaccttagaataaggagagctttcttacaattattaaagctaaccttcagaactgttgttaataacaagactaagaacaatttttaattttttttaacttcatagctgtaggctaaccaatagttaacaaataattcattcatttcattggcatcatcagtcctcctagcaatatgtgttttttttttttttaatttaagacttggtgggggaggcggtgaggactgtgcaattactagtcactgttttcccactcattggtactattagcttaacagataaaaccacagataacagccgcaatcaacttcagcaggttcccagaggcaagctcttgctttttgctgattagcttcattcaattatgtcttcttaattgttcatgtgctacagctcattaaatgaaaaataatattcctttcctgtgggtagggcacttgagatttgaaaaatagccacttcatctctgcctcagaggcacaagtaagttgatctgatggtgtctgaaaaagctcaacagatttgtgcagatagccctgcccgagaagggacaataaaattaataaaattgattgttaaatcaagtcaaaaataaaattactcccagtattttcctttaagattaattttcaggaaaattagacccagttttgtagcatttgattatgttcacctctgtaatataattttctttgtaaaaagatcagttattgctgttccattacagatgggatttagggaaagtggagtaaatttttaaatttttctgaaaatagattttgacagattaaaaagtgtgtcacacaatttatttatgaaatattctagaaatggagaaggtaagtttcattcattaaaatagattcattgagtacctactatgttccaggccttttgctacacaatgaggatacaaaaggtcttaacttcaagaggtttattagtctggtggagtagaaataataattcaataataatccattagctaatatatactggctatttactaaggacctataaagtacttggtcgatatgtgtcaccttacttaatctttttaacgatcttataacatagaccatatcatattttttattatagatgaactaaggcttagaaaaattatattgcttcctgatatcacataactagcaaatgctaaagtttagtttgggacaagatatgtatgaccttgtagcattcctatttacaggtactcctcaatttacagttcctatatgcatacatttcagtcaccatgtttagttaagttagaccagttacccagctcaagcgattctcccacctcatccttctaaagtgctgggattacaggcatgagccaccacacctggacggatgtgccatagtttgtaaaagagttgagaatggctgctagctagtagaaaaaaatggtgatattagaaacatgggtatattttcaaatgaattccaaaagtttgagaaagtaatagaatttttgtctgttttgttctctgttatttcgcaaacacagatactcagtacatatttttgcttttttttaaggagatgaaaaagtctgacatgattttataaaaaataaaatttcaaatttcagctaccacagtgtattaactgtaagtaattacataagtacaaattttgctccttgctctttggtccaaaatcattatgtaaataacaggtgtgcttcatgatcagtgaccattggcatcatctttttaaatgtctgtcagtgattgatcactacacatctattattcatcacatgcagacagaaaagtgtgcagttatgttgtctctgtttcccattgataaacacaagtgccatttcttaaaaataaataattgaaagaattggccagaaaagataaaagtacaacataaagtaaaacgttgagtccagtgaaaatggagctacagcaaaatccctgtgggaatattgacactgctgccatctgaggaacttaagctttgcagccagaacaacttagtgcagaggagcttattgacataaatgaagaaagtggatgtgatgaaaaggatgaagatgtatcaggctaagtgacgccagcaaaaacccaaacacacaataaaaaaaaaaaagacttacattaaaggaacttacagagatacttaacaatattgaaagcatcaaagcataaagtgatgaaagctgatccaaatttaagattatgacaatttgccaaggcataaaacattgcccccttcattgtaagccatgtaagaagaaatcaatcactattcaaactattagtaaacattttttaacaaacaagtaaactttaagtctttaacatcaatgtaattaagagggaattggccagcatatgtgaaagtatagcaaacaaatgaaaataatgatgcaaaaaataataatgtaagatatgagttgaatataaacagagttatagaaagaaagaactgactttaattcttttattcccagtgtaaattccaggatgttaaatgaatatgttttataatttatttattttcctacacatttgtaagtgacagtaaaagagtttctaatattttgaaaagaaattaaaggttatggaataatatttattcttgattattaagataaacttgcatgatttcagctgagattatcatgtttatcatccttcactaccatgtaaagcgagaagtgtgggtattaacttattatctgtttgtttaaagtgaatgacacacagcttagtgttacatcaacagaaaaatatttaagaggaaatgacactaaatcaattttaagataatgcttctattatgtatgtttctgtatcgtctttctaaacataattatggaaaaggcatcccaactggtgacataattattgccaataatataatagtaatgacaatatatttgttggtcaattaaaagtaactacattagctttggtaaaactacatttttcacttacatgattaaagacacttatcagtgctcttgtgatcctactttaagatatacatcttcatattaatttgtaaatgaaatgtgggagtttttcataaccaacaggtttaaagctgtgtgaagatatgtgagggaaatatatagttatgtctgtaagaatcagtgatgtgccatactttgtgttttgttgttattgttttcttgagacaggatctcactctgttgcccagcctggagtgcagtggcatgatcacagctccatgcagcctctacttcccactcaagcgattttcccacttcagcctcccaagcagctgtgactacagttgcatgtgaccacacccagctaatttctattttttgtaaagacacggtctgactatgtggccggggctagtcttgaactcttgggctcaagcgattctcccacctcatccttcttaagtgctggtattataggcataagccaccacacctggactgatgtgccataatttgtaaaagagttgagaatggctgctagctagtggaaaaaaatggtgatattaaaaacatgggtatattttcaaatgaattccaaaagtttgagaaagtaatagaatttgtgtctgtcttgttctctgttatttcccaaacacagatactcagtacatatttttgcttttttttaaggagatgaaaaagtctgacatgattttataaaaaataattttgatgttagtaatcattactcaacatatttttgaagagtctaaaggaaatttccactgtttcaaaagatcccaccttccatttctctctatctcatctcctagcaatctacccttcatttattgtactctagttgtgcttatctttttggtctttatcaaacacaacaaatattctgagaccttaatatttctgttccctctccctggaacactattcctcaagaaataaaattaggtaattatttcaatcaagctggtatttaaacatcttctgctcaaggaggcctagctgataatctgtatttaatgttccagttttcctatactctctctgaacccccattggccattctattttgttttatccatagtgcctatcacctgttggcatattatatgaactctttgtttattaacttatttgttaattttattgtttatcatttatgtctatcaatggcatgtagactctaagagagcaggcatatttgtgtgtgttattcattgatatttcaagattaccaaacagtgtctgtcatatagcaaccattctttttttatttttttctgagacagagtcttgctcccgggttcacaccattctcccacctcagcctcccgagtagctgggactacaggtgcccaccacacccggctaatttttctatttttagtagagacgggctttcactatgttaaccagggtgatctcgatctcctgaccttgtgatctgcctgcctcagtctcccaaagtgctgggattacaggcatgagccactgtgcccggcccgttcattacgtaagaataaagaaatatccccttgacatgaaattctgtgtattggaataatatatataccatggcaatgagcatttgtcattatcttagtcagcagtatatattttcctagacaatgaaaagactcccaactggccttttgtatgacaaaaagaactgctaatcactttcccagtttggcttttatttatctccagattaaagtgttattaaggattaatttaatgttattttattccatttagtgaacttttaaacaataaaacacttttatctatgttgttttgcacccatatgacaataaagtgttatcatgcccatactataagtagaaaaacacaggtagaaagaacataactgatttgctcaaagtcatataactcagaagtgaccgaatacatttgcctgactccaaaacttggtctgattttatcatcccttgctggctgtcagatctgatatatcagtccaaaaattacctcttgcttaaaccgatgttttggatgacttttgtaattttctgcgttccatcatttattagcgccaatatataaatggttatttagaatacagaggtttacacatattcgggaccaacattccaaaaatggcttaaatatttctggcagcctaatattatctacggagaattattttcctcaagaacattagtgagatgtgctataataatggttgagcaaagtagcacaacactagatgctgtgtaactctgggaacaccttatttcctgctctgatagaaatctgttaaagaccctcatctgttacaggcagagagaagagcagagtaaaagtgctttgcctacctaaagggattgttgtaagaatctgatgagttaaactgtgtgaaagcattttgcaccctctaaatccatacatttacatgtgacttccctgtatgacacaagctaacaaacaaactagaaacaagcaaacaaaaaaaaaccgagacacaaaaataaaatatctttctgttacctcatttgggaaggggtctaaaaacccagaaataatagtatttacatgtacatgtagttggtaaacattcaatggagtaaaaagtaaattaaaaataataccattagcagaggggaatgtatttttacttatgcatatatacccacatattggatttgtctctatttcatctgtaggacctagccactagccaaatgcccgaagcccctagaaccccagtgcctagtgtggtatgcagaaaataatgccctgttatatgtccattacctaattccaagagccttggaatatgttaccttacctggtaaaaaggactttgtagatgtgtttaaagttaagaacctccatatggaaaaactgtcccaaattatctggatagacccaatctcatcacattagttttaaaaatattaaaccttccttggctgtggtcagggagagaaatgtgattgtagaagaatggcaggcaaatgtaacattgctagttttgaaaacaaaaggagtccagaagtcaagggacgtgggtggccactataagctagaaagatcgagaaaactgattctcccctagagcctccagaaagtagcattaccttgccaatttaacctgattttaatcgtcagacctgtgtcaagcatgtgacttagagaagtataagatattacatttgtgttgttttaaggcactaattttgtgataaattgctaagacagcagtagataactaatacagctagaaaacaattttaaaatacattttaaaaagaacttcaacatgccaatatctaatgaataaaaccaaaaataggatgaaaaattaaaatgaaacttagaatttttctatattacatatttgggaaatttgaattatttcataatattctgatctcaaaaatatgaaaaaagtagcttgtctagttatcattcacctgaaagcaactgttttaaacctgtcattacaatctgataaaaagtaatatgtctcattcagtcccaactacgctcaacatgacccaatcttgtcagaacccaatgtgaagcttcaagtgtacaggaatttacaatgacaatgctccatggaattttcaatgacaatcaatgttccaaaaaagctatgacctacacttgaggctatcccaaggagaagcaaatatcatagcagcatcttacatttgtgaacacagtggtaaatatagagcatacaaaaccatgcatgggtattttcttctgtttttaacaatggataatgaatgtcaaaagtgatattcaaactagcaatatgcaagttaaaattaaatccataaagcacagcaaaataagcatttgttccattgtagagctcacgtttccttgagcacttattttctttcttttccctcctctctgctcctgtcccctcccctccctccttcccttccttcctcctttcctttcttccttcgacttccttcctgacttccatttttcttttttcagctttattgaggtatagctgacaagtaaaaatgaacatatttaaggtgtgcaacttgatttttgtatatgcatacattgtgaaatgatcatcataatcaagctaattaacatatccatcacatccataatgtaaaacatatctaatgttgtacattagatatactgttaccatgctgtacaataggtatatgccacattttccttattcatttatctgtccatggacacttaagttgtatccataccatagctattgtatataaagctgaaatgaaaactaaagcaaatatcgattcaaaattattttatttcctttgaataaagactcagaagtgggattgctgaagcatttggtagttccatttttaattgttaaaggaatcttcatattgttttccataatggccacaccaatttacattcccatcaatatgtcttcctttttctccacttccttcacaaaatttatattttgaagtttgataatagccattcaaacaggaatgtggtgatacatttttgtggttttgatttgtatttcctgataattaatgtcattaatctttcatctttcatctacctattgacctgtcgtctttcatctagctgtttgccatttgtacatctttggattaatgtccatttttgtaaatttatttttctattgagttttgtgaactccttatatattttgaatattaccttttatcagatatacagttgcaaatattttctgtagtttgtcttttcagtctgttgattgtttcttttactgtgcagaagctttttagtttgatgcaattccacttctatacttttgtttttgttgcctgtgcttttgctctcatatccaaaaaaatcattgccagaaccaatgacaagaatctttttcctgatggctttttgctattagttttacagtttcaagtcttatgtttatgtctttaatccattttaagttaatttttatttttgtatgtggtaagagcttatcttcatttttctacatgtggatatccagttttctcagcaccatttattgaagaaaataccttttccccagtgtgtattcttggtgcccttattgtaggctggtttactctaagtgcatggatttatttctgggctctctgttttcttgcattaatctatatgtctgtttttatgcaaattccacactgttttgattagatttgtaaattattttgaaatcagaaagtgtgatgcctctagcttgcttttcttgctcataattggtttagctatttgctatttggagtttattgtggttccatataaattttagaattttttttcctatttctgtaaagaatgccattggaattttgacagggattgcatgaacctgttgattccttttggctagcatggctactaaaacaatattaattatttcaattcataaacatttattttccatggatgaatgttttttcatttatctatgctttaacatttttccttgattcctcctccaagatggccaactagatgcagccaggagaaacatctcccacagagggaccacgacatcaggaagacgggtgtacccctagtaaatcttcagagggaaggcattgagagcagatagagagaagatacagaaggtgggataaagggagatgaagctgggaatgctgcatgtggctaccacacaccaggactcattcctggctcccagcaactcctgtggaaggggtgagttgaacagaaatgagcaactcactctcaccatgagcctctggaatcatagcaggaggagtcttgtcagccaccatggacacttgagttggcagagaaagctacttagtgaagtggtagggacagaactccagctgcagcagagcccatggggtttggtgcaggagcatctatagtggagaacagccagggatgcccatccccctaggcttgatttgctcctatagtagacattagccctaaggaaaggggtgaacgtagactctgtagagcagtcttgcccatgagatgagccaggccccctgagcaccctttggtgtgctgtcttctctttgggccccagcctgcctgtacctgctagcagtgtacccccccaggcacctcaagggggcctgcctcattgctcctgcactggtggactgcagctgactgggagagtgctccagaagagcaaaccctgtgtatacatataagactgcccatgtcctccccacactacagcctcctccatactgctttgctggcaggcactcgctgccagcgatccccatacatctctttgcctgtacatgtgtttgcagacagacctagcctttccttctctgacagtgcatgtgtacacatgtaccatgccatgccatgccactattgctggcttgagtgtgccccatcccttctccccctgttgcactgccatttttgttggagcattggagggcatatagtttgacagctctgccaccaccagtgctccactcctgtgccaaaactgctggcatgaaactaagcacagaaaacagtgtatctactcccatccctgagaggtcactgctgtaagcaagaatgctcacagagggtgcacacagtcctgcgaccactagcgccccatccctgtgctaacaccagcaccagtacaaatgtgcacaccattgccagcagggccctccaccttcccaaaccataccgccacagccactactacaaacacccacatggaggctgtcatcttccatgtggatggaggatgccgctggtacatgcaaatgtggacacatcccactacgactgtcctacaaaatgctttggctgggagtagccattagagtgttgtgaccagcagtctgagatcacattgacccctccagtgcagcaggttcctaaacttgatccacaggtaatagctggtgtatgataccagtctcccagagttagagcacacaatgcagagtgctgagctgagccttggccacctgaagtcttccactaacaaagccaggtgactgaacacagcttataccataatcaaaccctcaaggtcataaaatagaataaaagaaaaaaaatccaaaggacagcaacttcaaagattgaaggaacaccagcccacaaagatgagaaagaaccagtgcaggaactctgacaactcaaaaagccagagtgccttctttcctccaaatgagcacactagccctccagcaagaattcctaatgaggcagaggtagctgaaatgacagaaatagcattcagattatggataggaataaaaatcattgagttttgggagaatgttgaaaccacatctaaggaagctaagaatcacaatattaagatacagaaggtaacagacaaaatagccagtacagaaaaacaaacaaacaaacaaacaaaaaacataaatgacaggatagagctgaaaaacactctacaagaatttcataatgcaattgtattaagagaagaataccaagctaaggaaagaatctcagagctcaaagactgtttttcttaaataagatggtcagacaagaataaagaaaaaagaataaaaaggaatgaagcaaacctccaggaaatataggaatatataaagagaccaatattatgactcattggtgtccccgaaagagatgagaagaaagaaagcaacttggaaaacataagtcaggatatcatccatgagaacttccccaacctaaccaccaatattcaaattcagaaaatgaagagaactcccacaaagtacttcacaagaagatcatccccaagatacataattatcaggttctgtaaggtcaaaatgaaagaaaaaaatgttaaaagtagctagagagaaaggacagatcacctacaaaaggaagcccatcagactaacagcagacctctcagtacaaatcctacaagtcagaagagatttgggacctatattcaataacctaaagagaagaaattccagccaaagaaatttatatttggctaaacaaagcttcctaagtgaagggaaatatgatccttttcagaaaagcaaatgctgagggattttattaccaccagacctgccttacaagagcttctggaagcattaatatggatgggaaagaccataaccagcaaccacacaaactcacttaaggacacagaccagtaacactataaagcaaccaaacaagtcagcataataagtcgacagcaacaggataacaagatcaaatacacattaatactaaccttgaatgtaaatgaactaattttcccaattaaaaggcacagaatgtaagctggataaagaaccaaaacacaattgtatgctgtctgcaagagacccatctgacatgcagtgatgcccacagaatcaaataaaggaatggaaaaaaatctgccatgcaaagagaacacagaaaaaaagcaattattgcaatcctaatttcagacaaaaaagattttaaaccaataaaaataagaaatggcaaagaagggcattatataatagaaaagggttcaattcaacaagacctaactagcctatatatacatgcacctaacacagaaacattcagatttataaaccaagttcttagggaccttcaaggagacttaggctactacacaataatacggggaaattttgacacccccactgacagtattagacagaccatttaagcagaaaattaacaaaaataatcagaacatgaacttaacactggaccaaattgagctgtgaaacagctacataactgttcatcaaaaaacaacataatgtacattcttctcatgtacacacaacacatattctaacaatgaccacacaatcaaacataaagcaatcctcagcaaatgcaaaagaaacgagatcataccaaccactctcttggacaacagcacaataaacatagaattgaagaacaagaaaatcagtcaaaaccatacaatcacatggaatttaacaacctgttcctgaatgacttttgggtaaataatgaaattaaggcagaaatcaagaagtattttgaaattagtgagaacaaagatataatataccagaatctctgggacacaattaaggcagtgttgagagggaaattcatagcactaaacacccccatcaaaaagttagaaagacctcaaattaacaacctaatatcatagttaaaaagctacagaagcaagagaaaaacaacaacaacaacaaaataacaacaaaaacaaacaaacaaaaaaacccaaagctagcagaagataaaaaatacaccaaatcagagctgaacagagactgagacataatacaaccattcaaaagatcaacgaagccaggagttgactttttgaaaacattaatacaatagatagaccactggttaaactaagaaagaagaaaacagagaagatccaaataaacagaatcataaatgagaaagggaatattaccactgaccccacaaaactacaaataaccatcagagactactatgaaatcctctatgaacacaaactagaaaatctagaataaatggataaattcctacacacatacagtcttccaagctgaaccaggaagaaattaaatccctgaagataactataacaaatgctgaaattgaatcagtaataaacagcctgcaaaccaaaaacagccctagaccagatgaattcacttctgaattctaccagatgtacaaagaagagttggtgcattcctactgaaacggttcccccacaattgagaagggacttctcctcaactcattctatgaggccagtatcatcctgataacaaaacctggcagagacacaacaaaaaagagaactttaggccaatatacttgatgaactttgatgcaaatatccttaacaaaatactacccagctgaatccagcactatatcacgaatccaccacaatcaatattctttatccctgggatgcaaggtttgttcaatatacaaaaaccaataaatatgatttataaaataaagagaactaaagacaaaagccacatgaacatctcaatagatgcagaaagacttttgaaaaaattctgcttcccttcatgttaaaaactctttacaaattaggtattgaaggaatatacctcaaaataataagagccatatattgcaaacccacagccaacatcagactgaatgggcaaaagctggaagcactgtccttgaaaaccagcaccaaaaaaatgatttctccacttgctatttctattcaacacagtattggaaattctgaccagagcaatcaggcaagagaaagaaataaaaggcatccaaataggaggagaggaagtcaaactaatcctgtttgcagatgaaatgattctatatctagaaaagcccagtttcagctcgaaagctctgtaagctgacaaacaacttcagcaaagtatcaaggtataaaaatcaatgtacaaaaatgactaccattgctatacatcaacaacagccaagctgagagccaaatcaggaatacaatcccattcacaattgccacaaaaagaataaaatacctaggaatacagctaaccagaaaggtgaaagatctctacaatgagaactataaaacactgctaaaagaaatcagagataacagaaataaatttaaaaaaaaattctatgctcatggataggaagattcaatatggttaaaatgaccatattgcccaaagcaatttgtacataaaatgttattcctatctaattagcaactacattattcctatccaattagcaattacattcttcacagaactagaaaaaaaatcaattttaaaattcatatggaaccaaaaacatagcccaaataatcaagggaatcttaagcacaaagaacaaagccggaggcatcatgctacctgacttcaaactatcctacagggctacagtaaccaaaacaacatggtattggtacaagaacatatgcatagaccaaaaaaacaaaacagagagtcaagaaataagtctgtacagctacaaccatctgctctttgagaaaactgacaaaaaataagtaatggggaaacaactccctattcaataaattgtgctgggataactggctagccatatgcagagattgaaactggaccctttccttacatcatatacaaaaatcaattcaaaatgtattaaatacttaaatgtaaaacccaaaactataaaagcactggaagacaacataggcaatactattctgaacataagatctgacaaagatttcatggaaaatatgccaaaagcaatcacagcaaaagcaaaaattgacaaactaattgaaaaactggtacactagtctccagtgaaagcaactgcacctgaagttaatggaaagaaagaaggggaaaaggaagaagaagaggaggtaaaagatgagggtgataagttagaccaagctgaagagggaggatctgagaaggaagcctctagtgaaaaagaggaaggtgagcagaaagaaggagaaacagaggctgaaggtgaagtagaggaagccaaagctaaagaggaaaagaaagttgaggaaaagagtgaggaagtggccactaaggaggagttggtggcagacaccaaggtggaaaagccagaaaaagccaagtctactgtgccaaaatcaccaaaggaagaggcaaagtcaaaagcagaagtggggaaaggtgaacagaaagaggaagaaaaggaaatcgaggaagctcccaaggaatagaaggtagagaaaaaggaagagaaaccaatggatgtgccagagaagaagaaagctgagtccctggtaaaggaggaagccatggaggaggcagtcaccattaccaaattggtaaaggtgcacttggagaaagagaccaaagaagagggaagccacagcaacaggagaaagaggagaaagtgggaggaaatggggaatgagaaggaagggagtgataaagattccaaggaatccaggaagaaagacatagctgtcaatggagaggtagaaggaaaagagaagggagagcaggagaccaaggcaaaaggcagtgggagggaagaggagtaagacattgtcaccaatgacctagacttaagcccagcagatgaaaagaagggggatgataaaaatgaagataaagtggtggtgaccaaaatagtagaaaaaatcaccagtgagagggagatggtgctaccaaatacatcactaaaactgtaaccatcactcaaatggtcgaagagcatgaagagacctttgaggagaaaccagtgtctactaaaaaggtagaaaatgtcacttcacatgccgtaataaaggaagtcacccagagtgactaagatttgagtccactgcaaaagtttaagccatacgacaatttcaaaatgcatgtgattgacagcttcaaaacagaacagattctcccataggggctccagacattgtattttactttgtgcaatatgaggagactgcatgcaagctcagtgtgctcccccctcagtctttgggggattcaaatgcatgatactgtatgtacctgggaaatttaccaatttcctgcactgttggaagggggtcactcagaaggggagatgtcttgagatgtattatgtaaagtaccaactgagccaaaaacaataaatgaaacacagaactctcttagccttaagaaagctatatatgaataattatgtttaccacactggtgcatttaaaatggacttttcttcatgggagaacctcgttgacacggacagtttgcaatcttatgttgatcgatgtgaaatgtcatagcagtacttgctcaataaaggtcatattggaaacatagtcaaaaaataaataaatgaaagagcttctgcacagcaaaggaaactatcaacaaagttaccagacaaccaatagaatgggagaaattatttgcagattatgtagctgacaaaggtcgattatctagcatctataaggaatttaaacaaatttacaggaaaaaaacaaacagccccactaaaaagggtgaaaagtatatgaacagacacttttcaaacacaaaaacaaaaaaatacttgcagccaaaaaaaagtattttaaaaaagctcaacatcactgatcattagagacacgcaaataaaaaccacaatagaaaacatctcacaccagtcagaaagctttttattaaaaagtcagaaagtagcatatgttggcctggttgtggagaagagggctcacttttacactgttggtgggagtataatttagttcgtccattgtaagaagcagtgtggtaactcctcaaagaaccaaaaacagaactgccatttgacccagcaatcccattactgggtatatagccaaaggaatatgattgatgtattataaagacacatgcccacatatgttcatttcagtaaatgtggtacatatgcaccacggaattctatgcagtcataaaaagaatgagaccatgtcctttgcggtaacatggatggagcaagagaccattattctatgcaaactaatacagggacagaaaaacagaaaacagaaatactgcatgttctcacttataagtgggagctaaatgatgaaaacacatggacacaaagacagcaacaaccagacagtgaggccaaccagaaggtggagggtaagagggagaggatctgaaaaaagtagttattagctactttgcttagtacacaggtgattaaacattctgaatatcaaacccccatgacataattttacctatataacaaacctgcacatatacccctaaacctaaaagttttctaaaaaagaaaaatgttgtattttgcaaaaagtaaacattttcctttattaatactttataattttcagtgtatgtattttcctgtttgattaaatatatttcaaagtatttattcttattattatataaataggatttttaaaatttcctttcagataatctatttttagcctctacaaatgccacttacttttatttagagcaactttactaaattcatgtattaattgtagcatttttggttgtcattgagacttttagacttttctgcctatacacctatatgtcaactgtaaacagagataatattactgtttcttgtctagtttgaatgtctttcatttctttttattgtatcattgttcttgactagaagtggcaagagcaggaaatcttgtacaggattttagaggagaggcttttgggttttccccattgattattatgttatcagtgggcttttcttatatggctattattgtgatgaggtaggttttctctacacctattgtattgagagttttttaaattagaaataggtattaaatttgacaaatatttttccagaacttattgagatgatcatatggtttttgtgtttcattctgtttatgtagtgtatcacattgaatgacttatgcatgttcaaccatccttgcaccccagggataagtcctagttggtcattgtgtacaattttttcaatgtgttgttgcattcagtttgcttgtattttattgagcatttctgagtctacattcatcaaggttactggcctgtagtttacttttcttgtggatgtctttggttatcaggtcgatgctggctacatgaaatgagtttgtaagtgttccatcatctagattttcaaatagtttaagaaatattattaattctttgaatgtttgctggaattctcccacaaagccatgcagtgctggactattctatttcttcttcaatcttggtaggatgtatctttctaggaatttatgtattacttcgcatttatctaatttgttggtgtatatttattcataacagtcccttaagggctctttttatttctgagacatctgttgtaatgtttcctctttcatatacagttttatttatttcagtcttctctctctctttggttactctaggaaaggatgtgtcagttttatttgtctttttcaaaacacaactcagttttgttgacttttgaaatagcttttttgtcctttttaaaatttattttttgccttaattagcattatttccttctttctgataatatttgggttagtatgtatttttttctgtctttggctagttatttttttaggttgtttatttgagatgtttctttttttttttcttcctcagaaacatttaataggtattaacaaacagaagccatgtctctcgaggctgtgagacaagatggtggatccccatgccattaacccccagaacccagggcttatatactataggtaaggagaattgaagtaatttggtcagaatttatggtaagtgtgtgctcttaacagtagtagagtaaaaatcttagaggcattcccagaaccgaggttaatgaaaagccaacatgttggattagcatttaagacagaattggtttagcctgtacactccacctatctgacccagattttacaatttcacattctctcttcttccaagatggtccctgagcctagagagaggttgtttgatattgcacagctttagcagtagtgcattggcaatggaaaacagattgggcccagttgctataatgttccttctcagaaatacttttgctatatctcacaactgttggtatgttttcttttcatttttgtcaggaggtaatttttaattttttaaatttaatcttggacccaatgattgttcaagagtgtattgtttagcttccatgtatttgtgaatcatatggtttcttgtttctttaccattaactgatttacactttcactctattgtgacctgaaaagatacttgatacagtttctatcatcttaaagttgagttgttttgttatctaataggtgatctattgtgaagagtgttccatatgtgcttgaaaagaatgtacaatcttctgttgttgggtaaaaagttctgtagatgtctgttaggttaatttggtctctcctattgttcaagtaagctgttttccattgatttctctgtggatgttctgtccattattaaaagtggaatattaaaatcttctagtattattgtgctgctataaatttctccagttctgtcagtgtttgctttaaatatttagatctgatattgagtgcatatacatttacaatagttatatcttcctattgaattaacctttttatctttatgtaatgaccttctttgcccctggagacagtttttgacataaagtctattttgtctaatgtaagtatagccattctgctttcttttcattaccatttgcataaaatatatatttttccatcctatcatgtttaactatgtgtgtccttaaatagttggtgccaagtttttattctttcagccagttaatatcgtgtgattgggcagtttaatccttttacatttaaagtaactattgatagggaaggatttactattgaaattttactgactgctgtttttcttgttcctttttttctttcttgatgtcttattttgtgtttctttttttgttattgttgtttgacaggctttaattcctttctccttttcttttataactagttttttaactactgtaggtagtagattttcttttttaagtactatggctattttctgtgtgaatgacatgagtcttacataaaatataattataataatctaaaactgataacttctcttccacacaaaaacttcacatttttaccttgttcccattatagattattgatatcagaatttacatatcttaacatgtgtatctattaatgtaattttagttatacctatatttaatacttttttaaattttagattagaattaaaagtgatttacctaccacaaccacaataatatagtattttttatttgcctctataaatttaccattaccgatgagttttatacttttgtatgctcttatattgttatttagcatcctttgatttcaacttaaagtactccctttagcattttttatatgacaagtctagtggcaataaactccctcagctttcgatttttttaattttgtcttaagttttaaaggataattttctgggtatactgttttgattggcagttgtgtatttgtttgtttgtttccgcattttaaatgtatcatccaactcccttctggcctccaaagtttctgctgaaaatccaccaatgatcataggagggttccctaacacataacaagttgtttttcttttgctgctttcagtggtctctgggtgtccagagtatgccagctctcatcattgccctgaaacaggtgagatactgatcctttttagtagtaaccataaatgttggggcactaactggattttccaatttcttctctcctcagggaaaagctgggtgtataatctgctcatgctgaactgagctggggaaaagaactatggcaaatgtttgcaagctcattcaaaccacagactttttcaaactgttgctttgatctctgtagcctccatgggcctaatggatgctgatctccattagttctcatagacacgtcagttgaaagctagttcctcaggtagcagctggaaaagttaaggggatagatatgtagataaattccttccagactgaagctagaggcttgcttttatcattagagtgagcaagtgggagaatttgtggaaatatccacatgcctgtttaaaatggctgctttgttttctatagcccacatgtaaatagtgaatggcaacaccaatagctctcatagacagtgagttagaagccagacctcaggtaggagctagaaaacttagaatgcttgatttgtagtctaacttctttcatagagaatctgggaactgggctttgttgttgtagctagttggtgaatgaggaggtgaagtggaggagatatgggaagaacccatttgtttgggcattttttctcaatgtaccttagtttgtctgtagtagctggccacagtagtgatgattctatttcctgagaggtgagaattgctgccaaagaatgtctgccatggatgagaatacaaagaaaggaaactaagaactctcaaagcagctactagaaacccttcatagaggacaagaattatcttcagttttgagatatatgagaatgattacaactcctttgagcaggcttcacatactgcccaaagatgcttctctagtttgtgtccttcttgctatcagaaagagagaaggaaactaaataaaacaaaataaaaattttagaattttgtgctgtcttggacatggaagcaatgggtcaggatcaagattgtggaaagatgccagttcggatgcaggctagaaaaattagtattgtcctcaactggaatcagcaaccaaaagactaagtgtatgtgtctctgtaggctgaagggttttcagatatcataaaagataagaagtcaagctacacttgtttggaagcatgtggcagagaacacagattaattgtttaaaggatggcccaaacttaaggccaagtcacatcaaacccatcagaaaccaaaagtgtggcagaattcctaacagaaggatgagagaggaagagccttatatagatctgtcttctgtttcacattctgactattctaaagcttttaatgaagaattccctagagtcataaaacaaaggctaaatggtgagtggctgcaaatacacataaaaatatagtgaattttttgaaaagatatactaatttcaggtggctagaaagatttattaacataagtaataaaggtcttttagttgtcaaagtaacttatacttaatatttattgcaattttaaaaaattaaaatgctaaaaattatttgtgaaaatgagttgttttatatgtttacatttaataacaatactttttacataaagaaaatacaataattaaatatatctgaactagtcaaaagataattataagatttaaaattgagtttatgtgcaataaatgtggtaaacaataatgtgatataaaatcttctaaatttaataatattcttggtagaggattctggggcaaaaatatgattttctccatatccctgcccactacccaatatatgataacatgtggcattattaaatatggaaaaatattaaagaatggcagtagactagagagaagagaaggaaaggcatacaggaaatccaggtccctgccctcagagacctctcaattcctggcatatgtttatgttttgaacattatgcaaatttgtctgcatgacaaatttattcttgtttcaggttaagagtagaaatcaacccatagtccttacgattagaattgccttagcataacgattcaatcagtaagaaaatataatagactagagggtaatggagattttaaaatttatattatcttaatatatttattagaaaaaatattagattgctcaataaatcaatggtaactttaaggcttttactgtctactacaaagaatttttatagatatatgaagaatgatggtaaggaagagatatgatgccatgaggcctactgtgagcaagacactgctaatcaggctattaggttggtccaaaagtaattacagtttttgtctttgaaagtaatgtcaaaaactgtgattacttttgcaccaacctaatacttccgcactttggaaaggctttgcctacatcattttggttattgtgagaagacttgcacacataaggaatttttcaaaataatattttaacttgaaatacttttctttgacaaatacagtaaaagtgatagagccaaaaagaggactaggcatagccctgaggggatttccgagcaaaaaaatcccaggggatttgtatgcaaacacttcgctcaataaaaggagaggccaggtgtggtggctcacaactgtaatcccagcactgtgggaggccgaggtggctggattgcttgagcccaggagtttaggacgagcatgggcaacatgacaaaaacttatctctaccaaaaaaaaaaaagaaaaaatagcggacatggtggggtacacctatagtccagccacttagagaggctgatgtgggagaaacgcttcaactcgggagtttgagacccgcctgggcagtttagtgaaacctcatcactacagataataataataataattatctgggtgtggtgacacacgcctatagtttcagctactctggaggctgaggtgggcggatagattgaacccaggatatctaggctgcagtgatctgtgatcatgccactgcactccagcctgggtgacagagaccctctcttaacaaaataaaaaatacaaaaaggagaaagtcatcaaacaaaatgatgtgacttagtctggtaatattcgtcaagaagtcaagatttatgctctcttacaattctgactttcacattgaattaaattaagggtgtcttggcttgtttagtgtagtttagtaaaatacagtcatttgttttccacagctattatattattctccattaaaaaaagaagaagaagaagaaatgagaaaaaaaaatcagtccctagctagaaattttaagagtcaataacatttgggaaatgaaaatatattctgaagtagtataatcatacccaaatttttagactctgtactcaatctataagatgtatgtgagcaaaatattattagaagcaacatgaatgataatcacgcactacaagcgcacgaataatgtttccctgaaaggtacaataaaaaattattcaatgtgaaacaaaacgttgactgcaacaattattaaaatttgactattgaattgtcagtatactcaattatgaagacatttggaaaatataaatgagcactactgtttttgctcattttttaaaaatgaaaatttttggtaatgtctgacctgaaggcagatattcattataatagtcaaatatcataaatacatttcaaatgttatgtattctacataaattactcaggagaggaacatgtaggctcataaacttgcacacaagtaaaggaatgtttcttaggaaaaaattctgtgttaaagatattccacaccaatgtctcaggaaaaggcatttgtagtatactgctccattacctatgcttcataaaaaatgcagctatctaatttaatttagctctgaacagatttcttagcagcataatttatgttttgagaatatctcttaagaatcatagcttgcaatctatggtgcttcaatgaagaataatctgtaaacaaaatctccatctatcaacaaaggccattaaagaccataaaataacccatccttgactgattaatgctgctactgaaagggatttcaggctattaacatccagaaaatatactgccactgtggttgcatttattataaatcacatagttatatgtactggtgtaaagcaatgttttcttaaccacctccctctcccaaattaatttaataacaaagatactttgaagaacactaaatatctatagaaagtaaatgattctatttttttccctagaggaaatgtatgtgaaggcagggctatttataatacattagatagctaaatattggtttaacactttatatgcagttcaattatgttcatatatttatgtcattaaaatagtttctctaatgtaaaataaaacattaaattcatttgtatttcttgatacttttattaacaatactgatggtttttcatgggtaaaatagccatcaaaaattgttagttgttacctttaggttcatcctattctgtcaatttgattgtcactaactcttcctcttaggggatgtgaatatagctgttgagctcatactcttggaaggtaaagaggctttgtttactggtgcagatctcgattttttcaaatatagtatttcacctcagaaatactatctattagctcttatgccttacaaaactactggcttggatttgtccaatggttttaacccttgatcttacctttaacatgcttggaatctcacaaatattttcttatattgtttagtacaaggcactgtctaaatagtttagccacattatctcattccatttacaccaatcccatgagataggtacgttttaaccattttataacataagcaaaactcaatttcaagaggttaactaatatttccaagatcacatagctagtttatggcagaggaggattcaaacacaggactgtgttgattcaaaaatctatagagttaaatgtgtacttgtccttccgtaatatctgaggctagacaaaacaatccctggcttttctctcctgctttctatgaatattctgtcttagactacttagtcattatatatttttgtcttttcagtagagttctgttttgctgtgctagttcttttgggtttctataataataaaaataataataaaaggagaatagaagaataagagtagatcagggagaagatattctgaagataagttggtttaaagagaatgagttaatggatcagcttttgtctctgaagtcaacaaatgacaaagaaatgaaaaaggtgtaccctggaacaatgcatctatctgctggtagtacttgagaaatacatacaaaattcatatttttattttcttttgtttcattttattgcttattttggtcagtgttatttgcttcttatactagtaacattcctccagcacagaacaacatatctttgcaaatatttcattaaatatataaatgtcttaaataccacaaatgaaagacatgagtaacacaatatagtccacaaaactcaaaaggaaataaacacagtttagcatttttttcttacaattgaaaagattttaataactgttgagtatttataattatctatgctaactcccattttcttgccaagttatgtgtctttaaacactatggagtccccttgcaaaatttaacagagaagcaaagatatgtatcagtaatattgatgtttttatttttttaaaaaaaacctccctgataatttaagtgaattggattagaataattaaaacagaaatgaaggacacagaagcacatattctcaatatcgtcacctctgattactttagaattctgttagcatgtgctgtaaaaatcctttttaaaataaatattcccactataagcttaagtttattcatatctagggagaattgttttgttcggataattagatcaacagctgactctttaagctgagataatggcccactagccaataggaatcacacatgttaaggagaacagaattcaaagagtctggtcccttttgcacagtgacagaacatatgaggcagctacatatctagagagacaagaagataaatataagagagcaaccaaatcaagatgtaattactctgcatttaatcaaggcaccttagggttagtccagaccttttatccaaaacagctctgtaaacagcctactaaaccagcatcatcagctttctgtatttctcatctgtctaagtcagtcttccttgtttcaccatattcctacttgttttgtcttcaacactttctgagagaatgaagaaaaatgacaaaaaacaaattgtatgattgtatgaatgattaatatctcctctttcatgttgttcctcttctattgttcaaagagtatagagtgaataaatacaaaaacaaacacaacactgaagttaataaataataaggtccatctcatttgttaaatttcgtttcttaaggtatatgtgtctttgaaccttctggttatttctacaaaatagttctagtggctttggcagagtggtagcataacacatcactttttaaacagagttgaataattgtataaccctaaaagtaaaagaggcaaacaataaaatgaaatgaacaaatgaaataaaatcagaaattctcagcttaacaaaaccacctttcttgtgagcacattttgtgcatagtgaaataagggacatatctctaaagctctgtacacatatatttattaaaataaattgaattaacaattggcactacacagagtggcatgaaaaggttcagtatcttaacctcagctattcactaagataaaaggatcaccaacataaaatcttttttctttgcattgttaaacttaaataagtgttttttctctaaataaaatgattaatttttaattatgtagataaattttggatctaggtggactggaggcataaatgacacttacttagagatataaccagcaaagtcaagatggcaactttacagaaaaacataatctaaaagtttgaaaaacaaactgcagaatatattgtgtgtggctctttttatattctaaactatgttataaaaattttgcctcgacttacttatataagaaaaataaaactggttgcagaaatataatttagtattatgtcttgtgtgacctaacaattgggtaacaattatactaaaatgggacataatttattaatttacacagtataaaacctattggaatagactttgtaagttccaagtaagtttcttatcgtacctggtcagatttactttgcaatgtccatcttaatatttatgtttttaatatttttaaaataaattttaaggcaatagcatgaatagatgaatacataagataataaatgaaactctagctctttataacttaaaagagggtaggataaagaggcatggcataattttacattttaacttcagtagatgacaatatttgggaaaactaaggaaatatggaaggttagacaaaaataccgattcagggctagaaacaatatttatattttacaatgcccattttagggaaacacggcattgctatgtttttaaagcacgctttagagagtgaaagagttcactttagaaagtacaatttagaaggacttcactttctaaagtatgccttagaaacacagcaatgctatgtttttctaaaatgaagagaaagaaactttatcactctcaaacagcaaggcttaaaatttgtagagaatgtgaatgaggaaaagaaagacaattgttcaggaagttcaataaatcatatttgctgagtcattgagttattaaattcagcaaatatgattcactttgtggcataagtaacagggaaacatgttccatcacaatttcaagatgaaatataaaaagcttcagtctctcttttgtctctctctcacacacacatacacacacacacacacacactcacacacatacacatatgcacaaggtaattgaggctagggaggtgaaagaaatgtagagtagggtctctgacaaatgtggtgaagggtctctgtgtacataatgattttttgaacaatctgaagacaattaagcaaattcagaataattttaacatttcagcagattaactggtattaaaaggggaaaagattggcagaagctttattctaatcatgcaccagaacaacaacaacaacaaaaacacacacaaaaaatcaaagtggcaaatggtttcattgattattgtgaactatccggcacccacgagaaaacaataatccaaatttgttagctcctcaaccttggatgagttttcatgagtattttataaattagtgctataatggcaggagacaacgaactcccagaccacttccaaatttaaaattatatagttttccattgaatagtttattattttcttaataaagataactgtttcttaataaaactaatgctatataaagacaaagtggataaaaaatcattagcaagagaattagtaaacaatgcatagcaacatacatgcatatgagcatatatatacacccatatatgcatatacactagacctatatgcacataattgtaattatatattagtataacaataaaaatcctaaaatatctcaaatgtggaaataaaaatgctgagccaacactagcctagagggctgagaggccagaagagattttgagtttcaccatctgttggatcattcaagcatttcacaacttcctgccagtatcaaatctccgctattttatttgttccaagaaattttaaaacaaatgagagaggtaaaagcagttgaaaatgctgaaagttttgttcactttaaggggttattgttgaggcaatattgctcattaaaggaattttaatggcttaaaaattaaagcttttcaaagtcaagtactttatccctttggaagttttagcaatttaaacttgaataattttcatgaccaaagtaactgcaaaactataattttatattacaattgtatttgtaccatctgacctaattattaaatgtttaaacataataaacactaatgaagtgctctgtcactacaaataagcttctggtcagggtgctattgtcattctactttcttcttgtagttttgttacttttctcgtgcttgtccacagaaattcccaccaagagtcaaagttccacttgcatactcctgtgtgtggaacaagggtttgggatcaaagagtctgccttttcattctgggctctgctacttattacctcttccttgaatctatatttttaatctagagtttctaatagttgtgatgaggatcagatgagatataaggcagaattgcatttgtcaaatggctaatatatgatatgtataagatatgctaagtactcagtaaatggtaattgtttttgctatttctgatttgggcttggattttaatttattttttattgaatgttggataggtatttacccattcacacaatgttgtctaaatgttcatcatactttctaaagttaagggataaagtacgctgaaaggtagctattacctaaaataataactatacctcaggcgagataatacatattatgaattgagaataaacacgcattaaataagtggtaaagcgatacaaattgagtttatacagtagaaaatagaagggggttatttctattggcagccataaggctagagtatgttgggcataattcttctttaccagatacaatgttttgtatagaagtatactcagtagattttttaattctgtgtttctggaactaaacagaaatgtgtggaaattgtagaattgggcaagaaatggaattagaagattcaagagttaatccaacggatgtgcatagattgaagaaataagtccaagaaaataataaatggattagaattttgcaatctctagtactcatagttttttaaaagcaatattaatcaatgaaatacatatatgtgcatccattctatgccaagaacatcacagttaccttggtacttgagacacggagacaaataagacactgtctatctctataaaaacatcatagactttcattctagtgagagagaaaaacacacataaactaggaatgacaaaataagacacatacaaataacaacgtgtgaagcatttcatatttacaaaataaacataaaatactgttcattttctgaaaaactttctccatttatcttgaaatatgtagtatttctgtcaaattttataatctattattaggtatagaaacataaatacagagataagtttttcaataataaaaatattcccagtggaaaatggcgatggatacttagtcttaatgtcagtggcatcacagggattggtacagacactggtgaactaaaaatatcacacggtttaaaggcagtggactatacttggaaattgttgctgtagacaacagcaggctcagcattaccaaattatctcatttttttgagtagaaataaattttgatattttaatgtgcaaagcctttaaaaatgtgttcaattcaaaaaagtggctaagaaaaaaattaaaaataaagtttaaaaaaccctcaaaactatatctgtgggtggaatcaacattcaggtttctgctgtttgatcctgaactcaaggacttataaaagggaggcatgaagaagagctctgcaaaaactatagaaaattggaagatacagaaagaacactgaagaaaaagctactgtccttagattttctatggaaaattaggtcaggtataaagaacatattcctaatcagatgaggaacttttaaatcagtgaaatcatagaactgcttctttggaggccttaatttttcatctgtttggggttatttaaatgaagccattgcaagtgtgtcctattttttcaaagtatattttgtggactccccaactgtaatcacaggatgtgcttgttaaaatgcagattcccagacacctttccagatacagaatcaaatatttttggttgggtacagaattctgatttttttaaaaaattaactctagttaactttgatacaaagtacatgttgagaattataccactggactcacagccaccaaagacacttgtttagttggcgactttgagacccagtcagacttatgagtacctcggaactggaacccaagagacgtatttataacaagtttaactaggtgacattaatgtgtcttcagctacatggaggctatattttattgcattatatattcttccttcttgttactaatttctttggatgcccgcttttacaataaaattaataatttagaagcttataacttctttgtaaaatggcatttctagcccaaatacttgtttaaattcagcataaaaaagaaaacctagttcataagtgatatgtcattaaggatcactgttgtttatcatgaatttcattgtatctttaaaaacatgacgtttttatttttattttttaatttttatttatttatttttttaagtagagactggatttcaccatgttggccagcctgtctcgaactcctgacctcagatgatccaccagccttggcctcccaaatgctgggattacaggcatgagccactgcacctggcctaaaaatatgactatttggtaaacatcaccagggtcctaagaatattgtgtagattatttccagtgggatggtagccattgagcaaccaactgatcaaattttaagatcttgtaagatcttgtaagatgtaaaatgtagcactttcgtaattacctaacttatttgtgaatctgcttttgaataatagtaaaattgtgttttcaaagccatcttactcagaagtaaattatgttaatatacaataaagagaacatacacttttactatatgtatatggaaaattactatatcataaggtcttctatacagctaaaatttttgtgacctgggtacctggacttcaattgagtgagaaaatgaaactaagaaagttacagcattgatgaatagcatagtatatactatattaacagtcattactatatattaaaaagtagcttaaaagaaaagaaaaggccaggcacggtggctcatgcctgtaattcgaggtgggaggatcacaaggtcaggagttcaagaccaacctggccaagatggtgaaaccccaactctaaaaatacaaaaaaaaaaaaaaaaaaaaattagtcaggcatagtggcgggcacctataatctcagctacttgggaggctgaggcagagaatttcttgaacccgggaggcagagatcgcactgagctgagatcgccactgcagtccatcctgggagacagagtgagactccatttcaaaaaaaaaaaaaaagaagaagagtaagagtaagaataggagaaagaggaggatatagaatggaataagagtcacagaatgagagtattcagcccaactgtaactttgttttcaagatatattagaagcctggggaattcttctataaattctacttcccatttagcatgttctaaagttcttctgtcatgtcagtataatatgagaagaggtaatgtattttgatacctcctgttttctatagacaaagtatgtagattaagtacatgagtatttgaggttcaaatgcacctattaaaatgacagtataagtatctatttaactggagcaataaacatacatatctttcctaaagtgatacttaggttattacaaatgccctattaggtttagttatcttcctcatttaaaacactttccacatacagatagtagtagactactaaccttatgctggaacatacattatgatgtaaaaccggggaaatatttcaggtaaactcattctcagcagtggtacatgattatgaagctgtgttttatcaacatgattgctgtgagcaccaaataagaacatgcaagtagcttggttagcataatgtatagcacagagtaagaatataacaaatgtgagttactaggattgtaaagattatcattattattgtttgaatagtaatctctgtatgtaaatagacatacatattctactaacagatttgtgttatctacttgagtgtgtgtatatatgcgtgtgtggctatgtgggcaccagtggagcaataatgagtttgctacatgttatatatttctagaatcactaattatgttgaaatattattacaaaagtatgtgccttaacaaactaataaatactttggtgtctaaataagctcaccatagagcaaaatatatgaagacacacagagatagctatatatagagacaacggcagcatgttattccatatggaaaaaaaaatttgtatctgcagataaaatggcactccaggaggatatcaaagcatcaaatggatgttttcattaaaagaaaatttgtacatgaatttttaaaatttcagttcatgatgttactcattagctctatttttaacaaaatgttcccttttgcatagagaaaggaaagtcaaacactgatcttcaatattaatagttaagaacctgaaaacatcttacattttattttataggtttaatctaacttaaaaaaaatgttaaataaaagacaatgaaattgaagacccctcctggagaaactagtgaggatactaatatagactctacctcctcaaaaacctaacttcaaagagattttaaagaagtcatcaattctctcacatggcagactgggataacatctgttaatagagacttaaaaaaagtaagtaatttaaggaagaagggttgataattcattgattgggataagagaggaaatggcaagagaaacaggtatggtttcataatgacattgagataagtctcaaaggctgaaggaagaatttaatataattattacatctagtgatactgatgagaaacacatcctttctccctcagttttctttttgtgcgtaatcttgtaacagattgttcatgttttcagtaaatactgggagtgaggaatggtggaatgcagagatgttaagcagagggatttggtcccaccaaaggtactctaaattaaataagatgtgctcactttgcaaaagtgacttcaagataagtgcctagcttccaccattactgctatactccacttctaacaaaattatcatctttaattttctagactgccgcactagaaccatcatagtgtggaccaaatttacactatttttctacttcctatttctattcttctaaagttcttaatctgtgttctaaatctgggactgggcttctaagagtaggttcactgattgtgttatccaagacaggggttggcaaattatagctcaccggacaaatccaacccacacctgatttttgtaaggctgaaagggtaagaatggttttgacatttttaaacagttggggaaaaaatcaaaaaaacagatatttcttaacatgggaaaattatataaaatttaaatgtccacaatcttgttccccttttaaagatatattgttgattattttaacactacaacaaccagagttaaatcgttgcagcagagatgacgcggcccacaaaagccctaaagatttactttgttctttacagaaaaagtttgctgacccccaactcaataacttattttatataaacataaatttttcaggaaaataatactgtgaacccataatatgattgtagcataatgggaaaattaggcaaagattgataaaataccaatcttattattatacagtcacatatcatataggaaaaatctgatacaatggatttaatatatcagatgggaatttgagataaaaaagattctaatatttctagtcttataaatgaaactgagcctaaatgaagctttcaggggaaatgatcatgtaagacaaattacaggggttggtttctaaaaccgattctttttactctttactgaaggtcaaggatactgaatgtgccagtgcaccttcagaaagcagcctgcatcagcacatttaaaccactgaatggtctcaccacctagtttcttgcgaaagctgagcaatacattttgtgatagataccactgagaaagttaggcagaaattgttattagtagtatatgacaatcataatagtctaacttttactgtaaaactctattatttatatgttttctgtacatcctgtaggattgtctgtattttgcaatagaattgcaatgtgtaagagaaaaagaggcagtctatgtttccattgtcattctaagggacatattatccatacaacacctcctttttcccctttactgaaaagctgtgtataaaacactctaccatgctttcctgaaacataaaagaagatttattactattttaataaagaagtaagaacaaaaatatccaatctcctaatattcaatggagaagaatatatattcttttttaggaggacacaaaaatagcaagcttaagtatattctgttccctaaggtactgtgtaggtggagaaaattatttttcatttaaaattatatacttgtagttcattttaagtaagcccagtggacataaagctgattcattcacaaatgcaaaattttgttgtaattatttgcttaaccaaagcaatattcatcaaaaatggattaatgctaggattattttatttcaagtaaatgaacatatattgattagtgaccttccaaaccccatgctagcaacagtaattactattattaataaaatacatcctctagtgcatattaaatggttcaatttattaaatatgctgatctctgcatacctcctcaagattattttttaagaaaagtttactttgcctgagaaagaaaagatgaaatatgcaaacactaagtttactaaaaccaccaaatacaagctgccttggagtcccgttgttctgaattgtcttaccctcttaaaatcagatgttttaagcagataactcaatttttcatacaatataaaatgtccaaaatccgtgtaattctctgcctctgaatacatagtctctatctatttttctcattgttttaatctaaaaggaacattatgttttctctttttaaaagtaccctccttcagcattgtttttacttctaaactccttagattttctcctcaaatcccatttttctccgcacaatctcatcctcctttagctagaatcactcactggtgattaaacagagtcacgcagaaaataatgaatgcaaaaatgtgggcaggaagaaagataagggaagaaatattcttcaggaaagaaaatgaaacggtatttgtcagcgatgttgtaaaggggaagaaacattagagaaagggtgattggttgatagtgtcaaacgctgtaaagaaaggaaagaagaggtattttttaaattagcaaagtggagaatcatttttaaactttgagttagagttattactgaggaatgagaatttaagtttcctttgtggttttctgtgcttactaaatcaccagctcttcttataaggtgagtgatatatagtaagaatgagagtctgtggggaaggctggtgaacatactttgatgaaaaaatggactgtaaaggagtaccatccctgtcataggaagagatattttagtgtctgaatctgtgagggggtgtgtggaggtcaatgttgatgctctatgtatctaccggaggaaatttatgtgtgtgtgtgtgtttatctattgtaaggggaagccgtgagatatcagacttccctggcttttcctatctctgataagaaacactgtagttctagggaagctgagcgctggaaaggaccttgactttgataaatacaataattggtgacaagatttaaattttgttttccatgagttctggtgatagggcattctggcttgttttatgtcatttgtcctaatcctcttaacctcttaacctattctacaaaccactttaaatatttcttctcattattccaaacccttgctgtcaaacatcattgtaacctgtgtgtatatatatatataatatatataatatataatatatataattatatataatatatataatatatattatataattatatatatactatataatatatattatatataatatatattatataatatatattttctatatattatatataatatatattatataattatatatatattatatataattatattatatatatatttttcccactacagtgggaaaaaccattaatccagtggctatttcctgtacactatctctcgtgtctgtgagctcctttctgtttctattgccatcagtgtctttcacaacctcctctttctttatgatgtgtttcaaagcagattctttattttcattctcccaagacctgctgcaccttgcctactaatgtcagatacgttttcttcaaatgtcacacttcaggttagttatttgattgaatgcctatgtgattcccactacttccatataaagtccaatccaatcaacttaattattcacagttttgttcaattgattttactttccctgcctgactttccatttgtctattcaaggtagactagtttccaccattgcgctgacttcttgccctgaaatcactacttacagccttactcatcaaagcaaacgacatcaattaatgaagtaaaactcttgtcctaggctgtctattggtcttctctgatcctttggcggcagaagctctgcatacatccatcttgcctagacagtgttatgcaaattaacacaaccaaaaacaaaagtcaaattgtggttccttttatatattttataagtactattattaataatgaaaagacttttttttaaaatttgactaacttttttacataatactatctacttcataacatgaaaggattaagtggatttttataaataatgtgcatagaaccatgctgagaaaaatatgaatgttctaacattggtactgattgttattgttatttttactgctaattcttaattagtagagacaaatgttgactgaactatttctttggcgagaaataaataatgccatattttgggctcttcaagccgagtctcttctggcttggaacactaaactatataaattgacccttattatttaaaatgtaaaccacattaaaaattcattttcttaatcaagatgaagctaagatatttggtttccaaaccattaaaatttttatgagcaattctctgtaaaagcatttacctctggtatagtcgactactagttatgtactaataactattactaggatccattagctactcgctttgatctgtgttgtcatgaacaggaagatttggaaactgttgatggtttatacattgactatacaaaatactatattttaaaatgaaatcatatgaaattaatttatcaagattaactgtagtgattacaaggaaagaacagagagtacatgtttgatacattaaaaaatcttttcaaaaaccaaagaaaatcatgggtttagattataaagtcataaggtgataaggcaacttttgctcatgcggaaatatgttaattagttttataatattgtttctccatcgaagtacttatacacgtgtttggctacttaaaatagggtaaagaaataaataaataaattataatgctctaaatgaaatttggcatataccatctctcaaatttgcagtttatagtgcaggaacaaaaaagaaaagggaagtgtgatgaaaatatttagaaccacttgtctagagtttaaaagaattagtagcaaaaatattacaaaatataaaactactgattgccttgaatttgttacctgatcccaagttatgaacattaaaagtgtcataaagaaacaaagtcagacacttgttaaaaatagcaagacagatcttagtaagatactgcagtagggaagagagacttcagtggaaactgggttcagctctgatgaaacaaaaggcagaaggctgtttaaatgctggaatatgctaaagtaggggttcccaatccctgggccatggaccagtatgggtctgtggcccgttaggaactgggctgcatagcaggaggcgaatggtgagtgagcaagtctaagtaacactttgtatttacagtggctccccatcactggcattattgcctgagctctacctcctgtcagataagccacagtattagattctcatagtagtgcaaaccttattgtgaactgtgcatatgaggggtctaggttgcgtgctcctaatgagaatctaatgcctggtgatctgtcaatgttcccatcacccaggtgggattgtctagttgcaggaaaacaagctcaggactcccattgattctacattatggtgagttatataattatttcattacatattacaatgtgataataaagtacacaatacacgtaatgcacttgaattgtcctaaaatcatccccccaccccactgggtccgtagaaaaattgtcttcagtgaaactggtccctggtgccaaaaagactggggaccactgtgctaaagcaaaagtaccaaagcactttgaggtggatgcttaatgtgattagcccagttgtgtttgctaactggcacttacagaaataaagtccctactttaccacagagactgggaaatagaggccctatctttctcaatggttacatttcaaaaggaggtctcccaggtccttgagaaagacattcctgagttgcagatacatttcacaacgacaaggaaaggactacaagtttcctaatgtaaattctctaagaaaagggaagtctgggacccatagccaatgatatggtttggttctgtgtccccacccaaatctcatcttgtagcttccataattcccatgtgttgtgggagggacccagtgggagatgactgagttatgagggggagacttttcctgctgttctcatgatggtgaatgggtctcctgagatctgatggttttaaaaatgggagtttgcctgcacaagctctctctttgcctgctgccatccatgtaagatgtcacttgctcctccttgccttccaccatgattgtgaggcttccccagccacatggaactgcgagttctctattaaacttttttcctttgtaaattgctcagtctcaggtatgtctttatcagcagcttgaaaacagactaatacagtaaattggtaccagtagagtgaagctttgctgaaaagatacctgaaaatgtggaaacaactttggaactggctaacaggcagaggttggaacagtttagagggctcagaagaagagaggaaaatgtaggaaattttggaactccctagagacttgttgaatagctttgacaaaaatgctgatagtgatatgaacaataacatccaggctgaggtggtctcagttggagatgaggaacttgttggaaactggagcaaaggtgacttctgttatgttttagcaaagagactggcagcattttgcccctgccttagagatttgtggaactttgaacttgagagagatgatttagggatatgtggcaaaataaatttctaagcagcaaagcatttaagaggtgatttgggtgctgttaaaggcattcagctttacaaaggaggcagaacatgaatattcagaaattttgcagcctaatgatgtgatagaaaagaaaatcccattttctgagaagaaattcaagcgggcggcagaaatttgcagtagtaacaaggaacacaataggggaaatgtctccagggcctgtcagaggtcttcacagcaggcccttataccacaggcctggaagactaggagaaaatggtttcatgggcagggctcaaagtccccctgctgtgtgcagccagggacctgatgccctgcttccaagccactccagccatgggtgaaaggggccaatttagagcttgagctgtggcttcagagggtgcaggccctgagccttggcagtttccacgtggtgttgagcctgcaagtgtacagaagtcaagaattgagttttgggaacctctgcctagatttcagaaaatatatggaaatgcctggatgtccaggcagaagtttgctgcaggggcctggccctcatggagaacctctcctagggcagtgcagaagggaaatgtggggttgaagtccctacacagagtccctattggggcactgcctagtagagctgtgagaaaagggccactgtcctccagaccccagaatggtagatccactgacagcttgcacagttcacctggaaaagctgcagacactcaataccagcccatgaaagcagctgggaatgagactgtagcctgcaaagccacagggatggagcttcccaagaccatgggaactcacctcttccatcagtgtgacctggatgtgagacatggatttaaaggagatgattttggagctttaaggtttgactgccccctggatttccaacttacatggggcctgtagcccctttgcttcggcaaatttctcccatttggaatggctgtattttcccaacgactgtatctgcattgtatctaggaagtaagtaacttgcttttgattttacaggctcataggcagaaggcccttgccttgtctaggataagactctggactgtggacttttgagttaatgctgaaatgagactctgggggactctcgggaaggcatatttggttttgaaatgtggaaatatgagatttgggaagtggaatggtatgatttggctgtgtccccacccaaatctcatcttgaagctcccatagttcccacgtgttttgggagggagctggtgggagatgattgaatcatgggggcagatctttcccgtactgttctcatgatagtgaatgggtctcacgagatctgatggttttaaaaatggaagtttgcctgcacaaactctctctttgcctgctgccatccacataagatgtgacgtgctcctccttgccttccaccacaattatgagacttcctcagccatgtggaactgtgagttttccattaaacttctttcgtttgttaattgtccagtcttgggtatgtctttatcagcagtgtgaaaatggactaatacagccaggttttggcagaaacaaacattaacttattttagcaatgttgatgtttgtcaggtagacatttaagtgggctgggattgttaacctgggacacagccttgaactgttaaaaagctgtgctagaatttgttcaagtctcttagtgtgggacatgcacaaaatcatttatgctgagaatctgcagttctcacaggccaaggttaagtcccagtcaataaaaatgctcggaggagcctgactaaagtctggtcaaggagagagtctttgccataagaaacttaataataactaatatctctaggctactatttgtcatgcaatgagctagtatttgcagctttttcttatttaattctcatatttcctcttgaggaatatactaggattactgcctttatttgaaatgtgtaacaggctaagtaattttttcatgaattaatgctgtcctcatttatttaaactgtattttcataagttagcactagatacaggaaccaagggaacaggtgtagaagtcccaagaaactgaatgtgtgggcaaagcaaagaatggctaaacacacaacatccactgagttaccatgcacgagaagaagcaggaagatgtaggtcccctgttggccttatattcttcccacataaattatagattaacatatttcctgattttttgaagtttccagagatttaccaacttgatctttcatgtgactttctcttattctggattttcagtgacttttcctctcactttattgtctctaaaatcacagaaaccctgtttaccacaattattttcttaaatttatttctacaggtctttagttaaaaggtacagggaagcagacaaaccttaaacttgataatacgtgggaaataatgttactggtatcttagaagtcatgccagtaattcgtctaaatttaagcatcaattgaaatacggatgcaaaattattatacgtgattaattactttaggtctttcatcagtttatggtagagtaaccaaattgcccttgatgcctctcatgtgtcaagtattgttttgggtgcaaaggatagatcaataatatgacatggttcttgagtcagtttggttatgactggagttggtgagaatgttagactcacattcatgagtggatttgataaatacaatgtggctgacatgatgtctgctctcaccaagacttccatttcagttctttgatttctcctttgctttcgttaggaatggcctatatttggtacaccaaaaatttacactaattagtgagcacttctcctactttaaaagagaagctcaaacaggaaagaatacacacacacacacaatttttttggtatgagattcaaaattcctagaaagcttatgacaaaattatcaaatttgttgaattctcaaaattgctaaatttctgaataatgttcatctagctacagtacttattattccaccggaagaaagcatatgcttcaacacaaaaaaaaaatttgagtgcaaaactattaagtaaaactctgagaaaacatcatttttgtacttggcaataaggcaattacttaaaaaaagttagctaatatttgtgagtgttacatttaattaaacattaaagaactttatagaagtatttttaaaaaggaagaaaggaagaaatgtaataacccagaattcaagagaagataagcaaaatgttatttgacagaatccagaagcacatgaaaaagttaattcaccatgatcaagaaggctatattcctgggaagcaaagttggttcaacatacgcaaatcaataaatttgattcacctcatacacaaaacaaaactgaataaccatatcattatttcaacagactcagataaatcttttcataaaattcgacatctctttatgataaaaacctacaacaaactaggcattaaacatacctcaaaatgataggaaccatgtgtgacaaacctagagcaaaatcatactgaatggacaaaatctggaagcataccccttgggaactggagcaagacaataatgcccactttcaccattcctattcaacatagtactggaagtcctagacagagcaatcaggcaaaagaaaaaaatacaaggcatctaaataggaaaaaaggcagtcaaattaactctctttggtgctgatataattctgtacctagaaaactgtaaagactctttgaaaaggcccctagaattgattagcaactgcagtaaagtttcaggatccaaaatccacatacaaaaatcagtagcatttctatacaccaataatgttcaagttgggagccaaattaagatcaaaaacccatttacaatagccacaaaaaaaattaagtaggaatgcatccaacaaaggagatgaaagatttctagaaggagaattacaaaatactgctgaatgaaatcatagatgaaacaaatgggaaaatgttccatgctcatgaactggatctaccgactacgtttttcccagaactagaagaaagtcttctaaaattcatatggaactagaaaagagcttgaatagctaaagcaatactaagtgaagagaagaaagctggaggcatcacattacctgttttcaaattgtatataaggctactttaactaaaacagcatggtattgtcacaaaaacaaacacatagaacaatgaaacagaatagaaaacagaaataaggctgcttacttacaaccatttgatcttcaacagactcgacaaaaattagcaatggagaaaggactttctattcaataaatggtgctagtttaactggctagccatatgcagaagaatgaaactgcacccttgcctttcatcgcaggcaaaaattgtcttaagatgaatataagacctaaaactataaaagtgctagaagaaaacctaggacatggcattctggacatcagccttggctaagaatttatgagtaagtcctcaaaagtaattgcaaaaacaaaaattacaaaaaataaaaattgacagttgggaccctaaagagcttctgtacctcaaaataaactatcaacagagtaaacagataacctatggaatggaaggaaatattcataaattatgcaacttacagaagtctaatatccggagcctctaaggaacttaaacaattcaaaagtgaaaaaacaaataagctcattgaaaagtgagcagaggacatgaagagacagttctcaaaggaagacttacaagcagccaacaaacaaatgacaaaccctctacatcactaagtatcagagaaatacaaatcaaagcaaatatgagatactgtctcacaccaatcggaatgctattattaaaaagtcaaaaaataacagatgttgatgatatactttgaatatatgtccctacaatatctcatgtaaaattgtaatccccgatgttggaggtgggacctgcttggaggtgtgtttgggttatggaggctgattcctcatggcttggtgctgtcctcatgacagtgagtgagttctcatgagatctgatcatttatcatttaaaatgtgtggcacttccccacctctctcttgcttccactctgccacgtgagagccttgctccagctttacctttcacctgaggcctccctagaagctgagtagatgctggtgctgtgcttcctgtacagcctgcagaacaattagccaattcaatctcttttttaaaaaaattacccaatgtcaggtatttatttatagtaatacaagaacagcctaacacagttgctgaggctgtggagaaaagggaatggttatacactctaggtttgaatgtaaattagttcagcctctgtggaaagcagtttggagatttcccaaagaactcagaactaccgttagacccagcatttacgtgactagggatacacactaaggaaaataaatcatcctacaaaaaagggacacattactttgtgtgttccatcatagcactatgcacaaaagccaagtgtattagtctgttttcacactgctataaagtactgcctgagactgggtaatttataaatgaaaaaggtttaattaactcacaattcagcatagctggggaggcttcaggaaacttacaattatggtagaagacaaatgggaagcgaggcacctttttcataaggaggcaggaaggagaatgaactcaggaggaaccaccatacacttataaaaccatcaggtctcatgagaactcacacacttcgcgagaacagcataggggaaaccgcccccgtgattcaactaccttcacctggtctctcccttgacacgtggggattaaaaggattacaattcaaaatgagattttggatggggacacagccaaaccttatcatcaagacatggaatcaacctaagtgtccatagattggataaagaaaatgtagtacatatacaccatggaatactacacagccataaaacaagaatgaaatcatgtcccttacagcaacatggatgcagctggagaccattatcctaagaaaattaacacaggaagagaaaaaccaaatactacatgttctcacttataagtgggagttaattattgggtacacatggacataaatatgggaacactagcactgggaactactacagagggaagagtaggagtgggtcaaggtctgaaaaaatacctgctaggtactatgctcactatctaagtgatgggatcaatcataccccaaaactcagtgtcacacaatataccatgcacatgtgccccctgaatctaaaataacagttgaaagcataaaacataaaataaaataaatcttcgattggcatgataaatgttaaaaattaaacatcaagggaaactgtgtgagaaacatatggggatactctgtattaccttggcaacatttcagcaaatttaaatttatttcaaaataaaaattcatattaaaattacccctgctaaaattttaattaacaatatttataactttaaaaaggaaattaaatgtgtttcaagaataaggggacactgacatcctccttcttccattctgaagaagatcataaaacataagcacctgcacctgccccaagactggatcaaaaggtgaacacacagatctattaatcactcatctaaaattctcaaacgctaagatattccatagactctaaagtcagacctgaatactacctcaaaggacttgaacaagaagttccaagaaaaaaatagcaacagtagttttaggaggaaatgtgcataattaataggtcaacaaggataggtaagagacagatagcctgaattcccactaatgggaatattaaaaagaaacaatgaaagaaaagtatatacttacctgtacaaatgaaattgtaaactaaagagaattccagtttagcagattaaagctgaagtcttgactcaaatttccatttggtctaaaaccataatggaatacggagactgaaaaaaagcccaagtaaatgagacacatttctgtggaaggagttaaatgattttatttttttcaacagagtaacctgaagaagggagcctgcataatcctgaaggtcagggagcaaattaaagagtaaaggggcatccactggagattttcttctgaatgccttgggttttaagcatatccttttgtgagatgcaagggatgttgggttgtaggcagagctagaaatctttcccttcttattttctagttcttttcagaagttgccctaatcatttagaaaggagatttgcatgaacctgaaagttgcagagtttgctttgtaaagaataagaaacactagtgtcaaagatcaaataaagaaggctggttgctttacccgttattcaggcagagaaggaaaatagtgaactgtgtggaccatgtctaggttcaaggaggagacaggtgaaagcccagagtacctaacagtggagaatttctggacactggaggaaaaaaggtttgatgtgaagaagattcaaaaagtaaaatgaaaaagaaacagtgtaaatatgtcctccccacacaaacactggctcactgagggaaatgggagtcttcgtaatctccaaggtttcagaaaatataaagtatctacctgtaaatcaattacgccccaacccaatgctaatgaatgtactttctatggagagatctctctgcaataaccatggagaactgaaaaactaaacctaaatcataagaagagtttaggcacatattaggagtgttttagagaaaatgtcttctgacagcatggttgtacacaaatcagccagaacttttcatgaccccatgcattagctgatatgccaagatgcccatgcaccagccatgaatctccttctggccactggagccaatccttatcttcataaataccttccattactttcaggtttcttgtgtccatagccaaatgactgaattaaactctgaaaaacttgtattaggagcaaccttgattcttaccaaaaacaatactgcatttcaagaagatgaaactttttatatggtaaattataaaatcttgcactgctttctatacttgtatcaggagcacccttgattcttaccaaaaacaatactgcatttcaagaggatgaaactttttataaggtaaattataaaatattgcactgctttctatacttataaatattttgcatatgtcattatagcaaataacaatttttagaaataattaaagtctcaaagtgttcctttcttgaagtcagcagcagttacaatttgttgtaactagaaaaactgaataatattttattcattttaattattggaggtcatataagtctctggacttactgtattttatctaaaacatgtattttcattttggaaatggagaattatttctttattaatctaagcatgtctatgcttttagaatatgaggcaggctctgcaattttcttacaagacgctaaaggaatggaaagcaaaatcaacaaaaggaaaagagactgagaaaaaaattatacatattgtttataagtttggtgataacaagagttacttttaaagatgcttgcgcgtatacactatcttccaactgtttcagatgtaaatatattaaaacaagcattttaacctcagataaataaaaaagacacatagttaggcatcttcacaattataaactgctgcttattcttatccatgctcctaaaatgccttataatatctgctgtcactgccttggattataagcccaaaacagaattttctttttttaatagataatattataaaggtgattttctaagtgtacacggcctctttaggaagatagcagtaaggctcagatgtatgatttatagagcagagcttttaagccataaactcatcattgatgtcttacagccagatttaattaccttcctgaattttgattattttttccttgctttaaacagatcacacataaaagtatgcctacgtgatatatagtttttcttgtttttgaaatgtatacaaatagtctcctataaataaataaataaataaataaataaataatttattcattcctggacttgctttcttgactcagtcaagtcaaagctaaaatgaaagcaattattttagagacctatgtaaaatacatgcttatttagctgagatttgcttcaaaaactcgagtaaaacaaagagctccatgtaaaaatggtgacattcgtgtttaattttccttaattcatctcatatatgtatatatatatatgcacacacataatttcatacactgtgtaattttacaatctgtactgtcaccaaaatttacctattttatcttgtattctaccagagttctattacatggaaattgtgaagttcacagtaatataactactctaagttgttaatcacatataatacattaagcattgtgttgggtaattggcattcttttatctcttttaatttaatgaaaattgtattagttaggataggcaataatgtgttatggtaacaaatataaaacatcagaagcctaaaataagaaaaattatatattgttattcactctcaatgtccaaattgttctgctattatactcactcaaggatgtaggttgacagagctaataatgacacactcaaaagagggaagaaaaacatcataaatgatacactggatcttatatttatcattcagaggtgacctccacgagttcacttttaatcacaaatattatggtcatatatcacttgaaaaacaaaaacacagaagtataatcctgtcatgtgtctgcaaagaaaacgagaaatatttggtaacaggaataatgactaacctctctcaaaaaaaaattacaagacagccactatcatcatttgtgaagtaaagaaacagaagctcaaaaaagtaagtaacgttaataattgacatgaagtcattaatccagtaatactaaaaactgaatactaatccatttctaaaacctttattttttcctagtattaatattttaattggaacttaaaggtaaaacattagactaatcatcaacagtttatgatgcaccatcaccattagcaaataaatggcgcttttcttaatggtatttatttgtacagtgcaatgaatattaaaaatttgcttaaaccaagaattagagtattaccaactatattcatctgcatgtctctattctcccattcccctgtctctttaccctcagagataatcactttcccataggccagacaagagccaatcttgtaagcagatgtttctaagtgcagcagtctcaggtctcttttctgcatactgtaaaactaaattgtatttaatttgcatatatcacattttccttcctaatatgaatttataaatgtcatgaatgatgttgacaaaccatgaaacaatttcatataaatacattttctagaagccacatataatagcaaatgaagtggatttaagattttaggttaggtctctgaaatgtacaaacagaaagaaggggaaagagcagaattgaaagaagaacatgggcaggaggtcacgtcaccagcatagcattcccagtcagctttctagagctaatgactgatatgacagaagaggcaaacaatcccaaatctataaaatataacattgttaaattctttatttttataacttataaataagaacattaatttccaatataccattgccctattattttccagtactagaaaacacaacaaaattttcaaatgatttacacaacgtcatatcaaggcaaactatagccatattgagacatactcatgatgtaatataagtaaacaagatgtcagtaagttgtgattctcccaagtatataaaagcctttcaaacttttatggcatagcgtaccttctttccttttttgagctaaaattttctactctgtatcactatatctattcctctgtctgtcctactcctagtcaagactcaactaagaatcaatcttcaaaaaaaaaaaaaaaacaattcagggaggctagctgaagaatgatttagttacctattttgagctcccatcatcttcttggaacactattttgatagatatatgagttttcttgtcagtatccctcactatgctgtaaaatctataagagaggtgttagttttctatcactatggtaacaatcaccacagacttaaaataacactaatttgttaccttatagttctgtgagtcatcagtctcattagcctaaaatcgaggtgtggacaggactatatcccttctgtaggtcaaaaggaaaatccatttatttgtctgctccggcttctggagacagccctgttccttgactcatggttcttcttcaattttatcagttaataacagttaattgagtaccactcacaacacgcacttattccatagtcacatttccctcagactttgagcttatctgctttactctttcattttcaaggactctaattattgtattgagctttcctgtatattccaaaataatcttttcaggtcagctgactggtgaattttatcttcaataaattctcatttgctatgtaatgtaacatatttgcgagttccagaaattaggacatagaaataattggggagttattattctgtttatcccaaggggcataaaaattatccagtgtttttaatgagctcaataaatatggtatttatcaatctgaaacaatcaagtttcagaacatgtctgaatctatttggtactgtggacagcatgagcaatattaaatgttagaacatctgaaacagatgaagaccttttatgtggacaatactcagatctacttgactaattagtacagtctcttaaaataattcctttagattaattccttcagataacagatgaggaaattgtatcccagacagacaccgtgattttctctatgtccttcatggaaacagggagactccccctccaccctgtgtcacattttgtaactcgcacaacataaaagatctgcttgaaccctgatgactgatggtctcatgaaaaaaaagatctttattttcagctttttgtaactatgtattttagacatatacattatgagactggattggggtaccaatctcagagagaaagtatgtattttacctttacatttttttatttgattacaatctagtaaacaagttaaagaaagaaacccatggcctcccaaataattgacagacatttacaattaagattattctttcaaaattcaagttttgaatttgaggtaagaaatatcccttcagaaatctcccacatttttgctgtatctacagtatatctcattatactcagttaagtcattcagtaataactaaaatcctaaagtacttcgccaaaaatttaaccagataaaaacaattttaaaaagtagctaatgaatttaagatagtgcctggcttccattttttacacttgtcaactagcctatcttttattatttaatttttatttatttctcaaagaactaaagtagatctaccatttgatccagcaattccactactaggtatctactcaaagaaaaagaaatcattatataaaaaagacacatacacatgcgcatttatttgcaacacaattcacgactgcaaagatatggaatcaatctaagtgtccaccaaccaatgagcggataaagaaaacatggtatatagacaccacggaacaccgctcagctataaaaaataacgaaattatgtttttttttgcagcaacttggatggaactggaggccattattctaagtgaagtaagtcaggaatataaaactaaatacttcaagttctcacttgtaagtggaagctaaactatgggtacacaatgatatacagagtgatataataaacaatatcctaccttaacaagccactgtccctttaattttatctcctgtatcccgtaaaaaggacgtaaaattcacaggtgagtactattcttaatgtctccaaaattaatagctgtgcttgatgttttcttatagaattgaaattccaaatatatgcttataaataaacgataaatccaaatttgttacattgtacacatgttgccactttgaaagttaatattattttcaacttccaaagtttgtaataatattttaagagattcagacaaacatgacctcagaagaatctatgaggaggcatacatattctttagccctagatatataaaatcttatttggtcagagagttaagagttataaagtatttcttggagccgagtctaaatttcttcattttgttacattaaaaggcaaaaaaaaaggtctcagaagtttaagtttttgagagaaaactacattctaaaattcatgtttgaggattatttctccataatttgacttaaaatggttattttaataaattaaatacaagatactaatgccaaatgataaggcaatagaacagttacatatttgacatcactacaaagatattcaatacattgagttgtttataatagtgaataaagtagccaaaaactaataaataggagtattcctctgagagtctggtaacatatactgtaaaatccgcaaaatgtatatgggaacaccaccaaaagaaacatgattaatgttgatgattctgaggttttcaaatagattcgtgtgtatctgcagccacccaaccacacattaaccctgtcacctgaaactatcactatttaacaaaaaagactaatgaaacaatgtactttcctgatatatggcactgaataaaatatacctagtgattatagatagatttttaaaagctggtcatggtggtgcatgcctgtagtccagctgatctggaggctgaggaaggaagatcacttgagcccaggaggtcaaagctgtagtgcatcacggtcatacctgtgaatagcactgcactccagcctggcaacatagcaagaccctgtctctaaataaataaataaaaaccagttagaaaacaaaatgagaaaattgagaaaaataatttatagttaatgttgcttccatctgaatgtgtaatttgataataaagttattttgcatatttaaacataatttctttaacaggaaaacagaaataaaatcagaaaaaatgtaaaaattggaaattttctgccttcctgataatttttttttttttagaaaatcagggcaaaacatttaggaatacttactattattgcaaaaatttaatatcatgggttcaaagacacttgagatatataagtatgtacctttaatacttttctatttgttaaatatagcttagtaaaataaatgaactaataaaattcctaaatgttttactgaacaatgatttttttccttgatgtttagatgaaataatataatacctacaaaaagatactaagtgatgtcaccctgcgtagcttgaataaggacatttactgaaacatttttatgaaaaataaacatatttgattacataatttatataccttttccctccagatgtttccttttttccttccttattcttgaaattacttataaatgacaggaattttatatgagttctaaaatcagaataagaggaagagtggaagaattagaaaaagaaaaaaaaaatgccagttgtgcacttcttcacgatgcctttttaagagtcttagtgacatattaaaaagtacaaacaggccaggctcagtggctcaagcctgtaaccccagcactttgggaggctgaggtaggtggatcacttgaggtcaggagttggagaccagcctggctgacatggtgaaatctcatctctactaaaaatacaaaaattagccgagcatggtgatgtgtgcctgtaatcccagctactcaggaggctgaggcaggagaataacttgaacccaggaggcggaggttgtggtaagccgagatggtgccactgcactccagcctgggcgatagagccatttctgtctcaacaaaatgaatataataaaaattaaaatttttttaaaagtacaaacataatttagaaataaagttttgtgtgtgtgtacgtgtaaataaagcttttctaagaacatcatcataaaacaattgcatttgttttcatgaagaatccaagaaatgcacaaaataatcacttctataaatgcttatcttgaccacaatcaccacttattcagttatcttgatcacaatcaccacttattcaggaacagataagagatacaaatttttaagatctagatccagtagttattgaattaactactttctttctcaaagttttcctacaactaaactgatgatctcccttctaaatgtagcccctttaggatgtttatattagtgaatggccctattctaccttattacataccacttttcctccctttattccacttccactccccatttgcaataaatcatacacaggtacacatatgcaaacaccacacacacacacacacacacacactgctgtgtgtatctgtgtgcatgcacatttttctttatctatttttcaatctcttcacttgtctctagctccacttccacctgcttaaactactattatctctccgttggactatattgctaactgtttatttcacctctgatgttagttttcttcagtctttacacaaatccactctcttcactatagcgagtgatctgttttagaataaattgaatcatgatgttactatttctgcccccttcccctgcccccactggtcctgttccagctttaaaaactttaatggtttcacttagaatgaagactaaaattattatcattggctaacaaaccttggtctctacatacctcctcagtttcatcagcatttgatttacattggcctttattcatattgctatagtctgaatattttaactccccccacccataattcatatgttaaaatataaccccccaacgtgatggtataaggaggtgggctctttgggagataattaggtcatgagaccacagcccttatgagtgggattaatgccttataagaggccccgagagctgtctgtgccttctgtcatgtgagagcacagagaaaagaccactgtcaatgaatcaggaagtaggccatcaccaaacatcaaatttgctagcacctcgaacttagatttaccagcctccagaactatgaacaataattttttgttccttataagcagtttaaagtgttatgtttatagcaactgtctatatcaatttatagtgctatgttatagcaacctaaatggactaagacaagacacttgatctcacctcgcttacttctggtcatggaggcttatatattattccctccatttagaataaactccttgccccattatctttcatagtatctagcagatagtagagaccttaaaaaatacgttgaaagactaaataattaaatgaactgtcaccaaaagcaatgaatatatcagcatattatatgtgcattatcagctatgcaatgaattacagaaaattctgtttctcttactaaagacattatgactattccataccccaaatgatctattaggtcagtttagaggttacagtttattttacattgttttttataccttatatagttattgaaaatttattgaatataaataaaaggacaaaagttttacatttggtaataaatgcccaaaatataatttatataaaaagtatcagtctttattaaaatgactttgacccaagtttattctttataaacgtctgttgtaactctccaatgtaaagaaggcaaattggtgataaaattagttttgttttattttttgggacagaatctcgctctctgtcccaggctggagtgcaatggcacagtcttggcttcctgaaacctccgcctcctgggctcaagcgattctcctgcctcagcctcccgagtagctgggattacaggtgcctgccagcacgcccagctaatttttttgtacttttagtagagatggggtttcaccatgttggccaggctggtctcaaactcctgacctcaggtaatctgcccaccttggcctcccaaagtgctgggattacaggtgtgagccaccacacccagccataaagtttgatgaacctactctgacatatgttttttcatttattttagaagagtctcctcaaatgactttttatattaaacctgttcaaaacgatttctaaacctcaactctgaaaggatgctcaccaaatacttaaatgcacttcagaagtgaaagcaaagatatgttttcttcctacttgcatataatgaaagttaataatagaatcttattgataagtataatttgctaatacattcaaacacatgtgttgtcaaagttggtatacatatagtactgtgaaaggagagtctattttgatattttcccaggatagattatcattttgccttttgtacacacttttctgttgctctcatatgaccttaattgtttaaaaagtgttacttttttaaaaaatacatacttttgttctctgttagagcaatatgtatttggtatagattcagaaaaatatttgatatagattcagaaaaatattccatttgaaatctgggcttttaaatcacataaacatataatactagatgggtttcagttattttcttttttttttttttggcttagctctggttcattttttttaaaattttattttattattattatactttaagttttagggtacatgtgcacaatgtgcaggttagttacatatgtatacatgtgccatgctggtgtgctgcacccattaactcgtcacttagcattaggtatatctcctaatgctaaccctcccccctccccccaccccacaacagtccccagagtgtgatgttccccttcctgtgtccatgtgttctcattgttcaattcccacctatgagtgagaacatgtggtgtttggttttttgtccttgcgaaagtttactgggaatgatgatttccaatttcatccatgtccctacaaaggacatgaactcatcatttttttatggctgcatagtattccacggtgtatatgtgccacattttcttaatcctaacatacttttatatagtcaacaaatagatgaatttttaaaaattaatgccttagaagatgtaaagcatattcagtaagctttgaaaataactgaaacccaaatgtcctacaatcatagactgggttccagttattttcaaagcttactgaatatgcttttcatcttctaaggcattaatttttaaaaattcatctatttgttgactgtataaaagtatgttaggaatctttaacttgcaacatgtcatattacaatatattcactcaaggtcaacaaagagtatttattcttagttgactccttctggtattaagaacatggttgaacattttctgttttcaaagtactttatcttaagcttccagttacttgtcttagcaattccatcattggccagtcattcattctattgaacgtctctaatgacgggataaggctagaaaaaaagattcagaataacagtttctttgcaaagatttttcataatgtatcttttaacattgtattatggtttcaatatttgcatctcactccaaaatttatgttgaaacttaaacatcaatgcaacaacattaagaggttgggcccttaggaggtgattatgtcatgagggctgtgcactctgtaccttatagaagggctgaagggaactaactaggcccttttgcccttctgctatgtgagaacacagcattcgtcttctccaaaggatgcggcaacaggcaccatctttgaaacagaggccaggtcctcaccagacaatgaacttaccagtgccttgatctttgacttccagcctccagaacagtgagaaatacattatgttatctataaattacccagtttctgtttttgttgtggcaggatgactagggcatgtaaatattggtattatactcagaaaactcttagatacaaaattttcagtaaatgaaagatgcatttcttgctattttaaaatttgtaggttggcatgtctgtgtatttttcctttatacctaggaatgaagcagttgatatgcaaaaattattgggatttttggaatttaaattagctagccggtggtagagagatgacaagagtttagcaactgctgagagagacagagagagagagagaaatggtaaatagaaaagtgagaatagaagagacttgaatgaaacctattacaagaaaatgaagaatggagatagaataacacccacacacgaatgaaaaatagtaaaagcatttataagaaggaatttaagaaaatagacaaaaagttgtaggagatagagaaaattaaaaaaaataaaagtacagataccaagtggttgctgagttcctattatttgccagatactttaataaaatgcaacagagaaaatcaaagacaagatggacagaaatttgtaagaagaattgtagcacacagaatgaagtatgtagaaagtattatgagtgttctaagaaagaagtggccaatatattgtgcaggtttgtgtatgtttgcatgtgtgtgtaaatgtttttagacaaagaaaacattaaggaatattgattaatgatgaagaaacattaaatatgctttaaattgaaaatattattataacatactaacatatatttatcatttcttatatgccagaaatatactacacaattttcttgcataacattagttaatcctaacagtaatctaatgagaaagttactattattcttgattatggatagagatcagagccttagagaccactcatcaaaaatcatacattaatattttcaggatttgaaaatgttttatctgatttctaagctcatgctcttaactactatgccttaaatatttattttatattcacacactacatgttttatcgcatgttaatcctctgtttctcttttctttgtttatatgaaactataagatttgaatcatagttcctcaaaactatttcattcttaaaatctttttgtaatctattgcaggtgacacagactattactacactcccactttcgcagtataaataacattctttcaactgcagcctggactcagtgtaaaacactgtattcagaatacaaaactcacgtaaatgaaaggctgactttcacagaaccaactgcaggacttgagtatatatggattttggtacctatggtaggtcctggaaccaagccccaaggatattgagggacaactgtatttttatccccagaacttagcacaaaactgtcatatggtaaatttaatgaatatattttggagaaatagacatataataatattttatcacaacttccatcattttcctaaagttccagggggcggggcccacatcattgtacttttgtgattcctacaccacttattactaaggtattaaaatacaatgattaagagtgtggcagcatgatagggattgtattggatcagtagggcagtattaacaatattgagtcttccagtctgtgaacataggatgtctttccacttgttttcattaatttctttcagaaattatttttaatttttaatgcactaatcatcagaggaatgctgatacaaatgcaaaaatgatatatcacctcatgcttactaggatgaccattataaaaaacaaagcaaaaacaaaagacaagtgttggcaaggatgtggagaaactggaactcctatacatgatgggaatacaatatggtgcagctgctatggaaaactgaaaaacaagttctttaataaactgaaaatagaactacaatatgatccatgaatcctacttctaggtattcatccaaaataactgaaatcaggatcttaaagaaatattagcactaccatgttactgcagcactattcacaacaaccaaggtgcggagacaacctaacttttcattgacagatgaatacataaagagaatgcagtatatacatacagtggaatagtattcagtcttaaagggcggaaagaaaatcctgcaatatttgacaacatggataaactttgaagacattatgctaaggaaaataagccagtcacagagaacaaatactgcatactgcatgataccaatcctacaaagtatctaaagtagtgaaactcacagaagcaaagaatagactggtgccaggggaaagaatagaatggtgccaggggttggagagtgggagaagtgagaatatgctaaacaacatgtgtagatatttagttatgaaagataaaaattctagaaacctgatgaataacattatggtataaagataacaaatacagtattgttaaaaactttaaaatatttttaaaaggtagaacctctacttgactcttcttgcaaaaataaaaaaaggatttggcagcatgagccaggtgcctgagccatctttatggctgttagatgtaggatttgtgtgaaattaagcaagatagcttgaaattttaaccttctgtttccacatctgaaaaacaggaataataataaaattcagcttgtgaaatttttgtaatgattaaatagattaaataagatagtatatacttgattgaccattgatttcttcttcctttgccagaaatctggctcaccccagaaaatgctatttttctgtagccctctcactagtggtgaatgtttttatcatattcttccacaactaggacctgagttgggataggtcctgtttcttactccttcttccctattaccactgccctcttgcttaaaaacaaacaaaacaaataaaaaacacttggtatcatatcatcaaactgcctatatttcctcttcctccattctctcttgagccctctccaaactcagtttccttttcaaggttaggaaagtttggaaagagtttcaattattctttaaatttccaatattttaattcaaactggtatttttgtcaaactatatttattacatattaattccaaggggttcctctgataatctaaagtaaaatgtattctaagaaagagaaaattagaaggaatgttgtccagtgaactattgacactgcacccaacccagtacatgaaatgtgtattcatcactgacaacttgtggaattcattaaacaggacagcagcagtgcctttctccagtcagtgtaaatgtagtttttgagaggaggacaccaaaaatgtgacatttgaagacagccatgatttgattatgtgttttcttgttgctttggattgttatctgtctctatccaacataaaacaaaatccgcaaagatgagattttcatctgttttgttgtctgctatatacacaacaggtagaacagggttgggcacctagtagccccttaaaaataaagctatgcaattttgtataaagctatgtaattttgtgtaacttaaatgtaataatacattattaagtgtgttatctataaaatacaatgtgtgtggatgaaggtatatggtataaatacagagaagagtatttctaaggtgtttggcacttacaaataccacaaacgctagttgttattagaaacctgatgttagcataacaggtattacataatgcttgctatacttgaatgaatgaatgaaaatactcagcataaagcattattaatatttgtttataatgatatatatttttttcctggggagatatcatcagaattgcattccatgaatccagcagatcatgtgtggacaaatctttgatacaaccacataaaatattgatgactgtgttaacaatgttcttttaaaacattatctaagtctaagccttaacagatctcatcagtattccaattgttcaatgaagaaacatattaaatgcaaactagctgaacagtcttcactgagcatttagcggggcagcccttaggggcagtataggatcttacaagagtagggaacattaacagcatgaactgggccactgatgtcaggaacagccactgcattatgatccactagcgttataaacaaatactcagaaaggcagctaataatccgacatgagcaaagaagagaggaaatacctgaagaaagcatgaattcatagtttgagttttctacaaatacttttctaaataatacacaatcatgggataaatactaatttgatctgtaataaattacatatatgaaatataacaaaaatactcaacataaagcgtaaagaattattaatatttgcttataatgctctaatttttcctggggagatatcatcagaattgcattccgtgaatccagaagaccatgtgtggacaaatcttgcatacaaccacataaaatattgatgactgtattaacaatgttctttttaaacattatctatgcctaagctgaagagctctcatcagtattccaatttttcaatgaagaacaatatatatgtaatctataattacacatatatgagagattcagttagtgataacccatgatgtgataaattacacatatacatgtgtgtgtatgtgtgtgtgtgagtaaatttttagagattcacttagtattttgtctacacatataatttacctagatttcttgttttcctaacaggatgcaaaaaaggtacactgtggggtgggtaatatctccttactaaatatttattgactgattttgtccccacgtcattgaccagtgtcatataaatcaaactctcattacctatttttgaattgttgtttgaactccagctactatcctcaaagctcaccaacttgcccttctagctgacgcattttatgtctcaatctactttttattcaatgcttatttatttcattaatcacaaattgggtcattctgccaagtcctgaggaaaatataagtaactgagactgtctctgttcaggattttataatctaaccatgaaaacaagcattacatgacatattataaagggaaagatggacattaattttgattgggtgtcatcagtactaacattggagaacaataaataaattagtatcagtaataagtagaattttagtaaaatctagaacaataaacttttgttaaaattttacattataaaatcacaggacagcatgtggctatcgcatttcaagctgagataacagatttgctctcagatttcccacataatagttgaaccacaatgagaaagcaacttgagttccctgtttctttatagttccctgatctctaaactaggcataataatagtaaaatactaataattattgttataatcacaaggaccctatggagtacttgtgaacattaaagaatataatctatataaatggcttaattaataaattctaaataaatgttggtggttactattagtgactgatgcttacacataaaatgactattgatatgattcataatttcaagagacttcttgagtggtgtattagtctgttctcacactgctaataaagacatacctgagactaggtaaaatatgaggaaagaagtttaatggacttacggttccacatggctggggaggcctcacaatcgtggtggaagagcaagtgacatcttccatggcagcagacaagggagagaatgactaccaagcaaaaggggtttccccttacaaaaccatcagatctcatgagacttattaactactgtgagaacagtactggggaaacagccaccatgattcaattatttcccaccagttccctcctagagcacatgggaattatgggagctaaaattcaagatgatatttgggtgaggacacagccaaaccatatcaagtaggtaggaattatgtgtatgaaataagtaggaacattacttaatgttatatgagaaggcactaaatacaatcagtggcaaaaaagtgaaccctacaagcaatcaatcaagaataacttctaggaaggagggagaaagagagagagaatgagtattgttgtaaactggagttccacaaaggaaattgagcttataaatgagccctggatagatggattacgagaaagaaaagggcaaagagagaggatacagtaagaaaagcaaaaagactttaaaacaatatagacagaaggaaataaaatttaacattccaataatggaaaagaatacaatgtgagtaaacaattggtgtatgttgagaaattctgggaaataatatgagtaggcaaagcaagaatatatcacaaagggccaagaaagcttagatgtggacacaatccagtagatagtggaagaaatgttaggagatacttgagaaaagtactgttttaggaaatagagattagcggttcactgttttattaaaaatagctgaaagacagaagctgagtcacttcaacttctgcagtaagcaaagccatagtatgcaaactggcctttaaatccatgggggaatgtattatctcactttcatggtgcacatctatcatgggtaggtgaaagcaagggaaggagagatccactccacctagtcactcaaagataagggctgactgaggcattaccttttacagctgaaccatctgtgatacatatcttcttaagttgttctggcagaagagcgagaaaatgaagaatttcacatagatttttgttgcatcagcccaacaataatacgtcatacttacttatatttcactgcccagagatagttatacagttctgcctaataggtgaatatttaaacaactcatcagaacaaactgaatatttgcaaaatataactgtttcctacaaatgcaatgtgacaaaggtgtaaaattatttatttatttcacaaatgcacatggaacaccaaatgtgaactaagatttcaatgacaaaaaaaaaaaaccacacctaccttcccagttcttatatgcaaggaatttaatgtctaattccaattttcattgaataatctagactaagctgtcctaggaaaagggagtaaatgtagatagaaaatgacatattcccttgtactgccccatttatctcatcagtcattctgctttaaaggaattatctggtcacattttatcttctattcacatctgctactttcaggacctttctttccctcctctttctttgagattttcagttgctgctctgccttgtcttctgtgtccattcttagctccaatcctgagactcagctggagtctcagaggcttgcatctgagcactctgcattgctcagtgactaaggcaactgaattagggcagggacacctggaatagctcagtcctccacagcaggtggggtctgataaaagccatatgcctaagaccctgcagtatcaaagaactaagactcgcaggcattcctaactggaatctatctctatttcagtgttatgggctagattgtgttccccaaaattcatatattcaacctctatcccctagtaactcagaatgtaactatatttggatatagggcttttgaagagataattaagttaaaatgaggctcttaaggtgaaacctgtaagaagatactaggacacaaggagagacatcacgggtgtgcctgtacagaagggcaacaatgtgaagaggcagcaagagggtagatatctgaaagccaaggagagaggactgaggcaaccagctcaactagtaccttgatcttggataattccagtctccagaagtgcttaaatttctgttgtttaagccacctagtctgtggtatttaattacggcattcctagtaaaaggacaacttttatctctgtttccaataaacatttcaatcccatggtaggaaaatgacaatctgcctaatctctgccacctcctaacaaaaatcttgttttattaagaatacaaacaaaacatattttatataattttcttataattttattaatgtctgatgtaccagaaaatgacacataggtattgtatgctttgccttatttgaactcatgataaccctatgagagaggtagtaccattttcctcattttataaacaagaacagatgacttagatcaagtaacttgactctgataacatataggttaagtaggagagctcattcatctaacacggttacctttcatgacaatgatgatgaaaacagctaacagagtatccacgtgaccattattcatctaaaccccttacattaaataattggacattcataatattcctataatgtaagtattcctactagccgtgtgttatagacaaggaaatttaagcaaagagatattgagtaatttactatagccacagagctacagagttttggagccaggattcagatctaggcagtccaaactgaaggtgtgtatttttaaccaccacattctactgcttctcaaagtttggagtaggtatattagcatctggtaatggctgttgaggatattttaaaacttaggtaatgacttctgctattgtatacttttagaaaactggattgggatcaaaactgtccagtacatgctattttgttacctttggattcttttaatacctaaccttgtgcgattggggtcatagcacagcatgtatgatcatcattgctgcaaacggatacacatcttaaaagtgccaactcagtgttattcaaatttttcctgaaatttccatatgcttctcaagttccttaacttgaaaactcaaaattcttcctgcaaacattttctgattatctctactccaaaatgttttaacagttagtcaattagttaattaaaattttaattggcaaataattgtgcacattacatattttggggtacaatgtgatgttctgatatacatttactttgtgattaaatatgctaatgcacaaatttatcacctcataaacttgtcattttatggtgaaaacattcagaatctattcttttagtaatgttgaaacacacaatgcaatattatttattattgtcaccattgtgtgcaatagatcactgaagcttattcctcctctaactgaaatgttataacttttgatcaacatctcctctttcccatttcattgctcactccacccaccagcttctggtaaccaccaaccacatccagtggacagcaagttaaataataggaagttagagaaagctgacagttacaaaggatatgatgttatttaattgttcagaatatacaaaatgtgtttattataggatacagccccttatggaaaaataaatgagagtggggaaatttcaaaatcagacaaaagtaaaaagtactatgttcaccagaagatggagaagtctgataggaagacactcagaaaaggtcagtaaaaaacctctgagaaaaagaaagttgcaggaaaggtaaatcaataatgctgtttgctgaaatgctacaaaattatagtacttgtctaaggaagtagttactggaagccatagagagtgcactttcagtatagttacaagaaaaaccaaattgcagagcttaagggaattggtgaagaactggtagcaacagatacaaagatttgacagaacatctaactaaagaaaaactctattatgaattgtataagtcattgatgactcagagccaagcaagtttataattacatttttgctcaacttcgatttctatgaagaacatttaaaatgagttctgctttttcatacaattagaatgtgggcatttttcaatcgttctaaaattttcagattattagaaccacaaagacaagcatccaccttaccggatattattgattttatatgcattgcctggactctgaattagaccttttctttcttttccctgtctcagcaggacaaataagaacatctaggccaggagcggtggctcacgcctgaaatcccagtactttgggaggctgaggcgggcggatcacgaggtcaggagatcgagaccatcctagttaacacggtgaaaccccatctctactaaaaatacaaaaaattagccgggcgcggtggcgggagcctgtggtcctagctactcgggagcccgaggcaggagaatggcgtgaaccagggaggcggagcttgcagtgagccgagatcgcgccactgcactccagcctgggcacagagcgagactccgtcaaaaaaaaggaagggaggaagggaggaagggaaagaaagaaagaaagaaagagagagagagagagagagagagagagagagagagagagagagagacagagagagagacagagaaagagagaaagagagaaagaaagaaagaacatctgagcaccaatactgggatattgtaagttacctcagaaataacatccttgggtaaggggtgtgtgtgtggtggggtgtgtgtgtgtgtgtgtgtgtgtgtgtgtgtgtgtgtgtgtgttttagcagaaagagaatcttctaagtacaatgaaatgggcttctatttatcagtaccttttttcttctctctcttttagttctgttgctttccaggatatacacatggctttaacagagtctattactggaatacggagaagctattgaagtaatccttcaaggcataaggtcagaacttagagaagtcacagagtttgtatttctgaacctgattaccagaaaattcttctaaagcaggaaaagatatatgctttcaaactgttatcctacaaccaaatccattttggagacacaaggatccacaagattactcaccttcaggaaaacatgaagacaagaaatgctagtcttggtacaacctaatgaaaagacatagctgagatttcatatgaagataacattgagattgcttagaaaaaaattattggagttaacattgaaagtaacaatggtatttcttgtcatccctttctaaatggcatatatggtatgtaatctagaaatatgtacatatacatgtaatagcttacaaagcttccaataaaaaagacaaaatctctggattttgccatctaacgaaaacaatgtagttactattaaaacttgaatttaacttctcagaataaacatacagtcaaggtttttgtttatttctttgtttttccaacatggttgactgacttgggatgctagttctcggaaagatcaaagttacaggtgaatggtaatgatctgaatgaaacacagtcagatgagagccaggacctgtcagagaacccacaagaagaagctagggtacagaaaaagaaagcaggaagagtctggcagagattgacccccaaggaacttagagaccccaaaaaagtataggtgggggtgcttctctgttcccctcaccctggcaacaacctgctaaccatcgaattattagagagtccttctaccctcacaatcctgggcaatgatgtccgtggcaatttggaaaattcccaaagacagaaatccatgttgttaactcacacaggggtgcccacactcttctcaggcctgaactgagatgtcaagtgccgtactagttgtgtacacatagtgggccactgctgtgcctgtagaacctcagtcattgagtcaccacatcacaagatcccctgcaaacataccccataacctgctctgacatccacaatcaaagggaaacagagaggatccctgaggaactgtggatccctggtaatctagccctcagtgtgacctacccctggggaatgggggtgcacagacagccctccaaagcctgccttgagagaaaggaaatgtagtgtgacacagatcactgaagggagtggcaccggcagccgggaatggatatggagaggtagtcatcttctgctcctcccatctactcttgcagacacagcagaggctctaccagttaaaggccagcccttgtgaaattggtgtaaacttttccagtggttttcacaacagctacacctccattcaaagtaagcccctgccacagaggcttccatgaagagtaagacccatctctccccttctatacaaagaaatagcatcccagcaactgaaggcagacaagctacaaagttgtctgtcatgaacttggggaagaggatttgccctgagcccattttgttggtagctgccggaggggcatacccatggtctccagctgcactatggccaggagtcaaaggacaatgtatatttaaactgaaggtcatgagcaaaatgcaacagcggcatgatagggaagcagatcacattcctgtctgcccaggatgaggacctggtataggcctccaacgctcttccattgaaacattgccacagcccaacaggatctccaccagctacacctgtcagggtgggtgcctccagtcattactgagctaccagagaatgagcaggctcttatgcttaagtgccatcactggactggagagtaaaatagaatacctgttctcagaaaggcacagggctagtgaataagataagcttcctgagacctctgtactctcagcctcgcaggagatagtgtcagctgacacatctaacacatcaaaacaacaggcaacattcaagaaaaccaccatacaaagattacccacaatcaaggaacccataaagaactttggcacactgaaagcaccccaaaacaaagcatatcatacacatcataacataaatcacagtaatcctctaaaggaaaaataaatgatagaaaattcaaaaataagaagtgatatctcctttagatgagaaagaatcaatgcatgaactctagcagtacaaaaaggtagtagagtgttttgacatctctaaaggattgtacttgcactctaaccatagattctaaccaaaatgaaaatcctgaaatgacagataaagaattcaaaatacagagtgcaaggaatttcaatcagaaaaatgatgaaggatataaaaggcaaaatagctatattagaaaatagaacttcatgtattgaaaaagtaactaaaggaatttcaaaacatagttgaaagctttaacaatacactagaccattcagaagcctggtttttttgaattaaccctgtcacacaaatataaagaaaaaataatttttaaaaatgaacaaatccttcaagaaatattggataatggaaagcaaccaaacctatacttagaggaattcttgaggaaggagagaaagaaagaaacatgaaaaatataattgaggaaataattgaggaaaattttcctcatcttgtcagagaggaggacatccagatacaaacaatttagagaatatctgtaagatattatacaaatgaacattactaagtcataaatttatcagactatccaaggtcaatactaaagaaaaaaatcttaaacagtaagtatcaaactatctataaaatgtagtcccattagactaacagtggacttctcagcagcaaccttacaagccagaaggaattagaggtctattttgagccttcttaaagaaaataattttataataaatggcatccaaaatttttataacctactaaacttaatttcataaacaaagtagaaaaaaagtcattcccagacaagcaagtggtaagggaaattttcacccatagactggtccttcaaaaaatccttaaaggacttctaaacatgcaaatgaaaggacaatacttgctaccagaaaagcatatataagtacaaagttcacagatcccataaagcaattacacaattgaatatacaaagtatctagctaacaacaatatgacaggaataaaacctcacatgtcaatattaatcttgaatgaaaatggcctaaatgctccacataaaagatatcattttgcaaattggatgaaaaagcaagaccctaccatttgctgccttcaagggactgacctactgtgtaatgatatccacagccccaaagtaaagggtggagaatgatgtactacacaaatagaaaacaacaaagatcaggggtgctattcttgtatcagatgaaacagatattaaatcaagaaaggtaaaaaaaaagacaaagaaagatacaattcaacaagatttaactgtcctaaatatatgcacccaacaccatagcacccagattaataaaaacaactagacctaagaaaagaaacaagtcatacaataacagctgaagtatttaacaactattagttatataatctgtctggtgacagcaccagatagattatcaaggcaaaagaaaaccaacaaagtaactccagacttaaatggaactcttgatcaaatggatgtaatagacatctacagaacataccatgcaacaaccacagagtatacatttttcacatctgtgcatggaacgttctctaaaattaaccaaatacttggacttaaggcaagtctcaataatttcaaaaaaatcaaaattatgccagttatcttctcagatgacagaggaaataacattagaaatatatatcagccgggtgcagtggctcatgctggtaatcctagcagtttgggaggctgaggtgggtggatcatttgaggtcaggagttcaagacccacaaggccaacatggtaaaaccccatctctattaaaaatacaaaaattagctgggtgttagtggggcatgcctgtaatcccagctactcaggaaactgaggcaggaaaatcgcttgaatctgggaggcagaggttgcagtgagctgagatagcaccactacacttcagtctgggtgacagagtaagaccctgtctcaaaaaaaaaaaaaaatacatatcaggagaaactctcaaaaccacacaagtacatggaatctgaacaacttgctactgaatgattttaggctaaacaagaaaattaaggcagacataagaaaaagttgaaataaataaaaatagaaatataactcaccaaaactctgggatacaatgaaagcagtgttaagaggaaagtttaaagcactaaatgcctacataaaaagataaaaatatcttaaattaataatccaatatcatacatcaaggaactaggaacataagaacaaaccaaatgtaaagctagaagaagaaataacaaaaatcagagcagaactaaatggagttgagactgtaaaaaccaaacaagagattaacaaagcaaaagttgtgtctttgaaaggataaataaaattgataagactgctatttaagttaattaaggaacaaaaagagaagattctaatacgcacaatcagaaataataaaaatgtggcattacaaccgataccacagaaatacaaaatatattcagagtagtctatgtaaattctcagagagtaatcatggtagactatgaatatctctgtgatcaaaaacgagaaaacctagaagaaatgaataaatccctggaaacatataaccagccaagattgaaccaggaggaaattgaaatcctgaagagacatataatgagttatgaaattgaattagtaataaaaaatccattttccaaaaaaagccaggaccaaacagattaacagccaaactttaccagacatagaaagagctagtacccatcttgtataaactaataaaaatattaaggaggaatgactcctctctaactcattctatgaaaccagtatcatcctgataccaaaacctagcactgaacacatacacacaaagaaaactacaggccaatatccctgatgaatagacacaaaaatctgcaacaaaatgctagtgaaccaaatccagcagttcatcagaaagataatttgtcacagtcaagtggattttattccagggatgcacaaatagttaaacatatgcaaatcaataaatgtgattcaccacagaaacaattttaaaaacagtagccatatgatcatctcaatacctgcagaaaaaacattcaataatatccaatatgtctgtatgataaaaaccctcaacaaactaggcattgaaaaaaacatactgcaaaataataagagccgtctatgacaaacccacaactaatatcatactgaatgggaactgtaacaagacaaggatggccactctcagcaatcaggcaaggaaaataaataaatgtcttccatattgaaaaagaggaagtcaaattatctctgtttgctaatgacaatcttacacctagacaaccttgatatttcctccaaaagattcttttacctgataaactacttcagtaagatttcaggatacaaaataaatgcttgaaaatcagtttcatttacatagatcgacaacactcaaactgagaaccaaataaaaatctcaatttcatttataatagacacaaaaaataaaatatctagaaatatatttaacaaaggagaccaatgaggtaaaagatgtccacaacaagaactataaaacactgctgaaagaaatactacatgacagaagcaagtggaaaaatatcccatgatcattgtttggaagaatcaacatcattaaaatgactgtactgcccaaagcgagctacatagtcaatataatttctatcatagtaccaaatttattactcataaaattataaaaaaaaattctaaaatacatatggaaccaaaaaaagagccttaatagccaaagcaatcctaagaagaaagatgaagttgggggcatcacattatctgactttatactataaggctataataaaaaacaaacaaaactcagcatggcattggcataaagatggacacatagatctatggacacaatagggaaactagaaaataaaatcacatgtgtataaccacggttcttcaacaaagctgacaaaattaaacattggggaaaggtcaccctattcaataaatggtgctaggaaaacttgcttgctaaatgcagaagaaagaaacttcactcctatctctcaccatatgcaaaaattaactcgatgaattgaaaatttaaatttaagacctaaaactatagagatcatagaataaaacctaggaaaacctctttagacattggcctaggcaaataatttataaataatacctcaaaagcaaatgcaacataaacaaaagtagacaaatgggacttaattaagccaaagagtttctgcacagcaaaagaaacaattattagaataaacagacaacctatagtatgggagaaaatatttgcaagtaatatatctgacaaaagatttatgtccgaaatctataagaaaaacaaatcaacaagaacaaaacatataactccattaataagtgaggaaagaatgtaaacagacacttcccaaaagaagaaatggaagtgaccaacaaacatatgaaaaaacattcaacctcactaatcattagagaaatgcaagttacaacaaaaatgagacaccatttcatcccagtccatttgtactttttattatcatatatatcctcaaattcaaaacaaaataaaccacaacataaactgtgttagtatagtacattaaagtcagctccactgtgctgtatcacttggcaagtctgaaattccaatgggcttcagaaagttgactatgcaatgcccaataatgacctgataatctcatattagaggcaatgcaaatatatttataagactaagagctacaacaagcttacgaagaaaaccaatttatagcattacaggttaaaccagaagtgatttcctctgttaactaaaattacattactaaaaagtgcatggttcgtggatgtctaatgtgaaaaaagacagacagtgaatactttcctgctcagtgtgaacacttaataagaatgaaaatagaatgccttattatataaagtaataccaatacattgatttccaatctactcctctggcacaatttaaaatgagctcttgaactatagagtcacaactctttttcatttcaatgtgttttccttcaaaatagcagttatttatacatactgcttttaaaaatcatttttaggctgcagattcacaatctccataaatatcaaagatgtgaagttaagttcagatgcacttgaagtaaacaccatgctaactagcagcagtgttcaagagatcatgctgccgatcttatgaaagggaatatactattgtgaattattttgcaaatcccaaaagaagtttatctctcacattattgaagactgagaatgtcttaatatatgcacaacttgaacattgtttgtgaaaaagccagactaattcatctatcttctgatcaatcagtttagccaagcaaagcacaaaataaatgcacatcctttgctgccgttaagagcaaccagtttgcttgtctgtgcatcatgaatgccaaacaaatcttgaataagaacgaggaaaagttaaaagaaaagaaagacaggaaagaaataaaactcaattttcttgaataggaaatttctagggaggaaacattttccatttttgtcttctatcaaatttatatatatataaatatatatataacatattatatatatcctaactgtcattataggctattctaagacagattctgccaatattgaaatatctaagacaggcacaattgggccattgcaaacatcatgtactaaatggattctaaggaacctgaaaattaatgaatctttctaaaatgactgacttactgttaggggaaagcttaagaaatcaaataccaaatcaaataccaaaataccaaatcttttttcatttttctattcttcccaaaaaaaaaaaatagtgggggataaaataacgcaatgcccagttaaagtgccaacaccaaaacaacttatggctgctacttctgaccctttcagggggtcaaattttgttgtcttttgtatttctagctttgtttgagacctttgtttgcatatattcaaaggttagtaaatacaatttaatattgtttccacagaaattaagcatttacctagttagaataagcattcaaacagaggtcttgcattaaattttgtactaaactgtattccttctaccatgctgcaatctttattaagaaacaaaggacatctgatttcacttttctaagcttattttagttaaggttaattattacacagagatactaacctttcaatcataaactacaaattagcattattcatctctgtggtatattttcaatgtaataataaaaatcctggctcgctctaaaggtcaagctaaaagcaaccttaccatcatcatactggcccaagcagatttcaaagagagagcccaggatgatccctgaagctaaacatgtccagagataaaactgtcgaaacatcttctgtcaaagttcactcaaagctgatctgaaataagaaaaggtagaaagaaacatttgacatgttcattaatctgttataggtaaacacaattgtcacagcacagaaaagccttaatgacttcatagttaattacctgtgccacattatccattaacaaagtaacacactggtttaatgcactggaactgtttatcaacataaatttgcagacaagtaatctctaaggaaagacatcttttctgttatttaatttgccagcaagtaggttgagaagttaacatactaataatatcagaagcacactctttaaaatttaagacattatgggtaagtccaatgttaatcagtttaagttactaaacttatgttgtctacagcataattttacaacaaagtgtaagatagtaagccagttgttagtatcctacatgagcatttcaatgaaaatttgtcttatacaattaagtagaaaagcccatcattaaaatgttaattcctttctagtagagtgatcagagattgacttaactatgccaggaaagactaaggaaaatctgtcaattttcactacatctgctttatgaagcatttggatgcatttcattttaattctcttgttttacttttcaatccccagcaagttaaaaaaaaaaaaaaaagaaagaaaacaactgattgagaaattagtggcctgtgagcacatgagaatgtcttattgaaagaatgacatcctcagtttctttgtaaatttaggaaattatccacacagaattgttcaaaatgctcttgattataaattgtggcagactagggattggaacactgtttctctaattcagaggttccaaactcaaatgcctacagaggacaagcagacaaaggaaaagaatgaattagccaaaggggacaatagtgatggtagaggctgtgataaactgtgcaatgcaaggttttctaaagagaccagctggtgctcaacttctgtcagtggttgtgatgtggcaatgcaagccagtgtttctgggtcttctgattttcaaagagaaggcagaaatccaaattttcatgtgatttccaagtgtttacatgattgtgcaatcttctttataagactaaatgcttctagcaggtaatattgatgtctcaagttctccagttttctatttctgcccaggattctctctactagactagctgaggataaggtttatcagagggtacaaaggcacgattttaattctgcttttgtctacattttatttttgatttattgccaagtatttaataatgtttatttgtccagcagcatgtataaatatatatattgcattgtaaaattgtattaaaggtgtaagctctttttttaaactaatgggatacacagttcttgactttaaaagatcactgctctagatcacacacattttaatatgaagtctattcttctttgtttctttatctaagatataaaaggagctgccttctttttaactgggccttccacattttttcctaactggcaaagtgcttggcgcgtgcatttataatttctagggacagaaagcccaaagaagagctcattattagatgccaagagatcatcacaatccacactaacctgtagaaaaaagaaaaataaaattgaccaatgctactggttgtgtagagcagcggataagaatgtggctttttttttaaattcaagcttttcagcttactagttatatgactttgaagaaattaaatagcatctttgtctcacatttctcattatcataatggatataaaatagtatttacctcataagattgtcttaaacattaaatacgtaagggaatataaatacgtgcttaatgcagtgtacttacagaatgagtaccccctaaagcttaatatgagtaccccctaaagcttaatataaaagactcagcatctatggaacctccaaagtcttaaatacagatttactcaatctatctttagcaagggctggaaagtagatattattatccccattttgtggaggaaaggtcaggctcagagagaataagtgactggctcaaggttataaactggtgagtgtctgaagagaccataaagtctgtgagtaagacacttctgctcattccattagagaaaagtattggaaaaattcccagaaaacacagggctcagaagttttcaaggcatatggaggcccaggagagcctgctgtattgcttcccttaaactctgagagagacattctaacccccttcacaaaggattagagctctactaagatttctatatacaatggcttcaaatctttttttatttggaaaaacaaacatgacattaagaaataaaacaatgttatttaaattttaaaaatataaagagaaaccatatacaaatacaaaccagaaaggatatatattggaaaacaaaattaatacaaaccagaaaagatatgtattagaaaacaaaattaaagagacggtaatatcttagcaaaggacaaaaggacatagttgtgttcctgtgtgggtccttgatctgccagcttgacttcctttatagtagtttatagtattatgcattcacaaattatggcatattcttttattcctaactgaagctaatttggtttcatggaacagtctccaatataaaaacaacatgatggatcattattttaaaatcattaatgtcactgccattattatgcctccagaaacaaaacctcttgatctatggctctgcaagtttttagaggattatatgcatatttctgaaagcatcacagacaaaactcataaaaaatctatttagaatagatatagcatttactgcccagaggaaggagataattttaggggaaatattatacttatttgtctttgaataatgataataataacaatttctatagtttttttactctttcatctatatctgcctgatttccaaagaaattttcatcacttcaatgggctcaatatttacagagacctgaaagaaagctatgactcatcacatcaacccgataccccaaaacacagaacacatattgacttagtgagaaaacccagtttctaaacaaagatataatgaaaaggtacctcccacaaagagattgtgtaaatgactacaggaccaagatgtttagtacaatattgtgccaatcaactgacagcctatagtggcacttctgtgattgtgatcaaattaattggaagagatcaaatgctttagacaaaagactgtttttgttactagctttttaatctctagaattaaaagagaaagtcctataggagatgaattccataatcttgctaagtgactgtaggtaaatgaaaagcctgtcaaacaacacctctatggtggtactttacttttactacaaatcccacatcaaactctttccatgttccccgagtatatatttttcctacagaatttattggctaataatgttatgttctaaaaatccaaagcatgttcaattctaaaaagaattgtaggtgacctataaataaatatgttatacttgttttttaagagataattaaattggtgtattcagtactctaatatagctaataaagttatcattttgcaatcgtgacttagaaatagtattctgttgtcaaaatactggggaaaagtgtttttttcctattacagtataatattacacgtaagtggtttgcattccatgtgcattttatgacacaatttccttaggcttaagaatattttactgcaattattcaagacaaacatactaattttgaatttcacatcatttgtatttcctgcaagataaatctcatatttatttatctggcattcaatgttctcaaaaattaatttattcaacaagtacttatggagggtctactagataccactcactcttctaggcagttggaaaatatcagtgaacaaagctgacacatttcttttctcccatggatgttatattccagcaaaataaagatagaccaataacaaacataaataagttatataaaatgttaaaatgtaataagtgacatgaaaatagcagctagcatttcaaaactgtatattgtcactttacaataattttcattcagtaaatgaagtgagattacacaaagcaaccaaaatgctatccgataaaataactgaatgagaactttacaatgaaagtataactattccgacaaccctgacagcatccttgatggtatctactattctgagtacagatttctgtccatctcttggaaggagaataaaggtctttcactgcctttcactttcaaatataaatccaaagtctggaaatacacaaaggtctgtcctttttctgtttatccctgctccctgagtcttgggtgtttgcagtgacacatggcaaaagcagccaaggttgacaccacagcagttttctcttaaatacaattttgacaatgttaactattttttagcctatgtctctgactgctatgtgaataaacactaactttcttgagataccaaaacttggaacacaccgtcattactttgatgagaaaccccataccaatacacaaccatgaagcaagctggagtctcacagtgaagtgagctgtatgtatgcagtctgcccttcaacagttggttcagccaaattactgttattcttgatctgtaacaatatctagataaagctacaaaactaaaacttgtcactgctttgtattccttgtgagaaacgtatgctatctacctgctggaataaagcaaacttcccttcaaagcaacctcagcttcaaactaaaaacatgaggttttccaaagtcactgtatcttaccatactaaatatcaatttgcttaaatgactagagagaaacctgtcttctacctcagcatggtggtaaatattaataatgtcttcatcagtacagagggtacttatcacccttcagcattaccagatgaatcagctgttccttttttaaaatgtgtaatatgaagtttaggaaaataaaatttcagagagcctttcagatatattccttccttctagatcatattatatttttctttactaaatatacatatgtataagtttatatcatatattcatctataaaaatatattgatatttattgacaattttatagtacatttatacatatttatatataaaattatgttacatagtcacatatacaatttatataaagaagtatatattttatttaaatttacattaatgataggtaatatcaatgatattgatattatcgcccacttttttaaagtttgcaatttaaattcaaggggttccgttgtagctaatttgaggtaagtttggaaagtaactaatgtttttataggacactgtgaggtccaacctacctctcccacccggtcctgctaaattcggcttactagatctttgctcgggcttacagttttttttaacatgctactacatctgaatgtgtcttgactaccaaatttaaaatatgtgctaatttggccaggcgcggtggatcacacctgcaatcctagcactttgggaggttggggagcatagataactcgagatcaggagttccagaccagcctggcaaacttggtgaaaccccatctctactaaaaatataaaatattagctgggtgtggtggtgcacacctgtaatctcagttactcaggaggctgaggtagaagaatcgcttgaacccaggaagcagaggttgcagtgggttgagattgcaccactgcacttcagcctgagcgacagagcaagacagattccatttcaaataaaaagaaaatgttaatttgctttttgggtgcactctgtctcaacatatagattcatcctaaacattgtgggataaaataaaattgatgaaaatcatttttaaaattaagaatataaattattaagaactaatcttgctatcacttcaatcatttacaaggtctttcatttcagttttaaacattttaaatatataatcaacagttgtaaacattagatgagactaatttaacccaaaatatatttcccgaaaccacatgaaacacataaggtaagtccaagctctggcattcttatactacagctatggtgaattcttggagaattcaaatcagtgtcttaacatgtctgttgagtctattcattattaaattctggttttaataatagaactttaaataaaagagggaagaacactggttttctttttggggaatactacttctcaagaaaataaatgactgaccaatataattaatctgcttatgtttaaagattgtgtcttcatggaaaaaaactaatattcagtttagtctataatagatacatgccaaatgttataataatgtagtcatactagttggtttaataaaatataaatacaccaaaaatgtttttaaatgagtggaaatttaatctccatgtttactattgctattatattggatattttcttagtgtttatacatacatttactcaattagtatttattttatatttagtgcatatcagacactaagcttctactatagaaataaattattccatttcctcacaatgactttgctattgagcatgcactacatttcatatttttttacctaatatacatttcaaggtactttagtaaaataactccaaattaggagataaataagttttaattgccaatttttttgaggtttccattccatctatgttttcagaaccttcatctaaatctcagtcttttagataaatacatttctcactatttgttagaaaagtcatgggaaaaagcttagtttgaaaggagcaagcaaagggaaatataaaaagagaagcccaaacattatttcatcagtggagtgtttagcttaaaaatataaccaagtaaatttaaaatggagttttaatgctcaagcaaacgcatgcatcattttaaaaaagaagcttgaaagagagttctgtgcagtgttattacctggcacagaaaaatgattctgattaatattcttgtttgatgaatattatagattctaagaaacacaaataaattaatgagtaaatgagtattttcctaaggcaaatccatcagcaaaaaaaatccaaaagtattaagtcagtcaacagagactaaacgtaaaagtatgaaaatgtcagtgacttgtataatgtaatataataaaagtcctggctctggcatgagagagtcttgcattgcattcctagttatgttgcttttggagggctatataagggtaaactagttaaaacttgtgagaatcagtttaaaattaggacaataaaatccattttattcttctgtaattgacagatgaaaatttgaacaaaaaataaaagttaagaatattcatttgttcatttatagcataagtgtttactgagcactgattctggataatgcactttataagatgcagtggctacagctttatgagaaaaactaaatgaattaataataaatacataatagtccatatagagttttcagtctaacagagtgtgacagtcacacctaaagtagctcataatgaatcaaatcctcgtataatactattctatagatcaggggttcagtactggtccatggcctgttaggaaccaggccacagagcaggaggtgagtggtgggtgagcaagcaaagtttcatctgtatttacagcccctccccatcattcgcattaccgcctgagctccgcctcctgtcagatcagcagcagcattggattctcataggagggcaatctctattgtgaactgcacatacaagggttccaggttgcatgttccttacgagaatctaatgtctgatgattgatctgtcattgtctctcattattcccagatgggatcatctagttgcaagaaaacaagttcagagctcccactgattttacattatggtgagttgtatgattatatcattatatattataatataataataatagaaatagagtgtataataaatggaatgcacctaaatcatcccaaaccactctcctgctcccagccccaggtcggtggaaatttatttttcatgaaaccagtccctggtgccacaaacttggggaccattgccatagatagtggaatctatgacttgcttctaatgtgtagaatatgataaaggtaacaagatatcactttattgtttcaattaagttatataagattcagtcttagcacattggagaaagataaatcttcctgctctgtgtaaagaagcaaacgtattgtaaactgcctttggagaaggacatatgccagggaactccaggtgacttcttggaccagaggatggcctccagacaacagccctcagtcatataaccaaaaagaaatgaattctgccaacaatctaaatgagctttgtaaaacaattgcattccatattgttaattatattttgaaaagaaatgtaatttaaatactaaataatgagattttattttatatatgatcaattatatacaataaattattttcttataaatctagttacaacttttctgtttcttatattgaacaaattttgagctataactcagtcatattactttacttgcttttgccattaccatagcttggtaggaaataaggttttaaataatagtcttttaagtaggtgacagatttagaataaaagattcataacagttctaattttaaaaaatgacttcacatgtttaatgacatagcaaacaggtagtatctacattcctaattttttttcttaaatctgcttgcatttaaacaatgtaaaattaattggtaaagcatgtcatttaaaaaaaaaattaaattaaagttctgggatacatgtccagaatgtgtaggtttgttacgtgggtatacacgtgccatggtggtttgctgcaccgaccaacccgtcatctacattaggtatttctcctaatgctatccctcccctaacctccccacccccgcgacaggccccagtgtgtgatgttcccctctctgtgtccatgtgttttcattgttcagctcccacttacgagtgagaatatgcggtgcttggtttttctgttcttgtgttagtttgctgaaaatgatggtttccagcttcatccaagcatgtcatttttattagatatagttggtaatagaaggaaacatataacttttttttgttgtttgtttgttttgagatggagttttgctcttgttgcccaggctggagtgcaatggcatgatctcggctcactgcgacctcctcctcctgggttcaagcgattttcctgcctcagcctcccgagtagctgggattataggcatgtgccaccacgcacggctaattttgtatttttaatagagacagggtttctccgtgttggtcaggctggtctggaactcccgacctcagatgatctgccctccttggcctcccaaagtgctaggattacaggtgtgagccactgtgcccggccaacatataacttttaatagttatttaaatattaatatgtatgtaatggatactagagtaaatactgattgggaaatacaaactgtcattaataaaatatttgttttctatatagctttaatatgtactttttaacatgtacttacaacatttatttaacacgaatagagtagaaaatgtgtactttaatactttgccaggtgacatgtttaagtagaatgaataaaactaggtttatcctccattgcccctcttcttatcagaggggtcatatttcatatgtcatatcttttctacactttattttctacttcacattatatgaagtctaaccagagatcataaagtttcatactatatcaatgcagaggcagaatcaacattctatacatataactttttactttctttgcaggattttttaggtaaggtcttcggccaactgaactgcaactgtttcatttacaataattttaaaacagtaaaattctctcaagaactaagtttgtacatttgatgttgataaaaataatgctaatggtgaatattttttgagtatgatagatgttgatattattgaaatcattagatatgctttaataactttaaaaccaaatggtagactgttccatttcatttctctttgtactttaccaatttatactatgaaaatcatgtatgaaatgtatagtctagaacgtttgcagaaatatcatctcaaaaacagtaactcaaagtctaatacagaaagacatccatataaggaagcatttcacaaatatttctaagctttgatttgatatatattaagcttttaccatttatcttataaatctacatggttaaagaaatgatcaaccttctcaactggcacaatgtgaagatggataatttgacttagaaaaataactaattgtgtagtcatgtaagcccttcatttatgacacaaatccataaaggtcactgtcatatttcttagagactggattttaatgtaaagctgagttttatttttctaggaaactgtaacttttattgaaaatagttcatgtataagcagatttatggaattcaaactcatgttgtccaagggtcaattgtgtgtaattttataattgtaaaactctgtcttatctgtaaatgataagatattacaattagttggttctttatgtttgaggggcaaataaaatttgaataagttgtcttactcacaaagactatgcttcacgaataatacactaagaactttagtctcttcctacaaatacctaattttatagtgtatcctggcatttcaaaattaccaaactgaaaagtagtcgttctctctcttagtgtcaatgctaattgtatggtacgttcattactagagtacattttttctaacttaaatttttaaatttattacattaaatattagattatgctattatatagtaaattcaaactgcctgtataatattgtatcctattaaaatgatacagacattaaattttatgggcattctaatgattgttttccatttttccatacttttaaaataagttgttatatgtcccttggggatggggattattttaggaatactttactacttattaattttccaaaagtcaataatgaaaaatatttacttcccaacacaccctggcaagatattttataagtgaaagacataatttcattctgacctttttaattctaaggccttttcatgttgttttttttttttttttcaatctgatctaatttttaactctctctatttattaccataaccaaatttcattttactttatttttagctagttatttctgcctaggcattttctcctttttcatatttcgacctaagaatttgttcctcatgtaagacttctctgacaagtcacttcctcccccaagtataggtcaaatattttgcgataatccttagcctttcctttgtattcagcgaacacatctcagtttataattacattgcttgtcagtgggtactttggcaatatttgtgtttcactttatgcccctgagaagaggaatcattattagccaagctcctatcccagctttttatcccggagcccagcaaatagcttagcccagattagcattgatgttttgaatgaatgaattttaaaaagaaacgtatcattttcacaaaatgtcctgttatttacattaaagctaatttgttcttgtcaaatctgtattatatatgaaatttagttttaacacttattcctgcagcatttgctgaatatgcaaggatcgataattgataaattctaaggaagttctatttcctttaagacacatttaaggtattgttggagaaagggctatgaatattgtaaattctcacagagagtatggagatgtttgtacataaatatatacttattataaaataatattttaaatcgtcgaacttagataaaatatatgcttataaaatataagaataaaattctaatatacttggaaaataagaaccaaatctcagcctgtaagttaaaacttatggtttatatacaacaaaaactactggggctgtttttatttctgtgacccaattaaactaatcttttctcaaatttcatccctatgtctgagtatactaatattggcaaagccctctctatcctaaaataatgtctattttaatatgtcttcatagaaaagtcattaaaaagcagtgaacatagccactaagtatgattttaatatttttgttgaaatgactaaattaatagaaagtgacaaaaagtaccttaagaagaattttaaaaaacaaaaacaaaagattgaacaaagcatatgtggaaatataaattataattttcttccactttattaacactcttgtctaattagacaataattactttaaaaactaacactttccccttagaattactgctgaagttgaaaggttcaagtttttaattactgctcataaagcatgcagtgaaactttctaaactatgaaaagtctactatcttacgattcagcaagatatttatcttataaaaacatcattaataagtacaaaatctcatttaaattaacagcaagaaactttcattttcctttccagtgtcagagatgggtgaaataaatcaaaatcaaggatcttttgtggatgaaaggaagtagaaatcttaagactagaaactcactaatgtgatgcccatgggcaaagatgaaatcagatattacagatgattttgaagttgcagttttaataatgataaaggtatagtgaaagggagaattgaagcagaaatgaatttcatactgttgcccacaccaatcaactcatcatgcatttcaaaagtatattccggcacaacatggtggctcacacatgtaatcctagcactttgggaggtcaacataaaagaatggattgaggtcaggagttcaaagccagcctgggcaaagtagcaagacccagtctctgcagaatagacaaaataaaaaaattagccgggagtaagggcacacacctgaagtcctaccactctccagaggctgatgggggaggatggtttgagcccaggagttcaaggttacagtgagatatgatcgtgttactgcagggacagattgagagcccaaaaacaaacaaaacaaataaacaaaaaagtatattccactaataccttgtaaatgggggtgtatgaagtttttttaaatcagatataatgataatagcgtgtgtgcatggcagtgtgtgtgtgcgtgcgtgtcaggttgcatatattaagtgtaaacaccacagttatttcaggaagggatcataaatgcataagaatctaagtgtccataaaataccgtaaataaataattaaagctgattgagaaataatgggggctctggagactgtgcagaatttaaacttagcaactttgcagaagtctacgtctattttttccatcttccaattttttaggtaacattgagtgtctggattttcatatgcaattatgcaatttattttaattaaactattttctagtgtatagtgtggccaaggaaacgcagctttatgtgccatccagaccatgttgcaatagtttaaagccttgggcttaaggatctgttagtaacatgacatttgtatgatcagagctatctctccatacgcatttaggaccactgtactatcatcacgtccaaaacttcctttcataatcacaatctttgaaaattctcacactttagagtatcttcctgcctagaaaaatctatcacagtaatatatgcactcaccataaagataatgtaccaggatgctgaggatatactaggtggaaattttagaactgctgttgttcaggattttctcaaaagagaaatattcagaaatatcaggtagttactttacaaagtaacatatataaatatatgtatatacacacacacatatatttatatatgcacaaagggtttcttaaatgcacatgtacctttaaagtaagaatgcattttgggcatagtcatcaccaacacaaagttcattcttgcctcatgtattgatttatgctttaaattttgtaatcatgtgagcaatctttaaaatgataccagattcccaggttaaagtcatttggatgacatttatttatgttttttgtactattttgagtttgagggatggtgttagaaaatcttgtaaactagcttttggtattttctgattattattttttattttttggtgagcaacactaagactggcatttcaacttccaatgagggtccttatataatactcagttaagcatattactgctaaattcaaacaaattttaaaaacaaaaaaagatataaatgattgaaagcatgacaaacgttccctgtagatgttttctaatttttaatacattgaattaaaaatatgcctttccaagtgaattttagatattggttaccaccttcaagatcatcatttatgtatttgtgaaggtgaaagtaggaggcatacataatattatatctgtaataaatgtaactttttaaagtaacataacatctatatatggcaggaaataataatgatacaacattaaatagatatagacctgatgatatagttggaattctccaaactcttgcataacacttatgtaatcaatgtgaatttaaaaacatacaattggccgggcgcggtggctcacgcctgtaatcccagcactttgggaggccgaggcgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcgtgaacccaggaggcggagcttgcagtgagccgagattgcgccaccgcactccaacctgggagacacagcgagactccgtctcaaaaaaaaaaaaaaaaaaaaaacatacaattgacaataatatatgtgatatagtagattgtccaatattttgttggtctaaactacaaaatttgccctgatgattggtgtattgaagagaaaaacaattatttgtatctcatgatacttatcgaaagagtttgtagacaaataaaaaacacactagcaaaacacactctgtttcatgttaattaaagggagaaatactgttcacagaaattagcttccaaaaatcattcttcgtgaaaacacataagtaaactaattttaatactctcagttataactaaaatggtatcatccactatcttccactaactaagtattaaatacagagcataagctattccaactgacatattaaacaactttaagtatggcttatgtctataattttcttgtaatctcattctgaatggagctttcttgagcaacagtaattacagaggagttaagagtctggaaatagttatttgtttatagaaagaaaaactaataagagaatgaacatacttagtctaattagaaaagttttgtttaaactaccattagaagtaaaataatgccacaaactgaaatgaatccctggatattcttaaaacattattgttactttagtttcttaaaaacaaattaagcagacactcattttttccaatagcttgtaaacttttgaatcttgggtataattttaattcttgagagtgtcacatatttgataaagaatgtttgtctaagatttctatgcatatgtgtatttgagtatatgctatattaacatatgtgtattagactgccaagataaaatataactaatcaaagcatttattatttaactttgattaaatctattagcttctttacagattttgctcatttgtaagaggaggttaggtttcttcccccaggataaaagggatgagttatctgtttctcttgggacagatgtactgtggtaaatgcagtgataagagataaatgaaaataaagagaagcccctaaccaaacagaaatgaaaagaacaataatagaaaagagtgtctggggacagtgttcgaggttactttttcttttttctaaaatgattttttgcaattcatgaaaacaagcctgaagcgtaaacttgtcatctcattttaagatgcatttctcctaatattaggtattaaaatataatgatcaggcatatttttaagactcttttcaccttgtttgaaatgtattgcttcacaaagtctttgtggagctttctttttttttaagaaaagaagaaataatacaaatatagtttaggttgtgttaatgcttgaagaaaggtgtaaagggagtgatatgctttggttgtgtccccacccaaatctcaccttgaattgtaataatccccatgtgtcaagggtggggccaggtgaagataattgaatcacggggcattttcccccatactgttcttgtgatagtgaataagtctcatgagatctggttctataaatgggagttcccctgcacaagctctcttgcctgctgccatgtaagacatcactttgctgctccttcaccttctgccatgattgtgaggcctccccagccatgtggaactgtgagtcaattaaacctctttcctttatacattatccagtcttgggtatgtctttattagcagcctgagaacaactaatacagagagagaaagaaggttggagtagggagaagattgctagggtattaaaggaaagccctctgaaaatgacacttgagctgagacctgaataaactaagggatattttagagaatcccataacagggaagcaggcataccactttcaatggctctgagtggggagcatgccagccatggatgagaaacagcaaataggccagattaataagagggagggagtagtactagagatgagagacgtagccaacaagaaactgagagaatggaggtgccacttactggaatgtgatcctccctattggggagcggcaggtttggagtagaaatcaagagtttggctttgattgctcaaataaagtttgaaatatctattaaactaccaaatacagatgtcccatagattgatatgaatgaatctgaaagtcagggtagacaaaaaattgccagtcatgaaatgaacatggcactaacataggctatctacggaggatgtacaaagagagaaaaaatcaggacttgcaaatatttagaggtcagaaaaataaagggtatgtggctaaagagataagaaggagtgagagggaatgcctgaagccaaatgaagaaaggatttcaaacaggagagaatgctaatatgttgagtgccactaataggttgaggaagataaggattgaggattaactcttgtgtatttgcaaaacagaagtcactgatgcccttgagaagagtggttttagtggaggagtgggaacaaaagcctgactagaggttttcaagaaaatagagttcatataatttgttagtgtttttttttactgtgcaagtgagcaaccaaatgcggagataggaagacagtggggacaatgagtccatgaacttggcacatgtgtgcacttgtgttaaagatagagctattaccaatgaaaataatctattaaaaagtacagtgcagacaaaacaggagagagaatggacacacctgcacagtaagagaaaagtcctttcttaggttggtagaggaaattagatcctccagacagtggtaattaaccagagagaaggtccaggataggtggaagtttgcggatgagaaagatgtatcggagctttgaggataaagagaatgtatgaaggattcctttgaaaagtaatagtgtgaattaagtggcaaaatggcatacagttatacagttattgcatagggatgatggaccacttgatgtttgttttttcttttattttccagccacatgaagctgttggcatgtaggattagagtagacaaactactatttttattttttttatgtttagttttctttataatacacttcttcaagtttaccaattaaaatattttgaatctcataattaagtcttaaatatacgtgttcatgggtggtaattacttaaaacacttggatagtagcaagcaatgaaacttctctttctcttctgttgtattcaccaccactttagcctgaataactgagcaaataccaggttcttggaacactggcataaactatgtatctaggactatggctctgtccatcagcacaagccactagtaattcagaaattggtcatttatataatggcatttattgcatctttaccacgaacaatatgattttttaaacatggtttaaactatattatacaaataattcagctgtgtttgatacttcttatatgtaagaatcactttcctttttataggttacttttcctctttttataatatctgaaatttaaggatgctgtctcagagagccctttatttatgcaggcaagataagaatctatctgagatactctcacattcttaaaaactaaatagctacccatgtgtgtgtgcatagtgatgtcagaagttcttaactgagtcgtaaattccaaagaatcttagctaaaatgaagctcatatcttgctaattcttctctgttaacccataagaaaacagaagcccagagaaattaaaagatttgttcaagatttgcttgatagcatactaaggtggatttaggactttgggctctgaattgcttaatatggaagtgttgctcagggaaaagcccaaaccccagcattacacaataaatccatgcaacaaatttatacatgcagcctctgaatctataatttaaaaatgtgcaaaaccaagcatctttgaggaacaaaattctgagatattataagactttgaaagtcatattaggctttgctattgttcagattttttaaatatttttaatttttttcatttaaattttaagattttgttgtggtaaaatgtacataacatataatgtaccattttagccattttaagtttacagtttagtggctttaaggacattcacattgttgtgtagccatcaccaccatccatcttcagaacttttcatcgttacaaactggaactctatccattaaataggtgctccccattaagccctgctccccgcccctggtaaccattattctatgttatttctctattaatttgactattctgggtatggtatatttgtgaaatgatatgaaatttgtgctttcaatggacaagcatttgaggggattcaaaattgaattattttatcacgtttcagatggaactacaattattgagcatcaccattttagacattttactaggaaccttaaatacatgttttattttaaattctggatcaaaattctgaactaattgatttcatttctttataaattggacagaagctgagcatgagaggttaggtagccctctcaaagtcaaacattagaggcaagactagaagtggaatcttcaaacccatgtccattaacatttcacagaactttgaagtacattatgcttgcagtgattaaagcttgcgatcaagtgtctgactaacctgagttgcaatcctgactctgcctcttacatgctacaatattttgggcagttttctgaacttttcaaaccctcagtttttcctttgcaaaatgttaaaatgatagtttgaaaatcatctagaaagggtgttgattatagcatagcacaagacagaaacttttccatatcataaagaaaaaaatataggctttttgagatactaagaagattatcatttatatctgaaagggaattcagattgcttagggaaattatacctaagatgagactcacaatggcagataataataaaatagcgatatttttcacatattaaaatgcatgtgttattgtatataacaattatatatttaaaaattgtccttcagatatactcaaacacgtcttcaaataccttcatataaggatatttactgaagtatgatttgtaatacgaagaggttgtaaacaattagaatgtacagcaataaaggatacaataggttaaagaaaaaatgtattgtaggtatagaatatttgctatgtacctaattttttaaaatcatatttataaactaaaatagatactctaggatatgtcaaggagctaaggaaatcatttagtttactatttggatgtttacactgaatcttcaaagtgttacattttcttaaaagaaaatgttaaagcatatgtggcatttagtcaaatgtatatgaatatgtatttatggcctctttatgtaaatgcatatatgagatgttcttgaagtaaaaaataattctgtgtttttttctcttgacacaagttgaagctattacaaaagctaattatttaattaaaataacactggaaaaaatgttttaaatttcatttgttaagctagaaaatatttaagaagggaggaaataatttagatcaataccatgtgtatatttaaatcagattttcaaagtttgacctttttacagaaaatctaacagcaacaatcatttccagcgttactccaggtcaaatcatttgatagtgttatttcctatagtagtgtgtattagaatagaatgtctgaaaacttaggctacactaaatttataaaatgcattttttaaatagtaaactaactttagcttactgttgtttttaataaaatttttaatttttaacttttttagctttttgactcttgaacacatggtatagccatacaacatagtttctttctttatatttttattctataacctttttctattttaaaaattattaatttaatttttacttttaaagcattttttaaacctagacccaaaaatacacattagcctaggcctacaccgggtcaagataatcaatatccctgtcttcctcctccatatcttgtcccagtacaagactctgagaggcaataacatgcacggagctgtcatctcctatgataataatgccttcttctggaatatctcttgaagaacctgtctgagggtggtttacagttaatttttttataaggagatgaagtacactctaaaataacaataaaacttacagtattgtaaatacataaattagtaatataatcatttgctatcgttttcaagtactatatactaagtgtatgtgctattatttttatcactggcagcacagtaggtttgtttataccagaatcaccacaaacgtgtgagtaatgctttctgagatgatgttacaagggctatatcaccaggaaatagaaatagaaatttttcagctatgttatagccttatgggaccaccattgtatatgttgtacattgttgaccaaaatgccattatgcagagcatgaccatacaaatgtacagatgctcatcaaattacaatgaggatacatcctgttaaaatcattgaagtcaaaaatattgtaagttaaaatgcatttaataaactctgtctactgaacatcatagcttagcttagcctaccttaaccatgctcagaacacttgcattagcttacagttgggcaaaatcatctaatacaaagttaatttttataatagtgttgaatatagtatgtgactgattgaactgcactgaagtaaagtttccactgaatgcatatcacttggcaccatcataaatccaaaaaattgtaaattgaaccactgtaagttggcgactctctgtatataaaatatgtgtgtgtgtgtttatgtattttaaatcatcactgcctctacttttctaatttttgcatggaaatccaaatccaagggagcaagacagccaattttttttttttttttttgtatttttagtagagacggagtttcaccatgttggtcaggctagtcttgtactcctgacctcgtgatcagcctccccaagtgctgggattacaggtgtgagccaccgcactcggccaagatagccaattttaattataacccagagctaaaaatgtctagaaaattaaaatcatcagctaataaccaaactattatataaatatagattattttctagaaaagaaaagttcaaaggccatttaatagttgaaattttatgatgggtgcaaattttgatgcactatgttttgctttagatcctttttaaagaaagcattaaataaggaatgctttacagagttattgagattttttagcaaaaagaagtcctcattatttttgttttggtttcctgtgcttttggtgtcatatccataaaatcattgctgagacgaacatcatgaagcttttccctcatatttctttttgcactttaatgatttgagtcttacatttacgtcaataacctattttgaattttttgtgtgtatggtgtaaaattgtgtccaataccattcttttttatattcttatctatttttccaccaccatgtgttgattaggtcattgtgactttttggcacccttagtgaagatcagttgactatatatacatagatttatttctgagttctgtatcatattccagtattctatatgtctgttgtacaagtggtactatatcaaactaaaaaggctctgtacagcaaaggaaacaacagagtgaagaggcattttgccttaacagaatgggagaaaatatttgcaaaatgtatatttgataaaggtttgatctccaaaatactttatttttgaaactcctgtaactcaataaagcatgtgacttgattttaaaaatgggctaaagacttggaaagacaattttccccaaaagaactataaatagccaatagatatatttaaaaatgttcaatgtccctaatgataagaagaatgcaaatcaaagtcaacaagagatatctcctcacacctgtcagtatggctattacaaaacaaaaacaaagaaatcaaaacaataaaaccccaaagacagtatgtttttagtaagaatgtggagaaagtggaactcttgaaaactgttggtgggaatgcaaaatggtgcagccactatagaaatcactacggaggtttctaaaaaaatttaaaaatggaactaccatatgattcagtaatcaaaattcttggcatttatccaaaagaatcaaaattacactctcagatacaatcatatactagtactcttatgctcattgcgactctatttacaatatccaagatgtggaaacaacctaaatgtccatcaacaagtacatgaataaaaaaatgtgctacatatataatatatactgactaaaactctctcctttgaccaaaactttatttggactcttttgaatcttatgcttggctaggtctaaccttgggcttctctttctgtccttgttgaatccagtttgagcaagattcctgttaagtcagcttaggaaaaaagcttcaatatcttatgacactggactccattcagcaataattccatcaagttgatgtagctagaaacctcgtttttctgtatgtttcctcttagtaattttccattcactgaaccccaccctgctttttggtataagtctccacttgtcatggtggaagtcagaattgagtccaatctctctctgctcctttaagaccactttgctggggtccctatacctattaccatgcccatccttgaacaatatctgccttaacatctttaagaaaattctgcaatatataatacaatgttgtatggcagaaagtttcagtcaagccaggtaaaaaagccctagagatctgccaaacaacattatgtctatagtcaaagattatacacttaaaaattggttaagaggataggtctcacgttaagcattctaaccacaataaaataaaattaaaaaaatttaaaaaagtcttcactagcattaaaaattattaattataaatttattacagagctgtcctcaattaaattaaaaaataaaattgtcagcccaatgaaggcattatcttaaaaattagaattaatgtgcaaagagtagaataatgggagtggtaaaaattgaagttataaaagttatgttctaccctcaaccatcccattagttaggtaggctgggtaagtcatttttttttctctaagcctcaattgtacttctttagacttgggctaatcatactaaacaaatgggattgctattatgttaaaacacagacattaacaaacagcagttcaatctgactctggctaactatatactgaatagaatgcttaatgtattttaaccattctcacagaagtagaataaacaatataaacaataaatttccgaatccaaagtttaagagatgttaaggcaaatactgtattgtctgaaaagtatacacttttgaaaaatacataggattaatattgaaaatatcagaatatgcttaaacaagtatgcttacataggttttctcctttcatctcagtttgaaaatctagccatgtaaaatcagtttctagttaccagtgattcacagataagcttcacccattaaaatttccattcctacttaagaatcacaaagaagttaaaccccaaaagcagcatctcaaaatcaactctgaaaggcaattactttttcaataagtaaaattcatgaggaaaatttgtcactgcattagcaagttgtctctccatagaataaagaaccaaagctttacttgttcattgtgtatgagaagatcaggatcagtcagttaatgcttgtgttgagaacatttataatgtcaaaataaggttaataatcctaaaaattagataacttaataaagcaacattagactacctaaaaattccaatgctcaaaaagtaattcaatatttttagatatgctaaattgggtatctgctttctcagtaacgtttccaaaatacctatcttctcttcacattcaatttttctttcttactacaactctttagccacaactacataaaccttaaaataaaattttctgatattattattaatatatatgtccacataggtagataaaatggctataaaataggtaatttttaaagtttatgagctaagtgatgctaacagaagcaattctacaaatacatatgcaaagtgtattattcatttaaaacaattaacacaaagcactcttttttggatatggtaactaccaaagtcaaaaaaacaaagagctgaaatattatgtaaattgttcacagaaactgttgatctccaaaccagtcaattattatcacggcttgaatgttatataaaatggtagaaaaattcttgatcaacacttacattttgcctctgactactttcctcattaacttaccagccatgaaaagcactgtgcaaaagtcagcaattagggactgaataaagttttaagtggatcaatataacatatttggcatatctatgacacttctattaacattcatcaatttatgaaataacgacattaagtaattgtgttcatcccaaaaacccaaatatcaaatactatttgcatgactgtgttatacatagagcagaaggcagtgaagacatgatctttgcttttgtcacctatgaagacaaatatattgagtcacctatgaatacaatatattggagtgtgctctataagacaagtagatgccaactcctactggtcttggagaaaatgtaaataattctattggatgggagcagcaaagtaggtagcaatttcacagaatgggtggtattggggcatgttcttgaaggaatgagaggtcatcaaacagacaaaaacgttttgaacataggttataagcaataaagaaactgtggagttgcaaaaaatacagcatgatcaagaaattgtatagtcatgtgccacttaacaatgtttctgttaataatggaccacatatatgaggtgatcccttaagattggaatggagctgaaaaatgtctatcttctgttgacactgtagctgtcataacattataacacaacgcattactcatgtgtttgtggtaatgctggtgttaacctactgcactgccagtgtataaaaatacagcatatgcaattatatatagtacataatactcaataatgttaataaacaccatattactggtttgtgtatttacaagactaccttttttttttttttttttgagatggagtcttgctctgttgccaggctgggctggagtgcagtggcaccatctcggctcactgtaacgtctgcctcctgagttcaagtgattctcctgcctcagtctcccgagtagctgggactacaggagcacgccaccacttccagctaatttttgtatttttagtagagatggggtttcaccatgttggccaggcttgtctcgatctcctgaccttgtgatccacccacctcaacttcccaaagtgctgggattacaggcatgagccaccatggccagccacaagactatattttttatagttattttagagtatacttctcctacttattaaccagagtatttgaattttgcattttaagctgtggggagttgctaaaccagtaataactataataagaatatcaactaacgtttgtcagtactgttaatatcattcaccaacttttaaaatcacctattatatttgaaactgtttattatctcagtgtccctagaaaagcaagtactgcattaggtgcataagaagatgaccatcattgaaggtcaatgagcaaaatgtccaatttttttctcaacttggctgaatatgagacagaggagttcctctgagcaggtgagttatgtagcttatgacttacaaatgatccctaaaaacttcttatatggtatggtgtaaatgaaagtacaaaataatttatgacagtacgtagcagaacaaaagaggaaaatatgttttaattatcaattaaaaattacctccaaacttcaaatatgaaaacccacaaataaattgcatctctattgaaatagcacaggcacttcatggtttagatttgtagaaatgtctctgaaaactctgtatttcctacttttatgtttgtttatatttaggagcagcctacacataatttggctcacttaaaagactttcttaatgagtagtaatctacatagttccttgctgctttattttttagattgggctggggaagtcaataaccactagaaactctcaaaccaagaaattctcctgaagcaatctttcagctgtaaaccacctcagctaggaacccattgtattcctataaatttccttcagtattcctaagactaaactaatctgaacctcatgactgacaatgagttgagaatgaccttttgcaccagtgcattaattgtgaaagctttctgcagcaggagctaggaaattactcttctgagtacagcagccagagcactgaaatggctctggctgctgtactcagaggagtattttgaatggcaatgcttaactcttcagccacacatcgtctacatttttatattttacagacattttagatgtgtccatcatcctccaaggaaattggatttctgaataagaaatttcttttcaccctgtgatttctacatgatacttatagaaacagtttgacagctttggagaggatatcctatgcttcatgtagactttctgcttacggagtttaacacactcataaatttagctttactgactttacaatcttttatatgagaacagaaaagtcagcaaatttggaaatagaaagtttatgttccgccacatataaagtatgccaagtaatactttggccacttcacaaggaagaaaaggatatatatccaaatttatataacattcaagaaaatctttaattatattccagagctgataatttaaaatttatcttcaataattttatttgtttccaaactacctgctgctgagaggaaaataagaatatgcaatttgaaggcatggcttgtagtgtatcatagctctatttattatattattatattcatctacatacactgaactgaaattgtagagttcatttatcatttagatcaacttttaagaagatatatttccaattcttacctgtccatctcaaattgagctcactatattcactttatgtataaatggtatgtatacataagcaaaatataaatacaagcagtgatatatttattgcactttgtatcttaaactagtatacgtttgcttccagcagtattttgattttactgcaattcagatattctgattatcttttacctaaactttaacaatcaaaacaacttatcagtcatctaactttaaacttcctctgaaatcatagtctttgtacacgaaatctaactggggttaaatgttcttcttgttctctctgattgagccttccctgggacatctcatgcatagaaaagagttcacaaataaaaatcggttagagctgtgattcagtttacataagatctagaaatataagttccataacttctaaacgaagtcatatccttaagccattcttaaacttaaaagcgaataactccaaacatccctgattgaataactcaaaataataagctcatcaatctgataggaatgtcaatctcagatacattgccaagaaaatgaaaatgatgtagtaaagattaaatgagaaaatgatgccacatacttagcataaatgcaaacacaaaataaatactcaagtaaataaaaccattctttttttaaatgtattctaaaacaacaacaataacaacaacaaccacaacaacaaaacaggatacaggtgcagaacgtgcaggttcgttacataggtatacgtgtgccatggtggattgctgcacctatgacctgtcctccaagttccctcccctcataccctaccccgcaacaggccctcgtgtgtattgttcccctctctctgtctatgtgttctcattgtagagtaactcccacttatgagtgagaacatgtggtatttggttttctgttcctgtgtcagccataaaaagaaataaaaccattcttaggatgatatttctccttacccttctctttttacaccgagaagaattatcactttgacaactgacgctctctttctttctttcctgaaagtaagttacactgtaacttatatgagtaaatgagccctttatatgaagcttaacatttaaattctaaaggattcttaaacacatgtgtaacaacaccatgtgttagttaatcctatcataatatatcatgttcatatattagattaatacaattaatcacattctaaattgacaacattttctgagatcttggtttcttaatatttgcagtagaaacaaatattttttctcacccttgagaattaaaagtgaagcagaaactttagagtcatgttaagttgctgactatctaacttggtttctgaatgataaagtagactctaatggtgattgctttttcagtaacaactttcagtaatatttgtatttttctatcacacctttccctgaagaagaaatgctttcagatgaatagggaaagactctctaagtataggtttgagttttagaattggctagattggagagttttagatggaagagggaggtatcaatcaagtacagaagttaatgctacaataattacttgggaaaattctcacacttcagtgattgccaatcagcctgcactacttactgagtgaaatgtctatggttatcagaaatcgtacaagaaaaaaccaaaccgaaacaaaaaatagtgtagttctttttttctcaacgaagtatatttaagagcattaatttagatccaactaggcctaggtttgagcacaggattttccactgtgattaacttaaactctcttgtttgaagttgtctcacctataaaatttgggacaattgtggtaattccagaatgaaaataaaatgatgtacatacatcatttagtatattaaaaattctcaataagaattgatttttctgttaatacgattataatataatttgaggctacaactaaagaatgaaatgaatagaaatgtaaacagaatggtcacttttgaaagggcttattctgtttagaagaatgtatagacatgatcaaataaatgttcagataaatttatagagatgtcaaataataactgcaaattgtgcaattcaactaaaatgtcgagagacaatgagacaaataccttttttattcaagttttaagaaaaattactgaagtttagaaaatctatggaataaatagaacaatacaggcataccttgttttgctgctctttgctttatttcactccacaaatattccaatttttacaaattgaagttttgtggcaacctggtgtccaacaaatctatcggcattgtttttccaatagcatgtgctcacttcatgtctctgtgtctatgttttggaaattatcataatatttcaaactttattattattattatttgttatagagatcagcggtctttgagatcaactactattgtagttgatttgggccaccacaaaccaggtccatagaagatgataaacttaactgatacatgttgaatgtgttatgactgctccacccacttcagcttccctgtttccagaggcacacaatattcaaattaggccaactaataattgtacagtggtctctaagtgttcaaatgaaaggaggagtcccaggcctctcatttttaatcacaagctaaaaataaataagcttagtgagaaaggcatgttgaaagcccagaggccaaaagctaggcctcaagcaccaaacagccaacttgtgaatgcaaaggaaaagttcttgagggaaactcaaaaagtgctacttcagtgagcacatgaatgataagaaaacaaaacagtcacacaccagggcctgttgtggggtagggggagggggagggggaagggataacattaggagatataactaatgttaaatgatgagttaatgggtgcagcacaccaacatggcacacgtatacatatgtaacaaacctgcacgttgtgcacatgtaccctaaaacttaaagtataaacaaaacaaaacaaaacagtctgattgtggatatagagaaagtgttactggtttggatagaaaatcaaaccaaccacaacattcccttaaaccaaagcctaatccagaacaaggccttaactctcttaaattctgtgaaaactgagagaggacaggaagctgcagatgtttgaagttagcagaggttgtttataacatttaatgaaagaagtcatctccataacataaaagtgtaagatgaagtagcaagtgttaatgggtaagctatagcaacttatctggaaaatttagctaagatcattgttgaaggtggctacactgaacaagagatttttaatatagatgaaaataccttctatggaaggatgccgtgtaaaactttcataactagagagaagtcaatgcctggcttcaaagcatcaaagtacaggctgactatcttgttatggatgaatgtaggtggtgactttaagttgaggctgatacttactgaccattctgaaaatcggagggttgttaagattatgccaagtctactataactgtgctctatgaatggaataacaaagcctggataacagcccatatatttacaagatagatatgaatattaattttttccattggggcttcaaatgaatatttaagccccaatggaaaaaaaaagattattttcaaagtatcactgctcattgacaatgcacctagtcacccataagctctgatggagatgtacagggagatcagtgttgctgtgatgcctgccagcacaacatccattctacagcccatggatcaaggagtaattttgacattcaagttttattatttaagaaatacatttcacaagactatagctggcataggtagcaattcttcttatgtatctgggcaaagtaaattgaagaccttccattctagatgccattaagaacatttataaattataggaggagatcaaataacaactttatcaggagtttggaagaagttgattccaacactcatgaatgacttcgagaggttaagacttcagtgtagataatacctacagatgtggtagaaattgcaagggaactagaattagaagtggagcctaaatatatgactgaattgctgcaatctcatgataaaatatacacaaatgagcaactgttttgtgtggatgaatacaaaaaaagtggtttcttgagataaaatctattcctggtgaagatgccatgaactccattgaaatgacaacaaagaatttagaatattacataagtttagttgacaaagcagtggcaggttttgagaggactgactcccattttgaaaacatttctactgagggttaaatgctatcaaacagcactgaaatctatggggaaatctttcatgaaagaagaaaagtagcactggcagttgaaagttaaaagcttcccatttctgatcaaaaagattctttcaaatcagaaaataaatgaaaaaaaaaaccgccctatttttgtattttaatttccaccctaaatttctacttcgagctttattttagcatgcccattccttaggtttccttttgttttgaataatacttccatagctatcctgaaaacttttaacaagttaaagtaaaatgatgtgattataagttaagtcattgcagggatggatgtttttatctatgtatgtgtatttttccccaacatctcccctgaccatcaggctgtcatcttataggatacagtggaaatttacgtttcttttagagatggtgtatcactatgttgcccagactggactcagattcctggggatcaagcactccttggcctcctgtgtagctgggattacaaatgcacatcactgaacccagctagtgccaatttttgaagatattattgttattatgtctttgcagaaataaagttattttatttatttgtagttactacagaagaaatgactttgatagataaaaaatagtaacaaatttcaaatagaatggaaagagtaaattatctaaaatatcagaaataacttgttttagcttatatatacttgatagtttaaaaaatatttttctctcaaagtagcatactatatttctgttgtgaaattatttagttcacatatcatgatcttttaaacttattttatttacaggtatatctgcatataaatttaaatcttcatgttgaaaatacatgattacctgagaacacagtttaatttatttaaaacagttacattatgttagacttatattttgtttttattttttcattatgtatatcgctatgcttattgaaatgtgtgtatatatatatatatatatacctctttacatgcttgcaatagttaacctctgcagaaatgtttatgcttatttttgcttattccatttatggtcagagagagagagagaaaaggaaggaaggaaggaaggaaggaaggaaggaaggggaagggggaaggggaagggaggaagggaggaagggaggaagggagggaggaagggaggaaggaagtaaggaagaggcaaggaaggcaaggaaggccggcaggaaggaagaaaagcaggaagggatggagggagagtgaaaaaaagaaaaagaaaagaaaaaatagccaggaagactgttcttacataaaaacgttctcacctattggttatttcttactctaacaggcacttacgatactatttaggccacctgctaagttctgtatacagtggcatctgtacattcccttcttatcattggtagagagactcctaaatcaatactcatcctgagagtgagctttaatatagtatgggtggtatttataagtaatgaagcagtcaagaggagaaacaagtccatgtttatctgaaatgactatcttctcattcaatgcagttacagccacctacagaaagggaaaatcatccaaacagaatttaagaaagaaagtttacattcgcttgactggaaatcacaggcaaattgctttgttggcatgggataaatgaaagttaaacacgtttggatattaggagagacaagctaatttgaagtattggaattaaaaaattaagtacatagatttcttgaaacaatcactcacagatacagtgacatgggtttgctcaaagaatagagaagactggcacattttgacagaatgttgccttgggtttattatttgcatcagatctgctcaatagtttagtgctgtatagattctgtgtttagaaggattccgagggtgtctgttgctgagcagagaaaaagctacacactatttgctatatcagccaggggaaatggaatgagatgagatatttgtcattcatgtggtagtgcaaagatctgcagctgtgctgccttacagaacctggttttccaccctctacatcatttcaaaactatataaatttgatcaattacttaacctttttaattctctattttcaattttatcacttgtaaaatgaagataataacagctaccctgattacctacagtgaatttagaggtcatagataaatgttctaacattatgcctggcacatgatagccaacatttacctagtgccttctattatcatgatttcttccctgacaactgagccactttttatctttagaaggcaccattttttaactattgccagtgtcatttgtgtaaaagtttcttagtaaagcagtctttgataatgattatgacttttctgtgtcctcaagaagggttccttgacttatataataaattcttctttgtctttcacatttaaaagggaaagtcaatattaatcaaatgagtgtgttcataaaagtaatgtcctcctcttcggaagaggaaaaacagcattggtttacccaaaatctgtttctgtgcttagaataaagatctagtgtctgaaatcataatggcattctaacaaaggattaaacaaataacttcagaaaacataatacaccttaatgatatttcaaagtatttatcaatgttattgtcaactttgaaaggtgagaattttgtaacatgatttgacaatgcttaactacaggttttatgtaaaaaaaaaactagtcacttacatgttcctcaaattattagttcatatgttacggaagaaaatgtttgccacatttctgaataaaagtcatcaaaatattgtgatctagatgtcatgtaaactgaattaccaagaccctatcttaagtgactctatcaagacccataaccagaagtaacaaaatctctgaaggaaaggatttctgcatgttttcaatatgacagaaaattattttttattgttctatgatgataatgatggcaatgcagtcccacctcacttttgaaaccagacttcagtgtttctctgaatacttttaagtgtggccaacagcaaagtggctgaagtagtaggattgaagactgttagccttaaggacaaaaatggtaatataattttcatcatactataattttacctaatattccttatattgaatgtcaggagaaatatattcatatatattatttccattaatgcattttaataacatatttagaatgttacattatttagcatctcagtagcaataaatagttttttatttctttatctttttaacactttgtaaagaaaatacattttactggtaagttatgcattgcataggggaaaacaaatggacaaaatgaacatatgaaaatcagctatgccttaatgattatattttatgtattttaaatatagtattcctaaatctattttacaaatgatgctcagtaaaatccttaacctctccattgcagcaggttcccagcatgaaggggctaaactaacaaagctaggggcctggcattagccccccagagttactgcaagcaggcctggagtactaaactaatctttggccccctgagatcttccagagacaaagtcaatcgactgaacccaccatattcctctatcaaactcccaagggaatcaaagaagataaaagcaaataccttatccaaagggcagcaacttccaagattgaaggaacatctgcccacacagattagaatgtaccagcatgagaactctggacgctaaaaaatccagggtgatcatcctccagatgatcatgctagttccccagcaatggttcttaaccaggctgaaatgaccgaaatgccagaaacagaattaagaatattgatagggatgaagattactgagattcaagagaaactcaaaacccaatccaaggagtctaaggaatacaatacaacaatacaagaactgaaagacaaaatagccattttaagaaaaaacaaagctgatctgatagagctgaaaaactcacttcaataatttcaaaatacaattgcaagtatcaacgcaaaatcaaccaagtggagcaaagaatctcagaggttaagtctggtactacaaattaattgtcatacaaaaataaagaaaaaagaataaagaatggacaaaacctttgagaactatgggattatgtaaaaagaccaaatctctggctccttggcatccctataggagaaagagtaagaaagaaagcaagttggaaaccatattttgggatataggccatgaaaattctccaacctcacccaagggccaacacttaaattcagaaaatacagagaacccctgtgagatactatacaaggtggccatccccaagaaatgtagccggaagattctcctaggtcaaaatgaaagaaaaaatgttaaatgctgctagaaagaggcagcaagtcacctacaaaggcaactacatcaggcaaacagtggatcttttagaagaaaccctaaaagcctgaagagattaggggcctatattcagtatattttttaagtgataatgcttcagatttcttcctacataattagaaaaaataatcacaacaaattggagaggaaatacaataaccttaaagataatctgggtcttatctaattccaaccaaaaatttcatatctagccaaactaagtttcataagtgaaagagattaagattcttttcagataagcaaatgttaaggaaatttgttagcacgtgacctgccttaaaagaggtccttaaaggagtgttaaatatggaaaggaaagactgttacaagacattataaaaacacactttagtacataaatcgacattctaaagcaactacacaatcaagtctgcataatggccagctaaaaacatgattaaaggatcatatctgcacatatcagtattaaccttgaatgtaaatgagctaaataacctaattaaaaggcatagagtggcatgctgaataaagaagaaagacccaactgtatgctgtcttcaagagaactatttcacaagcaatgacacacagaatctcaaattaaagggatggagaaaaatcaatcagacaaacagaaaagagaaaaaagcatgggttgctattttaatttaagaaaaaacagagtttaaacacacaagcaattaaaaagacaaagaagagcattacataattgtaaaagtttcaattcaacaagaaatcccagctatcctaaatatatacatgcccaacacaggggcatccagatttataaaacaagctcttagagacctacaaagagacttagataaccacacaccagtagtgggagacttccaacagcccactgacagtattagacagataatcaaggcagaaaattaacaaatatatttggaacctgaacttgacacttagccaaatggacctaacagacatagacagaactttccaccaaaaaacaacataatatacattcttctcatctgtacatgacacatactatataatcaaccacacaatcacccataagacaatcctcagcatatgcaacaaaattgaaatcataccaactgcactgtcagaccacagcacaataaaaatgtaaatcaatactaagaagatcactcaaaatcatacaaatacatcaaaatgaaaaaagctactcctggattacaatgtgggtaaacaatgagattaaggcagaaatcaaggaattatttgaaatgaataacaaagatacaacacatcagaatctctaggacacagctaaagcagtgttaaacaaaaataaacaaaccctaaagctagcagaagacaacaaaaaaccagagtcagatctgaactgaatgaaataaattaagacctgaaaaccatacaaaagatcaacaaatttagtggttgtttctttgaaaaaataaataagattgataagtaggctactgaaaaataaaggtctgaatatccacaatcagaaatgacaaaggggacattacttccaattccacagaaatacaaaaaaaaaaaaaaaccttcaagtaatattacaaacatgtctatgcacacaaactagaaaacctagaaaaactgataaattcctggaaatacaaccttgcaagattgaactaggaagaaattgcaaccctgaacagagaaataatgagttccaaaattaaataagtaatacaacgcctaccaaccagcaaaaggcttggaccagatatatccacagctgaattctaccagatgtataaagaagagctgcatcatttctgctgaaactattccaaaaacattgagaaggagcaactcctcctcactgattctatgagtcatgcatcattctgatatcaaaacctggcagaacacaacaacaataacaacaaaagaaaacttcaagccagtattcttgatggacataaatccaaaaatcctcagaaacaaacaaacaaacaaaaactagcaaaccaaatccagcagcattctaaaagctcattcaccatgatcaagtaggctttatccctgtgatgcaaggttggttcaacatatgcaaagttagtaaatatgattcaccacatcaacataattcacaacaaatccacatgatcatctcaatagatgcagaaaagtctgttgataaaattcagcagcccttgaggttaaaaacctccaccaaataaggcattgagtaaacataccacaaaatagtaagagccgtctatgacaaacccaccggaaatatcatactgaatgagcaaaagcaggaagtgtcccctgctgagaaccagaggaagaaaagaatgcccactcctaccattcctatttaacatagtacttcaagtcctagccagagcaataaggcaagggaaaaaaaataaaaatatacaaataggaagagaggaagtcaaactgtctctatgtgcagattatatgattctatatgtaggaaaccccatagtctctgcccaaaagcacctagatctgataaacaaattcagaaaagttttagaatacaaaatcaatgtacaaaaatcagtagcatttctatacactaacaacatccaagatgagagccaaatcaagaaggtaattgctttcacaatagtcacaaaaacgtaaaatacctaaaaatatagttaaccagggaggcaaaaggtacctataatgagaattacaaaacattgaggaaataaatcagaaataacataacgggaaaaacattccatactcatatatagcaagaatcaatactgtaaaaagtgcaatacttcccaaagcaatttaaaagaacaaagctggaggcatcacattacctaacttcaaactacagtgtaaggctgcaataaccaaaacagcatggtattggtaaaaaagcagacacatagaccaatgggacagaatagacaacccagaaataaagccacacacccctacaaccatctgctcttagacaaaattgacaaacaagcaatggtgaaacaattcagtgttcaacaaatggagctggggtaactggctagccatgtgcagaagattgaaattggactcattctattcaccacatacaaaaatcaactcaagatgaattaaatacttcaatataaaactcaaaactttagaaaccctagaagataacccaagaaataccattctggacataggcaaaattttacaatgaagatgccaaaagcaattgcaaccaaaacaaaaattgacaaccgggacataatttaactaaagaacttctgcatagtacatgaaactatcaagtgtaaacagactttgatagtttgaacttctgcatagtacatgaaactatcaagtgtaaacagactttgatagtgtaaacctacagaatgggagagaatatttgcaaattgtgcctctgacaaaggtctaatatccggaatttctaaggaacttaaattaagaagcaaaacaaacaaacaaaaaccacacaaataaacaacccattaaaaactgggcaaaagacatgcagagacactttcagaaagaagacatacatgcagctaacaagcatgtgaaaaacgctcattatcactaattattagagaaatgtgaataaaaatcacaatgagataccatcttacatcaatcagaatggttattattaaaaagtcaaaataacagatgcctgcatggttgcaaagaaaaggaacacttataccttgctggtgggaatgtaagttgattaagccattgtggaaagcagtttggagatttctcaaaaaacttaaaacagaactaccatttggttcaacaatcccattaattgagcacattcccaaagaaatataaatcattctaccataaaggcacatgcatgagtatgttcattgtagcactattcacaatatcaaagacatggaatcaatcaaaatgcccatcagtagtggactggataaagaaaatgcagcacttatgcagcatgtcatattacacagccataaaaacagaacaagattatgtcctttgcaacaacattgatgaatgtcattgttctaagtgaactaatgaaggaacagaaaaccaaacactgcatgttctcacttataagtaggagctaaactttgagtactcatggacacaaataagggattcagagacactgatgcctacttgagagtttagggtaaggattgaaaaactacttatcagctactataattattaccttgggtatgaaataatctgtacattgcacccccatgacacctaatttacttatataacaaacctgcatgtgtacctatgaacctaaaataattaaaaaaaatacatgctaagattaatccatatcagttatttccagaactgtcatttgaatgtggtagagatataattaatataattgaaagaatagttagaatgcctgggttcaaattatggctccatcacttgttagatatgcaattttgtgcagtttatctcatctccccaaacctcaatttcatcacatataaaatattttaagcgtaatatttcataggttgtacttcttgatctataatcagtttttacaaccttttgaatttgtttatgacataagtgaccatagcaccactattatccataccatgagttgttctacaaaaagtgcatagagaccattttcttctagaacagtgatttgactataatagattatcatgaacattttaagctttatctgatttgaagaatatttactttctcaaatattacttaatatttactggctcttggtcaggtggcatggattcacattttgattctatcattcactactgcataagtctgatagttttactcaaattataggtgattatagacaggtatctgatgatggatttttttcaaaaatttctgaacagtattgatagatgtggtatcaacggtacagtgaaacttgccatttctctttctcagagagtggagattaggcatcttaaaaagagaagagcatattgagaggtaaacagcataattactcttaacagtgagccagatattttgaatgctcagatgtataaagctgagtctcatccaactaaatatgaatggttgtctgccttagcagagtattttaatcacattcatcacctccagagtaatgctgattacaaggaactccattaaaataaaatgcatttgatattccaaatagttttcatgatagtatggctgaaatatgtacatttaaattatctttaatatagaaaacaaactgatctttctaacttccaagtcaatacacaacttaccatccccacttttagctataactcaaccctagaaaagtactgttagaaatcaaatataaagtaaaaatgagtgtattgggtttcatgttatttagtcaattatagggctaataggcctataagaatttaaattgcattgaaaacttgaagaaatatgacatgcagagattatcctagtagataaaattccttagatggtatgggatagtaatataaatttttagaattatttccatgtttcctactttaagttttacacctaccatacctggagaataggatatgtaggtatttgaagacttaaccacaggaaatgggggcgaggaagacatattttaatttattttttcaatacggtgtctcgctctgttgcccaggctgtagtgcagtggcgcgatctcggctcattgcaacgtccgcctcccaggttcaaacgatcctcgtgcctcaacctcctgagtagctgggactaccagtgcatgccaccatgcccggctattttttgtatttttactagagacgggtttcaccatgtgggccaagctggtctcacactcctgaccttagtgatcttcccaccttggcctcccaaagtgctgggattacaggcatgagccatggcgcccagccagaaagacacattttaaatcttagaaaataagatgcaggaaatcctgttgagaacatagaagcaatcttcatgatgttatacagacctacttctctaatataattctaatagggtttacacatgttaatagtaagagatgtggaacactgtagctgtacttggtatactcctagaggctgacctctataggtaataaatgaaactggaccatggactacttacctaagctacagaacctagagtaaattgaggtggtaggcttgcctgatcagccccaaagaagggtcagagaaattaagtaagactcaactgacaaaatttgttgcaaactccagggacagtaaagtttcttaggaaaaatgagtagtacatcatgcaacagtaacttagtactatagataccactgttcttgcccaggtccatataaaattgagaggaaaggagtctaaataaatcatattttgatatattttccattggaagtaacttgctggtatagaaacttgaaatttgaaacaactacttctgtccagtttgccatttgcaacagctaccaagactttattctcagaagttacaaaaataacaaatggagactaaataaatacacaaataataaaataattaaaatagtaaaaataaagcagcatgtagatttaagattcctgaaaatacacagcctatctgactttttgaagcctgcatttatttcaaaataatacaaggtctttcaccagtaccaaaactgttttgggacagtattctgtgattctcacttcatgaaaaactggctatttcatttcaacaaacacacattacatgtttaccagacataatgcttagggttgagtatacaaagataaaaaaaaccacatgctggctgtttcatcaaatacatagaaacctaaaagaataaagaaacccataaagagatcattttaagaaggggaataaaggacatgatataaactcagagcaggactgcttagccccaatcactagattggtcatcacttttgggatggcataatttctaacataatctttaaatgcaggtaatgagttaagtaagtaaataagtcagagtttatcatgttttagcaacaggaaaagcatgagaaaatatatgcaattataaaataacatgcatatgttgtaggaactatattctatataattgtaacataaacatcaagttatgcatattagtggaaaaggctgtagaagcaggccaagaccacgacacagaggacatgttgtatgccatatggataatcacaatagagccagagacttgctaaatagaagtggaataaggccagttttttcttgtggataaatcactatggcaacattgcggatggtgaatttcaagagtgcaagataaaaagcaaaaggtcatggctcatatttggtattatatttgcatcaagtaaaatagactaacccaagttggactgtgacaaatatgctgaatcttacagagttgaatattttttatccagatgataaaacatataatgtattgaatggcaaaaattccatctatgtagatatatagaaaatgaagaaaatttttgattagacattatattacatagatcggacattagatctgacattctattacagcagccatgtgaattttgcagttacatggttttactgtttctctttgttttctctctttatagtcaggattttacctgagtatctagattatttctcagcttttattttacttaatctatagtgttggcctcctcttaggcctaaactgaactatttcaaatatctgactcctaattgtgcaaccttaaggctgtcagaatcaccccaatgcaggccagaataacgtgtgtgtgtgtgtgtgtgtgtgcgcgcgcgtgcgtgtggtcatctttattcttggcatgcttaaatagattttcataactgttccctcagataacgagcaataatagctctaatgatctctgaaaaaaaggaaacaaaatatcagaagcaaacatttgttttcattattttctcagaggagttttacaatttttatcgcttgagttagacatcatgttgtaaagtgagtgccttagttttagggaagaataattcaagattgactatcaaaacctgaccgtggatatttgctttaaattcttaccaccactgattatcttctttcattccaaagaaaaagaagagaaaaccaaacaattcattactatatggaacttacacctccctctgataagaaatcagttgctcaagcactgaaacaagatctttgcaaatgcattctttttagtatttgaaacttaatcacatcgtatagaaacagaattttatacgtaagtaaagaatactatgatcggttccaagattctccacttattcttggattgattgaagagagaaggaaatacacctactccatacattattatacattaatgaagaaatacacatttccttcaaaagttatactgcacaatctatttaagcctcagttttattttctgtaaatgaatatgaggataataatatcaataacaattgtaataatatctacttccattgttgttgtgaggatcaaatgacagggggtctttagtatatgcctggcacaaggaaacaaggaaacacacaagtcttagcaattacaaataattcatatatatatatatatacatatatatatatatataaaatcactttaaaacaattctaatacatattaatgtatagttatgggagtaatgtgtgtgtgtgtgtatatatatattatttatgcaggacatatctaaaatatatatattcataaatatatgtgcaggacatatcttaatatgtatataaaataaggcttacattgaatgagtcaataaacacagaatgaaagattgctgaacttatggttttactttaaccagatttttaggaattttccactcatgcaattgactaggataatgtatatgaatgtgtatatgtgtgtaagtgttttttaacacctttatgtatatatatattacatatttatatgtaatatatgtaataaatatgtactagacatgtaataaatatgtatatattacatatttagatgtgtcctgcatatatacttaaataaaaatataaatctgcatctatatacacatttaaatgtgtcctgcataaatgtagcaattcacaatgctactgacgtgatcctaccaagcaaacgtttgagtaatccttcttcctctaattgtattcattcagatcaatgcaatcagtcccactcaagtggacgatcatgcaatgattctttacaaaattggtaaatgaaacatcagttttcctagtgacaaaagcttgtatctaagggttttacaaacactgagaaatcaataaatagtgctggaaaagtattgtgaaggatattgttagtttcaaaattaatcatatttagtttaatattgtttaataatactgattagatttttactgtaggttaaatttctgagcgaagcatttctctctcaagactatgttgcccaccacacagttttagaatagcagtatattatgttattattagcctatttattttctactggctgctgcagaaaataaacacctctataatgaccacagtctagatttcagcctgtgtcaaaaggattttgaattatacttcatttttagcttttgctcccaccctttgcacaaagtagaagagacagaacagaaatgttttcctaattgctgttgcaagaaatacttcatctagaaaaaaatgaggaattaatttattttagcaggaaaaaatgaacaataaaaaatacatagagtgaaaagttgtagtcttctaatacctcttttttacttgatgactcaactttttgggaggtttctgggtctaccacctaattatttttactcaaattttattcctggaaggaagatggccatatgcagtaatttatggttcaaaccagaatacttttgagggtgagagcggtattgttaataataatgcagcaggcataaaccggattgctttgggaaaaccagtatatatgatcacctgtatataagggactacaatttcagtacttgacagcatggcaacactctatttagcaatgttttaggtttatttaatggtcacttcccttgccatgtggtaattacatctgctaaaagggtaagaggctgcttgctgtcacaactcaggctattcacatacttaatagacctgaacaaatactcagaagagtttcattgaatagctgtgtgtaccattgagataatctatcatttaacgtttcaaacaaaaatgatatctttcctctgatacttcaagtcattgcaacatatcagtaaaacagcattaaggaagtgttgataacatatcttttgaatgctgataatgtgactaggtctagtgacatctttcatatatttaatctgacaaacatgaacatacaacacttgaaaataagaggacttcttgatttatagggagtatattgtcactatgagttttttcatgccatagatatccattcctagggcaaaacaataaggacaacgtacaaaatcaaatctgctcatgtatcacatggatgaaaactaaggaatcatagaattctgagtaggtatagaccttaaagttcattctattttccaacattttattaaaaataatcacctttataatatccataatttatgagtatatttttctgactataaatgtccaaaaatgtcgataaattcctcaaaagaaagcccagttgaaaatatacaggagtttattcattcaaccttaatttgaaaaactaataaaagttattatttttttaaaccttacttctaatgtcttgaacaatgctgtagagtttactcagattttaaaattataatccttaagtagtgggactaagcaaacctgtattaaaccattttgcaatgtataatatcttctatttctataattatcatggattaacttccagatatgtcataagtaattgtattgagatttgtataatgtttaattgcttctgagttttctgcctttgattatacaaatgaatattacacatccttaaattctgaaatacttacaggtatttctcgtatatacgtagtagtgtaatttgttccctgaggcactcctaaatttgaatgtaaagagtatagaaattactttttccctttacaaggtacaatttaattatcaattcttttcctttacttaatcttcaaagtttcaaaaagggagagacaaagaaaatctattgtcagtagaaaaatgaatatttaaaaaagcagaaaacatcattgggtagttaggctaaaagaaataatctgttctccaagttcaaacaaagcatttcgaaattcattgttttaagcattaatttatattgctaaattttaaaagagatttaaaaaatcataacagctaagacacaacaagcagtagaagagacatatgaagaaatactacactgatggaagagacaatgatgaaaagaacatgtcatttgaagcaggattgtgataaggagagttttgaaaaagtttgagtgctatagaaaatgtctcatatttatagcagaggttagaaagaactcagatgtcaatgcaaataatggaattataggttgatgggtgcaccctgttctccagctggaaaaagtgtagttggggctttgggtgtacaaaactaagggggcagtaatttagttcatatagccacggaaaataacattctaaactagaattggaggctacatttagcaccccctaagatgatgagaagagctaaccaactgggttgaagattggtaccagtttaaactgaaacactagaaagaattaatcatcttatgagttatagcaagattcatgtcctaaattttaattatcataataattttaaacagatggatagtttggataaactttgaacttcactatgcagtaaaacagattttagtattccatgttttaaatagacctgtaagagatgtatgatagaaaacgttggcacagatgaaaattacgaagatagcttttaatttctacctcaaatttttaaaagattatctctttatgccataggtaatgggcatcataaatcactagctgcaaaagcaggtaagtgtgaacattccttcaatgccttggcataaatctagaacagttatttctttagactttatttcatagaattcattcaatttggcatgtgttcatagatgtggctgtttgtaactgaatgaagttaaaacacacacacacacacatacacacacacatacacacacagggcctgatttcaagtttttttacatttaatagtccacattaaagaaaatattcttcaacaaaattaaatttcaaaactccttacatgagtcattgtacaacttaatactgtgaacagacgcacgagaggaatatatttaggtaaataaaacttgtacaggttggagaacaatattctacctttcatagtagcaccgtagtgttgttcaaattgcagctttatgctaattagtgttgttctggctttttaaaacgtttaagaagtaacagtttaaataaattccgaattgattaagtagtcagtattccacagatcatggaagattttagaattctggatatatttccattcatctgtataatcagtgtctgggcaaataatcaatatgtctaaaatcttcatgacgaaacacttaaatatttcctgacaaagctctaagaacattttaatatatctggccatatgcctgtaaggttgtattacattttacaggtatcttatttatttaaaatttgaaaattgcgttttctaaatttactgaatttctttccctagacctgaaaaggcaaaacatgttttatcaaaaaggttaaatcctttcaccacaaactccattttgacttttcccttgataaacattgaagtaatattttattttgctttcacagaagaaccaaatggctcacattaattctgtgtcttatgtttatcaatgaaccaatagattgtgatgaacagaatcaaggctttgaagttgaaagtgtctctgactgatgctacttcacctctgtgagactcagttttcacatcagaaacactggccacgtagcagcccctttattcttcggttatattttctttcacaacttcacagttatacaggacttagaaagaacaatgtcagacagactaaagtgggacactgaactgtaatcagagaaggagatctctttttgagaaaggtgtcagatatcctgtgaagtgaactgtctatcgcaaacatcactggtgtctctaaacagctccaccagtcgcaactaaaagttagcctttttcagcagtgtagagatgagaagagagactgataggtaatatgaaataatagaacttacagcacgtattcagattgtatttgtgtccagtcgcaatgtataggttcatacatgtaaacttcaaacacatatgtacagtttaagcttcactctttatcctcattaggattcaacaaaactgttttgtaaaaaggccttaaacattcaattaatagcagtataatctaattccaatataggaatcataactttcaaaaagatccatttgattcaatttttctaaagtacataataaaagtcatcttataggcttcttacatatcttaggatatcttttagagtcatagtgaattggcttcattaactggtcttgaggtttgggaagttaagttcttcaagcccatggctaatagatttaacattcaagaccatccatttgatatattttcaaacttcacaggactcctgtttttattcccaaactataaccttttgaggtcaaaaataaaactttttaaatcttcatgtattctattcacttaatgttataatttttataacttctatctttgtggtataaacaaatatattcaagtgtgaaaaattttaacatcatgttgtgtggtaaatttatttacattcagttttggggtagaaagtgtattcttaaaaagtttaaaaccaactgttttcatgattaagctaatagaaattattaagcacatatttgtttgccaagagaaatattgagattgctgatactcatttttttttctccaagagtaaactatagtgagttccacaaatgcagtaaatatatctgttttagttcaccactatatttcaagtgcaatgctcggtttagacttaaaataattttccttatgcaaggtaactgactatatagaaattatttgaatagagtttgatttttctatccattaagaaattaccaatatggaaaataaatttccttaagggaaggtggaggcataggcagattgattctgctcaccctccatcttattcccccaagtgtagattggtcttgttaaatcgcccatgcacttgttgcagaaacagtcaaaatggcgggttagaggctgttagcatgcctcagccactcggaaatagcaaaacagtgcataaagattgacactgtgagctttaattcacgaaggaaagtgggaattcaccagaataacaaaggacactccagatccaagggagaagatagtgggcaagccaccccctgatggcgtttggctggtaaaacgatatgggtgcagtggaacattttctttcatggccagacatatctccaggcttttgatgcaccatatctcctgggataggagcttcagttgccattcttttcccacacagacaatttagtacagcagcactccctccacgtcacactcagacatacctccagtcatttggcacacacacgtccacagattagtagtttgagccattcatcccttcccatgcaaagaccttattacagcagcagtttctctgcttttggccagggtatatttgcaggcatttgacacacacattctcttggcttaggaatctgtgctgcccctcccttcaggtgcagagattgtggtacattggtgctctctcttcttgatgcccagacatatctctggaatttggagcactcactcttctaggttatgatttaggccacctcactcttcccatgcagagaacctgaggcagcagaagtttctagaattcatgcctaggcacatctcctggttctcacaggctgcccactgggacccttttcaaagctgatgcatgtgcatgccattgggaaacctgtgggtgggcctgctcagtctggtcccacacatcttggatctttcctaaggaggaaggtgataccactgtgcattccacagatcaacccatggtctgaggcaacagagagcttctcccattaaaaaaggattaggtatatacccacctattttgaccacaggtggctcatacccataagtgacacctactggcctagagtttgaaatgcaaaacacaatagaaaatgatattgattcttcctatccatgagcatggaatgttcttccatttgtttgtatcctctttaatttcattgagcagtggtttgtagttctccttgaagaggtccttcgcgtcccttgtaaggtggattcctagctattttattctctttgaagcaattgtgaatgggagttcactcatgatttggctctctgtttgtctgttattgatatataagaatgcttgtgatttttgtacattgattttgtatcctgagactttgctgaagttgcttatcagcttaaggagattttgggctgagtgaaaatggccataccacccaaggtaaatcatagattcaatgccatccccatcaagctaccaatgactttcttcacagaactggaaaaaactactttaaagttcatatggaaccaaaaaagagcccgcatcaccaagtcaatcctaagccaaaagaacaaagctggaggcatcacgctacctgacttcaaactatactacaaggctacagtaaccaaaacagcatggtactggtaccaaaacagagatataaatcaatggaacagaacagagccctcagaaataaggccgcatatctacaactatctgatctttgacaaacctgagaagaacaagcaatggggaaaggattccctatttaaaaaatggtgctgggaaaactggctagctatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttcccaaaagaagatatttatgcagccaaaaaacgcatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggaccataaatcatgctgctataaagacacatgcacacgtatgtttactgcggcactattcataatagcgaagacttggaaccaacccaaatgtccaacaatgataaactggattaagaaaatgtggcacatatacaccatggaatactatgcagccataaaaaatgatgagttcatgtcctttgtagggacacggatgaaattggaaatcatcattctcagtaaaatatcacaaggacaaaaaaccaaacaccgcacagtctcactcatagatgggaattgaacaatgggaacacgtggacacaggagggtgaacatcacactctggggactgttgtggggtgcggggagaggggagggatagcattgggagatatacctaatgctaggtgacgagttagtgggtgcagcgcaccagcatgtcacatgtatacataggtaactaacctgcacattgtgcacatgtaccctaaaacttgaagtataataataataataataaaaagaaaatgagctgacacaagtcaacagacaagtcaacagcagtggggaatgagataggcttcctgagatctccatgattccagtccaataggaagcattgagcctgctcacatgcacagtgcattgctactaaaaataacattcaggaaagccatcatacaaaggctatatgtaaccaaagaacttatacagactctttagccctgaaagcacccagaaccaaagccagaaggaccctacaaatcatacattatagacacctcctgaaggagaaaaattccatccaaattaaaacaaattcaaaaaataaggagagatagcttatctagatgataaagaaccagagaaacaactatgaaagtatgaaaaacagagtgccacaacacttcgaaagatcacactgattcttttttttttttttttttttcttttgagatgaagtctcactctgttgcccaagctggaatgcagtggtacaatctcggctcactgcaacctccacctcctgggttcaagcaattcgattctcctgcctcagcctcccaagtagctggcactacaggcatgcaccaccatgtccagctaatttttgtatttttagtagagacggggtttcactatgttggccaggctggtcttgaactcctgacgtcctgatccacccgcctcagtctcccaaagtgctaggattacaggcatgagccactgcacccggtccacactgattctttaccaatgaatctaaactaaatgaaatctttgaaataccccatgaaaaattaaaaatattgattttaaagaagctcaatgaaatccaagacaaagctgaaaaaaacacaaagaaatcagaagaacaattcagaatattaaaaaagggtagatatcattaaaaaacaaacagaatttctagaaataaaaaattcattaaaataattacaaaatacagttgaaagttttaacagtaggctataccaactggaagaaataacttcagagctggaagacagatcttttcaattaatccagtaagataaaaattaacaaagagtttttttaaaaacttaacaaagcctttgagaaacataggattatgtagtgtccaaacctacaaactgtaagtattccagaggaagatgaagaaaaagtaaaatgtaaggaaaatgaagaaataattcagcaaaactcccatgggattgtcttttttgtgcaaatggtagctatttttattatttccttttttttttaaattttactttaagttctgggatacgagtgcagaatgtgtaggtggttacacagatatatgtgtgccatggtgatttgctgcacttatcaacctgttatctaggttttaagccccacatgcattagctatttgtcctaatgctctccctcacctcagccgccaccccccgactggccccggtgtgtttttttccccttcgtgtgtccatgtgttctcattgttcaattcccacttatgagtgagaatatccagtgtttggttttttgttcctttgttagtttgctgaggatgatggcttccagcatcatccatgttcctccaaatgacatgatctcattctttttatggctgcatagtattccatggtgtgtatgtaccatattttctttatccagtctactattgatgggtatttgggttggttccatgtctttgatattgtaaatagtgtaaatcaaaaccacaatgagataccatctcacaccagtcagagtgatgattattaacaagtcaagaaacaatagatgctggtgaggctgtggagaaataggaaagcttttacactcttggtgggtatgtaaattagttcaaccattgtggaagatagtatggtgattattcaaggatatagaaccagaaatgccatttgaccaagtaatcccattactgggtatatacccaaaggaatataaatcattccactataaagatacatgcacaagcatgtttattgcagcacttggattgtcttgggagaaatttggacatctagatacaaaaggctcagagaattcctagtagataaattggaaaagcctcactaatgcatatagtcatcagaattttcaaagtcaaagtggaaaaaaaaatcctaaaatcagcaagagagaagcatctaatcacctataaagaaaatcgcatcaaactaacaaaagacttttcagcagaaaatctacaagccaaaagagattggaagactatttttagtctcttccaaaaaaaaataccagctaacaattttatatcctgccaaatgaagattcacaaatgaagatgaaatagtctttccaagacaaacgaaaggaattcattactaccagatcaccttacaagaaactttcagtacaactttcttcacaacaaagtttcaatgcaacaaggtttaactatctatcctaaatatatgtgcatccaacaccagaacactctgattcataaaacaaatactactggtcctatgaatagagatagacagttatacaataatagtggaggacttcaacaccctattgacaccactagactgatcactgaagcagaaaatcagcaaagaaacttaacttaaactggactatagaccaagtagacataataggtatttacattacatttcatcctaaaccacagaaaatacattattttatctttggatagagcattctcctaaaccgaccatatgcttagccatccagcaagtctccataattttttaacaataaatcatatcaagtatcttcttggatcacagtggaataaaattagaaattaataccaagagtaattctcaaaactacacaagtaaatggactaaacaacttgcttctgaatgacatttgtgtaagcaacaaaattaaggcagaaatcaggaaagtttttgaagcaattgaaaatacagacacaatatttcaaaagctctgggatacaacaaagaaaagtactaaaggcaaagtttatagtgttaaatgtctacatcaaaaagaatgatctcaaagtaacatccaaattttgcacctcaagcaactagaaaaaggacaaaccagacccaaatctagcagaagaaaaaaaataacaaagattatagtaaaactaaatgagatcaagaccaaataaataacaaaaaggaccaattaacagctagttctttgaaaggataaacaaaattgacagactgctagttaaattaaccaaggaaagaaagagattcaaagaagtacaatgagaagtggtaaaagtgacattaaaactgatactacagaaatacaaaagattataagagactactatgaacacctttatgtgcataatctagaaagcttagagaaaatgcatttctagaaaaacagacaacttcccaagattgaagtaggataaaacagaaatcctaaatagacccataatgactaacaaagttgaatcatcaacaaacatctaccaacaacaaaaagtccaagaacagaaagattcaaagccaaatttcatgagatatacaaagaagagccaatactcattttactgacactatttcaagccatcaaggaggaaagactcctccttctctcttttaacaaaagtggtatcatcttgataacaaaatcgagcgaggcgacaatgtaaaagaaagctactggccaatatccttgatgtgcctaatgcaaaaatcttcaacaaaatactagcaaaccaaatccaacagcacatcaaatatacaatacaccatgatccagtgggtttatccaaatgatgtaaggatggttcaacatacggtaatcaataaatacggtttaccacataaagagaactaaaatagaaaaaacatatgattatctcaagagatgcagaaaattcatctgataaaatcaacacccctttatgatgaaaaccctcaacaaattaaacattgagaaacatacctcaatataataagagccatgtatgacaagtcaacaaccaaaattatgctgaataagggaaagttgaaaacaatctccataagaactggaacaagacaggatgtcaactcttattcttattcaacatagtagtggaagtcacttgtaatgtcatttttaccatttatcattattcttctgggaatttctcttatctcttggttaatttaactagcagtcaattctgtttatccactcaaataactaattgcttgtttagttgatcctttgtgttgtttatttggtcttgatcttatatagttctgctatgatctttgcctgatctttcttcaggcaaaataaagaaaaggcattgcaattgggaccaaaaaaaaaaaaaaatgtcaaattatctctgttaaatgatggcataattgtgtatcagaaaaccctaatgactcccccagaagacctctccacttgataaatgacttcagtaaaatttgaagacacaaaatctgtgtacaaaaatcagtagcatttctatacaccaataacattcaagctgagaaccaaatcaagaatcaatctcatttaaaatagctgcaaaaaataaaataaaatacctagagatacaattaagcaaaatagttaaatatctgtacaagaagaatgacaaacactgatgaaagaaattatacatgacaaaaacaaatggaaaaccatcctatgctcatggattggaagaatcaacatcattaaagtaaacatactgcacaaatcaatctacagattcaatgcaatgcctatcaatttagcaatgttatttcttacataattataaaaaaaaaatcttaatgtttagatggaagcaaaatagatcccaaatagccaaagcaatcctaagcaaaaaggacgaatctagaggaatcacattgtgtgatttcaaattatataatactataagtctatagtaattaagatagcatgctactagtacaaaaatggagacatagatcaatggaacagaaaagataactcagaattaaagcacacacttacaatcagtcgatcttcaaaatgttaacaaaagtaaatagggaggaaagatgctctattcaataaatgatgctgggaaaattggctagccacgtgcagaataatgaaactggaaccatatctctcactgtgtacaaaaatcaagtcaaagtggattaaagacttaaacataagaccagaaactataaaatcctacaagaaaacctagaaaaatctcttctggacatttgccttagcaaataatttataatgatgaccctgaaagtaaatgcaacaaaaacaaaatagacaaatgggtcttaattaaactaaacagcttttgcacaacaaaataaataattaacagattaaacagataacctaaacaatgggagaaaatattttcaaatcatgcttctgacagaagactaatatccagaatctacaagaaactcgaacaactcaacaagaaaaaaaataattccactgaagagtgggcaaaaacacggacatttcttaaaagaagaaatacatacagccaacaaacacataaaaaattgctaaacatcagtaatcatcagagaaatgcaagttaaaatcacaatgagatataatctcacccagtcagaatggttaatattaaaagtcaaaaaacaagagatgttggtgtggatgtcaagaaacggcaattgtttatacactgttggtgagaatgttaatcagttcatcttctattaaaaacagtatgtagatttctcaaagaagtaaaagtagaactaccgttcaacccagcaatctcatccctgagtatctacacaaaggtaaagaaatcactgtaggaaaaaggcatctgcatttgtatgttcaacacaatactactcataataggaaagtaatggaatcaacctaagtgtccaacagcagttgactgaataaggaaaatgtggtgtatacatcatgacaaactgtgcagccattaaaaagaataaaattatgtcctttacagcaacttggatggaactagaggtcattatcctaagtgaactcagaaaataaaatattccatgttctcattcataagtggaaactaaacaagaggtacatatagatgcaaagatggaaataacacacctcagagactcaaaaatgagcgagggtagaaaaagtttgagggttgaaaattacctattggttacaaagctcactatttggctaatggatagagtagaagcccagtccctaaccaatatacaatataattatgtaacaaatatgcatatatacccccgaatctaaaataaaattaaaattaaaaaaagaaattaatattagctgtagagagtagtatatcttcactgaaaagttatatgttaattttgtatggtgcaccagaatatataaaagtatatttacagtacataaaaattgtaacaaaatatatatttccttttaaaatggtttctggaataaacgactcaacagaaaagcaagactaaaggtaaacaagaaagctatatacatataggtttcttatatatgtgtgttagtatacatatatacatatatataattttagattcaggtggcacatatacatatttgttacattattatattgcatagtggtggggattgggcttctactctacccattagccaaatagtacatatatatatagatatagatatagatatagatatataaatagatacacacatgcacacctatgcacacatacatacatatatttaaaaacacagctaatgtataccttacatatatattacatacacatatattttaaaagcatgttcccattagtccgaaacacagaaatggattttatgaatttgtatgccagaataagacatcacattgagttgtagaatattccaacactgtgggttcatgagccattctgaaaaataaattacaccaataatggattccaatactttaaccatttcttgcgaaattttctatatattaatattactaatttgtaaaaatatttacattatagtcacagacactaaaaaccttaaaatcattgaagaaaatgtccattttcttagtaaatgaatgaatatttaaattatacagtaatgagcgaaatttagtaatgaactgaagtttaattcaaaattacaaattagcagcttagatcaggcatgattcctcatgccagtaatcccagcaatttgggagaccaaggtggaaggatcacttgaactcagaagtctgagacgagtctgtgcaacacagtaagacctcatctctacaattgtttatgtttatataaatataattatatatataattatatatatatataattggaaactcatttctctgattaaacaaaggaatgtaattaataaaacactgcaacctcattattcataaagaaatagtctacaatttgtatttcactctaagcaactcatttaggagcttgaaaattttatttttacagttttttaaagcacaaaatgagcacattcaagctaaaactgataaaatgggaataataccatccatgtgagtggctgagcctagtaataatttgcagtaaatattatcacaaaaagttggaactggaattcttgggaaactgttttctgctgaataatttcaagttggaattcagttctggtaaaaaaaaattactgctgatatgcactaacttgattgtcacaggttagcatgtaaatgaagaaagatttaagcaggtacctgtctaaattaatgtaggcagctgttacaagtacatgcattcaaacctcagggcatagctctgcctctctaaaaaggacttgcccaagatcagaatatagaataagagctttacattttatctttatttaaattctccctcccctttttgtggaattgtgagtgagcagcaatactacatgccttttataaccctttctaaaaatatattgaccacagttttactaacagttagaaaattggagtatgatctcaaatatacttaatgaagacacacattccacagaaaaaaattagtttaaatttagtttcctaagaaaataattattattatagagaaactattttgaaaaaggagataagaatttaaaatatttgtaaaataataaagttgattctccagtcatacctcaaaatcagtttcatctttagcacatttctacccatcaggggtgtgtgtgtgtgtgtgtgtgtgtgtgtgtgtgtgtgtgtgtgtatttgaattgacagtgaatagctataaaataaagtggtatgaaacaggaccgaaaatgctagagaaagagaatgatgagagggcacaggtcaaataataaaatgagagatatggaattcagaacttggttttcaatgaagatcatcgagattcacaacaaagtataaatgcaatccaagtaatctaaggaatctagcaaaatgacataagagctgaaagacaaaatattcatttataaaaggaacaaactgatctgatgaagctaaaaagctgactacaaaaattttgaaaaacaatcaaaagcactacacagcagaataggccaagctgaagaaaatctcagagctctaagactggttcttcaggtcaactcattcggattaaaaagaagaaaaaaaaaacagagtaaacaaaataaacaaaatctctgagaaatatgggattatgtaatgagaccaaacctgaaattaatttgcatctctgaaagaaagagagagattgcaagaaacttggaaaatatttttgtgggtattaacattaaccatggaaatgtctccaatattgctagagaggttgacatgaaaactcaggaaagacatttgagaactatactcaaacacttgactagatgagcctaacagatatctatagatttctccaacaaaaaacagcagaatatacattcttcttacctgcacatggtacactaaaatcaaccagatgattttccatgaagcaattctcaacaaattaaaaaaaacacatgcacacaaaatcatatcaaccacattgagaccacagcacaataaaaatagaaatcaatacacgggagatctctcaaaactataccattacatagaaatgaaacaatctgttcttgaatcacttttgggtaaacaatgaaattaaagcagaaaacaagaaattatttgaaactaatgaaacaaagatacaacataccagactctgggacacagctaaagcagtgttaagaggaaagtttctagcactaactgcccacatcaaaaagacagatttcacactaacaacctaacaccacactgacaggaactagaataacaagagcaaaccaatcccatagatagaagaagacaagaaataaccaaaatcagacctgaactgaacaaaactgagatgcatcaaaccatactgaagaccaacaaaaatatgttggttctttgaaacaataagattaatagactggtagctagactagaaaacatgacagaagatccaactaaatacaatgagacgtgacaaaggggatattaccactgatttcaaagaaataaaacaaaccctcagagaatctggtgcagatttctagtcacataaactagaaaaccttgaaggaataaataagttcctggaatcacacaacctcctaagattgaaccagaaagaaattgcaaccctgaatacagcattaatgagttacaaaattgaattagcagtaacaaaccaaccaaccagaataagccctataccagatatatttacagctgaattctacaaagtggcttaacaaaatctggtaccaatcctactgaaactattccaaaaaactgaggagggacttctccctaacttactctatgaggccagcattattctgataccaaaacctggcagaaacatgaaggtaaaagagaacttcaggctaattactgtggtgaatgtagatgcaaaaatcctcaacaaaatactagcaaactgaatccagcagcatatcaaaaagttaatcaaccaaaattatgaaggctttattcctgggatgcaaggttagttccacatttgcaacacaataaaatgattcagcgatccatcgtataaacagaactataaaccaaaccacgtgattatctcaatagacacagaaaagacttttgataaaattcagtgtccctttatggtacacatcctgaacaaagaagacatcattttgaatatacctcaaaatataatagccttctattgactgacccacagagaacatcatactgaatcggcacatgctggaagaattcttcttgagaactggaacaagacaaggatgcccagtttcaccaatcctgttcaacatgatattggaagtcctaaacagaggcataatgcaagaggaagaaataaaatgcatccaaatagagaggtattcaaactatctctgtagacaatgggattctatgcctagaaaaccccatagtccctgcccaaacactcctagaattgataacgtcagcaaagtttcaggatacaaaattaatgcacaaaaattgtagcatttctatacatcaatagtgtccaaggtgagagccaatcaagagcacaattgcattcataatagctgcaaataaataaaatacctagaaaaacagctaactagggaggtgaaaatatttacaattagaattataaaacactgctgaaagaaatcagaaatgaaacaaacaaatggaaatacataccatgctcatggataacaagaatcattatagtaaaaagggcatactgtccaaagctactacaaattcaatgctattccattcaaactaccaatgtcatttttcacataattacaaaaaactattcaaaatttacatgaaaccaaaaagagcctgaatagccaaagcaatcctaaacaaaaacaacaaagttgaaagcatcacactacctgactttaaattatacgacaaggcaataataaccagaacagcatgatactggtacaaaaagaaacatataaatcaatggaacaggttaaagaacacagaaataaagctacacatttataaccatctaatctgggacaaagtcaactaaaacaaccaatgggaaacaactccctattcaataaatgaagctgcagcaactggctagccctatgcagaagactgacactggatcctttcctttcaccacatataaaaatggatttaagacttaaatgaaaaacttaaaactatgaaaattcttgaagaaaatctagaaaatactagacattgtccctggcaaggattttatgactacgactacaaaagcaattgcaataaaaacaaaaattgacaagtgggacctaattataccaaatggcttctgcacagcaaaagaaactatcaacagtgtaaatagagaacctacaaaatgggataaaatatttgtaaactagacttctaacaatggtctaatatccagaacctataaggaattcaaacaattgaacaaccataaaacaaacaaccccattagaaaataagcaaaagaaatgaacagacatttctcaaaagaagacatatatgcagtaaacaacctataaaaacattctcatcatcaataataagagaaatgcatatcaaaaccacaatgagatagtatcttacaacgctcagaatgactattattaaaaagtcaaaaacaaagatcctggcaaggttgcagagaaaagggaatgcttaaacaccgctggtaggagtgcaaatttgttcggccactgtggaaatcagtttggagatttgtcaaagaacttaaaatagaacaatcattcaacccagcaatcttattcctgggtatatatccaaaggaatataaatcattctaccatgaagacacatgcatgcatatgttcactgcagcactacttatagtaacgaagacatggaatcaacctaaatgattatcaatagtggactggataaagaaaatgtcatacatatataccatggaatactacacagccttaaataagaatgaaatcatgtacttttcagcaacgtggatggaactggaggctattatcttcaacaaattaatgcagaaacagaaaaccaaatgccatatattctcacctatacatgggagctaaacattgagtacacatggatacagacaaaggaacaatagacacagggcctacctgagggtagagggtgggagttgaggatcaaaaagctacctattgagtactatgctcattacccaagtgatgaaataatctgtacaccaagcccccatggcatgcaatttaccttgtagaaaacatgcacatgtaccccaaacttaaaataaaagttggaaagaacaaatcataagaaagtaatcaaagtagaacccagatataaatccatgcattcacagccaactattttttgaaaaaggcaccaagaacaggaaatggggaaatgagattttcttcaataaatgatgctgagaaaactggataaccatatgtaaaagaatgaaaatggactcctatttctcaccatatacaaaaatcaaataaaaataaagacttaaatttaaacctgaaactatgaaactattagaagaaaatattgaaaaaatacttaacgacactggtctatgtaaagagttttctttgtgtgtgtaatatctcaaaagcacaggcaaccaaagcaaaatatagacatatgaaattacattaggctaaaaaccttctgcacagaaaagaaaacaatctagaaagtaaagagacagccagagaatggaagaaaatatttgcaaactatccacctggcaagagattaacaaccagaatatataaggagctcaagcaactcaatggcaaaaatagatgaaattaaaaatgggtagaagatctgaaaagacatttttctaaagagacatacaaatggcccacagttgtatgttgaacaatgaaaaattgttcaacatcactagtcttcagtgaaatacaactcaaaagtgcaatgagctattatcttaccatagcttaaattgattttatcaagaagacaaggaataacagatgctggcaaagacgtgaagaaaggagaactttgtacaccgttggtaggaatgcaaattagtgcaaccactatgaaaaaaagtatgacagtttctcaaaaaaattaaaaataaaactactatatgatccagcatttccactattaggtatacattcacaaaaaggcagtatattgaagagatatcttcactcccatgtttattgcagcactatttgctatacccaaattatggaatcaaccaaagtgcccatcaatgaataaagaaaatgtgagatagatatatatatatatatatacacacacacacacacacacacacacacacatatatatatagttgaatattgttaagtcatacaagagaatgaaatcctgtcatttgtagcaacatgatggaacaggaggtcattataagtgaaattagccaggcacagaaagacaaattgcatgttctcactcatatgtgggaactgaacaagtgactatcatgaagataggaatttgattattgggtaccagtggccaggaaaggtagatgggaagggagggtgaagagagtttgaataataggcacaaatatacagtttgagagaagaaataatatctagtgtttgatagatcaatagggtgattatagtttgcaatgattgatagtatatttcaaaatactaagaataatttgaatgtttctagcataaacaataaatatttaatggatatctcaattacactgatttgatatttacaaattatatacatatatgacattatcacatgtaacctgaaaatatgtacatctattatgaatcaatgcaaaaattggaaaaaaaaattaaaaataaaaataaatataccaacaatgctgtgaataaaggtaatcaaagcagcacagtagaatacagagagcatggaatgagaagcagacaaacttaaattcaaattcatattaggagacttctagctaaatgatcgggggcatatcacattaataaaaattattaacctccagagagccagagccagagacagagcaagtcagacacagagaatgaaaaaacatccaaactaccaatatccttatgaaagacgggacatcactatagaacttaaaaataacaaaaatataataaggaaatactgtaacaactctacatttgcaaattcaccaacaaatataaaatggaccagtttccttgaaagacacaagactcactcaagaaaataatggataacctaagacatgtcatatatttagtcaagcaattagatttagacttaaaaattcttccaacaaagaaaaattttgtctggatggactcactggggaattccactaaatgctgaagaaggaattttaacaattctgaacaatcccttccaaaaaatagaagaggaagtaacaactctcacctgattttacaagggagcattgtcctgatactaaagtcagacaaaaacatgatcaagtaaaacaatgaactaatctctctcatgagcatagatgcagaatttcttaacaaattattaacaaattgaatatggcaatatatacaaaacatactacatcacagtcaggtggagcagattccagtaatgagagcctgtttcaacatcagaaattgagtctacataattcttaatattatcagaataaaaagaaaaatcaatagattcagaagaaaagcatttgataaaattcaagatttgtttatgatatacactttcagtaaactataagtacttccttaacctgatagagtttgtctacgaaaacgtacagctaacattataatggcgaaagactgacaaagcaagtatatctcttcctcatcactactatagaacattgttttggaacctagacagtaaaataagacaaagaaaattaataaaatcctccagattggaaagaaagctctctctattaaaaagagaacatgattatctatgtagaaaatatctgaaatctcaaaaatgaaaagaaaataaactttcaagaatagcaaaagaatttagtaagtcacaggatacaaaaatcaactgcatctctgaatgttaacaatgaacatctttaagtcaaaaactgtaaccataccatgtacaatatcataaaacaattagatatttaggttaaattctaacaaagtatatgcatgatctatattcagaaaaatacaaaacacaaaagaaatgaaagaaggcctaagtgatgggtatacatattctgtgttcatgtatttgatgacttattaatgagataaattattcccaaattgattctatacatttccaattgaattcttagcaggatatttttagataccaaaaaactgattataagtttacatagaaaaggaaaataattataatatccaaaacattttgaaaaagaatttatttcaagatctcccactacctgatattcaaacttttttaaagttatagtaatcaggacagtattttattggcaaatgggtagatacacatatgaaaggaataaaataaatagaatataaatagaaccacacaaatgtttattttctgacaaagttgctttaaagacaataataaaaagacttaattttaaataaatagtgccagaaaaattagacctccaaacgtaaaaacaaaaatggaccttcacctgtacttcacattttttatcaaaatcaacagtaaaggatatagatataatatagaatgtaaaatgttaaaactttacaaaaaaaaacaaagaaaatttggaacataagtttaagcagccattttatagaaagaatatcaagagaaaaaacattattaattggactttaacacacttaaaaaaatgctctgccaaaaaacatatttaaaaagtgaaaagactagtcaaagattagaaaaaatatgtatttgtcaatcccctatctgacaaactgtatgcattcaacacagagaaagagcaattatgacacgataataaggaaaatatgtgggcaaagttcagtacaggcactttaccaaagaagaaatatggactgcaactaagcaaatgagaagatgctcaacaacagtcattaggggcatgcaaattgaaaccacattataatatttttttaaaggctaagattacaaagaaaacaaaaccttgttacactaaataccagtgaggaagtagagcaattgacacactcatgcattgctggtgaaaatgcaagataagacaacaactttggaaaatagtctgccagtttttaaaaagtgatcatttaactaccaaatgaccttgcatcaccacccctaggtatttacccaaaacagattaaaacttatgatcactcagaaatctatgcaaatggctatattgcccttattcataatggtgaaaaatggtaagcaatcgaaatgcctttcagctaataaaaagaaaaatgagctctggtaatccatacaacagagtactattgagtggtaaaaaaagaacgaaccaactattgatacctacaatccatgtggatgagtatcaaatggatatcctaactgaaaaaagtcagattcaaagggtcatgcatgatttaatttacatgacattcagtaaaaagcaaaactataagaaagagaaaattttgctacaaagcagcagcatggaagtttctttggggtaatgaaactatttcagtatctttattgtgatggtggttacaagactacatgtttgtcaaatataatatttcataccctaaagtgtgaattttactatataaaattcagttaaaatcattaaactatacatttcaacttattatatgaaaactaaatcataatacaactgacttttaaaaaacatctggtatattaaccactttattatactatccctttatagaaattctcatgttaaatctatatattttatgcatagaaaaatctacaagaaaagatagtctcaaaagtatatttgtccatgaggattttgcttttgaccaatttggttaattctactattttattatttgagtgtcttgaaaaatattctgtgtattttctgtgtcagtcagaatgattgccattctaactggtgtgagatgatatctcatagtggttttgatttgcatttctctgatggccagtgatgatgagcactttttcatgtgttttacactgttggtgggactgtaaactagttcaaccattgtggaagtcagtgtggcgattcctcagggatctagaactagaaataccatttgacccagccatctcattactgggtatatacccaaaggactataaatcatgctactataaagacacacgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaaaaaagaaatatactttctgaatgtcaagatctcgactttctttccttaggtcaaactgcattttagagttatccctcttgagcacttagaagctgcaataatcctggcaattggcaaactggagactgaatctaactctgtagcatgtgaccatagacaacagtatcatcacattatttctctaaaaaacagccaccttgctcttgataaatgctgtaattcccattttagtagacaatccttcctttcagaatcaggtttgccatttgattttatcaatcacaagtttcaaatgatcaataatccattagaattattttcaaaaaaatagcttttggaagatgatttcaacatatttctttctctctcacccaccccatcccccaacaaacgcagccctcagtatttataaatgtgccccatgctgctttcttggtcatgctatgaccatcaccagcattacacatgttgttgtacttatcttctttctaagaatacttcaatcatcatttagtacaaaataaaattcatgtttctaacaaaaactcttcttcatctcggcaaaaggagaactctttcctctgcagttgtgtgtagtttttgtatgagtttagtaagatatattagatggtacttcatagtagttacgtaggtctgaatataccttcttctactaggttttaaggttcttaaagacagtatatcagcatttttgagaaagaactttaggcgaaaattcatgtcccatatttttgttaggaactatgattctagagaatagggtgtgagggaaaaggagagtgaggcaggaagcaagcagggtcaatatgacaatgcattactgagctggtcactgatggcatcaggtataacgaatcacttgattttgaaggactgtcttcaaaaaggtcaaataatctctttccaggggggacaaaatcataggccagcttctgtttctctctgaattaaggtttaccagagggagcactaccttcctgtacaaatggattgcacatccatgagtgctacaagggtcccaaagcattacatgcctcagtggcagcactgaattctcacagaagacatgaaagaagcacagaaaggacctgatgttagacctgccgggtgcttcttatgcgaaactggccagaggtcactcatattcgttgctccaggtgctggcgctgacccagtggctatctgccctggatataggtgacactgaaagaacctgaagtggcacataagaggtgtctgattgagcatgcatttgtggtaaagctgtaaccataaagctgaagttcatctttgaatcacccactatactacaaaatggtgtatacatcaattattaaaatacttgctaaataaataagatttctaagaatgtataatggaaaggtaagagtgaatgctcacaatataggtgagcaatcctgcttacagaaaaggtaatgagttagtaaattccaaatgtatgaaattgaaaagagtgttaactactagtgtaagtacaaaattatacaaatactttgctgaaaagtcagggccattttcttattctaattttagtgaaaacagctgtgtgacctctctgggcctcactttttttcatctgtgaagtcaaaagcataaatttgatgacatttaagattttagtcaaactttgaaactgatgtgtttgaagttctgaatctatggcaaataaataattaaatattaatttattaggtatgattgagtacaaattgtgagttaggcacctctccagttcctaagaatacagtaatgaaaaagcagatatgaatactgccctattcgagtttaaatcctaatgtggagagtcacaaagcaaaataaatatctatgcaatatgttagaagtggggaggccagagaactgcattgcatgtttactcgggtggccagggtaggagtcactgaaaagctgagctgaaagatccagccaaatggataatgggggaggagcactctaggccattgtctgagcagggggtgaacttcacatgttctggagaataacgaactctttgacttgagccacatgatagaagttagagactgttatgaggatgatgccaaagagttaagaaggacagatcatgtagcaccctaggacattttgagaaatttgggttttactcagaatgagtcattgaggattttgagcagataaatgtatagcttgatttaggtttataaaaggatcaggatcaaattggctgctatattgagaatagattataatggggcaagtgtgtaaacagagatatggaaataaatagtttccaaaagacacatctagcataatttctgtaaggtaacaatgtggctaaaatgtgttttaatttagtatttttatggtcgtcagggtggttaaaaggttttatttattttaaagtaggtaaaacatgaatttactttacaaacatgtaaaaaacaactaataaaagttctactcaaactatttcaaaaaattgaagtggagggaatacttcaaaactcattctatgaggccagaattaccataccaaaaccagacaaacatgcaataataataataactataatccaatatctcttataaacacagatgcaaaaatcctcaaaaaacactagcaaactgaattcaacaacacaataaaaagatatttcaccatgattaagtgaattcatcccagagacgcaagtatagttaaacatatgctaatcaataaacatgatacatcataacatatgatcatttcaatagatgctgaaaaggcattccataaaatccaactttccttctttaaaaaaaaatttcctttggttattatcttgattaaaaacacctaacaaactaagtataaaagaagtatacctcaaaatagtaagggccacatctaacaaacccacagctaacataatactgaatgggaaaacattgaaagcctttcctctaaggtctgtaacaaggcaaataggctaactttcaccactcttattcaacacagcattggaagttctagacagaggaatgaagcaataaaagtgaataaagaacattgtaaaggaagaagtcaaattgtccttttttgcagatgatatgatcttatatttagaacataaatattgaaaaaaacctaaggattccactagaaaccgttagaactgatccatgaattcagtaaagttgctacaaaatcaacatacaacaattaataacatttctatattccagcagtaaacaatctgaaaaaaatacaagaaagtaattcaatttacacagctaccaaaaacaaacaaacaaacaaaaacccgggaataaatttagccaaaaaagtgcaagatctttactggaaaactggaaaagattgataaaataaattaaaaaggagacaaaaacatggtaagatacctcatgttttgggattggaagaattaacacagttaaaatgttcataccagctaaagtgatctacagattcaatactatccctatcaacataccaatgacattcttcacaaaatcgaaaaaaaaaaaaagctaaaatttgtatggagccacaaaagaccacaaatagccaaagcaatccagaactaaaagaacaaagctatagtatctaaaaaacagcatgatgccgtcatagaaatatacacataagccaatgtaacagaatagagaacccagaaataaatccatgcattttcagccaactcatttcaaaaatggtgccaaggacatatgctgataaacaaatacttttcaatgaatggtgctgggtaaactagatagccacatgcagaacaatgaaaatagactcttacctcttactacatacaaaaatcaaataaaaatggattgcatacttaaacgtaaaacctaaactataaaataactagaagaaaacattggggaaacacttcaggactttggtctagacaaagattttttgggcaagtcctcaaaagcacaggaaagaaaagcagaaatagagaaatgggattacactgagctaaaaatacttctacacagcaaagaaagcaatcaacaaagtgaggagacagtccacagaatgggagaaaatatttgtaaactatccatctgacaaaagggttaataatcagaatacataaggaactcaaataagacaatggtaaaaaacaaataatcaaattttaaaatgggcaaaagatcttaatagatatttttaagagaagatacaccagtaggtatgtgaaaataatgttcaaaatcactagccatggggaacgtaaatataaaccacaatgaaatatcatctcaccccagttaaagtagctataattaaaaagacaacaaataaccaaagctgatgagaatgtagaaaaatgtgaccctcctacattcttggtgggaatgtaaattggtacagccactatggagaacagtatgaaggttctactgaaaactgaaaatagaattagcatatgatccagcaattccattccttggtgtatgtccaaaaaaaggaaatcagaatatccacaaaaaatctgcagtctcgtgttaattgtactactattcacaacagccaagacatgacattaatctacgtccatcagcaaatgaacagattaagaaaatgtagtatatatacaaagtggcgtattaatacattaaaaagaatgctactctgtcatttgcagcaacatggatagaactggaggtcattatgttaattgagctaagccaaatacagaaaaacaaatatcccatgttctcactaatatgcgggagctaaaaaacttggtcttctggagataatgactataacagtggttatcaggggctggcaagggtagggtagaggatggatgaagaaagattggttaatggatacaaaaatatatatagatagaaggcacaatttctagcatttaataacacagcaggagtatagctaacaataacttattgtacatttaaaaatggctagaagatttggaatgttctcaacacaaagaaatgataaatgtgtaagatgatagctaccccaattaccttaatttgatcattacacattgtatgcatgtatcaaaataccatatgtaccacataaatatgtattattatgtaccaatattaaaagaaaaaatataaacagaaatatatttatacattctcttttttatatactaatatttaaaactaaatcatactatatactagtatacaaaaactatatattaatatataaaactaatacatataaaaataaagccatgcatacatatttagtaactaaaaatgtactctttctctttccaagtattatgttgtgtattcctctcaatgccatgaaataagtaatttttcatttacagatgaggtcacatggtcaaggacatatagaaagtgaaaggaaggcttacatattagtgaagcataatcactgatggcagaaaaaaaatgaagaatggggtggtagattcctattactgctattaccaatgactacaaaattgatggtttaaaacaacacaaatgtatcttataattttggaagtcagaagtaaaaaataggtctcactggactaaaatcaaggtattgacagggctgtgttttatctgtaggcttgaggcagaatccatttatttgccttttctagcttcctgagtctggtcacattgcttggctcatggctcatggcccccttctatctttaaaaccagcaatggccacctgagtctttctcaatttgcatcattctgacttctatttctgcttctctcttcgacttcaaaagaccattgtgattatattggacccacctcaacaatccagggtaatgtccttatctcaagtcacttgagtggtaatcctaactcaatcttcaactttaattcccacttaccatgggctataacatattcaacaattgtgaggtataagacattaacacctttgagtggctaatgttctgcctactacaaatggtgagataaatttgaggtgatgggatgctagataagtcttttcctttcctcataacttttgtcagaatctatgtgaatatatatagcagaatatgtaccatcactatttcaaggctatcccatttaatttttgttatgaggtcattgactctttacagaaaacatctaacatgtcagcgctttgtccttattattgtatttatctgtgtggtcatgaaagaagtggtctatgtgggagacttttccaaattatgaatctagaatacccataaatatttagtctcacttattcctacagtgtgtatgggtaagtgtattatttttcataagatgatggctggggaaattgggaatacagaacatgaagacagttaacatacgtgccagcctagttgttacccctcattatattacagactggtaaatgtatctacctaaatggaatgatgatgctactcaagactgaagaaggtagccttagaaaattttctaatgtagatcgttgaatgttgaagaccttgccatgttaagtgatgtagagaaaggtcctagaatactggctttctcctgaagagacaatagatttccactgatgacgtagagtgacacatcctgagtaaggctataaggattgtggagactgactttataccagggtgaagtcgggacatgttctttcttcaaaagcttttctttaaggcctgcattctagaaaggagagacagtcccaagggtactttcctaatgtcatggtacactagctcctgtgttaagttggcagcctggggtgagggaagaagtcttcgtcacaaagaatacattgcccagtaggaaaccactatggaaatttatggacttaagttattcaggaacagtcatattgcatactgagtttcaaatgaccttgtgtagaaatattcatcaatgtcttacaatattcaccataagtctggtaaaagttacaaactggtctttatctaaccgtttgaaaaaagaagggataggtgtccacaacacagtgcggagtgtttaaaagagagccatacaagcactaagaaagccagaagtgagtaaccagcagaaaagtagataaaggttctgatctggatccagatgataaatggaatggcaagtgaaaatcgggatatattttccagaagataaatgttcctggatatcttggaacatcaagtaaattattaagttcttatatataataaagcaagattgtagattcatctttttattcaggcatttgaggaaagtgtgacttcaaggactattgaaatctgagacatatgttctgggtacattaaggagaaggtatagtagtattgaagaatataaaaatatatttaggtctcgtaagtcagcacttctccttacattaactatatgactccttcattgtggattattattccatccaaaatttcctatttagaaggccacatttggttcatgcaaatacgaaaagatgccataatcggagaaaaaagtttggagatcatgaagatgcaaacaggagtatttcttaatactttattaagcttatacgaatacactaaagtacagttttaatttggcttctaagtatactttactctatacaaattaccaccacttgaaagaaaaaaagagagccagagatgaatatatagtttccaacataatatagaggcatagtagcatccttaacatgacatacactgtgctcctaaatactgctcctaaatattaaggataacatgctaaaatttgtctttatccccatgttttgggttataaaatattagatttagaaaaaagaaaaaaaaagaaagtaaaaagaaaccactctaacacaaggaattttattttcataaaacatccatatccatatactttgtaggcagttttcaaaatggctttcagtgatcctcttctcttaatattcatatcctgtcctttcagcttgatagttggcttgagattaatcacacttgagcttaatcacttccaagtctagatgacaaaagcctttgacttttctcttgcacattcttttttgccttcttatttattagccctgtcaaagctgcttctatgttgtgagatgctttatggataacatccatgtggtaaaatagtgaagtaggcctcttgccaaccaccagttaggaataaccatggaggaactgagtcccaccaacagctacttgagtgactataaaagtggacccatcactggttgaaccttgggataactatagcccaattgacaccttgattttagccttgtgagatattcagaaacagaggatgcaactaagcattgttttaatttctgacccatggaaactgagataataaatgtttgctgctttatccagtaagattttgaataatctgttaaacaaataaatagtacacatacatatacaaacttgcaagataaaacataactttagaggaaaaaaagaaatcaagcaagaactagatacagttaacataaacaaaactcatcatatttcattacagcatgtggaaattgtgaagtatctttttcttatatatgttaattactcagtaaaaaattagagtatcgctgaaatctgtataccaaagttgaaaaagacaaagaaaacttatagaatgtatgggaggtggtgaaaagataattaaaagattcaaaatcaaaatttatataacagaatttgtattttaagaaaaatgtaaagtgttacaaaaagtatgtctccttctctggcagtaattatcctatttgctataatataataaataggttttgagtaactgttttgtggccgatttaagcagcaatccacgtaaacagacacctggatttccttcagtaagggagcaggaaatgacaattacattcttcagcaaaaacattttatctttgtttacagacattttgtgtgtgtgtgtgtgtgaatgtttctcacaaattgcaaaggccccccaccagtcttaacaaagaatttatttgaccattaactatatttcatgcgtaacatatattttatgacatgaattatattttgaatttagatttttacattttgttaattactacttcacaagaaggggaaaaataaaaaatcttcaaaaagcaattatagctcaatgatttaaatcaattcaccgggttatggttgtggcagataataaaaaattaaattcttcttccaaagctaagttgattactctgagtacctacctgtgttcttccaaaattttataaattacgtgtgattggagctcagatgaaatttagattgctgattgactttaactataggaaaaactattcaaagaaaagattaaatgagaaccaaatccttttatatacacacagaaaaaaaaacatgaaagtgaaagtgatctaatcagaagtattacaaaaaatagacaagaagaaccaacagttatacgatctctctgataatggtaaattctctctttaagtaggcatgttgctattgatgtatgctgaatgagtgtgttttagttttccaacatagcaaatctgacagtgaacttgaaatcagttagactggtaaggggtttctggctggattccacataatgctgttggctcatgggatttccttggtctagccaggtttagaaacagtttttaatcagttaatactggatttattatgttaaagaatgggggagggtaaaactcactgattcagaaactggataatatataagtgtataatataaaattaatctgcagcgaaggccagagtgctttcaaatataagccagtacatttctttaacagtttccaaatgtctgggaattttaatcactaattatagcattaagtgagccaagaattttagaaaagaatatacttttattagatattttcttgaagatatggcagtctaacaaggaacaattttagataataggaaaacttattggaatagtagtcaaaatctccttcctgaactgtgagataaatacttaaaaatttactaaatccttcattcataaataattcttattttccacctattaatttgttaggtgattgaatgttatcttgcactcttatgtacaatagggtttctcaagcacagcactattcgcattttgggccagatgacaccttgttgtgggggtgtcctatgaattttaggatgtttaacagcatcctggcctttctccacctgctggatgatttgcgccctcccagttgtgacagccaaaaatgtttctaagcactgtcaaatgtccttttgggggcaaaataattgtctgttaagatatactgctcaaaaagaaagaggggaggagagcaggtagtggcgatggttaatgggtacaaacatacagttagatgaatggataagatctagtattcatagcaagaaagagtgactacagtctgcaataatttgttcacattttaaaataaccaaaagagtataagtggattgtttgtaacagaaagaaaggataagtgcttgaggtggtgattaccccatttaccctgatgtgattatcatgcattttatgtctgtatcaaaatatcttatgtaccccataaatatattcacctattatgtatccacaaaaattaaaaattaatgaaaggtttctatgactcatgtgcaaatataattataatcttagtggtcacaaccagtatatatatttttatccttcttgtgtcagggttccccaggaccactctaaagtttgatgatatacatattcacaactatggtttattacagcgaaaggctacacagcaaaatcagcaaagggaaaaggcttatggggcaaagtccagcggacaccacgtacaagtttccaagaaacctctcccattcgagtcgcacagatgagagtacagatggtccccaacttacaattttttgactttacattgggtttatcagagtattataggcatttgtgacttacaatattttcaacttacaatggttttataaggtgtaacaccactgtaggtcaagaaacatctgtgattcatagcaatgagttgtaacaccagttgtggaatgtcctctagataagttcattagagacttaatgctaactgcttagcacataccacatttccagactttcagaaataaagcaattgtttagaaaaaccatcattgtttttacaaactgtttaggtactacacaccatgcttatcagttagggaatgacgagatccctttcagaaatccaagttcccagacaccagccactggtcaactttgcaaaaagatcattctaatcacagcagtctcaggtctgttatgttaaccctttctctatgctttcctacaaaatgttttgtgacatgtcagctgcattttaggcacccaaagacttatacaataaataggtgaactaattaatcaaccagtgatgttttcagttagaattccttaaatgtctctattgacacgtttgttcctaaggactcttacacctacaaagaggaaaatgttccacataataaagcataactacagttttataatagaggaaaattttagttaatcaaattgtaccagcattaacctgcatttccagaaaagtcttcaaacaactcaagatccaatgggaggaactcattttcagtgaaaagaaaatgatgtatggtaatattctggtcgatgtaactttcaaatgcaaccactaagagaaagaggaatttaaatttcttgaatctaagactccatgaataaccattttctgtcaaggagccaatattatttttaaaaataaaatcactcaatggttacatttttttttttttttttgagacggagtctcgctctgtagcccaagctggagtgcagtggcgtgatctccgctcactgcaagctccgcctccagggttcacgccattctcctgcctcagcctccagagtagctgggactacaggcgcccgccaccacgcccggctaattttttgtatttttagtagacacggggttttactgtgttagccaggttggtctcgatctcctgacctcgtgatccacccgcccccgcctcccaaagtgctggaattacaaggcgtgagccaccgcgcccgaccactcaatggttacattcttatttgagatatggagttgtctagagcccttcactcaagacgatctgctttagattaataggatgctttgagaaaataaacttcatgttacttttgagaaaatatgatgcacattaattttatgataattaatgttgaaacacctcccataaccacacatccctcttttatacacgggataaaattgttagtttagattttattacttaattattgtctggtcatcaccccttatcccctcctgaatatttaatgagaccaaggtccgtgctcttttttaattcacatttgtctctccaggaccttgcataggatgtagtaaagagtatttaacaagaatctgttaaaatgatttttttgaaaaagctcagagagataactgtccataccccatgtgtccccacggtatattcgatctttattttgaaggcaaacactatattttaaaaatcaaaatctaataaagataaagcaccatccctttacaggattgatttctttgattgtaaagtgtgcgaaaaaagggtttccggtgcactctgacaccattcataaaatcctaaccaggacctggtaaggccttagtttgtcaacactgtaccagaaatctctaatataaacaggctcatattataatcttctgcatttgtaatttttgagaacagggtggaaaagcactcatttaagtggaggatttttcttttaaatgctgtacttgagaatgtatcattattccagatgagacagataagacgcgttgctcccttgccctggcagtggatttgtttgtatattatgctttctaactctctttctttgctgagctagctattttatgtttctttgtgaatgactgtaccttaagggaactatattctgtatccattattttataaaggtgagtgggctcagtaaatgcctgaaaaagtaccttgactaagatcacagagttaacataataaacctgatagtgctgtaggaagaaagacctagttaggtgtggagtaaaacttagccttataattcccaggccaaagtgtttccaccatcaccaaatcagcgtcagtaactaatcaaataacaatttatttaagccattaaaaaatgtaatgctttcactgcaatgtgaacatatatttaaacatgatgacgatttgtaaaaacaaagatttttagaactaagaagaaatatatattacaaagtagttagtattaaataaactgtttcctggatcctgaatgatgataaaagtttaccccattaacactagggagcatattcaaagaatccaaaattctagcaattctttggtttagtagaagccacaagaagataatttatatctgaaattctgtaatattacagcatcccagttccttttgtgaaacccagagttccatttactcattcgaatggctatacttttttagaatctcttcaaatttgttccatacatactttttagatatgaactaaaattaggcagagtaatatagttttctcctcaatatggaattgaaaaaagaaatactccagttacattttccagctgagtactttggcttattattggatttgattttacctttaacagtgatacaaaggcaaatgcaattgacaaagttaaatatgtggtagcagagtttgaagtttaaaaccctacgtgcttgcttgcttgcttggttttgcttttgttttcttgagcaattgttgactactcagcctgctctgtaaagttaagagcatagactctggagtatcagatgtagattagaattctatttttgccactacctatatttatgaattaaaacttttttttaacttccctgatctcagttttctcatactttaaaagaaatttatgtgtagacaaggaggggtcttactactctcattagcaataaataatattattacttcattgtcaagtttcctactacctaggtacatgaagcgcccttgctctgtctctctttctctctttctctcctctctttcttccagtttcctttatttaacagcaagttaaaaatgcagttggagaaatcaatttattattctcaaacaatttattttacatttataaaaccgtagagatggcttatattgtttatgtgacattgtttatccacaggataaaagaaaaagagttaaacagtaaataattaaaattgttagtttatccacaggataaaagaaaaagagttaaacagtaaataattaactcccacagctatagtcattcctctttaaaaactctagtcaactaaccaaaggaaacacctttttggtgaatacaggtaagttagggcaaagttttggtagtgaaattgtaaagaatcgattactactgtgatgaatcaaatcataaagaatttaacttcactgtactatacaatctattttcaagttgaaagttagttaaaaatgtttcactttattttctttgaagacaataagttggaggcaattcaaacattttattatgaattatcaactaagtttatttaaataatgaatttatctttatgcttaatgcaaattgcatatacattgtattcaaaataaaatgcaaataccaaagaaaaattgttttctaaaataatgttacaagtttatatttgtttcacagtaaattatttttaaatttttgtcagtttacaaacaaaagattgcttaacaattgcaagcagcaaatttaccaatatataaaattcaaaatgttcttccaaacacaaatataattaagcagcaataaaagcttagtatatgaactttattaatagtggttatatctagtttgtagttgccaagaagtaccagctttacatgcactggcaacagtaataaacaatttatggctttctaataaacagatacgtgttaaaagcacatttaaaagaaataccagaagagtttataacatttagcgagcatatggtctctataaagtagtaaattaagtactttataaaactgttagtattaatactatattacaatattttatatttgtgctgcatagttttcaaagtatcatttagaaggattctaatatttttagaacttatttattcttcccaactttgccagataagatttatctctactatgttgaagaattaaaactgagactcaagatggttaaaattttgactgacgtatttcaccacttggtaggagggccaggactcataattaggtttgtgtaattctaagtcaatgattgttccagtttatcttgctgttgctcaaacaggtgtgcttttaaatttgcttataaaatatgcacaaacagatggcacctgctaaatacataactggcaataatatcttgatattttcaaatactcaagagtaatctagcacaaagagctcagaaatttgcaacacaatatattgcacccagaaaaaacccttaaaaccgtctagttcaatcatctatgttagagaaaaattggacaaatagaattaaatgtctagccaatttactatctagaaaatttcaaagttcagactcaaaaatcacttctttgaatccatttctagagctttctgtgttacatcaagaaaacagatttttttccaaatgtttatgtttctttgtccaatctaaaggatgaaagatactaattctctgtaatacataagaagaaaagagaattagacagtatctttatcaagtcccatcagattagcaacaaatttacaaaagtgatgttataaaactttttgactaaaaggctttcccaatattataaaaagggtatcacattatactgccatttaatgctattaagaaaacattacctactacaaataaatcttaccgtcatgtttctcaatctattataattaataaaatattaggaaaagacttgttttattgtgaaaatgttattcaatatattttattccagataaatggatattaaaggatatttatagtactttcaatttgttctgaaagctacatctgtattatcaggaatatgtataagcactaaacattgttgcagaatttgtctaaggctaacaccattttcaacaccatgaagaataaaacaggccgggcgcggtggctcacgcctgtaatcccagcactttgggaggccgaggcggacagatcatgaagtcaggagatggagaccatcctggctaacatggtgaaaccccgtctctactaaaaattacaaaaaattagccgggcgtggtggcgggcgcctgtagtcccagctactctggaggctgaggcaggagaatggcgtgaacccgggaggcagagcttgcagtgagctgagatcacgccactgcactccagcctgggtgacagaacgagactccgtctcaaaaaaaaaaaaaaacaaaaaacaaaaaacaaaaaacaaacaaacaaacaaacaaaaaaaaacaataaaacaattttcctatatgtcagaaaaaacttctttacagcttttatgaagtgtataaatccctgcatgaatatattcaactcagtgactctattacattctttgatgtccctcatgtttctaaaaaaaatgatgccgagtgtatctttaggatttgaaagcaatgaaagtatataaagccaactgacaggacctcacttatttcctgctggtttatcagccgtcaggaaggatttgcactcaaactcttccacctttccccccttgttatcaatggcatacatggagccacaggaagagtaacgcatagtgtggccatctaaaacagggtaaaattcagacagtcttatagaaataaagtcacaaatgaggttcgaaaataattaccaacagacacaaaagaagaatctttaaaactccatgatctaaatatatattgacaatataattctatgccaatgagtagttttgaattcagcaccatatactgactgcctatttatcacatactaaagatacaaataagtaaggagttacccacatataaatattccatcaatgtttgcacatccatggtatatattataaagatacatctagcaccagaggatgttgggtgctatggaataagaaaatagagacgtgatttttttttttattttcgagacagggtctctgtcacccaggctggggggcagtggcctgatctctgctcaccgaaacctctgcctcccaggttcaagtgattctggtgcctcagcctcctgagcagctggaattacaggcgcatacaccatgcccagctaactttttgtatttttagcagagacggggtttcaccatgctgcccaggctggtctcgaactcctgacctcaagctatctgtccacctcggcctctaaagggctgggattacaggcgtgagccaccaggtccggcagaggcatgaattaaaaacaaacaaacaaacaaaaaaaaaaacttaaattacattctcaccccatcaacttatttgatcttaccaagtcatttcatctctatcttccattttttaaccacagtgtaaaaacatttgacttttcttcccactatattgttgtaagtataaaatgccacaatatatgtgaaaatggtctgaaaatcctaaagcacttctatattgctctatatacactagagcaagaagaggttaaatggtttcccctggtagcaccttcctgagcacagaaaggtgacctcggcaccagggtgtactggctcacttccctaaatctggaatgtaatctgaagagtattacccaaatcctttttctattgttttttttttgttgttgtttttttgtttgtttgtgtttttttttttttttttgagactgaatctcgctctgttgcccaggctggagtgcagtggcgccgccaccacggccggctgattttttttttttattattattattttttatttttagtagagacagggtttcaccgtgttagccaggatggtctcgatctcctgacctcgtgatccacccgtctcatcctcccaaagtgctgggattacaggcgtgagccaccgcgcccggctccccaaatctttactgccaagaaaagtgacaggtttagtaatttcatagtggtttggataatttggctttcaaatttcctttagattagttcctttagattataacattgctaacactataaaactctagtttgagtgaaattcttgtggattcagatactgcaatcaacgaacattgagccaaggatgaattggtgctattcctggtcaattctctttggcaaataaagatagactcgttccatgattgaaagctacataaaaaatatctaatatcactacatatcaaatataatttaaaatataaaatcaaaattaagtccttattaagccttggtagattaagaaaatacaccattaatatgccgacacacatctaattattaaattaaggaaaatttttgtatcaatttttgattggtaatacagaaataaattttcactacaaagaaattttgaataagtattgacactgatataaagtacatcatttaattattatcattattttttcaaattttagttatatttagaagattagattaccttagattccaattcaaagactatatcccatatgattatttcagcttttttcagaatgcattatttaaaaaacaaaacgtttatggacataaccaattataatgtgctgctgctcacaaaacaattgattataaacatgccagaaaaaatgacacaagtcgcatatgtgttctttccagattcaagctattatcttctaaatattctaagtagatagtagattaagataatttatttgccatgtttttcacacttagagtttttctttcttttttttttttttttttttttttgggagacagactcactctgtcacccaggctgaagtgcaatggcacgatcttggctcactgcaacctctgtctcttaggttcaagcgattctcctgcctcagcctcccagtcccttgccatcacacctggcttattttgtattttcagtagagacagggttttgccatgttggccaggctggtctcgaactcctgacttcaggtgatgcacctgcctcggcctcccaaaatgctgggattacagccttcagccactgcacccagccaggtttccctttatgcagaaagcagcttgcaggcaatgctaatattggtttaattttcttaggaggaacccagtatagtacgggaaataattaatataatttgttcttaaaaatatagcttagtattgtattaatttttctagagactgagccaaatcaagtttattccaactaaaatactgcaaacatttacttaagctaatatgtcttattcttaaaatgcttaagggtgcagctctagaattatatttcttagtcacaccttactgcaaattatattaattggagaataaatttatttataatcctagacacgttttaggaagagaatttgaatggaataaacagggaagagaaagatacatcttcttatgataaaataaagatactagagatctttatgacacaatagtaaacatatatatgaattatgaattaatctaatcatgctcatacataaagatctaactgtgtatttttcattttaaatcagttaaattagttacataatctactgtataagattaataaaaatgaactaaaaatatctgttggctcatcagaataatgcagcacttttttcattgggttattaaggataatatttataataataagtgcatacaaagttcttattacagtgcgtagagcacaatggatgctaactggatgttactttctctctctctatcgtgtaaacaccatgagacaaggcgcggtagctcatacctgtaatcccagcactttggcagcgggtggatcacctgaggtcaggagttcaagaccagcctgaccaatatggtgaaacccccgtctctactaaaaacacacacacacacacacacacacacacacacacacacacaaaattagctgggcatggtggcaggtgcctgtaatcccagctactcaggaggctgaggcaggagaatagtttgagcccgggaggcagagtttgcagtgagccgagatcacgccattgcactccagcctgggtgacagagacagactctgtctcaaaaaaataaaaaagtaaaaaataaaaacaaaaaatagtaaataccatgagtgcaaaaagaaaagctatcttattactgacgtgtccctatcctttatatagtgtccattacgtaataagagcccatcagtcatttttttcaatatgtaaatacggagaaatatcttgactacagtgcaggactccatgtttgtttggctctctgctcaaattagacttttcttccatcaatatagaataagccatgcatagacatagtttctattaaaaatctgtaccctaatgagtagaatgggctcacacagatcttggaaaaatacatttagtaggcttggtgaaactgtaatggctttgtacagaactccactgcaacccacctgacaaactaggatatgctaaacaaaccagtcatttatgtgagcgtgtgtatgtgtatgtgtctttctgtctgtctgtctgtatgtatgtgaaagagagagagagagagagagagaaactatggatacttcctttataaattctggctttgccttgccttagaacaggacaacagacttcacaatttttctacatatatgcaaataaattctcggcactttaactgtctttgagttacactttgatacatccacagtgcaatttatgtcaataaaaatgaaattcctaagtaggagggagctgtgtcttaacgtgattagtatttggacttcctattattgtatttgaagacagaggatgcttggctttatgaagcaagctcccaattggattaccatatgtctcaaaaaacatgatagtaaatgtcttttgatagcatgagatataaaggagaaatataaaaatttgctttatgaatgttctgcttccagccggggtatattcagttgtagttaagatagttgtgttctattagctggggacaatttgtaactgtccttattagaaacatacatgtgtatgccaaactgctaagaaatgagaaatttctgtctatatcacctgtttttggcttgctcagaattctaccttttttttttttttttttttttttgagacggagtttcgctctgtcgcccaggctggagcgcagtggcgcgatctcgactcactgcaagctccgcctcccgggttcacgccattctcctgcctcagcctcccgagtagctgggactacaggcgcgcgccaccatgcccggctaatttttgtatttttagtagagacggggtttcaccgtgtcagccaggatggtctcgatctcctgacctcgtgatccgcccgtctcggcctcccaaagtgctgggattacaggcgtgagccaccgcgcccggccaattctaccttcttaaaaattggctttcctttagaaaactacttcatttgccttctttatggtagtcacagtgctatgcccaccaacaatgacaagtaagagacctaaataagaccaattagattattccttaaagttttatttatgccgagagagagacagagagagagagaagggctcctttccttagtaattgcaattatgaatttaggttgagttgtcagcagccttaatatatagctgcatggacaaatattgactgagagttaaagccaaacatcatgggatgcaagcaaaaggcatcaaaagaaacagattcctcaggaggtcttattgggtctctgaatacagccatgcctgaaaaactcactgtaagacccttcattgctttatattatttgagctgcttttctttcccttgtaatcaaaggaccactgacaaatactggctaagtagaatattaataagaatatacacgaaaaagaaaaacatgaatatgcttttggtataaatttacctaaaatattttaacatgcaaattagataccatgtagtttgttaactttaatagttcctcaaattaaaatgttttagtatgtaaatacagatggtttccaactttaaatggttcgacttataattttttatttgattgtgatgtgaaagccatactaattcagtagaaatgtttcatcaaattttgaattgtgatattttccaggctattaatgtatggtaaaatactctctcatgatgctaggctgcagaccccagccagccacaagatcatgagtgtaaataagtgatactctacagtgtattgtgttgctgacgctttttggatattgtcttttcacatcccatcatgtttacaaaatggcatttttgacttacagtgttgtaaatgtatgatgtgtttatcaggccacaactccatcataaatcgagcagcctctatatacacaatatgtatataattttgagtatctcttcatattaatgtaaagttttattttacacttcatttgtggctacttttttcctttaaataaaggcaatgaaaccagatcaatgagagtacttgaattaattctagttgtagaaaagcttggatgatacccttacaaaggaaacccaaataaaaacctaaccaattgaacttttgggttgtgtttggaactatctcttttcaatgaattaacatgtgttatgtgtttatgatgacaaatattagactatattctttaaggcttatcatcagcaaagactttccgggttataggacttctctttatgatttcatctttccaatttttctgacttatgcctgtattttcttttatctttgcctcctataggtctggcttcttctgtcctctcatttcctggtctcctactgactcgcctcttatctctatggcatgtgaccttgggcatgtctttcagtgcctgtcattcttcttatacttcacttcctgtctctgccttccctccccctccatcttactacttctcagcatccttatatacaggtgaaataaaatcacttaaaattatcaattagatttctagtaggaaattgaaaagtactatcatcattttctttataataaagaatgtgacatgatatttaaagaaaattatttttagaagtgttcaattccacttgaacactaccgggcaaacacctaaattttcctttgttcaggttgcaaaatgtgagcatttcctaaatttgctgtgaaccctcaggaataaagcaaaaaacaattttcaaaataaaaatgaacaatttaatagatttaaatatgaatgtttcctaaaaaggatatattaataaagttctgtactaatatatataaatcctaaataaatttccatttcaatacttccttttgatatttctgtcttctctctcttgatatagaaacaacctgcatgtatgcagttcagttccttaggcatatatgattcattcatcttaatttagaaaatatcaaggccatgcctgggagcagaattggggcattatttgtctttcggcagcgtatttttaaaattgttatgaataagtaaattgacaaaatcctttctaagatgtacagacattttcaatcaataatgcacactatcaggacataaaatcttccctaactttttgagaaatctttacgttttctttagggaatagattcacacttaggttttatcacctatcctacactgacgtttgggggctgaactttttgaggtaatgggtgcctctgtacagctgcaacccagaatgattctttcactactatgccctgagcaaaaacagtcttgggttacaggagtgaattagtgccttctcctgtttcctgcaccctttatttcatgaccttatcccatgtatagggcgagtaagagtagtcagttcatactgatctcagcagatagcgatataaacagatacttggctcatagggcataacttacatttactaagaaaatgctcaaaaccattcattgaagtttttctatacagactttcaggaattttaatgagtacttgcttataaaatgttgacaaccttaatcataaagtggtaaaaactaatatgcaatgtatcaagggaacaatacctccaactgttttcccagaatatactttacaaattaccaaagcagataactgaccacatttcctttttaatttacctcactagttctttgaagttctattcaccattagctctttgaataactgttttaaaacagatgggatgaacatctggataacacaacatatatattttttttatcaattgcctcactgatgtgaggaacatctcctcccacacacaccaccctgtgcctcatctaatgtgttaacactttggataatgagaacaacagaagtggatactaaatatcttattcaaattaactcaaatctgagtgcaaatgtggaagtatccatgcaattcacgaactgctgccccagactgtgtttttaacagcagtgtttgatgatgttggcactcttgatcattttctgtttttgaagttactgagttcaatgatccatcctttgtgtttatttatcaggactgtgaacatcacaaacaatttgagatgtttagaattaaatgttgattttagctggcagaaaaaatgcaaagttaggtaaattgatgagcatcattttcatgtatatattatctctttgttaacagttatctttcccagacataatggaaatggctgaggagtatgggtaaactgaagtatctgagttcaaatttatgcatgttaagatagaataataaacatgctactcttctgtgcagaaattcaatgccaaactaattcatgaaatactgtacaatactatacaatacaatatagttcaactatattggctcgaatcaatataactggtagtttaagtcactggtagttcaaagaaagaccaactagattctgagcctcaaacagcattattagggacttgcctgcctctttgtctggcttcctctacgatggcttacttttcaggctgggtttcttaataatgttggtaaatatgatcacaacaagctctaaaattctacactccttgcctttctgcctgaatcttgcccccccaaaaataatttatttcaggcacttccagtccaaattttaaaactgatactaattttgtgtagtttgggtcatgtttatgacctactaattagtcacagttgccaagaaaccgaatgacctaggtaatatgctcaactctgaagctaggctatcaggttttgaaaccaatggattaagaacaggtaagtagctgggcgcagtggttcatgcctgtaattccagaacttgcgggggccaagacaggtggatcacttgaggtcaggagtttgagacccgcctggccaacatgggggaaaccctgtctctacccaaaatacaaaaattagcctggcgtggtgatacacatttgtaatccaagctactcgggaggctgagacaggaaaatcgcttgaacctgggaggtggaggttgcagtgagccgagatcatgccactgcactccagcctgggcaacatagcgagactctgtctcaaaaacaaaacaaaacaaaacaaaacaaaacaaaacaaaacaaaacaaaacagttaaggggtaattctccaaaggaaaactatcattattttatcaaactaatgaaggaagcatgctggtcagtcaaaccaacctgtgtctataatcaaagtgcaagctttgcagaggagcttttaatacataactgaaatattattcataagtaattggagtattctggggaatagatattagtaaaagttaaggaaatagaatgacaacaagtgataacaacatatatatatgtatatgtatctcctaacattagtctaaacatagagtccataccactgacagcaggcactggacatggttagaggaccattctccttaccataaagtgagaactcagatatactctccaactaatttaaccttgaatcacattttacctatgtatgagctatagcataatgtcagagcatattaatcataaccatatagcaagaatattacagattaaaattgtcatagcttatttttcttgtcttataagaaatgctaattagggtgaaattcatgttataaaagtatttacatataaatacttcaagaaaaaatttgctggagatattagcagaacatgtcgtacttaaaaaaatgcaagaatttggtctaggctgggttgaatatgtttaggaaaacacagtcttttgaagaaaaagtagattgcaatatctcaaataataactagtgacaatgaagaaaataaagtgttcttatgaacataagagttgatatttgtaacttttatggcatagctgatgaatcattcagtaaaaccaaatgaaacaaataccttcaatctctcaaatcaaacaccatactattgagattttagctataactttatgtttgtcttgtttgaaaaaatacttcaaaaccccaaaatattttttgttaaaccatcttacatggttaaaacattccttttagagtaaacacttatgaaattcttaagcattgtaacttcatcattctaaaggattaaaatgtttattttaaattgaacatttatgaaatgcttaagcattttagctagccttttttaaagtgcaatcataaaaacaatggttttataatgaaagaaatatttcataattgcattcatacatttgaactgtttatacatgtggcaataaaatgaaatacaattgtgaaacacatattttatataaagtatagttgccaatgtttttgttttcttgaaataatctttttattctttttcgcttttaaagcataagtttgtgtcacaatttaaattcattctagaaacttgcagttaatccctgattacttgtcatgattagatattcagctaaggtatacatcacagaccatctgtgagaggacactatttcatttgtcttctgggtaatagggaggctcattttgaggatgaacccaccctgctcttttgtgaaagcaggagagtgccaggtggttggtagagataaacacaaagggtaataccggggaaaaagaaacgcagggctttcccagcaaacctttacaatattggtgcactacaacaggtggaaaacagtgagatgtcatatatgtgtgcaaagccagaacacatttcacaatttgtagctcagattccatgagacactaagaatacagatgttaggaagtttcaaatttcaataagggtagaatgtaataccaccttgaaaataccctttctcaactgcatgtacttatattgctaactggagaaaataactctggagagtaatcatggaactgtgtggagtttatttggttaatgggaccaaacatacagttaggtagaagaaataagttctagagttcaatagcacactctaaggtgactagttactaattcattgtatatgtcaatatagctaaaagagaatatttgaaatgttcccaaaacaaataaataataaatctttgtggtgatggacaacctaaatatggtgaattgatttttacgtgtggtatgcatgtatcaaaatatcacatttactttttatggatacataagagttgtactatataaatatatatatatatagtatataaatatactatataaatatgtacaactcttatgtatccattaaatgtaaatacatgaatagattaacaaatagaacaagaaaaaatgattagtacagaatatttagcctttttctaagtttcatgagaaatctgcagatttcctagggaaacttatgatagcctattaacatgcaaatataacgtattagatctaatttttaaaagtaaaaagggatttttttaatcgactcgaagaagaaaaagatcttttaccatggttttcttgtcctgggctcaacatgtaatgatgaaagcaaactagaatagaaagtaaggcaaagaaaaataaatatatatttttttcagtggtctctaaatgtcttataaactttgttatgtctcttgtctagctttattccaggcacaaactgatcaaaaattggttcactgaatgagcttgccatatcagatatagaaattttgagatttgctaattcaaagtacaagaacacagtaaatagtaagagaatacatgagcctgtgagtatattaaattcactggcatgttttttcatctatttccctttagaatctattacaaaacctagagaaatgtgactcctatgaaccactgttatgcaaaggtgtgccagattcattgtgtttagggtagaaaatatagctgggagtaagaaaataaaaaataaagattttaattccaagaatgccccaaactaagtaaatgatgtattaccaaatttttattgctgcataaaatacctctttgtgacaacccagtttacaggcaatttcagtgttgactattagagaactattaagctgagaaggtcatgtagcatagggtaaacctcatgacctcatctgttagaacatgtgttgatacgatagaccaaggaaaaaatatgctctgagtaagaggtaagcatgcaggatcaattcaaaatggtcccagatgaagatgccttctgagtatatgtcagggaagtgaagacaatgaatagttccatgcaagcaattcaagtgagaaagggcaatgcgtaaggcaaaataaatgagataagaagcaactgttgccctcaaagagcctggtaagaggaagaatttttgtaagtcttgcttatttttcattagaaaaaaaatttagaggcaaatctttttatttaggcatattataaaaatatttctgtatcctaactatgaatgagaaaataagcataaactcaaattataaaaagatccaacaggcaaaaagctatgacatacaacatttgtttgaggttgatacttgaaaagaaattacccacaagttgtggagaaaataaatagaaatctgtttttctccactgctttaagaatctatactaatttcaactctcttagacaaaatttcacataggccacgtgcataaatatttttatgttgccattataccttatatggcaagtaattcctgtatccatactaactttactctgttgagctaaatacctttttagcaaaaaatagaatgtatcaaaatcgtaaatgctgacatttattgggaaaatggaataaattacatgcgctataattctcaaacctgtttagtgcaaaatatcttaaaagatgaaaaaagttcagagagagcaatcacaaatggatagaaaggaaaattcaaaatgatgtcaagaaaaaactggaatattagctccaggagagcaaaaacttttgtcttttattttttaaactactctcaccctggtacccagaattttgtttggacatagtaagcactcaatagatttagtgaatgagtaaacacattttaaaacatcaaaagtattacctgtattacagtgaaaaatacctaatgaccttctacaatgtgccattctttatgcaaagtactttatatataacagcctgtataatcactgttaaaaccacagagaaagataatcatttattgatgagaaattagaagttcagatctattaagaaagtcatccaaagccatgctgacttcaaagtacagactctttactttaggacatggcataacctccagagggtaatgatattgagaaagctttgccattggaaacacaatttcatagacaagaagagaaggttatgttcacattacttttcatgcttcacatggcaataacattctgatctttaatgttaggatttataactttacactaaatactccatgatctgttgtctaaatggtaacaccaagaatcatcacttttcctctgtaataagatgtgcagtgtctttgtgtgaaatatagctatatacattgtatatcttctagttgagaaaattaatcatgcaatgtatctggaataagaaaaaaatacagcaacaataaaaataggacaataaaatgagtaatacgtttaaatttctattgccagaaaaattgttcaaaatagaacttatgaaagagaaatagtgtagcacaaaacaacagcagaggagaaatgatgaaaacaatgagagaaagagataaattagtgaaataaagttgaaaaaagtttcattttaacatcattgcattttgtgaaaaaattttacacttttacattaaagagtttaagcgtatactaaattgaatttcttacttgatgcttctgctttaaattatatcaacgcttaattaccatttaaagcttattattagttaatttatatatcattactaatgtcagcatcttgtcaggcataagagttaaatataaatttatattccccaggtgaatgcaattgatacaagaaaaaaaaaaaggagttcctttctctaaatgtatcacatagtgatacaactttttatacactacaaatagactgggtcagaagttaaaaaaagtagtttgtagggccaggcgtggtggctcacgcctgtaatctgagtactttgggaggctgaggcgggcggatcacaagatcaggagatagagaccatcctggctaacacggtgaaaccccatctctactaaaaatacaaaaaattagccaggcgcggtggcaggcgcctgtaagtcccagctactccagaggctgaggcaggagaatgacgtgaaccccggaggtggagcttgcagtgagccgagatagcaccactgcactccagcctgggcgacagagcgagactccatctcaaaaaaacaaaaaaaaaaatctatccactatacacctttttgtgttcttaatataatcttcccactgaatacacaatcatatttactaacgtctataaccataaatgctatattttaacattatagacttagtagggttgttacttaaacagaatacatgacaacatcttcatgttctctaatctgcagacaccttttcaggcttttgcaaaatacgtaactgtttggctcaaaatttattacgagttcaaaaatatttttaaatactgaatacaaacagagagtattgaaaagctattttaaatattcaagaggactggagaaaactcctccattaattttaatgatgaaattaaaactgaacctattaaaactaaacctattagtcatcaagaatgatgattaaatgaaagtatcaaacagaatctatgagtccatgctaataagtgtttagatcaattaataaatgagggagtagaggaaaagcctcccatttagaagaattccaattaaattacatagacagtccacactaaaggagggaaagcataaatccttacatcttaagtgtgccctggtgtaagaaacttctttcctaagagtacagtatgggaagggggaagaacagtgacatcacagttgagaaatccgacaagtcctatttcatccaggagatcaaggtcaaatttaatagtcataaattacattggtagtatgtaccattgatacaatgtgaggaaaataacaaattccctctgtaatatacctcccccaagcactagtcttatcaataggaaaagcaccaacaaatcccaacacatggtatgtattctacaatatctgactagcatgcctcaatactgtcaaggtcatcaaaaacaaagtccaagaaattgtcatagccatgagaagcccaaagagttaggacaactaaatgtaacatagtgtcctggtgccaccttggtatagatagaagacattacataaaaacttaggaaatatgaataaactatgaatttcagttaataataacgcatcaatatttattatctaattttaccaaatataccatgctaatggaaaaatgttactaataggtgaacctgtatgctggggtcatacggggattttctgtacaatctcctctatttttctgtaaatctaatttttttctattaaaatgtctattaataaaaataacttaaccaaagagtctaaatatgaatgtgattatatgcaggtctgaagggcataacagcatgagagcatagagagaatgcaaattacacagtccagaggatttgacaagaagtcttcttgctttgcaataagctgcttgggcacacttagataagtcatttaagcctcttttccctggtttgctatgaaatgaatgaacaggactacaagagttctgaggccccactgagctctgttgtccgttgatttacctacaaaatgatgtcaccctcagagagattacaatctacttgagaaagtaaacttgctaacattgaaacaaatcaaaacatatttaggaacatagttcaaggctgggatcatattctatgtagttcatattctcaggatttcagagaaactaagcagcattatgaaatacttaagaagtaagcgagacttaaggaccattttgaaaaattggaaaatatgaatgaagaagtgaaggacaccccatatcccaaataattggaatctgactcttacagcaaattctccttttgcttcagttttaggttctgaatggggtaaaatattccttcaaatccctctatgctttattatcacatatagcatgaaacccaagtgccttacatggtgtatcccaccttccttgacattgtccttgttagttttccaaacccatgtcatgccacttgtaaagtgatctgcattagcacagtcctgagctgtctttagtttcctgcacagactatagttttagtttgaaacctaaatagtgttctgtgccaggacaggactctgtctgggaaagaagtgtaaaacttttggacttggtttggaaatgctcgttcattttaattcctcagtttgttttgattatctgagcctgcagaaatgatgcacccaacatttctctcaatcattcaaatgatttaaaacagatgaaatttttgtatataatatatcagatttcagtgagttgttaacttctgtataggagccaacaggaattttaaaaatctgttgttaaacactaataataatcaaagttgcaagacacttcatgttgagaactacaaagacacagccatagataaagttaacagcgacctggtgtcactgctcactccagggtgtaagcttattgaatagaatggcaggcatgcttgacagcagagtacgcaatgcctttttttttttttttaaatctcccactctttttctattttatcaagcatacataattaaatttgttaagtgaaaggatgcttaaaacacttgcagggatgtttctcaggaacatcctgagatttttttttttttcaaaaattagtgactttaaagaaaccagcatcctttgcaaactcaccaaattagtgtgtgcgtcaccaagatagaccatattttcttatgggtgggatgctagcatgcaacctgggatcccaaaatgtgatatatttacaggaaacatcatcacaaaatgccatgagaaagcagactgtgtacagaatccattctgctaaaggtggcatcagagcatccatctttgggaagtagttgtgacaaagtttctagaatccagtgcctgagggtcagcagtccagctctggtgtctgtatccctcaacagtatttcttcctgcataagccagttagggtgaaatctgttctttgcaactcagagcactgatagacaatccttcttttcttctggtgatacgtttctctaattctttagcaaatacctttttgtctgtagttctcaatttttggttccctccttaactgaaagtaaaaactaatactctgttgtccagtattgtagtctaaacacatatgtatctatttacattaaattagttcaaattgaataaaattaaaaatttacttcttcagtcatcctgaacgcattttaacggcttaatagcaacatgagctaccagcaacaacatcaaacaatgcagatacagaaacatttccattactgaagaaagttctatcagaaagagctgctctaaggcatagaaaatttgactagggcatatgtttctgcatctacatcagagaatccccttttaatgagttaactgattctgttaatggtttcaaattatgaccttgataccatgacatattacattcatctttcactctattattcattttgattttgcaagtaagtttacaaatgatcagattagattcagagctcattttgttagaataacaaaaatttaatctcattactactcattcctaaacattgaagttttcctcccagttaccttctcatgaatgatattaaactccagagtaaaatctgaaggctgacactaacagagccatccttttcagaaagtacatccaactatgttaaagtgttcattttagttcaacgatacctgaaatgcaggctgtgaggtggacatttaggatatgtacctgcctagcatacatttcccatccttttactaagagtactccaatttttgaagtctcccctagtatacaaagtcttggtacttctgtcagtcaagttattttctcactctcccctggccttgtgcttgacttaggaaacaattaaccaattggattatgctgtagaaacttacaaggagggaaattaaatgaagttacttaatctcaacgaaattacccaaatatatgctcatgagttccccttcactagacccccagagctgcccttattttgtccttcctgagttttgattgttcaaaatttactttgcatatgtgtcctcctgcaagattttaatgataatttttagattttgcttttagaatagccagttggcttttgcaaaagtattagatgatatcaatgtgcccatatttttacctacttgggaactttttcaaattacatctgttcttgatattctgaaatgccacgcttacccctttcttatctgtcttggtagcctaccacactattgacacactcatcatgaaccagataggtactttgaattcatctgcctgagaataatttaaccttcatggtctatttctgccaaaatactgctttaatacccccaatatttgttaactctatttgaagttaaatttctatctgtttgtgctttgagagatgttggcaaagagaaaggaggaaaataaactattttagataggcctagccttgtcaaatgtgttggagactttatagaaatcatgttgtcaaagtgatcaatttaaagaaaaacatacttatgtcttcttattttctgtatcaggatgtaactgaatatcttttggttagacatttgatcatatgttattttcccaaaccatcatttcaaggttattatcataagacaaatcactctaaaatctaatagttcaagccagtcagaattgagtgatgaaaatatacagctttatttataagtacattttatcattaggcttgaattggttcagacgtcatgaaaaattttgcatgctagtagtaattcctcaaactccaaagggattagagtttaacaaaattgccaatccaaaaaaaacaccaagcaaacagacatttattttaataagtacaaattacacataattataaatattccttatactaatatttaaactcagcagacagaggacaggttgaggtttgatttatattcacacttccgtcttaaaattttcaaaagacatcttttatttgcttacacatgaagaatgatcagtatcactatctgaatataaattaataagtgaaagtatctgtatatgtaaattcaggcaaactcaggcttaaaaatctaccttattgtaccacattgcaaaatagaaaggattgtaattctttataagtattcggtggaattaagtgcaatgcaaaacatgctatgaatgtcagctgttatatggaaaacatctaccagaaaagccacccatgagtccactcagataataatttttcctcttgtctgttttataagctgttgaggaatatataaaagaaatggaaatttacaaatttcaaataaatgaaacatacatatttttatagctatataatattacatacatttaaatagttacttgtattttattggctcttcggctacattccaaaacttaagcaagttaatttaggaagagccattaaatgcacgttctcaggcatattttcctacttgtaatgttcatgttcaaacatatttttcaatatgtaaaagtaaagtctttgtaaaataaataatttaagacattccttgtattataactgcattcagaatgtataatacaattatggcttggaaaaatcaccttaaaattttgtcttatctttttgttgtgcagaagctccactcaaaagaagacatacatgcgtccaacaaacatatgaaaaaaagctcaacatcactgatcattagataaatgcaaatcaaaaccacaatgagataacatctcattccagtcggaatggctcttattaacgttcaaagaaacaacagatgctggtgaggttgtggaggaaagggaaagcttttacactgttggtgggagtgtaaattatttcaaccattgtggaagacagggtggcgattcctcagagacctagaggcagaaataccatttgactcagaaatcttgttactgggtatatacccaaaggaatataaatcattctactataaagacacatgcatgcatatgttaattgcagccatattcacaatagcaaagacattgaatcaacataaatgactatcaatgatagactggagaaggaaaatgtggtacataaataccatagaatactatgcagcataaaaaggaatgagatcatgacctttgaagggacgtggatggagctggaagccattatcctcagcaaactatcataggaacagaaaagcaagcatttaaagtgggagctgaattatgagaacacacggacacatggggaacaacacatactggggcctgtccaaggggtggggggcagggagaacatcaggaagaatagctaatggatgctaggcttaatacctaggtgatggtatgcatctctgcagcaaaccaccatggcacacatttacctatgtaacaaacctgcatatgctgcacatgtaccccgaacttaaaagctgaagacttttttttttcttagagggagaaactagatctaaatgagtcataaaatacaaatgaatacaaatgcttaattctcctaatacgtcatttttaataaattaaaactatgcttatcagttcatgtgggattgtctaaaaattataaatgaaagatttaaattctctaccttcacaaatcaggtacagctagcattgatgtcattgagatttggctgatggtacatcattagattctataattaatcaccaacacctgcagatgcattctcaacatgaaattacttttgatatcacatggagaaggagagatctcactaaatcttttaactatgagtactttggaggtaacagagatgattgtcatcttgtcacactgagacatgttgattctagcacttttggattcttccatgaatatgttaaaccattaccaataggtcaataacctgcccttttcacccctgactagaaacactattttaaaagagttcttattgatttttttctagctgtttttatttttctcactttctaaaataccaagaaaatatcattcaatgctgcaaaaataacctaaagaaaaaaaatctaggagcatcatacaataaaaatgaactgatttcttatgaagtcagcttcaaaactgtgtaaggcccaattcttatctctgacaatctgttacttaacatttgctgcttaacacttcataaaagtcaagtctagatgaactggcatacttcataggctttttttttttttttttttttttttttttttttttttttgagacggagtctcgctctgtctcccaggctggagtgcagtggcgcggtctcggctcactgcaagctccgcctcctgggttcacaccactctcctgcctcaacctcccgagtagctaggaccacaggcgcctgccaccacacccagctaattttttgtatttttagtagagacggggtttcaccgtgttagccaggatggtctcgatctcctgacctcgtgatctgtctgcctcggcctcccaaagtgctgcgattacaggcttgagccactgcgcccagccacttcatagtcttataaataatttactgtaatactcattaagggcagtaaaacaatcagcagttactacacactgacagattcaagtatagagtgaatgagatactatgtatctactatatcttgaaactaaaacataaataagtgtcacaaatttaaaatatacatttaaaaaagaatagacacacacacaagcacacatacatacaatcacatacacatccaaacacaggcgtattgttatacatgcatataaattaatattaaataaaacttatgttttaacaaactctgtatacttaaattcaccagtggttagttatcccaggcagtattacctactaagccttagggaccattattttcatttaaattccagtagtaggtaaaacctaaatgtcaaaacttagcacaatgtttaatgagtggataaatattagaaaccacgtctcctgaaatcttaggtaagtcattattaggggcttactactttcagtacctgacatttactcctttttttcatattagttttattttttattaaatgtcctcctgccttgaagataatctatttaataaagaagaaaaaaaagtgcttttttactttgaggtttacttgaacataagcatcacctttgtaattccacacaagcgtcacctttgtaatttgtcctttaagacaattagactgttttatatcaatgtattattaaacttgattgcacttatgcaggacatattataaaagaattatgagggaagtacacagatgctgttagagtctactaaaaaatagattatttactattggaaacccaaaggagagaatgcctcaaaaatgtggtaataaatacctgtgggaaaatcttaagttgaagaataatcctggacataattttatttactattgttattatatctttatcctaacgagattaatgactgatgttttcactgcaatttcagttaataggaactctatacaatgaaattgcttgatcaactgatagttttttagtttattgttttattgacacataatagttatacatgtttatggagtacatagtgatgtttagatacacacaacgtatagtaatcagatcagggtaattagcatatccattatctccaatatttatcatttatttgtgttgaaaacatttagtatcttctagctatttaaaaatagatattattgttaaccattgtcattctacagtgctataaaatattagaacttgatcattctatctagctgtaattttgtgttccttaacaaatatctcggccgggcgcggtggctcacgcttgtaatcccagtactctgggaggccgaggcgggcggatcacgaggtcaggagatcgagaccacgaggaaaccccgtctctactaaaaatacaaaaaattagctgggcgtggtggcgggcgcctgtagtcccagctactcggagaggctgaggcaggagaatggcgtgaacccgggaggcggagcttgcagtgagccgagatagcgccactgcactccagcctgggcgacagagcaagactccgtctcaaacaacaacaaacacataaaaaaaacaaatatctccacatccttcctttccctctaacctttccagcctgtagtaacctgttttgcattttacttctatgagatcaacttattttagcttctgcatatgagtaagaccatgcagtgtttaacttttggttcttatttcacttaacataatttcctccagttccatccatgttgctgcaaatgacagaacttcattttttatgtctgaatagtatttcatgtgtatatgtgtcatattttctttattcagtcatccactgatagacatttaggttgattccataccatgacaatcacgaatagtgctgcaataaacattggggtacagatttctcttcgatgtactgattaattttcctttggataaatggtcaatagtgagattactggtatgatcattttaatttaaggaggtattcatcaaactggttgataaaattaactagtcccagcttaagatatctgggatctagaagcactgtttatatactttgcatgagacacagttctaaccatacaattaaaaaaaaaaaagattccaagcagttcatacctgtagcctcagacttaagcttaccctctaattagttaaacattagggcaatgattttctgcctgtattttataaaatgtcttcatgctggtggtagagtgaatgtggaggaaaagaacatatttaagtggaggccattcatgatataagataccatggaaagcttgagttttcagtttaggctacagaaaatgcaaataaataaattaaacagttggtttaaaatattactacaagtaggattttcccctgaaggaaggcttggttttgtcatgttttatgctcggtttgttaggttttattgttggcttcatatgtctcttgctgatgggagtatgtgacgtcaccacacggcatagagaggaccaagaagctgtcccagtatcataacagaaggagactggaggcaatgtgagaaataaaaatgcagagttaagaggaggtttatacaaagaaagaactagggagtgcgaagaagagacataatttaaaagaaatgttttcttttattatggaaaaatatgctgtttatagtataatgtgaatcctcttctcattatttttactcaaacttcattaaaatatcaatttctggttgatgcgttgtgctttttaagagataccacgaaagaggacttaggtggttattctggaatatgggtatttacgatgagtaaggtgactattttcatgcaatcatttcagaatcagcactgtgagctgtcctgccttaagacaatcgttgcgcacatctatacaatactatctatttcactccaccaccataccaatcatcgagcgctggctgctcagcagggtgcggatgtgtacttgaccatagccatagtggttctcttgagatgcagacagtttctacactaaaaatgagttgacgtttaggagaaagaaagaacaatcttggtggtatccatttgaaaaagggaagcggaacttcaaggaaatattggcacaaaaactaagactgcttacaagaggattacctcatctgggttagaggaggatttcaaggatatgaggcgctctcatcacaataaagcagacattcccaacagtcacagaagcaggcaaatgaaagatgatgtaaacttatataagacttgagttgcttcatcttaagcatccatccaatttcagtacatgggttcttttgctgtttcaaagttctttttttttcttttagtactgtacatttccatataaactttcattcagagtttttacttttaaataatttctgtagctgccttttgtacttatttgaagaataattgaaaagaaaaaaattgagaaaattaaaacagatttctttttgccaaaagaaagtattggtaatttatagcaaagctggaaacgagggcctcttaagagttttccaaagtatgtcagctagtagcatggggttttagatcttttctttactgcaatcaatcctgctggaaatatgaagtcagttcagaagatcagtagagttgagctagcaaaagaataaaaatcctgaaaggagttattaattatgtgcatactgtgtgcagacagaatcagaagatactggccaagacattatgaaacaaggaagaattcacgagaaactttgaaattgccatatgcaagatgcaagttccctttacccaattttgcactcatcttctgatgctagaaaagcaaatgagaatgttgctaacacaaatgttatgtatttgcactgatcgagatgggtgagttcaacaagggaatccagtctcagtgtggattactgataaatgtccttgcttttgtgctagcctaaatttctagtgttgagagacacattttgtgtagattccctatttatattacattaactaagtatcttgaggatatgatgatttcagtaaatgtcattcacacaatccatcaatagtcccggggtggaggggcgttatcagctattgtttctctgaataagtattatcaaacattgcttttctgctatacagaagcactatggaatgaaaccacaaagtctgtagacaatgtttttgcacactgtaaaaattttataaagtcaggtttcatttaatttacacttttgtttctggttagtgtttttactataatttgggaataatgtacagtggtaaatcattgtgaagtaacactgcattctccttaaaattgggatgtattcaggcatattaattatttcaggattcattaaatataattctaaaagagtttctctttaaatatttatctactcttgactggtcgtattgaatctcacattcattactaaaataaatttaagaggccttgataattgcagaccaaatatatagttacaattgtcgctatttataaagaggttcaagaactctaacctataattcacattaagttgaggcatcaaagaaaaaaatacacaaaaaaggcatgttggcagtgatggtggtactaccaaaggtagagttgggtttcattcctttcctgttccagcctatctattgcttttaaataacttatgctgctcgtgtgtgaagggatttctccttttactcacatatttacaacctctaattcaggagagagattagagatagagaatctaatacccttttaagttgcaggactataaaaacaaaataggcctcactccacttttctaaggcaagattctaggaaaggataaatatattcatgagtcaaaatccactacaatgaaataagtaaccaagggtaaatatattcatgagtcaaaatccactacaatgaagtaagtaacctaggttactgaccagaactctgcattgaggataaagccaaattctttataacctcaactctgtcagagttggtagtaatcaggactaggattcagtaataagcacttttatttaatatatatatttatctgtctctctctctctatatatatatgtatatatatatatatacacacacatatgtgtatatatatatacactcatatatgtgtgtatatatatacacacatatatatgtatatatatacacacatatatgtgtgtatatatatatacacacacatatatatagcatttcttcccctttctgttcaatacagcacactgattctttcctactatgtgatgctccgggctggtatgtaaatcaagaggcctgccttccctagccaaaatgtgaacacagcagagagttagcagggtgtaaatgaatcctactgtcattcccaataatttgaactgtgagtacaatgacacaagaatgagaaaaataaatggacttcattcattcaattggtggtgctctatcaacattgtcgatttgtgcttcctacatagacccctgaggctttactgcagcatttttataaactagtctcattctcaaaccttctcaacatttgtgtgggctaatattctccagaaaagatccttttatgattaaattggccactattggtttatgttcatgcaactacagaatcataatttatagcacatggcaagcatataagaaatatttgcacttattcttataaacagcagtggtaaattctacattgtttagccctttggggtggtttgcttgaattctatatagaattacaaaatgttccgcagagaagttctcaaataattcttgctgtcattcatgtaagataagtaagacactacttcgtgtgaggtgccacacataagttctagggaatacttcatcacttttgagcaagccagcaagaaagcccttaccacaaggaggatatattttaagagaaagagaaatgtgagtcaatcagttttgatagcttatatgcaatggacagttatcagtctgagcttacattacatttactaacgtaaatacaaaaatctttgggacatggtgagagatgtcagcattagctagctgtgggtcagctgtttactgcaaaacctgcaaggcttgggaactgggagaactgtttgttctcaagaggagacgtgaaacccgaaatatctcccttgaggatgggattttttaatgtacaattctttatatttttcactaaaatctatgtaattttctttcacaatcaacataatctgacaaaaatgagctgttcctcataatattgagacattcttggaaacattttgaggaaggaaagcttaggaaaacactatcaagtttctggccaaagagtagggctccacacatcaggatttgaggtatgaataaaaatgaggcatttttacactcatcaggtgataaagcaattgtgtaaaaaaaaaaaaaaaaaagaaaattctagaatataaattatcttttaacgaatgagaacaaattactttggagatatttggtagcttccttaatcatagtagctttgaatgatatagatgcccgattgtcaacagagatcaaaactaaatcagaaacttaaaatggcccaataaaatgtaaagctccttagaaaaacagcattgctataaagtctcaaatacagtaatgtgggagaaaatgacacgcacagcctatggtaagggataagagctgcaatatggagaagtttatcttggattctattttattacctctacctaagccactttttaataaaaatcatcaacagttcacaccataaaacattttggacctagcccaagtgagaaaagtcaaatatatttatatatgttttttggctttttaagagattatttattttttattatactttaagttctggggtacatatgcaggacgtgcaggtttgttacataggtatacacttgctatggtggtttgctgcacccatcaacccatcatctacattaggtatttctcctaatgttatccctcccctagcccaccatcccccgacaggccctaagtcaaatatattttatatgagatccatagtactcacaaaatttaatacatctatgtagacattgtcaaatataggaagacacttaacatatttctttgaatatactgaccctttttatatattaatgcctgtgtatcaaagtacatttcatacacagtttatcttctcctgaaatgtgattataaaattgatactctacaactgatgaaaagctagtaattgaaatgaagtcattctaatgaagcaataacactaacatagttttccaataaatatactgtgaatgacttagcctatggaaaaaggttttgaataaaaattattattttctaaatatctgaactgtaagatattagttctctaaatctatcttttttcttttccctggatttgaatatcatagctcactaaacatctttacaatttgcttcctctaaacacattctttcttctggaaataaaatggtgctttgaaagaatattaccaataggaagacatatttcaaacacgaggttcctgctttcaattacctaacagctggtactatgcgtttacatttagaaagacaaaaccttacaaagatgtattatgctttttcaagtaatttagatttgtcacagtgcaagaaaaactcattggcaaataattcaaataggcttgtaagtctcagagataaggggctttaaaaaaagcaaaatacattctttaataagcaaagttatgagacagatctataaaatagaattgagaaatctttcaaagtattccatgcagaacagctgatttagtaacctactgtgaaaagaactattgatactccaatagcagcggtgatacagtgaaaaggtaaattttgaggatgcgatatgactgcttgatctagtagtacaatactgtgaacaagcagggactttgcagctagacgtatttaagttccagttctgactccataatttacactgctgtggttcacttaaaactctgtgagcctcagtttctatatctttaaaattaggctaataatgcctatgtaagtgttgtgaaatgctcagaaatataaactaaaatcaatgctattgttttcctgtcatctggcaaagagtattgctccaattttatgtgtcaagtaatgtaaaacgtaaaagtactaacctaccaaatctgttctttttctaattgattacagaagaatccattaactttagtggcaagaatgtctgttatctctcaattgttctctcccttcaggctgatttttttgctaatatctttggtgctgagataatccaaaagagaacccccatctcctttagtggcagagctggcacaagcttatacacgacctcagggacctaagaactagcccaccaagcttgctaccactggagtccccaacacatccagtggtagtactgccacacacaggagagctggccagcccaatatctttctctccagcaaggcctcaccacagtctctacaaacaactgtagtctatgctaccaagacactcacccataccactgatgttaattgaagtcagagaaatcacatggagactatactaatgtgcccaccagaacccaagccaaagcactctaccaaaccaacactctaggacacatctacaggaaaaaaagtcttttcctataaaagctactccataaaattggaagaagaaactattccaccagttgcacagatatcaatggagggatacaaaacaggtaaatgcaaggaaacgtgacactttcaaaggaacaaaataattttccagtaagagaacccatctctaaaaggaaatctatggaatgcttgaaaaagaataataataattaacaaagaaacagatacaagaaaacacagaaaaaatgtttaaataataagaaaaataatttatgatctgaatgagaaattcaacaaaaagataggtatcatgagaaaaaatcgagcagaaactctggaactggaaaattcagtgactgaaatgataaatactactgagggctttaaccataaagtaggaattttttacttgaagacatcttttgaaataacctcatcaaataaggagaaagaaacaaggaaagaaagaatgatgaaaaggaaaaaagaaagcaaagtaaacatagtaaagaaagcctgtgagacatatggaacatcattcagcaaataaatatttgcattatgaagtttctgatgaagataagaattcatagaaaacgtgcttaataaagtaagagctgaaaaattcccaagtcttcagagagatatggacttccagagtcagaaagattaaagatttcctagtagattcaacccagagggttttcttatcgatacttatagtaaaactatcaaaagtaaaagacaaagagaattatggatactggagtctccaaagtggggaggctgggaggggaataagagagacaaaaagccacatattgggtacaatcttcaccactcaagtgatgggtgcactataatctcagactttaccaattgtattaatctgttttcataatgctataaagaactgcccaagactgggcaatttacaaagaagagttttaattgactcagagttcagcctggctagggaggcatcaggaaacttacaatcatggcagaaggcaaaggggaaacaaggcacctttttcacacggcggcaggaaggagaagtgtcaagtgaagggagaagaacttattacaccatgaggtcctatgggaactcactcactatcatgagaacagcatgcaagaaattgcccccaggatttaattagctccacctagcctcttccttgatacatgagggttatagggattatgagggttacagttcaagattagatttggttgaggacacacggcctaaccatatctccactatacaatttatccatgtaatcaaagaccacttgtacacctaaagctactgaaattttaaaaaataaaaaaataaataaaaagatcttagaataataataataaaaaaaaaaaagcaagagaaaagtgttgtcacatgtaggggaatttttaccagactaagagcagatttcgcggtagaaatgtaacaagccaggaataatgggataatagattcaaagtgctgaaagaaaaaaataaaagttggtcaaaaatactatgtccagcaaagctactgtttagccatgaagaagaagtaaagtctttcctatatggacaaaaactaagagaatcaattcatcaccactagattggcctgaaaataaatgcttaagggagtccaacatctggaagcaaacagatgatatctaacatcatgaaatcatgcaaaagtagaattactgatggagaaaaatgtaatccaaggaaaattgtggtgctatgatcagaaggcaaaaataaatactgggaaaaaggcaatatatatttgtataactctgcataatcatataatatattactgctttttgttttgtttatatctttatacatgctggttttggtcttgaataatctgaagatgaatctatgtgaatgaattaatttttatatattttattttttctacctctgacttcacccagctcccaacccccatcgcatactgaacccattaatggcttcatttccatcatgtcagtcatcagtccttctctaagccccaagacatccctgaccaagacaggaagtgtgcctgcatttcagaacggaacacagagttcatctacccgatatgacccaaatatcagatcagaagaagatacagagcaggcaaaacacaaaaaggaaaggcagcataaagtcagttccattttataaaaatgcctttcttttttactcttcttggaaaataacttcttgttctcaaacttttggtgatcagaaaaaaaaaataactttatttttttctttctgatacataggagcctggagcctgcctcaacatttttttctcttattgttctacctagctgcatacctcagtattaatactagaataaaatgtattttgcttttctttcacaatcccctcctcctttcttaagcttcatattttagctctctaattaactcccaagtagggtaatacctaataagcattatgtatacaattcctgagagactatttaagaaacaacccatagagttatcccttgcatacctttgatgagtttcctggatccccttttgatctggattaattaatgttcctgagggagtgctgattttctagcattcttccacctttgatgcagaatctcaaaattcccttgtacaataactttgggtagcaacatgaacgcaaatggctgttcagatttcaagaccttctatactaattctttgtaaacttaggctgagacaagggggaaaaaagcatgtagcaccctggataaatcttaaattctgccatcagagctaagatttaccgtcatctgtttctgcagagacagacatttttttttaaaaggcatcctatgcttgactctaaatcctcacttatatcttcatcaccatctagagatggagcacctcagggaagttccagggattgccatcagcacccccttctctctgatacgttgttaaaggtttcctttctaataaataatttattgagttcctagagctatagactgaagtgtttattttggattctacattttttcattcaataaatgtattgagtgtccacacttatgatataatatgcacttatacttctccaggtaaagtaatataagaaattgtactgattggtgcaattactgaaagtgaaagtcccataatcaccgtcagttataattctgtgcttttagaatatatgacacaaaaccggcagcttgatgagagcatagcagtcatgcattcatctgtatatcaatgctaggataatatcatctgaggagtccatagttaaagtctcgaatgtagcttttgaatgaatcatatatgacatacataatcagcaagaacagacacatgattctactacttcactctattccaccagttaaagtttgagctcctaggagaagatctttcatatacaagacttttccaaaataacagataaaaacatagacacaatagtcccaaaaatattttcagagaattcaggcaagttatttttcaagtatccatgataatgctctgtttatagaagtcaaagacataaagtacagattattcacaagaaacagctgtcttgagaaacaaatctgatttattcatttaataaacatttgttggcaccatgcaggtcagtactgttgggaatatagtcataagaaagatacgtttttattaaagcagaattttaaatgaagggtatgctttgtggaataggattttatagatctttgaatttatgtcaatacaatgaaatgacaaaccgtagtttcttatcatttagtcttcaatatatgactttaggttttcttcttatcaatctgttcctgttactaagaaaacaatttatagtattttataataatgagaataaaatcaaatagggtatggcaggtcttcatattattattacaattgttcttttataacttgtatccattgcaattttctttgctaatttcctcaaaagttaactatgtaaagatattatatttctatataatatctctagatttgtttgttctaggttttacttgtctaacctagaagattatcctacaaagtccatggcctttaattatctaactttgaaggtatcatctttagatagaatgccaattttgattctaaaaaacttgatcttgctgtacatgtgaatcacataatgcagttaattggttcattaattatctataaaaatgtggaaaaagtcctaaatggttgacaaatatatgctaaaagcagggtataaatataggccaacatttaaaaggtttccaaaatattctacataaagataaaaaggaaaaaaaaacaatttttacaaaaatcatcttaatgtatgctttgtgacagttacacaaatatataaagtgtatgatacaatcctttatctaaaagcatttatttttcaagttttgaacttgactttttagaaaatatgtctaagtttttacatatcattatgtgatagtcaacaatagtgtcaaaattctaaacaatttgattcaatgtgagaggctactgcaatgtttctcacttcagttactcttaagtattctcttctgcaaggcaagttacactacctctatattatctaaaagtgactcttctccaggcatcaagagtgcagaacatgacaggatgagccagtatggacttttcaccttcccttcatggggcagaaaaacattcaggaaatcagagattttcagtttaatcatcagggcatgaacctcagggctcaaagctgctgagagccaacatacggattttgaggacagattcaactagcaaagccaatggagagatgcatcccaaattcatgtttgagccttaagttcagcgaagcttgtagcaagccagttatatatcactaggttttcaattagttagaacaataaatttatttatcttctcttttgaataaacttatttaggcagaaagagagtatccgagagagcgtgaataaacagcatgagaaaacttggaatatcttagcaacgcaatgacaccataagactggcagcactgtagagaaaacagagtaagaaagaagagaggcacaggaaggggagaaacaaaaaataggaagggtgaccatcaggtgaaaaataatgagaactttcaggaacatatgggaggaaggtttgactctaaagctattaaggggatagaattaacaggaaaaaatatagcatttgaaatacgagcagaaacaaacagggataaaacagggctgatatatgggtttcaagcttgtaatatgatattagatgttattagtagacgaaataagattataatgaagaaaaattagaggttaggaagcagggatggagaagagatcatgaacttagttttacaccttatgaatctgaaataatcatgggatatccaaatgaaagttccaagagacagttggttatgcaggtctgagctatggaataaaatttggagatgtcagagatacaattttagctgccatctatagacagaaattagttaagaatttaacggtagataaaataaatcagaagtaatatggaaggctggaggggaaaaaaataagaaagtatatctgagaacattaacgtgtgagatatacatagagtaagaagagcttgaaagtaaacctaaaatctgtcttcagtaataagatttaaaatgtaaataattataaacaaaaaataaacaaaaggtgaaagttatgctatgtaaaagtaggcagaggagagattctaagatgggggaaaagtcagcaatagcaagtaatgcagatgggtcaaatcttccattgagtttagcaagtcattggtgacaactggtatggggcatctcagaaaaatagtaaaggtggaagtaagattgcagtagagaaagtggaattgcattaataattcactcaatgggtcatcgagtttgaagttgaattcaaacttatgaatctaattctttatagaatcaaggtcctctagaaacttggtcatttcctatatgaaactttcaaagaagatatttatattccccatgagaataatactaactacatggaatatggggtcacattgaatgtctcaggaattgttgctgattttttttctatgagaaagcataagtacgtctaatatagtgaatggctcccaaaacattcatatttaaaattcatttgacaaccaatatataacataacatttataagaatgtctttggtatgaccaacaccaaagcaaatacaaaaacaaaaatccttaaagacatactatgtgtgaatgttataagttatccaaaaatcttgtttctattttgtcccttgttaaatttttaccctatgacttgctgagaagctgcaggagagagaatttcctgatgagttgtctaacagcttattctttcctcctgctatgtcctcaacatctatgttcaatattaaattgcactgcagcggagatgactgtgtgtgtgtgtatgtgtgtgtgtgctttaagcaaaagacagaggcttgagtgatttagtagctacaaatataaatcactgacaagcaattaacatatactttggttcaaaaccaaatatttccttagcaacaatcataatcactattttacagtgaaaattggcatatttatgatatgttgacattaagatattcagtaagcatattgatgtttaaattccatgtttaaatgcaactatttataaatcaatcatcccacaatcaccttttcttaattttgaagtgcaaatatgtgagtttaagattttagattgaccaaagtgcttatttgttttcttccacatagctcagtttaaaatttgtaaaaagtattaaaccacaggaaagaaaagtgataaaagcaaatatgtgattcagcaagtttcttaatgtttgaaagtaaatggaaggtcataattatttaaagcagaatacaaaaatatcacattgaaaatggcaaaattgggtgagtatggataacatacactatcaaattgactggagaaaatacgacaaacttaacaaataagggtagcatgaaaatcaagaaagattagtggtgtcagttaaaatattaaataaaagtataggtaaattagggggatccttccccaagttctgagcaattttcccataagacttctccttccccataactaagattttattttctgaagaaattgtcagagagccaccagacttttaagtcaaagaaagtaaggccaattctttgcttgagtacaggaatgtctacctgctgacaagctctgctcatacacagaagatttccaaagagcatctcagtgcccagccactagtgacagtgacaactatctattaaaaatccacacacacatttttacatatgtatatatttacatatatatatatacctatatatgtaaaaaatatatatatgtatttccctcatcttttagaacacaacaagagtatttatctcaacttcccaatagttaaacttggccttgtgactgagttctagacaaaggcaggtgagaagtcccatgtgccacatcccatcctatcttgatttatgaaaccttctttgcaggctgcttatttttttcccgcagaaagttgtctggggtaacaaatcctctgagcgagcttggaagccatgtgttgcagatcattcccctggccccaaggtcctgttgacttaaaatccacccacacagagatacatgaaaaataataaacactgaacaattacacgtgaagatatatatgtttccattgcctacatactcatctaataatttaatgtgaatggagaagcaggattaatcagcctctttgaataaaacctgaaaccctaaaaatggaaaataaaacagaataaaaaataaaaggtgggaatagggagaggaaataatagagaggtagctaaataaaactgctttaaaataaacatcctcacaaagataagaaaatataattttaaaaaagcaaatgacttagaggataagaatgagatcttgagagaaaaatattaagacccacaaacaaaaataacaataacaacaaaaatactcaaaatactcctagaccaattatctttcaatcctaacacagcacctgaactgcttttcatgtttactaataacctccatttttgaaaccagtaattatttatcagttcctgtctttttggaatcattaatggtatttgaaacaattgatccttataagggcccagagctcttcttttcttaaaataaaagaaatatgaggtagtactcagcaatcaagtagtccagataggtcaaatcttccattgaatttagcaagtcattggtgacaacaggtatggggcatctcagaaaaatagcaaaggtggaagcaagattgcagtagagagagtggaattgcattaataattcactcaatgggtcactgagtttgaagttgaattcaaactggagaatctaatcctttatagaatcacagtcccttagaaaccttgacctcttcttttcttaaaatttaaggtccacagaccttttcttttcttaaaatttatatccagcccaacttctcttctaagctctaaacttgcagggttatctaatttgtatgcattatactcatctcaaacgtaacatgtttaaaaatgagatcttaatttgcctttctaagctcatgctaatcttcccatctcagtgacaattttaaaaatcctgaagtcatccaatctctctctctacttcatatctcacatttaagccatcaatacattatggtgattctatctttaaaatgtattcagaatcaaaaccacttctgaccaccgcactgctaataccttaggctgagccaccatttctttgtgcctaaattattgcttgggctccttaatttctcatttctgctctcatctacctgttgactatttccacagagcagggagagtagcacctttacaatgtgcattaggaagacttctgatttcattaagaagcccctcttgttacaacacaaaagccctgtacacaacacaattaatgagcatagaatgaccctgagaagtagaaagaacaaggtgaactggctagagacctaagggccaacaacaacatggcagtgagccctctgggtttccttattctggcccataatctggggcagggctccaaaatggactggaatatagatgcaggtccaaaaagctccaagaaaaatatctttactctaaacaaaggaccagaaaaatggtggtctaaaaacagaaaaagttttgggaaatacttgcctactccagccaaataccaaggacaaaaattgcaccatctctaccccactagtgacttcagcaatgtcaagtagggagcagatttttcacaaatgacaaccttgcttctgagaaagcaggtagctgccactaaattcatctactcaaggagctgtgatgaatggttttgtgtgtcaacttgactgggcgataagatacccgaatacttggttaaacattattctgggtgtgcctgtaaaggtgtttctgaatgacattaacatttgaattggtaaactgagtaaagcagactgacaacccaagtgtggatgcgctttatctaaaccactgaagtcccgaacagaacaaaagttgctctccctacctgtcttcaagctgggacgtgagtcctttaccatcagacttgaactcagactggatcaataccatcagtattcctggatctccagcttgctgactgcagatctagggacttctcattctctgtgattacttgggacaatttcttgtctatctatctacagatagacagacaaataggtaacctatttgtcacctatctaatttcctattcattctgtatctccagagaaccctgacaaatacagtaatatagccaggttgagcactggcagggtgggatcttatatctcattcactaccagaaagaaggaaatgtactgagtcccccattcccaactcctacccatatcatgctgttagcagagtcctccacctggaccaccaggtgagctaggtgagcctctattcctacccagtaccaagctgacttaattaaggaggcaatatgaggatgatcttgtcaattgtaggctccactccactactccatgtcaccaccagcacccaatatcagtaggctcaggggaactgaaccttcatccccacctgggcatcaatgagattgaaactgtgttgcaagtctaggctagttagcactgcgctttatccccacccttggtgtcagggatattgagtagctgagcctccacacccattctgcagcaaaaaagtattgcaagtcaattctctattttcaatatctctggtggctctgggatacaggagggaagctgagattttatacacccacccagaggcaatgaggcagtataagtctgggtcttaaaactgctgaaaggaggactgccattctgaaaaatcatggaatttagtggccagcatttttgaagacttagaaaaatttatttttctaagtcaatttatctattgactatcatgatctgtggaatgtctcaaaaaaatttaaagatacaggttcagcaaagtaagctgaaaaaggcatgaattaatgatagaaaaataaaaaattagaaaagaatcacaatctatttttgcatattgtagtaaagtagccataatttatatatgtatatatatgcttatatatacatatatacacacatatatatacatatataaacatatatatacatatatatacacttgtgtatatatatgtaaaactgtgcttagaacttggggtaggataaaaaatgagctgatggtataaaataaccaaatgttaaatagcgtaataggaagaaaacaatatcttgaatcagtaaatcaaaagataacatcataatcatgttatttaaaaatatgtgaataaataaaataagaaacatcacaaaaaagggtttacaaagttgtataggaaaacttgactaaggggcaggaatgtgttcttttttttttcattatactcacaatttaatgttcttttttgaaaacaatgcacagctatttctttgattaaaataatcatgaattctaagaaactgctttgagatatatatatatttcctttaagatatatatttctttcctttaagatatatataagatatatatatatcttatatatatcttaaaggaaatataatctacatcaaaatggcaactatttactaaacatgcattttattacataaacacacagcaatgctctttgctttggcattttctcaattacacaatatcttccattcaagttaccatctcctaaaaagttatttgagaaaatcttatttctcacaatgaaaccttattatctgaagctcagctgaatattgttctatccttagccctaatttacaaatacaaaataataattaatataatgtatgctattgaaagctcagtatatcctgagtggaaatttttcaataaaccttataaatatgcctgaaatgtttgctgtcatttttttgaaaaatattagcacaccaatgcaactatagctaatgttccaaatggagtattttatttcatgcttaccgtatcagatggaatgtaaggttaacagactttcaacacctcttaaatgaagggcttcatgcacacacattcagaagtaaaattaatcagaggggcaaaatctgtacctacctggtagaggttaaatggatggcatatttaaaatcaccattcatagctcctggcacacagtagactctaaatattttttccttctatcatttataagataaattcaacaacacatcaaagaaagtaggaaaataaacattcaaaccaaactcttgcattcattcctagattgctttttttaaaacatagtcaaacagtagtaataacaaatttagtaaaaagttctgaattgtaaaattcaaaaattgtttaagttcaaatttttaacataaaattgaaaatcaaaatttgagtactttactttctggcaaatctctttatttatcataatctgccttatagctagggatagccttagtactttcatattatacattttcacttacaaaccatacacattctttatgatgatatttctcccatcttttcttgaaattcagaaaaagaagtatatgtgtgtctcatttaaaattctccacacttcttagttttatactttttttctaacttaatggtccacttttccttgtccttggtcgatcttcactcatcttactataaacattcacttactttttaaaaattcctaccgcctctctcttccaaaaccagtccttatattaagtaattaaataaaaatgaccaagtcaccaccaggacaaaataaatgtccattctcaaaactattacttcagttggccttaagaaagtaggatggacagtagggagatatcttttctagtaattctgcaaatcaataccaccattctctgcaaagcagacaggaggaaattgattgtttcattgcaatgtttcatattaaaaaaccaaaacatcatttcagcttttccatactctatggaaactaatattcagagcaaatatgtattctttcatcaaatatttattgagtacttaccaaattttggacactgagctagttagtggaattactaaaatacaacgtgcaaggccacaaatgaaatatgctttttcatttaattgagagcaagactatgagatagaaaataatacctgagttttccaggtgatgcaactatagcttatcaatattaaattactcactatattctgtgcagaataagggttgaaacaaggatttaacttgacctctgatgccttgacctctgatgacaatgcttttgctttcaagaattatacctaaataattatgttgatgtcaaggatgatgatgatgataagtatcaatctccatttactgaaatataccttggtttcaggtcctgtgcttgcatgctttatgtatgtgaattacatccttttatcaccctttacagagagaaaccaaggctcagagaagttaaacaacttgatccttgctggtaagggagtggaatagaattaaagctcaattccatctggttctgtattcttttctttaccatcaattctctatagcaacagttattgaaacttgaagacccatctcacagcctctctcttacatacacacatttaatttcattctccatgcttggatcacaggctctcttctctgtctttctacattatctatctatctatctatctatctatctatctatctatctatctatctatgtatctatgtatctatctatctatctatctatctatctatctatctatcatcatcatctaggtatctatatctatatatcaaccttcctattatctgtatgtatgcctgtctcagtctccctttctgtctctatctctcagactttctgtctctatatccctttccctatctctttacatttttttgtttcattttgattattatttgtctttctggcaatctgtctatttctgtctttcttgaccctgtgttttcccggcctgtctgtcactctgcttctacctttctgtctcaacctatctccacttctctctctttctgttcttttctaagtgtatatctcagtttctctttctgttccctttctctttttcttatatttgactgtctctaacttttattatgtttttccctgtgagtctctctcattttctttgtgtgactatccctgtatctctctttgagtttgtatctctgtgaatatctttctgtgacttatctgtgtctgtctctgtctctcggacagagatgtaagattctaaagtaataaaaacctctcatccagttttaatgacccttttctggattccagtgatgtgctgcaaagttgaagaaataagtcccttaaatgataaagcaaaaagaaaagtcactgtccttggataaacaatttgcatttccataaggattcagtgatgcagaatcagaaaaggctcattctgacacctccatgaaaacaacagggagagcattcattagctgggcttccttttgaatgatgcacttcattgcacacaccgctgtcctcccccggtcaggaaacagtgcttaattctatcggaagtttgccctttcactaggcatgagaatgaatgacttttcaaagtaataggaactacacatctgccatggcctgagaatgcttacactctaaaagccatacagaaagttacacctcctatcaatttcttatccatcaaggaacacaataaacaagctttgaacttttccatttaccaacttgaaggaaagaaatgcttcattttctttagttttttgaaataatgactgcttttgcctcttacatttatagcttcaatagccatgatctaattttaagggtgaatgcaacctttaaacaaggtttatgatataaaaggaaatttgtccattacagtgctcagaaacttttactctttaggtgaaaattattttgttgctgttattgttgaaacacacacacacacacacacacacacacacacacacacacacacgatcatcttaggaagtaattggacaagattaaaacaattaattgtatttaaaattatttagcaatttacaggtttcttattcattttgctggcttcatttataagttatgtattttaaatgtggacactgaggaacaaatgtttagagggtgtgctgaggttctcaaggaaaataattgttgtccttcggacagaatatgatgtttctatgctccttatattaataaatagcacacatgtgtatgtgtgggcagggggggagcggggtgtgtccatcttactcagcgtgactgacttttaggctgagattaagtcatactcgtctacatattcttccaagtctctcacttcagtttatacaccacagttgaaaattgtattttaaggtcaagctagtcgctctcacattcaaaactacctcccatcctgcccctgccatccatacatgcaacgaattaacatgtgcatttggaatttctgggtgtattctcggttcttgtcaccatttcaacctaagtgcttccagtattcaatttaaataaacgttacagtttctgggtgatttacacctctggaatttctatggcgactctatcaagagaaaataatctggccataaattactcacattagctttttttttttcctcactcaaaattgactatgagcactaatgagtcaccacacttccttccaatacccttggatgcaactcagtcatatttgagtctgaaactaataaatgaagccccacaggtcactgttagttttgaatccacattctctcatgctatagtgttaacgacaacaacaaaatcccattacaaaagaaaatatatcaaacctcaaacaaagttttagttgagagtaacaaaaatagtttttggatgccatccctgacaagtaaaacaatcttttcaatattataattgtatagtcttattttgcatgtgaaaaccacagatacatagaatgacaaaatgattctagttcacaagtggtcccgatactaagaactcttttaaaaaatggaaaaatacaaacaaaatgactatgaccaaaacccactcttaaaatagagtctgaagtaaaattaaacttttagataataaatatgatcattttatgaagtagtgtggtctctttgtttagattattatttctgctaacttttccttgtgttcaaatcctgagtgaaacttaaaaccatgtatttctcccagcattagggctacaataaaatgtaaatgtatatggggggcttctgtgttaggaagaagttaatataacagctcgtttatgaaaagctattgttttacaccatttaagtaggaaaaaaagttcctacagtctgaaattgtatctgcacatttacagaaagggggagtacactcatctacccaataaagtagtcacatttatgaaattactttataatttttggttttacattttactattttgagaaggttcataatttgtctaaggagtaaaagtcctcatgataaagtgataacacaaaggaatcattaattcctcaacatgtatttgcttgacgtacgttttgtgatcaaataattatagtgatttcctttgataaaaataataattaccttttgcctttaatttcaaacataagctatgaaccaaatactggagaatttttgcaagtggcataaaaacaatttatgtctgcctatctgctgtgaaagttgtataataaaaagatacaacacataccatgcaaaatttaaatgtgaacaaattaagagcaaagttgtaatggacatttatttttcactgggtttttttaaagcataattattagtgttttttaaaactatagttcagatacttatcaaatattatcagtgggtataccatatttttaaacatttcctagaaaatgaaatgttttatttaaatctttttgtgaataatattcaaaacttcatgccataattttccagagaagttgctgacacttaggtagcacaaactctgacctgttcaggtcacttaatgattatgtttaagggtaatttggggggcaaagttgtagggattcacatttcctgctcagcacataattgcaacagctgaggggttaggaggtcgccactcagtggaattgggcacccattaaatggcacttttatttcataggagaatgagtccacagtcaaggggatcaagttgctgaaacttgaagacacacatgtacagatacattcactcattcacacttagccacaacttaagcaaactaaagaaactaatagtaaaaccaattttctgtgaaaagaaaacaaaaaaacagttcacatgagcatatacaacaaagcttcatacctgctgtgcaaaccacagcaagcattttgcgctcaaaatatgcctcttttacagattatttgtttctctaatgttaagcaacataataacttaagtatttggttactagatttgacaattggctcttttgtgaaagcaaatgagtatgacttggagttaaccttacaggaggccatcatattatactctagttaacaatggctttctgcatacgtgctacaagtccatcaaatcgatggccatctgtgtgtactagagacacagagtatcaacacactgaacctgaaacttgttattcagggcccacccactctatagctaccaaagtatattttttaaagtaaaggccacatcacaaagtgggaaagctgttaatactatctagcattaattctgtattagaaggatacagttgacctagattcaaattctaaatggttaatgcttccagatacgcacaaaggaagtaaatattctaataaactaaaacatccacagtaaaaatatcagtatactcacaaaagacaaaaaatactgttcattgtgaggcagaattagctactttaactcaactgccaactataacctccagcaacaaccactcataaaacaaatcatcaatatttgcacacagaaaaacaaaaagtcaattctgatgccatttttctgtattttttcaggttggaggaagtagaagaagtggttgaggactaaaaattcttttaaataacaaaccagagttataattcaaaagcttgtgtctttgtaaagattacattgtcatctaaacaaaattacaataccagacagtaatcaggaagaatgaaaggacaggcagttgtgttcactcttccagcaaataatcacttgcaatcattactactctattctttcaacaagcatgacagaaagtagcatcatgacagagatcattgtactgaaagaacatcttaactttctctgtggttcactgctgccttaaatttgaaaaaaataagagaagggcgggggaagaacttacttgcggtttaaagtttcatctttagtccatgtaagattatgcagcaagttttcttgccaaggctgcctcttgcacatccctttaaaaagaaccagtgctcataatctagttccaagacgattcattcacatgttccacctcttgtttctgtgaggcattgatatccactctcatatcatcaagaaaatgttactaggaaaatttttagaaaagcaaaacagttcaacatgttaactcagaaagcataccatcattctccacgttctgagatgtatgccacctgccttagttaccacaagcaactaacactaagctgctagcaggaatctgtctgccctctatctgtcgctattagctcagcacgttg

SEQ ID NO: 932 - DNA, 992600 bp, Homo sapiens; identical to SEQ ID NO: 931

SEQ ID NO: 933 - DNA, 998519 bp, Homo sapiens
ttcaaatgaaaatttatttttgaaacattgtgtagtgaataacaatgcattttaacttaaaacttctaattcagattcttatacagtaacataatatttgttaaggaagaacaggtatttggataaagaaattgggaaagcagtgaaggtgttgatagatttttcaaactatagacaatgttcgaatcttccatacatgtgcttaactgaccataaatttaaagtagattgcaatgaaaaaaataccagtctataactaaagcttcttatgataaagatcaaaattaactattgaaaaccaataaaaaaaatagaacaaaaatttcacataccatttgggaatagaaagaaactatctataaaatgtgtaagtcctcaacattattttgaacctatccttcagccttatcgctgtgtaatttgcaggcaccaataggcatctgccctgagaatagattattagcactttttgcctattttgctaattaaattcaagtggtatataaatcccacttaaggtataaagtgcagaaggtgaagcagagaaagagaaaaatcaaagctcatgaaataaaagacagaaaatgtcttccctcgagagtcaatattcaattacttctggctctatgatataaaaatgtttttaaataatattttaatggtaactactgaatcacctttggaacaaccacttaagtaaataatagtctttaacatccctgtgaacaatgtggtaaaataacatgaatgacatatcacatataaaattcaaggcaaactttcttctgtattttaaaaagatggttttggccaacctacggttgcaattctatgacaactctcagagtctgtaattaatgagaaagacaaattgagagagggagattaacacctgtgattcgatggtcattaagtcacaaatgtcctatgtcactctgaccatattttctcattcttcctctgctttcccttaatgcccacaagaccttctaaaatcaacgggttgcaatattagtcattacatcattctgttctcacctcgattagccaagacctgctgtttcttctgcctgattgaagctagtgctgattgagaacaacaagaaaaccttcctacaccttcctaggaaaaataacaaccaatttctttataaatatttacattgaaacgttatttatatgaagtattcttaagattaaacatacctgggtatttcctctgggttccacagttttaatcctgagtcagggatttatagactagtgaaagttctatgaaagtaactatttaattgatccagatttatttagttagtaataattttgctgctctacgttacccaaaaatatactgaccaaatatttggtttggttgctctgtgtaaattctgcttctctttatactatctccattaagtaacagatgattgacctcatgattgtttttactgaaatgatcaagtttaaattactgaaatgtgtctgctaagtggcttgtaaaattttgcatattttctcataaaaaatgtagtttaaaatacagtgacatctcatatgtcaggccactagacttctgccaacatcatatttccaaatctactggtaaccaaagaaagcgtctaagagtcgcaaaacatttggttgaatccgtgtacctaattcccatcttaagcttcatgatttttcaacattaagaaaacaaacaaaaaacacaaactttcccatcaggatactagaagctataaactgaaagaaaaaaatgtgagaaaggcacaacaacagaataagttaaatgtcacagccagaaatcaaaggacaaaaacgcagccatgaagctgtatatagagagaatatcaagggatgctgactgagatgatctgggggtatcaagataatattaaattatattcgatgacctctgattgaattagtagggaaatatatgcttaatctaattcctatacaaagtatcctatactaaaaaccattgctttggtgcctgaaggaataagccccggacttcattgcttccaaaatttaatgtgcatataaaccaccttaggatcttttgaaaatgtggatgcttgtttggcaggccaggaggtgtggtcatgattctacgtttctaatctagctaatgccactaggtttttttttgtttgtttgttttgttttgtttttttggcaagggtatggaatgcattaattctcaataaaataaggtagatgagatgttactgtatttgatctcaaatattttcttggaaatctgaagtaaaaacatactactcttacaagtcggcaagtttatgtcagtacaattcattcactttggaaatgaggaaatagcataataataaacaatttttaagacgcgaaacatgtaagaggggaataaataatagtgcattattcagtccttcaaccatatattaagcatgcatgaggaaatttcattaaaacctgaacttggtcaatactgtgcaaaatttgaagtgagctacatctatatcatactaagtaatattcaatagaattctgaattctcttaatctatattgtttcattctttttacatcatctggaaaataagcaacacacaaggcaagttttttaaaggatattctgttttcatttctacttatgatgaaacactgtgctttgttcaatggtaaaaaatcaagaccatgttctttgattttaaaaaatgcccaggcaatgatttcctggttctggattttaggcacataaatatgtgcattaaaatattctataaataacctgaaaatggaagaagttaaacacaacatttgaagttatgaattcatagcctttataagctttatatattatatacatttcaaccctgccaaattcctttactctgatatgctgggtttacaaactattaaagtctagtgacattaatgtgagacttccctaacctcaccatgtcttccattatgaaattgtcgttctagatgcattactgcttactcgaacctttctcacttccctaaaagcttttgctaagggtgagatttccatgttgctccaaacaattatttaacctcaagtgattaaactaaactaaagtatctaccatatttgatatgagatgaagggacaagagaatattgtaaataatattgataaaaagacatacgacttcaagtggtttcctaaagggtcaagatataaatgtatttatggtaaaatgtgaaaacctttatacaggacaataaagaaagaaaacaagctcatgatttaaaataattaattatttacaggtgattccctcatttactttactttgcaattctagctttcattttaaaaattagggcagtatagacagcagctgtataaactcattgcctgtaaatatcctcttacttcttttttgcccttttggctatggaaaataaaattacatgtactaaaaatgttttgtggagctagaaataaagcataatctatgttaatcaataaaatataaatgattatttagtaattatttcttgtttattaaaatgaacaaaaattcaagacccaacaaaacagctaaatgtttaaacgataggttatttagtgaaagtatgtccaaaaggattttctgggaaaaacgattaattgataacaatgtgagtgcaaatctgtctcttaaaattttaaagcatattgttcaaagttttagcttgtgtgcatgatataaattccatacattgttttctcagtgacaataaaaagcacagtttattaaaaatgtaagtaaaaattaattaaaatatcttttaaaaaattggtcacagttttgtcattggtatatggaggttgttccaggggcccatccaaagctcttcatcatcagactgtgtgtggtcactatgaaattccaaagcctccttgatgttcttactgtcaatcatggactcctgttcaactgtgcttttcagcctgttccttagtggcttcaccgctgtattgtcagtccccacagggcaaggggcaaatgtaaccagagttggtcttgcattcattttttcagtagaaaatggcccctttgataatgtgttcagaggtacattctcctcatgtgtcactgccaacttgtctagtttcttaaagggccctcccagtcgaacaggggaagcaacttttaagttgtccgtgaggcaggcacggcgggttctcaccacagaaccattctgtgcaatatatatattgccgttgatattactgtggatactaggatggtgaagacggtttctctgacattcaggagcactgtcttctccagttgagctggtttcatactctcgatcaacaactaacttgatcattctttttcttgcccactgataaaataaacaaaaatatgtgagtcactatcaaataaattaaaaaggcaatgattacattgcctgtgaaatccaaaacaatgacatttagaaagctgtcaaaggtaaatcactcaagagagatagaaggaagccagtctttattaacatacatttcctttcatcaatcctttattggctttagatctttcttattaatgtttgaaaaatgtattgttgagttggaaagcagacatttcaggaaacacatgtattcttttagatcaaattactgatccacatggaaaaaaatgtattacttttatttaaggagctgatccactatttgacagctgctctactattcaggaaagttaaattgaaaggaatgaacagctttagtatattctgttcatattaacgcttctattcccaatatttaaaaaatatttttaaaccacatcattctaatttttaatgtattctctagttagcgaaaacttttgtataatttaatgcattttgtataatttaagcatttatttacttgactttacttatttacttgatgtataatttaatgcatttatttacttgacatatcctggttttctgggttgtcccatttagatatactaacttaaaaggaaatatcttctcagcctgcatcatttacctagtaatacacaaaactgaaagctaattattatactaaactttccttttgtaagcaactggacattttcacaaattcatttgacttttaccaatcaacattaaaaatagcaagaagcaagggttaagcaatactgtgtttttctcaaaatagtatcgcatttttggaatatgtgaactatcaacacattgcatgcattctcattttcagaactatatttcaaaattatagtttatttacctagaaaaaattttatgcctgttacatttatttttaaatccactgtagctaataataacagaaaataagctgtaataacttttaattaattgaaaaatgttatttcattgaattcctaatacttgaagttgcagatacaaacttacttatttgaacatgttcatgatagtttttataatacctttgccagttgaaacgtacatatatgcaaaagtagacgactgttaaagatataatttgttgaagcttgtcttagtatttattttgaaagatgatataaaaacatatatagtgtgtgtgtgtatatatatatatatatatatatgccatccattccaatagacagagtgtcactgataatacataatgccacattgcattaacaaaaatcctaccagtaaatattaaatattgattagctgattgcatgtgttctgatttactaatataggaaggattagtcagttttactctaatacagtctaatatacaaatggatttggacaacatatatattcacttttctggcatgcttctgatcataagtcatatcaaaatcttgatcaatttcctccctttcaagtgtcactttggagaacacacagaaggcactgcacacgagagcactcatcacagcaaaacttccacctactgtgatctctttcaaagtgctgtgttgtaaccttcagagtttgctcctggcgacttcttttggtttgcattcttgcttctgtcatacgctggtacctgatagccccatggacctccagactgactttcgctactactgctactactacctgattctgattcctcctcactttccacacctccttccaccgaagctgattctgcactgccctcttcagggatatcttgagcttcagggtctgtactttcttccacaggggctggtccactttcttcttcttctgagtgttcttcttcttccatcttaggttctttttgttcttcttgtggctcctctttcctacccttgacttccttgacctcctcaaccatgggccttcttcttgcaagcacaatgtttttccttgctttttctccttctgactctgtggattccgattcttctgattcaggggtggaactctcctcctcctcagagggtgtctctgactcagattcctcttctgtagtctcagactcactgaactcagactcttcttcactgtattcagtatagtcgctggaggattcctcctctgattctacagtgctttctgttgcttcctcttggtccagagtgagtttcaaataatctttatcttcttcctcaaggcgtctctgccactcttcaccctcaaggtcaacgattcctcttttatcagctaatcctctaactttcttaaaaatcatggggaatattctggctctcttccatgttgtgtatgtaggctcagctgctggtggtttttcgatagttacaactacttcttcctcctcactaggctctctaatttcaacctttggttttttaattttctttggctcttcctgaaaattgtgaaaatgcaattgaagtgtcagcttggagatagctatggtatgaccttgtcccacgaaagctacgcaggaatgaatctgtgggtgatagcttcatgcatgttatataactggcttaagaaaataatcacaaaaatttctactgcatatagacagaaggtgattaagagaaagtaaattattttattttagcttgtactttacaatacccaaatatattaatttccttcttgttactcaacgtttaattttcctcttagatcaaataaaaaagaaagaattattgtctcttccttccttccttcttctgtcactagacttaggttaatagctttctgtattcccttgaactaaattttcaagaattttcaataatcacgaaaatatgacgatttatctcattttatgagaaatctattttatgaaattttgcacatgttaaagccacagtgacatttatttcttgttagtgttgtttttgtataaatttgccaagtaaatagtgaagacaaagtataagaattttatagaaatgagtcatgctaatttaaacataaattacattattccttgaaaattatttgtggaaataatttacttttctctgataattgaaaggtggagactatattttttcatgacttttagttttgctagataatgtgggagcaaaagtaacctttgtattgcagaactttaaaatatatttgcttataatatctttatggagcaagatttagaattttagaaaacataattttcattgtgccctttccaaatgtttaacacttttagaaggaaataaattaaatgatcaagaattaattttcctccaaagacaaggcaatgaaacggtcagcactgtgaaatttctatgggaaatacgtactaagtgaaaggaatttctaaaagctgaaatgttctacagccgctagtcacgtagggttaaacaatatttttcttggaatattatcttacataataaaattacagtaattacctcttcctcctcatattcttcctcagcttcaccaaccacctcaccatattcctcctgtccagctggtggtaacaatcgacggcgactcccatattgaggcatttcatacctgtaatataaacttacatctttaaacagtttgtcatgtgatttctgtagaatctaccatgagtgatctgtttccttctttttcttccgccattcaatcgacagatatttacacagcacctatcaggctccttgtaaactagttacaaaactatagagtaagaactgctacctgatgaccagtgatttttgccataatggtaccctggaataacaataaagagagttgagttatttcagatactcgtttttggagaaactagaacgagaaaaaagccatattgtgtcttaactagctgaagaatccagaacacaaaatagatactttggaacagtgtaatggctcattcaccacattaaatctgtatgttggtagcaagaagttgcttcaaacatggtctgtaatggttttcacaatttcttcagtattttttttgaaagtggttaatttatatgtgtacaagtgacttttgagacacttatcagtggattctaaggtgtgttttctgtttcctaactgctcttgggcaaaactttaaactgattagataaaacattaacatcttatatgaaagaaatggtgaatttaggaattgagcaaatatgtttcacatctatttcccatataaataattttgaataattttaccgcatttctagaattgcaatcgatatcaatgtaaaatatcaatatggaactcaatatagaaaaatggttaaaacttggttaaaaataaagctagatatactattcattttcaagtattatactagtgagatcgacatgacattaaaaacaaattctagtaataataatcatttaataatttcctattaataaaatattaaaataagaatctgaattttaaaaatctgaagatgtacccatgctcataactgtaataatcttgtccatattcctggccaggatcaattccagactccatggataattcctattgttcaaaaagaaaaattgcatttgaaaacgaattcttatcacgtttcaggtcaaagtcagatttctacacctagaattccatgattctcaaaacattcctgccaaaataactttaaatacaagtgtcagttaaagcaattaaaattactctatttaaaagtgttagtcaaatctattcatttttttctggctgtaaccatttgatacaaaataaggttatataatttgacctgaagaggaaaaagtaatttttttctaatggcaaacctgttaaaacttgcagatgagcattttcacttgtttttggatgtcttttaaaattatcaatcaatagttaatatttaactcaattttaagttaaattattaagtgatgttggccttaagaaaaattataacactatctacagcattttttttcatctccccactaacagttttctagtacccagtattcttctattcattgaaactgttctgataaagtcatctgagaacaagaatttaagttaatgtgtaatgcttcccaaggatgtttatactttaaaacatactgctgattctaaatttaagggttttttgtttgtctgttttgtttttttgagacggagtctcgctgagtcgcccaggctggagtgcagtggcgtgatcttggctcactacaggctctgcctccagggttcatgccattctcctgcctcagcctcccgagtagctggggctacaggcgcccgccaccacgcccgtctaaatttttgtatttttttttttggtagagacggggtttcaccatgttagccaggatgttcttgatctcctgacctcgtgatcagccccaatcggcctcccaaagtgctgggattacaggcgtgagccactgtgcctggcctctaaatttaaggtttttaaaggaaaaaaagaatttgttagaatagaggtccttttaatatttccagttctaaactctaaacatactgattgatttctgtcaaactctacttatagaaagatgtttttcttgagatatacatgtgaaaacggtttctgataactatcaaatgcaatttctctacatttcccttttaaattctactttaacatgttaagcaggttaaatgacaaaggttaaccaaattcatttcgcaatggaatacgagaagagaggggggaaaaggataggtactcacatgaaaatagattggtacatatttctatcatctattatttataaaaatttaattttgttgatccaggaatagtaatgagtcaggaaataaaaagccctcctctgagggcacaaatatgtcatttgcgaagtgtggaaatttacagcctgcatgattgatatggataaagaccctcagttgtgcttggtgtggccaacatcattttaaaaaattgaattcattactaacagtgctaatcagaaaatgacaccaacactgtggatgttggtttctcttgaaaaataaaaagatggaaacactaggatcatatttttacattccaataatctagttggctagattaatttttacagcaagcatgtcctctcctgtttatgacagtatccccaacgacacttttctacattcataccctagtcactatgaaatctgtcatctgctattgctttgtgtctaataaactccattcacttacattactaccctagatcctgtaggtattgacgcttgcattacttcttctatcttataattttgccgtttacaaatactttgtgaacctactctaaaggaatccaattttgatgttaaaactagtatagtttattcaccagaataactaatatttagacaaacccacgatgaacaatactatgtatttgcagggacacagaagagctaaaactctcatctaagtctggagagattattacttggtaaaactttttagaatatgtttggcaatagtactaaattaaatataaccatttcttctttcacagaacttaaatttgtagttaaatacccaacagaaacatgtacacttgtgagaaaacacattattcgtaacagtcccaaattggaaacaatgcaaaagtccatgagataaacacgctaccacatcgcacaacaacataaatgaatctcccaaacagaatgttgagcaatataggtcaggtaccaacgaaatatattatatcattctatttatataaatttcaagaactgactaaagaatatgttacaggccagaaggaaaactgatatctaggtgttgacatagaagagcttgaggggcatgtgcactctgtaaaaattcatctagttatacagtatggtttatacttttcttatgggcgtaggttttatttcaacaaaaatatatttattataggaaggttgaagtgtgggggaaggaatgaggttaagaaagacctggaagaaactgagacaaaaagtctagatttaagttatttcaaactaagtactttgtaaaaacgtttcctggaggtaagctaagaattttagggtatgtaaaactcagtgtaatgacactggtttaaatgaagcaaataggtctcagaactaatattttcaaactgcttgaccaatgcacgtttaattaaatacatacagatactgagaaaataacttcaaacagttttgaagtagacttttaacaacattaggtaatagtaagaaacacgaaataaaaatttcaagtaaatatttatggagaaataatgcaactgagtggattttggattttagaagtcagcatcaaagaattttctttacataaatactttttcttcattaagggaaaataacgctcagctcttgctagctacaatgcatatggcatcaattgcattaaaaatgtaataagaagtatagaagggatgcggataggaacccaggaaactcagcaagatagcccttgattcaatcagtcactctgtatttctgagttgagtaaagagggataggaactagcagaaggaaatgatctaaaaggtccctcttggatgcttccaccacccatgaatgaagagcagagccatcagtcgttaaaaaaaaatttgaggaaagagcccgggtgcggtggctcacgcctgtactcccagcactttgggaggccgaggtgggcggatcacaaggtcgagagacagagaccatcctggccaatatggtgaaaccccgtctctactaaaaatacaaaaattagctgggcatggtggcacacgcctgtaatcccagctactcgggaggctgaggcaggagaatcgcttgaacccaggaggtggaggttgcagtaagccaagattatgccactgcactccagcctggcgatggaacaagaatctgtctcaaaaaaaaaaaaaaaaaaatcgagtaaggaactgctgaccagtcagatccatgagtcaacctcaaccaacaagggaatgctggccctttttgttgttccacacagtcccagtagactgtaacaaccccttagttgatgaattctagattttagaaaagtatgcaaagtaacacactagtgattttcttgggtagatcaaacacttaatgtaatttttaatattcatttttgctgtccacacagggaaaacatagaattaacttaatatttaattattataaacatttatactgatgcaaaacaaaaacaacaacaataattgtaatttactgaatttcttcctgttacattccagttgttgagctaggaacttacacatttattagatattactgctaacattttatagaagatgaaattgatgttcagcagatgtgtatcttgactaaggtcttgcataaagtcattggtgtttggatttcaaccctgagttttccaattcaaattttatggagccctctccatggaaatttttgctaaaaccttataaaagtttaatattcctgccacacaacctccagattttggagagtagattctaaccaagaaatgcctctttttagcaaagacagaattctgtactcaaggaaaaggaataaaatttttgtaagtggagcttatgaaatactaaatttgccgtaaaattaaaagtaggatgtctgtgtttttatttttaattacatatataaacataataagtaaatacaataatatatatttattatacaaaaaatatctttttcacattgcagaagaaaatgccataggcaattggtaatatatgtgtccaaaagaagtattttgaatcacataaaatgatatttaagtacagatatcagcattctgtctttaaactttgcataatctaaatctgatgtcaggaatggatagatgaattcagattgattaagacaagtaactgctgatcgggttcattaattgcttcattcaatgaatggcccgtatttattaggaataatgggcttgtctcattcccagagaatgaggctaaaaatttggaagttgagctaccagcaacttcaggaggtgatttcttggtttcttttttttgaagttattttgaaagactcttttcttttcctttaaaattatgccacattggcagacacccactctgcctacaagaattaatacaatagatcttaaagtcacagtgaaggctcagtgaggttgaaaagaaaatgaaaattgatacctctggtttaagaagagagggcctcagcagttgctgttgctgtcaaaggaaattaaaatagaaaaagatttagaaaataattcagatgggaaaggtagatcatgattgagaagagaggaaaaaaaggcgacagtttaaaacgtgtttccttgggattattcattattcatgtgttagctaccaaaagcattaaatattttaactaattctttatattggaacataaaataagaattcatttgttatgttttaatttcatcattcttctagttaatgacaaatttaatagccttaataaacaggaatctatacagatttttgttttgttaagctccacagtacaaagagttatttatgtttctaaaagtactgtgtgtcatataattacttttatcaagtttaaccttgttttaagttgcccttctttttttccttcccaatcacattaaatgtgataagattcattgggaagaagagcagaacacacaaaacgataaagttgtaatgtatctatcaacatattgaagacatgctctccatttcttcttcttaccaaagtgtggatttcttgcactaaaacattaagtgtgttttcagaatgattaggaaagtcattaattatcagatttggtaggaattgcttcctgcctcttccttctttcacttgtatttatttaaagctaatacagtcaccattgatctgtttcataataatacacactttaaccagataaaaacaagatacacaattcaaattttggggttagtaactctttggagggaaaacagcatattaaactaagtattggaaaagtgggtagtgaggttctgggaggtaattccatcattgaacccactgtttaaactggctagtagaacaaccatttgactgaagggatatcctttttataatacagttgttggtgagttagttattttacttataatgaattctaaactacaatccaattaggtcgtatacttctcttgattgagaagctgtatgctaaatcaaactaggttcgcagtgacttcattggtaacatcacctgcagtacagctggccaaatactactggccagaatgcccagtaagttctctgcagacagaatcaaatgaacacagtagaaaacccagagctttctaacattctgattatttttaaaatctttaggatctcaagctttaacctagtgataggatggcgccttgaactggtaaaaagatcaaaagttaagtagtcctatatatatattctttgttttttttttctttttcttttttttttcttttttttttttttgagacagagtctcacttttgcccaggctggagtgcagtggcctgatcttggctcactgcaatctccgccttgccggttcaagcaattctcctgtctcagcctcccaagtagctgggactacaggcagtaatcctagtttctaaattatatgtatagccttagacaaataaattttggggaaatgtcagaatactgagtaatagtaatgcagaacaaaatacatgtatccttaaaaaggtaagcaagtgatctttgaccattgaataagagatttaaaaccttaaaacagggaagcaacatatataaaagaaaataaatagcataacatactaatatgtttttgctgaaatcaaagaaaataaactagttcaaaagaatgtacattagtcttgcctattacacaagtattttcctagtatgcttgttacgacatcaacaccataaagcccttacctctgatccataacctctcctgcaaggcagaaataaataaatcagtattaaacatcttagattttcgttattaaacaaaatgactgacagataagggctttaaaaaatgtctgagtaaaactgagaagacaatttctactaaacactatctcagtgggaagtatattttgtggaattatcaaaacaggaagatcatggtttcacacctgaattactaaaataatgatcaacccagagcctcgttccatatgagcaacaaaacatgcaaaatctattttatttcaatagtgtataatgacaaactttgactctattattatcaatcaatttggataaaaaatattatacatgatctctgttatacacaagtcttgatatatatactaatccttaggggaagagatatgctttatacatgaagaatgtaataaacataggatgaaaattatgtctatgattgaatatattcttccaaatgattgtatgatattttctttatgttaattctaaaaataatacaaactattggctgtccttgcagggtcaattataatattagaaattaagtgaagaagtttttagagctttaatagccaaatattcaatattacataaagatttataaagttcacacatcacaagatggtgaaacgtttgactatacttgagggggagaaaagaatatagagttttcaaagttgaatgttactaataaataatgaaaatgttctatgtgttattttttaagcagttaaagtgttaaactgatgctgtcaaccatgttatgtagaattaatcaatcagtgtaatgaagaattattacaaagaggcacatattacaaagaggcacatgcataactttctaaaatccaacaaaagaatctctgtagaaaaatttttaaaaaatgttgaggccttcacaaagtaattctacttatcagaaagcatcttgtatggtttatgcattgtatattgaaactgtttgtaaaaaaaagtaaatacaatgcttacttaagcttctcaattgattctttaaaatggttctgcagtgaatttcgtagagtgcttacacggttctgccaatatttataagactgataattcttccagagcctttagaaattgtagacattttcaacttttaccaaatttatatttttcagaaataattcaggtagggaaagctcatatttaggtttaaacaatgacaactgagtcatataccttataaaatatccaaccaaagccaggctttattttttagacgatttcttctgactccttttattagcaatgttttccatcaatgtgaaaaataaaatatcaatagataaactataactcaatgttaatgtttccattcacatttttgttgccttttatttggttatttgtattgcttgtcttggctcaaaggcagaaagttacttgaaagaggtacataacagaactactactttacctgtgtgctttcaaaacatgactattgatacttataaagccagttcatataatatcgatgcacctctttatgcaattcataatcaattgtattatttattttatatcatgtatatgtatcactgtttacttttaacaataaggacaaatgtttggtcatctttcttaagtctttatttaaaaggtatctaataatttcttatgcattaatgagatcataataaatattgagaaaaaagtgttacttttctcctctctggttgtcaggttgtaagcagttagggtttgagaggaggaagaatatttaggcttgtgtactcaaataatactaaaaggtctcatatagaagatattttaactgacttttataatgtatcataatgacattaggaatctccaaatacaatgtgtcagaaaaagactggcttaaatataaaacacaggtatctatgtttcaattaaaaagtacagaataataacaaaactttcagattatgtaaatagtaaaatgttatagaaaaaggcaatataacaatttaatagggctgtaggtacctacacaaatatgttttttggacttctcttatttcttttgttactatttatagatttatcaagaaattataaattttacatttgcaaaaagctggtgtagatattagcttagaaaagacacactcacattaaaggcttacacaattgtgaataccttgtcagagtccgccaaatagcacaagttctcatgcatatgaccagctgccaacaaaaactccaactgaagtttttcagtgaaagaaagaaaaaaatcacgttcaagaaccccaagaaagtaattactcttgatttcgatgaaaagattttgaagcagatgggctaataaaaataatcagatttacagattgttttctgtctgatcttggtaactaggaatgccaggtcaaattattgaagaaatatgagggatgaagaaaacctctgaaataacgcattgaagggggctctcaacttatattcatatacttccaatagtaattatcaggtatgagttttgcctgtattttagaattgtacccttctccatgcaaacttatatcttctaaaatcttaaaactccagagtgttttataagtatttgttttaaacacttacatgtgcattcaaaatgtgaacttccagtaaataaaacctattccatgtgtttcatgggaaaaacaaagtaattacttgatggtcacatattatacattatatactaatattgaaagtatagtttccttaggaaggaagggacatagatagtatctagcttaagtgatgctgttcgaatttaacaattggagcgctaagaactattactacaactacagaaatctcttcccagagtatacagttttattttctttgtttaaaacaaagagcagaaacctaggtaaaagagtgattgatagttcagcaaatatcacttctcttggtttttctatttaagctttttatatttcatttattaaactgaagatcatactttctttaaaaaggaatcttatgaaaaaatttaaattagggagatgattaataatatgaacaaacaaaattaaacagcactttttaagcatctgttggaacaatgaaatgccttacaaaagtcaacgactcaagatttattttcattataaagaagggaagggaaagcacaatgagaaataaagagaataagacagcaactgaaaaagtataagatttatcaaatccataagcatactactaaatccataagcatactactaagataaaagcaagtcagagtaaaagatgttcttatcagaaaacagatgactacatgttatagcacctgagatttattttgaaataccttatgtctgtcatctcctacaatctaggtacattatattttacttcggtagtatttcttcttaccaaatacataggcttcaagaaaaaacagaacctatcaatcatatcagttttaacttatttgtaacagtctgcttttttcttggaacattcatataaaactacgatcaaaaactaaatgtaaatgttactgcatccacatgatagacatgcctttggtttaagttgggtatctaattttcatgcccacatattcccactaaaaaagagattaaaattacttacttttcaaataaatgtagaacaaattatgctactttgtagtttttaaaaagtaaggtaaatctattatatgagtgagttagtagtgatgaggttaatatctttttaaattaaaaacgagaaaaaaaactgcatttcattgaatttggggtaaaataatagagtcttctttgacgttcaaatttgatgttcaacttgaagactatgatcaacaagaggtttgcccgactaaaataagaaaagcaacattacagtgaagtagattgactgtgagattgtttttcagttccctcgacaatattgttcaaactccccttgttttgttcagatgtgatttccatatttgttacttctgaagggcacatagtttgaagttctgaaacatttgtgcgtagatagtttttttctatttgactgtacatgttagctactgatttttcaagttctgctaagtttttaacgtgtctgaggatgccttttggttctctctgagggtctgttttacacactgtcgttgttgatagctgtgtcatagaggacttaattttctcggcaggcatcaagttggtcgtgcatttaacacctgttatacagacacactctgtggacagaaatgaagctgaaggaggtggagggcaaggaatagaaggaggtggtggaggaagaggagttggaaatggaggtagaagaggtggtgttgggggaccagacgttgaaacggaaagtggaaaaaatgtaggaggaggaagaggaagagggatagaaggaggagagggaggaggacaaaaaagagaaaaaggagaaatgtcaggaggaggagcaagaggagcaggagcaggaggaggagaaggaggagaaataggaggaggagggggaaggggacaggcagaaggagagatgtttggtggatgggcaaaattttcaaaaatatttctttcggtttcaataggtaacatacaaataggtgtctctctcctagagagtgaagaatgtaaaacacaaggccttgaaggagaaagttccaaggaacactcagcaggagaactgatgacattaggttctgatttgagttccacagttcttgaaacagttggcaaagtggagaatgagaagtgaggcctgggaaagcaaaatgaagagtctgaagagagagatttcaactgttctgttccttctatcatcagtgtttcaccttgccttatttcctctttctctgtcaaatttgcctcttcagttgtaagcaatggattgctgctacctcttttgtttgtacagattccagtgttttcattttcagctttctgcctggtgccttgccactgctgcagatctatgatctctggtctatttggaactttcctcatcagcctcctgggtaagctgactgactgactccacagcctctgaatcttttctcttgggcccctcagagacttactcttggcttgtattttgggtgaaaatgggtctacaaaatctgttctctgtgaaatgtctgaatttgttgatacttgacttatgttttccttataaaggggattatgggcacttaagtcatcctcatcagatagaaatgtgaattttcttgcagacttcagtttgttgctcttaagtgatccgtctacatgagctgacttgtgagcctcaatagtattggaagaaaagggcatcacaacttgttgatgtttcctgtcttctgagactgagttatttcccctgctttgttgaaaatggtagagaaggaaaagacttgaaagaaaagaagataatgaaatgtaaggaaacaagttgtgacacagctttcatgagaaagatgtttttatggctctcattactattaaatacttaaaaacatcaaaggccaaacaacactaacctactaaagcaagacattattttaattccctgctcttagaaaggcagggcagaaaaatcttagagttgtgagaagaatgagaaatgtaaatgaaaaaaaaagtactcatctctagattattttggaagagagtattttttgtttttgttttttttcagctagtgtgatacagcaaagcatccatgtccacacgtaacagttcccttatgcacaaatcacagttcttcccattgcagaacaccatccttgcctgaggatgctcagggctgcctgttacgcatagaagattcttagctgtatctgattcagtacttctgtcctagagccaaaagtaatctcctctctgagccatcatgtggaatatcctgttctccaaattaagagaattaaaatcaccaaggacagatgggagtttgtctcacagcccaaaaatcacaattgagaaattgaatgtatgctagaattgtgacagaggagtttttcttctgtttaaattttgtgcttaattagttttaaaaccttatacataataccaatcaggaaaaattgttttaaaaccttataaatagtaccaatcagaaaagatgttgtcagtaatttcttagactgatctggatcaaattttacttaaaactcaccttaacaaaaagattgatgctaaaaaaaaaaatcactttttgatatcactgaaaggcttacttatgcacggaaactgaatcataggtagttgtgagtcataaataaagttgcatacatcaaagatcacaaattaaatggctctaaggaaagcatttggacccttctcccaggattgttggctgattgataggtggttccgaattctcattagcttttactctcaagccaaaacagaataacatttattttagttactgcttaatatttacccacttagcaggaatgaaataaaaaagaaatattctgaatagaaattaactagccatattgaaaaattagggtgatagtttaggcaacaaaataataaagccacagttgttaatgtgtcttttggcaaagatacgaactataagaaagagaaagaaacaattcacacaggtagacctggagcatcaagcctacttggacaacaaagaaaattcagacaatctggactaatcagagtgcaaacaaacacttttactcttcgaatcttgaaaagtatttttcaaatatggcacgaacaactgggattgatattatatactggttgtttttgtaaacaaacatttgttcgtggtttgatttctcttggtaaagcacccaatggatataacaatatcacatcactttgactaaaagaaatctataaataggtttctatttatagatttgtaaattttaagttcttaaaatttaagaatttttaaaaactaatttaaaaaaattaaaaacaaggagaattttgaaattcctttcagtaggcacaggtaccatcacagcgaacacatgttttaagctcatgccatcaaaaggaaattgggtgtggaagacaaaactttccttttaacagtaagtgagtctgtggcaaaagatgaagatcactgtatttacagtacaacagcattttaatctgttctattgtatctatttttctaacgctcttctattagagtgatattatttacttacttatgcctatgtatccacaggtgagaaacagaaaacatgtgatagaaaaaaagaagtttttactagagttaatttaaaacaattctgaaaatatgagcaggaacttgctttaaacaaacacttagtacgtatatcaaaaaaaaggcatgtttttatattttgttattattcatatgaatgacatttaatagtagatgaaatcaaatgacattatttgaatgtcttttcacagaaaattgtatctaataaagtctgtttactatacatagataaaaattcacttctattaaacctggatgatgccaatcctaaaataaaaattttaaatgagagtttaaaaattgcttctatgatgtcttaactctgtaaaactggttaatgcacactgacttttaaagtagatatattttgtttggaagaaagtaaatatacaactactatgatgacaattaattacaaagtaattatagcattcataggaagttatcatacgaagttattactttgtgaagtagtttttccaaaatgatctttgactttgttctttttaagataattgataataatcatttaaaactaattcattttctagtaacttaatgcttagaattcctgtaaaaagttcttgaatagatagataggttaaacatttactaaagataagataattaaatatgtagaacttacttaaactatttcaatgaatacatatattacaattgcaaaatctactgagtctactacaattgttcaagtaaaaataatcttaggtattgctatttgaaaattactgtcatcaaactatgctgattccagatgatgttatagtatacctgttcttattaatttaaaatgaatacataattcattaatttcatatataaacacacaactttacacataatccttttttttagtttctaaagatctttgcttgagagaggtcattaacatactcaaatagaatcaaatcatattggctcaattcctacattcaccaataattaattacaaaagaaacaatcatttttcaacttacaaaaaaggtgaaagcatatatctaaagcatgaaccctgtattatgtccttattttggaaatagaatgtcatgctttaacctattataaattcagattttgtgttaaaataatagcattaagatcaattttaacattaatacgactatcctaaacaaaaccttgtataacattattaatatggtaagtaacctgaacacatttgtttaaaaccagcttttccattaccaggtcaatttcatgattttttaggcttttcttattgctactagtaactgatacggatgtcacatgtaataacatgttatagtccttctactccatcaaattccagttaataaaaggttttctggatttaattgtcatattcaaaattgtaaaatattcttggttgttttacatatcatgtccaaaagcagttattcttgaatttttaaaatactgacaaactgaacatcaccataaggaatccaattatgagggtagcatcattatacaagcaactgtgaggtcttttaacagttaccagtgtctttcaaaaatgtatgattttttaaatagtgactacaagtttcaaatcgtgcaggagaaatattcggtaatcaccgcagtctgagagtaataaagtgaaaaaagcattttctaagtagttgggaatttaatatagaaattctgtaatttcattgagattttaatttctatatcatataacgtcctaaaagtagtatctcagaaaatactacgattttaaaccagagaatttggttttgattaccaaatagggatcggtttggatacctaatcaggattactattttatgattgtgctttatttctctcgtctcctatgcaaaaatatatttttcagaatctatttatatatttatacatatatacatatacattatatatatgtaaaaatgcatgaccctgaggattgagatattaaatattatactcaagctataaatgtgcaattgtctcctgaagttgaattctgcttttctcttagctttctttaatttctggtttggttttggctattatttttcaacttaacctttcttagattttcgtcttaacaaattttctcttgaaaataatagaataaaataaatagtccatgtaggcatttccacatcagattgaaattaaatactcaccacacagaattcagtaaaacccaactacttctcagagttcctgaacggtctacttacattgagctgtctccaagttcttcatagagatgcgcacctggcggaggcggcggcggcggcgggggcgctgccactggtgcaggagccggcactgctggtttagccgcgggtaatgcggcctgaattcgtgcagtctttgtacactcagcttgacgtcttggataaagtaaggatggcttgtaaaactcattttagaaatcataatgcttatcaataagccaccttttaataatggggtccagttatcaggggaacccactaaaattattttacacaaacatcaatttataaacagatgtaattacaaaagcatccccacagggtatcatttgcatataatccctgctttgttcttgaaaatagctatctcttgaataaggggtagaattcagcagacatatttgcaaattaaattaaatgataatcttagagaaagcaaaattttaattaaaatgggatggataattaattggtagtttaatgaatctctttcataagatgaggcatattaaagataagatagataatttttctttattatttgtcttttaaagttatttgaaatgatttgaaacatttttgacgttatttcacagaggctgtacacacatgtacaagggaaatttggttagcttgtatatcctttaagattcctaggaatgcctaggccgggcacggtggctcatgcctgtgatcccagctactggggaggctgaggcaggagaatcgcttgaacccgggaggcggaggttgcagtgagcccagatcacgccattgcactccatcctggccaacaagagcaaaaagtccgtctcaaaaaaaaaaaaaaaaaaaaaaaaaaaaaaaaaattcctaggaatgcctgtgattctcatgttacagctacactgctgtttttggatttcctggacactgattaatttcttcctcaaaaccaagatgttacaggatggaagctataggcaaactatctttttcacatttgtgcaagttacgtccaattgtctaaaatcagctcaattctatatatatcaaaccaagaaataaactattacaaacgcaaaacaagggaataagatgtggttctgagcaggctgacttgattgatataatctcgggtttctcttttcctattacatgaaaaggatgtgtaaaatgttaattatacttacactttaaacctgtttgggaaagcaagagtaagaaaaatagaaagctacattagaactattgcattaataacattttaacatctgatttattctaaatcatgaataatttatacgttaaattcataatgacagagttaatgacagactaagaaaactaaggatatcaattcaaaaggtgaaaatagtatcgttaccgttagagtcattcaagccattaaaatatccataacagaaaaataaagaaatgaactacatagaataagaaaactggattaaaatgtaaatgtgagaatttcaactctagtggaaaaatggaatattaaagatgacctgacctttataattggcttcttggtttaccctgcttgaagaatattacaggaatggagagaggtagcaagccctgattatactcttggcttcactttgaagctgaagctacaattggaaggtcctactcttgggtaataaatttatgacagtttttacatatttgctttttagtttccattcatagaaaagttcaaaggcatatcattatataaaaggatagctattcattcttaccttatttgcaagcaaatatcaaggtacaaatgttaggtctttaaatattagaattttactttgctatgtgagcagagaaaaactcattttgtttaattatgttaatctataaaaagcagtaactaaattcatatggtattgagctgattatcaaactaaaggagaattaaataatgcgtctataaattatttaaatattaaacatctcaagtatttgttgtatttcagactaccttgtataacatccagagcgcttcagttttgatcattgcatactgtgccaaatacaagaatttttctcactgatttgcttgctagcaggatataataaagctcctttggaaaatagttaagtgtaaaaagataactggtaatacggaatggatttaacattataattaataatgggttgatggcttaataatttaaaacaatttgttcagtatcaattttgttcatcagctttagatttagcatatcaattgattggttaaggacacattaagctccagtatatcaaccttaatgctgtatttgcaacttcacattgcttttgaggtagaaaatatttctgtagtttcaggttggaattacttgaaaagtaatgacctgcttgaaaaatattaaaggaatggagtcatgcagcaagccctagttatactcttggcctcactttgaaaacggagctagaattggaaggtcctacttctgtgtaacgaattcatgatactttttttcatatttgctttttagtttccattcatagcaaagttcattcagagcatacatttggattttcaggttggaattaccttaccttattcaattcacaagaaaattttaagtatttgagaacaaagatgacagtttaagaatacataaggactattggctgggcgcggtggctcacacctgtaatcccagcactttgggaggctgaggtgggcggatcacgaagttaggagtttgagaccagcctgaccaacatggtgaaaccccgtctctactaaaaatacaaaaattagccaggtgtggtggcgcatgcctgtaatcccagctactcaggaggctgacacaggagaacagcttgaaccttggaggcagaggttgcagtgagctgagatcacaccactgcactccagcctgggcgacagagccagactccgtctccaggaaaaaaaaaaaaaaagtaaagaatacataagaactattttagtatttcctctgtaggtagtttaaatgatgaatagcagttctaccattatttcttattgtttattacataaagtaatttacatgatttattattactgtctgctatttattttctttttgtggcacactcagggctacttctcttcttaatcagctccccaattttttcaagtcattgtctatagaaatatacttaaaatgtgtggctctctatcacaaagcttccccagacctagtgtcaaagaatatattactaacctacttcaaatatggatgtttaaattagtgataattacttgactactctagataagttaaatacaattttaaaatatggatattgtcaatggatgcacttgactgcaggaaccagaaaaattaagagcctgcacagccagaacatgctgtcaaatagtacactaaaaactctggcaaagcacccaggaaggaagaaaccacatagaaaattacatcttacatgctatgattttacaatgcttttgctaacactgtgatcatttgcacaaaggcaaatttaacagtttggataaaaacctatcatgacaatgtcgcgaagttattgaccttcctttggagctgggcagagtgggtatccgcatatgacattccattgcttttaccccaggatacctgttaccttctctcccaagttggctcttaaacaaaagaagagcataaacaaagccacaggaactaaggtgatatttctattgaaagagaccgaattagaatcacaggaatattgggccatcagtgaaaaatgtactgggagtttgtactgttttccttttgaagaaaatcatttggtacgagatagacagacagataaagcaatctcagagtagttgcaccatcaatattttacaacgcaaagccatgttaccagagatggttttctgcaatgacttctgaggaactatccaggtttaccatccttgaatacttactgtctgtagctgaccaaaaccaccaagatggcaggaatgcagcagaggatgatgatgaaggccagagccaacaaggccccttctgtgtatcctagactttctcctctctttttaatgctggtcactgcctctggagtccggatctccagaatgcgtcctccttccccataatacggctgaaagtctttattgatatcaagtagtttgccatccaaaaatctttattgttagataaatagtaaaattaatgatgctagcagagaaagagcattttaaaaataaaatctttttgtaagatctttcaatattttctctaattgaaacacaagctgagtcagaagtctcatgaataataagaaaagcatatataaaaagcataagcaataaagaagaggagtaattacacatctgtatagaaatatcaaaaatattttaaaacacagctcttgatctgcttatagacttaaaaaatctaattatcagtatcattaagcttaatattactgtgtcaaaataatttaacaacattttagatggaataaaatataatatcctaaattatataccatagtttatatttatgcattttatctccttgggtcctgtaaccttcaggataaccctgtaaagatcaaacattacaatactgatttattgcaggccaaaaagctatacagttataaaaacaaatctgaggcaccaaactaagatttcagactcaaactctgtatttgtttgccataacaccatcttaaaagtaaacattctcaagtttcaaaccaaaagaatgttttatggtcaaatggtgaagacatttaaaagacccttctgcctaggaaaaaaagactaaataaatgatgcgagtagtatatcagtgttgtaagaatgacaggaagtggtagtcaatgtaattccttcctctaaataatgcaattccaactatgagtcttgaattttggaagagaatcaaggaataattattcctaatcttatgagattgaaaaaatttgttatgtatttaatatcataattagcaggtgattttttaaacaattccttgggaacttttgaacagtcccttataagctctacatattgatgcagcaactgtgttcttaatacaacaacaccataaaggtcaaacgtcttactatagaatattggaaaacaaaaatagttcaagaaaaacacaattactcatagtcccatgatctacagacagtcataatcacttctaacatcttggtatatttaagtctaatatttttttggaggggtgatattaaatattttatatacttgagtatactgcatatataaagtgcttatgttgaaaaatacagaaaacacaaaaaaatgcaaaagaaaaaattaaaatggccctaaatttcattatcaaaatataatcaatgccatgcttgtgtacttttttcagtctattttatgcccttttgagacatttaattttaatattcagagtgaccatgctgattttaaatcccgttaacacactgttcattgcttaaaaatagaagtgcctggtatcacatatgaattccatcacatatgtaactcataaactaattcatatcacacatgtggcaattagaatgcttttttgctttttttaaacagatacgcttttatagattaaaaatgtactttttatagcaattttccaagctcattgttacacgttaaaagaaaataaaaatttagccatttttatgattactagaaatagaatagtgaaacttcttgtttgaattgtttattagataaaggaagagattctaaatgatgcatagatcaagaattgcttcacaggaactatattattagaacaaggaagaatcagatccagaagaggatcattaatttaagggaagaatatacccctacaatgtggagttcagttgacagatcaaaattctattggattcctggatttcatatccaaactctctaaagtaagatttgttagtctttttacactgcaagagccctattacttagatacttattttcacttatcaatgtgatgtcataaacaattttttactagaaggatggatcacttttgaacccacacctgatctagactatctttctttactttgtgtatttaaaacaacttgtctgggtaaaaattcttgagtcataacattatcccttacaaaacagcaaaattgcttccattgccttttgtcattttatcatgcaaatgagatatgcagggcttacctaatttttgttcctttatgagtaagatatttttatttctgtttcagtgatttttaaacatattcagatactattcaaagaaacatggctaccttttcattgatttttgcctgtaatataataaactcttgaattcttttttcgattttttgcttctgttataaatactacaattttaacctcagaaataactgtcattatcaggttgtattttaatcgtcctataaatatattttgatctcttttattatttatatgttttttcctttttcttaatattgcataaattttcaatggatacacttcatgttgtcaatttaattttcacatgccttctcatttcaggaaaggttgaatccaggtgctcaattgattttaggagataaaatttaatttataaattaggcacagtaagatattaacaacaataactaataacaaaatagaacaattatagaactatagtgtaataaaagttatgcaaatgtggtttctctctgtctctgtcaatatcttattgtattgtaccattggtaactgaaactgaagaaagcaaaaccacagaagagggttgactgctatactccagttggactgaggggaaggcactttagattaaagactaccaccgtgtaggaaagggacaattctcacgagagaaagtggaattcttttaccagaaacaggagaaggactcaagccatgtaaaacacacacaccatttcaccaatccataccattctgttttctactaaaaatgttaaactgttttccaatggtttctgtaggagaaaatttccagagttatatattctccctctgggtcatcaggttattatctcctgattttccatatttattttgttttttagtatttattgctgatcccgtttttccactgcttacttatcctaaaaaagagatagatctgcccaaatccagcatcaacacagaaatgtgttttttttttttttctcgtcattttcatctacagtgtactcagttactatatgcaaaccttttgtaattctaagggaagggtatacaggtcccttcccaggatgtagccaacatgaattgattactgctatgttatcctgaaatgagataagttgctaaaccaatgtcatgtcttattattttctcaagcacatgcaaacatgtatttctgcctccattgatggatatggggcctaatgttgtgttattcagcatataattaataaatacataatcaacaatctaccctgcatctcaccttcgtgactgattaccttgatgatgatgattttgatactgcaatgtacatatgaatgtagaaataagtaaagggtgagcaggagattgtactctagacagtagagggacaactgtctatttcctttgtaggtacacaatttaggcgtacagagtgggcagtggttaacatatctacctacattcattacactgtataagatttttctgcttaatcaagcaaatcatggttagatcatcaactattttcttttcacagtttcataactgtttaactagattctaataattagtattccattgatttggattttcagtattttgaatttatatgtatagttttttacttagaacattgaaagaggctttatcagagcctgttaatcagataccgtttaaggtctaagtgtgtttttaaacattgtggtttaaaggcagtgtataaagtctttttctgccttctccatctttctcttacgatttggacatactgtttttaaataggctggatataagacagataaacaagctaaaatgtatttgcttatttttaaattttaattaaactatattttaaagtagtgtgttctgttttgtgtagaatgcagaaagccacaagagaatatggctattaacagcaacaacaaaatgacaaaaaagtgccaggttatactaaaatcataaatttccttgagctgaagtcacaatgtgagcaaaaaaaaccaaattccattgagtgacaattaggataatttcatggtgagatgtgaccatacattgtttcacctttggcagaaaaggttaaaagtggctgccataggctgggcacggtggcttatgcctgtaatctcaacacattgggaggctgaggtgggatgattacttgagctcaggagtttgacagcagcctgggcaataaagtgagaccatgtctctacaaaaaacaaaacaaaacaaaacagctaaaattgtaataaataaggttagaattatagacacccacaaacacaaggggagtctcccctcatttgaaaacttctttgcgtagatttctgtaagatagattgggggacaaggcaggacacaagagaatattccttcatggtgtaagaataggaacaaatcagcaaggctggtgcacaggcagcaacccttgtgcaattccccagacctttatctcagatgaaacaagggccgtaagtattagagggaggaggaggaagtgtgcccatccctggtgctcaggcaaaggtctactgcttctggaaaagaggtataagcaaaaatcccctacccctgggggaggagcaggaagtcctctcaggtgtaagatcttgcaccaatacaaagtagaggtctactatggattgagaaggggcagaaaattctcttgcacccaagaccccctgtaaatgtgaagcagaggatggctgccatgatgccataagaaagagggggaaaaaatcttgagaaagcccataccaaggcttacacatgcaggctgtacaaggagaacagaggaacccctattccatgacccacctcttccttataagagtggaacccagcagcaaggaggagcagtctaacactgtgggacagatcagagtgtgggcagaaacctcttctgtggcacaagcatatagagagcactgagagctgaggactgagtaagaagactgagaaaaccctacagcacgcaggcctctattctaagactgagttgacaccattccaccaataaaagaatttttgaagcttttggcacagtggaagtaataattgcaacagcaaaatccaaataattcctgaatagctttacttaacagagtaaatgtctgtaatgtccatttacaggcataaactctatttacctcacttcttactgttcttccacaccatgtctggcattcaatcaagtaggacacaaaaagcctacaaaatataaaacaaccattttcaagaaatgaagtaacagagccagatagagataacccagatattggaactgtcagacaggaactctgattcaactctgattaatacattgcaaaatagcagaaagcacaaacatgcctgaagcgatggagaaattcagtagagtggtggaaataagaaataatctaatagaaatgctagaaatatctttctaaaaagataaaaagatgaagaatttcttcagtgagttcatcaataggctaacacagatgaatcagtgaattcaaaaatagggcagtaaatattattcacactaaaatacaaagaaaaaactgtgtgtctatgtgggcgggggaggggagcagagtcagaacggaacaaaattatgagaaaaatcaaattgtaattggaatcccagaaaaggaataaagagaaaatgggcataagaaatattagaaaaaatgtctgagaatattccagaaataaaaaaagaaaaaactcaaaatcaaactcacaaaaaaatgcagctccaaagagttgagaactacaaggataaaaaagcaggataagagtaatatataattattgcataaaatctaagcaattcaggtaaccaaaaataaaaaaattaaaataccgataagctggccaaacaaaataagttattaacatatcactaaaagtcattccagtcctgtctatgcatttatgagcttttttatttttgattgccaaaatatattttttcaaatcaaagtaagttcccaggacaaattattattatgatgatttctaatcctttgacctgagcattccaacatcctcagaagcttagattttaaggtgaaaggaaattgaaagaacacttccattgacctggaccggcatcttaatgttctagtacatttatgcagtgttaaaaactaaataaccaataactctcacaactacagaatagataccaatacttgggcactggcattatcagccttggaaaacacacacacacacacacatacacacatatacacatgtatatgtatgtgtatacaattttattataaaatctttcaagaaacaattctagagtttcaaatagaccagtgactctaagcttactataatacttcaaggtgaagactgctaaggcaaaattttcatatttcatggctattctatcttttcttcaatataaacatatattatttatttatttatttatttatttatttatttatttagaggcagagtcttgctctcttgcccaggatggagtgcagtggcatgatcttgctcactgcatgctcggcctcctgggttcacgccattctcctgcctcagcctcccaagtggctgggactacaggtgcccgccaccatgcccggctaattttttgtatttttagtagagacggggtttcaccgtgttagccaggatggtctcgatctcctgacctcgtgatccacccacctcggcctcccaaagtgctgggattacaggcgtgagctaccgcgcccggccaaaaatttattttatgatttatatatattctgttttttccttgcctgctggctatgatagttattttattgaatttagatgtttactgtccataatataatttaggtttggaaaaacttatttagaattaattaaagatgttcatcttgtatttcatggtgtcacttaaaacccaagtggcttttttttccccaaatatttaatctctagaaggtttgctagttaaattcaaattctaatcaccattattttactctttaaagttagcccaaatataatacatatttttatattcaggtaaaaacaccctaaactcaatcaatcgtgaaatttaaaaacaaaactaatgtatgcaaaaaacacagaatgcaggtagattcacataaaaaagaaatgtgttgattttctgacaatcgaaagaatatatatgaattactttggaagtttattcctaaactttttaaattaataaactttttaaattaataaaacttacaaaaaattggcttggtagatctaaatgttgcttcattttggtggtgactataaaatcagagtgcgagctattacttcattcatctatatttcctccacggttagtatcctgttttgcacatggcccaaatatctattaaaaatgaattgatgagccaggcacggtggctcacacctgtaatcccagcactttgggatgccaaggcgggcggatcaccaggtaaggagatcgagaccatcctggctaacatggtaaaaccccgtctctactaaaaatacaaaaaattagctgggcgtggtggcgggcgcctgtagtcctagcttctcaggaggctgaggcaggagaatggcgtgaacccgggaggtggagcttgcagtgagcgagattgcgccactgcactccagcctggggcacagagtgagtctccgtctcaaaaaaaaaaaaaaaaaaaaagaattgatgagtaacatgttaaataattatggcttttaaaaaattttagctgatattaaatcattattttattattgccaaaatagaagtgatgaaattttgtcgatgaacacatttaaaataaaactaaattcagaatttattaatttgaataaaaattgaatagatatttacaaaataaataaatttacatacacataatatagatatatttgtaaatgtgtatatggatatgtttatatgctgtttaaaaagtatagacaaagaaaaactaaattatgatgtttcacatatagagttcggcatgactatatatacaggcacatataaactattatgattgtatatcaatatatatttttaactaaaaatgtttcattgagatagaatttcattacaagacccagttggacactaggtgtcaccagagtaaagaaaattctgttaacaatttttttttttttaagtatttaagtgtgctcgaataacatccaaagaaagtaagtagcaggattttctttaagattctgcactttatttatttttaggatttataactcaaatttttaagttcctgctaggatgaaatttcacatagagcatgaacttaaatgggaatgattatcccacctgctctccacctgtaagttaaagaaaaaagcagatattgatttttgctgatttagtagacctgtaagaaaggtggatttcttcttaaaatgcaagcatatgaaaatcattgcagaaaaactgcctctttaagaatctgtgctttcctcattaatagccagtgcccttgagcaagagtgaggagctggcagcaggtgatttcaaggagctgttccttgttcttaagtacaaaaggtcatctgatgcccataaagaaaatgggccctctgaagtcactgtagcccacacttagacctgaaaactttaaggcatgagaatcctaggtatttcaggttctttgcttacacttcactttcagtaactatttggtgggttttaaactttaagtacttatagcctcaagtcagaatcatctatggttgctattgtaaccaaagagctgttacagataacaaaaagcacttacttaaaaagctcatttctatcgatggctctgttggtttgggggtcaattgcatagacagtcaagtcacatttggtgtaatcttctagggaaaaggcatctccatgccggcgagctccaatggactccactacgaccttggcaccaggaatttgttcctgaacatagcgatccaagatcctataaatcaaacaaagtacaaacatgacagtccaatgggctttctgggagtaaaaaattactcttaacttgaaaagacatttagtaaatgaaaaatgatgacagcctagttttttgttaatgtttactgaatataaacccttgaaaaacattctctatattttttcagcatttagctcccaatgatgctagaagctgaatacggtagaaaaggtcaccaaccatgtcctatttaactttaggctttttgaatttatgatactatttgagcttttacatgagaaatgccaaatatgctgtacaaataaagctgtctatgctttataggaggcatggggtcttagaacccttgacttcacatggttggtgtcataaattacatctcccactaaagtctgtgacacatgacacgtagctatatgctaagaagcaggactaggatgcctgttttcccaaaggtataaaaatccttgcagaatcacagcaacgggagaatgtggagatattttgcaatggcaggattaccacgttaagataaaaatatggcatgcaaatctcagacactatttaggtgaataaaaacaacatataccatctggtataaattagtgatatttaatttaaaaagcagagacaatattaatcaataagtaattttcccatctcatgactggattttaattgaaagtatgaattattaccatttcccaaatgtctcattccttattaaaaactttatattattaacccaagtatataaatattaagagcatataattcagtatttacagatgtttaaatttaaataattttaattactatatatgataaatattctaaaattcgtagactcaatgctcttttctgagtctatattttgaggtttttttagggggagaagggcaatatattctaaagtcctttgatacatcagaaaataacttttgcttctaatgccacaattgacatatttcttgctcgactgaaagtatattcccttaagagtcttgtatgtgcttggtttgccttgttattagaacaatgaggttactaaactttggaggaaatggctctaccagtgcatgccaggagacactaccaatcatagtgaaatgtttgcttgcttgtttttaaatgtttgtaacccagtactgttgaagtctgtcttattgaagtactattcattattttccttttctgtcaccactccacgcccactggtctctcggcttcgcaatttcttttctgatgacatccttgaagtagactaagaaaagatgatgtgtaaaaaaggaggaggagcaaattcacttggaaaatatcagttaatagttgaatgcctgcaattccagctagtcgggagatgaaacagaagaatcgcttgaacccgggaggtggaggttgcagtgactccagcctgggcgacagagcaagattttatctccaaagggaaaaaaaaaaaaaaaaaacaaccccgggaacctgaagataatggatgtactgagagacacagactagtctaacatcatttggactgtgtttttcagattttttttcctgagagatttatgctcatttaacaaaaataagagaggcctcggagtcaaaccatattatactcttgacattttgtaggaggcacaaacaataatgatataatgttgaggagtacagatgtctggctggcttcaattttaatttcctttgcctttcaattgcataaccttagacaagtaatcttaagctctcaaagtctcaggtttgtttgtttgctttttgagatggagtctcattctgtcgcccaggctggagtgcaatggggcaatctcggctcactgcaacctccacctcccgggttcaagggattctcctgtctcacgcctggattacaggcatgcaccaccacacctggctaatttttgtattttttagtagagacagtgtttcaccatgttggtcaggctggtctcaaattcctgacctcaagtgatccgcccgcctcggcctttcaaagtgctgggattacaggcatgagcatcacatctggccatgtttccttaaatagaaaacaaggaaataatgtaccacatggggctgaatgtgcattcggtgaaataaagcttttacacagttcctagcacatagtaactattcaacaaaatgaatcttatttttattaatttgactgaaatatttccattaataagcttcttccttgtctcaaattcattcaaggcctttaattaatttgtggaataggaaagtatacttctcactagtataatcaatcagttcacaaatcaaaacgcaaacaggagtacctagttaaatacaatgcaatagatggctctctgtcccaatactttggtctaacaatttatgccttctccagtgcattttggcattgatttgacatgttccaaggaaatccttcatataagcatagattaattgtgtgtgatcctacagtgaagaaacatatctattgtgcttgggttcttttctattttcagtgcaatactgcagaatcatttcactaaaaaaaatagatgtggaataaaatataactgtaccaattccttcatggtagcagggaatcatgaataaaagaagtctaaaaacaaattatgtcatttaaaacatgcaataatgtcttcactttgagcatttttttgttaaacttttaaagatcttttgggacaaagtatatcttatgataaaaagagatatagcctaatcttaactgcttctgtatctttttcttataaatgtaagtaaaactaaataccttttaattgagaacacatttcataaaaatctatcttttcatttatcatctatatctatatactaagtattttctacatctatattcattacctatatgtatataaatttcctcacatatatacatatacccccacacacacaaagaaaaagagatttgcaatgatgtttatctaacccataatatttgtatcatacacacacatatcaagaaagatgtccataatgatgtttatgtaatgttaataatgcttagagctggatggtatgattttgagtttaccttttataactttcttcttcatatattatattgcttatatttctttataatgggaataaaagaacaatatagttatatttttaaaaaatctccttaactccctatttcctctccccaacttcgtgataaaaaaagtcttcatataaatctatattttctagtttaaaaatgaaaaaaattaaattggattcagggcttttcataaaattatagcaaaactcactcagggaagtgttaagtaggaaaattttcatttattcattccttcaacagatgtttattcaatgcctatcctgggccagaagccattccagacacatggaatacatcagtgaacaaaatacaatctttgatgtcaaagaagaatttacattcaaattgaacaagacaagtaacagatcatggattgataaaattggtaaaagtgttcagaataaatatcattgagactttgatatttgagcaaaaactttagggaacaatgtgtgctgtggctattctaggaatgagtgttctaagaaaagagaattgctaactgcttgtataaatgtgctgatgtagtagtgtgtggccagagcagatcacgtggggactttgaggattgtaagagcattgttttttgttctgagtgagataagaatctgttgctggttttgaatactaaagtaatatgatctaccttacatttaaaggaggcacactggttgctgtgttgagactaggctgagtagaatcaggaaaactagttagtaaagaacttaagtacatgaaggttcattaaatgctcagcctactcaataatttagaagaaaagacacaacccaatccatgactattagccatatgaaataaaatataaatatcagagcagatataagcaaaactttgaccaaaaagaaaacacaaaaaatcaagaaacagaaaatttgcttttttggaaaaaacatgatatgaccataaaaacagacacgtacaccaatgaaacagaagagaaaactccaaaataaatccacactcttacagccaatcatttttgaccaagatgtgaagaacatacactggggaaaggacaatttttaatgtatgatgataagaaactggatatccatattcagaaaaataaaaatagattcccatctttttctatgtacaaaaatccactcaaaatggattaaaagcttaaacataagacataaaactgtaaaactactagtagaaaatattgggaagagacttcaggacattggtgtgagcaaagattttgtaagactccaaagaaatataaattttccaatgaaagcaaaaataggcaaatgggattacattaggcagaaaagcttttacacagcaaatgaaacaattgtcaaagagacaacctatagaataagagaaaatatttgcaaactatccaatcaacaagagattaataaccagaatatataaggaactcaacagataaaaaccaaataatccaatttaaaaatgggccaaggatctgaatagacaattctcaaaagaagatatacaaagagtcaataggcatatgaaaaaatgctcgacatcactaatcatcaaggcaatgaaaatcaaaatcacaatgaaatattatctcatcccaactgtaattgctattgtcaaaaaacaaacaaacaaaaaataacaaatgctgtaaggatatggagaaggaggaacatttatacattcttggggggaatgtaaaatagtacagccattatggaaaacagtatggaggttcctcaaaaaactaaaaatagaactataacatgattcagtaatcccactgctaggtatacatccaaaagaaagaaaatcaatatattgaagagttatctgcatgcctatgtttatcacagcactattcacagtagtcaagatatggaatcaaccaaaatgtttatcaacagatgagtggataaagcaaatacagtatatatatacaatcaaatattatttagccataaaaagaacaaaatcctgtcatttgcagaaacatggaagaaactgaaggttattatgtaaagtggaataagccaggcaaagaagaaatatcacatattctcattcatatgtgggagctaaaaaatggatctcatggaggtagagagtagaatggtgcttaccagaggctgagaggggaagaaagatggggataatgataaaatggttaatggatacaaaaatacagatagagaaaataaataagttatagtattcaacagtacggtagggaatttatagttaaaaataatgtgttgtatatttcaaaacagctagataagaagaattgtaatggtcccaatacaaagaaaaatattggagttgatggatattccaattatgctgatttatcagtacacattatatatatatgaatccaaatatcacatatatcccaaaaatatgtacaactaggttatatcaatagtgtatgtgtatacacacacacacacacacacacacacaaacaaaaaaagaattaaaaaatgaatgccaaaaatttccctgaatctgacttcttggtagcaatatacgtatttaaaatgcaaatagtacaatcaagtatgaagcaaaacagtatctgattatgtcgagcattctcaaaacagagaactggctgtgattggtcttctaaaaagtgaaaaatatgttaataaatttggatgataattacaattattgaataaaaattacattttaaggctatattgttccactttactttgaatgctctctaacatactcctgttaatgtctatttaattatgtcacctttaggaaaagttttaaaaacagaaaacttctaaagaaatacgttaatatagctaatacaaacattttatgtaacatatgttagtatagtaccacatactaattaatgtccaatacaaaacagtttatctaaataaccttcttagaataaatgctgaaaggtttatttaactgattttttttcctatgcagatagcattattttaaaatcacaaactaagggtgtcaataaacaattggttcgcttaacttacttattcttgaaccaagttatttttggtagatgctctaaatttcaatttacagcattaccttatccagttacctgtatatacatcttcaattagtttcaactagaaattgcattatgaaaaactgtagtgtaaggtgtttactgatagttttatagctgggacaggtatttactcatggttgatttagctttttatttatttttttacactaaaattattacagcagccataatctcaattacccatttgtctgtgtgaatgagttgagttaaaattaccatgtgatgagaatttctggttttgcatgctcagtttactcccaagaaaagatgggttgggtttttaattaggtttgcctcctaagaggcagtgtaacagaggaaactccatctgctggtggctggtagacgtagattaaaattaaacctccattattgtgtctttgtggaaattacttaacttttcaaagtttcagggaatttatctgtacagtgggaaaagtagtcaaacctacctcaaaggtcctctgtgataggttaaggagactacacccattaaatgcacaaaaatctaaccaatatgaagcgtgtcataaatgttggctacctgttgtgatggttacaagaactcttcagatttcatgattataaaccctacttaggcttttgttgaggtaaatggcttatatttatctagcatcatagagagttccaccccaagtgcttatcaatatttttacacaagcttagctaaattaatcaataggcattgcagctggctggagggataaaaatacaggcatacagttcctactgttctgaacttctttcctccattaatacagacccacagggactctacccagaccatatcctaagtagtgctctagatgccatggagcattttgttcattacattacatggtaacctctctgtggtatcccacaagataaaaatattttcctctaatctggaattagactttgaaagagttcttttgtcccagaagagatatggttttgttaattttgtaactgagtctgttctttttgtttagcttgtttgcttctttcactttggccctaacaaggtgacagtcaagtttgtgactactctatatggactatacaggcctttgcagcatctctgtaattacttactcttactctgatcctttctttaacttctttctcatctgtttgctttatttttctacactcatttttaatgtattttacctttttttctgtgtgaatcattgtaaactacttctgtttttctttggaataaggtagaaaattaaaacaaaattaaatttagcctttaatatttattagacatatatggaagcatctaaaatataatttatgactttctgatacaaacggaattctcttgcataaacattttgtggagtttatgtctcacattaaaaaacagcagtacagactgcggtaaattgtgaataaattgaagaaagtatagaaaagaataataaataggattaagagaacagaggaattgactcttgatgattaaagtggcctctaaaggaagtgatatatctaccttgtaccatgagttggggtgaattacaaaaataacaagctgttcaatttgacaaaacttctaggttataaaaaaaaaaagaggaggaagagaggaaataattttaaaagaaataaatgtccactatgtattttagagatctccataaagcaactgtgattcaaatgttttgataaaataatatataatgatgtccttatttttacactacaactattttctagttattttctacttggtacaagcaaaagatcttaaaaataaactgaactgaatgatatttgaggggagaaaaacagattataatacaagttaagattaaccgctcaatctttctttgcttttcttcctaatttctagatcttaaaataaaaacataaataaagttgtctggaaatgtttttttccttagtgttttataagtgaatttcacttttgaacatgaataaccccttaccttcaaatctcaggaaaaaatatacctgtatcaattattttttctccatcataagttgataagaacattttaaacactttaaaattttgaagcacaattcaaagattcagttaatatacgggtaccttcattacgatgattcattgtgcattaattaattttatttctttaatgtatctttcgatcatgctattttcttaaacaaaatagtttccccaaaattttgtttgtattattttcatagtgcaaataaaggcaacataaacatatttatctttgatttaaaactaaacacatagtgtttttaattgatcttccaataaaatatatttttaatctgggaagatctcatttatctctttttgaaaacaacaatagctcaaagattttaaacttttttcacctaaaagcaaaatgaaaatgtcctcaatgttcatttatttgtttgtttgttttggctttccattgtctccaaaagtttgaatactaaaaaagtaaaaaagataaaaagtagaaagaatattgattctgacaaaatacaccacctaaatgtagcagccctgcctcattctttagtttttaatctttttttttctatgttgctgagaaggcatggagaaagtgtgcaaatatgatttcttttttttatattacatctctcagatggcaagtgttaactaagaaagttgatttattttgtatatgtatatatattttttccaaacagaagctgttataatagactataagcattcagaaatgtgttaatgaatgaatgaatgacgaccattaaaataagaaacatatctatctgaagcaaacatgtcagcatacaggaccctttacggaatcaatatgcaatggaatcttaagaaaaaaagtaaaacctacttgataagtgatttgcttttggttaactttgcttatagaaaaatatgtacaaattggccggacgcggtggctcatgcctgtaatcccagcactttgggaggctgaggcaggcggatcacaaggtcaggagatctagaccattgtggctaacacggtgaaacctcgtctctactaaaaatataaaaaattagccgggcatggtggcgggcacctgtagtcccagcaattcaggaggctgaggcagaatgacatgaacccgggagacggagcttgcagtgagccgagatcgcgccactgcactccagcctgtgcgacagaggaaggctccgtctcaaaaaaaaaaaaaaaaaaaaaaagaaagaaagaaaaatttgtacaaatttggaaaatccaagtcatacaaaataaaaaaaagcttaccttaatatacgtgaaatatattatcagagacaaaacactaattattgtgactttgagccatgtgacagatgattaatccttaaagtaaacaatttactcatattgggctaagataacattcctccaaataataactaagaatccacgtaaaataaaaccttttaactctcaaaaatagaacagaactgaaaatcatggagcaccttagtttataatcatctttgttccatgtgattatttcaatactaaagttttggaaacaattaaaaatcctgccatatttaactaaaaacagaattttaaatctgtgctttttctacatttcaaagagttaagcattaaagatgctactgcaatgtgcacaaggattattataaaatagtagcttttaattgtataattgcatattggggtatcttcagttctgtaaagaactatgatttctttaatcataattaacctaatgagttaaagacaagtcattcttcttgtaaacagaggttacttctctactaaataatgctccaaatgaatatttcaaaaagtagcaaataaattttctttctgtcaaaacaatgaatttccaaggctttgaataaagcttagtcacacttaacctttttttaaagaatagtaaattataccttgaataataaatggtaggatttattattatatttctggtttgtattttatttttatgattgcttttagtttattttatagctattacattcctattacagaaacattattttcaaaaattgtactattaaaatgggtgtgctgcattatctgataaaaattaaatcattcatggcaattctctgttgataatatcttcaactccaactatatctttatgctaagtatgctgagagaaaattggcatgtaatagacaatacagcaatttaattgtagaatatggcagctagggagaagactacataacaaaagaaactcttaaggtatctagtggctaccatattgaacagatgggtctaactaaggactttccatctcacacagaataaaacttgaaatcgtccaagtgatctatcaggtcctagaactgattttctaccatgatatctatattttaataagccaagcatggctctttctctgggttttcataactgcagttctctatcaggaattgtgcctcttcctctctcatagtcaaacgactttttccatcacttaatatagatgtcttctcagatttcaacttatcagaaaggctttctttaaccatcctatttaaaacagcacctctcttccaaaattttctacttgatacttgtatttatctgtctttattacagttatcactacataacttaatattacatatttattaatattgttattttatatgccatttttatgcaatcgaatagaagctccatggcagcagggacttcacactgttcactgataatctccagtgcttacaatctgtaactatttattttttaactaataaatccccagctctaagatacaaatgcaaaaactcaaagagtttgatagactggcccaagacttcctagctagtctttggtggtctgggaaatgagcctaggttctctgaaacaaaaaggagctcaaactttccccttaaaaccaagtttttattacattgatttaagaaaatgtgctagcagttagcgtttcataggtatgcttcccgagagaccttctaattatcctcctagaaatatatatatatatatatatatatatatatatatatatatatatatatatatttacacacacacatatatacatatatactatacaaataaataaattctatatacgtaatatatatcctggctacatttctaatgtaggttttgtaaccttaattctaggaactatagattgattacacagcacatttcaggtgctacataaatatttcataaagttgaggctcttcctcatcaagtcagtaactacttcagtaaagctctactataattgaattttcatattttattcagaaggtaagagatgggtttgagcaactctgagaaataagttgtcagttccgattcatacaaaaatactctaactcagtgtttctaaactcgagtttataattttcaaaatatctcttttatagatgcttaaggatttaaattttagaaccacagattcctcttatttgagtttcatggtgaactgggagtagaaagaagttataaaatgcaaacatttcatagtttcttctttagacaattatttgccaattatttgtccattgtagttacgtgtccctactgttattctcacagctgtttctcctataccttaatttaaaaaaaagtaatttaaaaaaccacaagccttacaaagaggtgaattctaagatcaacttaaaatacgtcagagcacagatattcaagggtatctgtagtggatgcagatcctcactggaatttgttgaatatattaatctaattaaaaaggtatatgtttccttacttaggggaattggtcaattttataagcttaaaatctaaaaagtagtaaaaaattttcagtatagtcatttcagctgattcagtgaggtgaggagtaatcattacagcagctaagatttattacaagcattccattttccaggtactgcggtcttagctatcaaagtgtactgatctttgtaaaatctgctccattgtaaaatggatatgtcaggtcattatttttcctttcatcaagtgtcctcatttgtactgattacatacttaccaaggaaactttatatttttgcctaaaatattggtctaccaaaaaaaaaaatgatcacatgacattccagttttccacttcatcggatagggatgtctcaagggaaatatagaaatggctttgatgataactaacttgtcacctaagaatgtcacagggaattaatgtgtttactggtctcgtcactagaacaataaattcttctatttaattaactatttggcaccccgatggctacctgagttatgtgtgtattttcatcactcatcccagacatggatagggggagcactggggcttcacagtgctgactcaggtcttacagttcttatcactaccacttccatctactaatgtaggtttcaaaaagagatcagaaatatttctgcttaagaaaactctaaatttacataggttttaaaaaaaatctacaaaatgaaatcagacatggaagggacaatttcttaaacaactagtattgaaaaaatggaatatccatatgtaaaaaaaaaaaggctggacccttatcttacaccatatacaaaaattaactcaaaatggattaaagatctaaatataagacctccaaaccataaaatgcctagaataaaacgtatgagaggtgttttgtaacactggatttgacaacgatttattgaatatgacaccaatagcacaggaaacaaaagcaaaaatagacagatggactacctctgactttaaaactttttgcccaattagtgacacaatcatcagggtgaaaaggcaacctatggaataggagaaaatatttgcaaatcttacatctgataagggattagtatctaatatctaaacaactcctacaactaaacaactaaaataaatcaagtaacccaattaaaaatgtgcaaaggacttgaatagacatgttttaaaagatgatatacaatggccaatagcacctgaaaagatgctcatcatcaataaccatcagagaaatcaaatcaaatgacaatgatatatcatctcacacattagtatggctactacgtataaaaaaggaaaaagaaccagaaaataaaaagtgttgataggaggttgagaagttggaaagcttatgcactggtggtgaaattgtaaaatggtgcaactgctatagaaaacaattttctttaaattagaactaccatatgatttagcaatcccacttctgagaatgcactcaaaagaatgaaagcaggatataaaagatatattttaatatttatgttcatagcagtattattcacaatatccaagagggggaaacaacccaaatgtctattgagaggtgaacagatgaacagaatgtggtatgtattgagaactattcagctctataaaggaatgaaattctatcacatgctaagctgtaacatggatgaatcatgggaatatcatgctaagtgaaataatccaatcacaaaatgagaaatactgcaaatttccacttttatgatgtatttaaagtagtaaaatttatacatgtaggaagacaaaaggttgttacccagagtctaggggtaaggctggaatggaaacttgtttaatgggtaccaaatttcagttgtgcaaaatgaagaagttctgaaaatctattttgaaacaatgtcaatatacttaaaactaccaaactgtacacttaaaaatgtttaagatggtaatgtttatactatgttttttaatcacaacaaaaggaatggggcatgtatgtgctgcttaataaactcgcagatttatatttaattcttttaaaatcaacatgagatagaggtctttattccaattttcatgaagaataaaagtggctctaggtgctaagtagcttgtccagaggttacagagctgtaataggatctaaatctctgtgtctgaaaccataatctgcattccattaccaaatgcttaataaataaaatgtacaaaactcctagccactctccacctaagtctactgactttgagctgctagctccatttatatggaatatttaccattcaccgaatagtcatactttctattgtcctagatacattatataattcagttttcaaaataattctatatgttttattagctcttaacagtgaaactgaggttgaaaagattaaattatttgcccaatttcatgttttaaatccaaagttttatgaagtcagagcttccttcacaatgatacgattctctcaagacctgaaagttacctgatttttcctatttatatcatcctatctacttaagaagcattaaaatcttataaattcctgcaaaactatacttttgctattttctttttcagtttgataaattttgtctcaaaataaagaaaatggcatcatgatttgcttgtaaaacatcctttcaataaaatgtatcaagtgtctactatataactggagttatagaaataaaacacaagtctcatacattcgtagagataatattctagtggaaattgactataataataacattagataatgctttgtagaaaaataaactagaataaagggttaaaatttgaagctgggtatcatttcttacataatagacaacggaatcagagaaagcctgtctcaataggcttttattaaagcagctaaaagttaggcacaattctaattatttttaaagtataatcagctattattttgaaaaggctcagtgtatataaactacttctgcagaaataaacaagacactgtacaattgatattccatgcataaatgttgataaccatcaccctcataaaacaatttacatgacaccaaaaggttaaatttgtgaactatcctgaaataattgttatgaatcatatatgcttttcttatgggaaaatcacatatgctttaatccgtgcctactgtattttatttggcatataattactaaaagtttagttatctgactctttaaagcttcttctggcaagctgaagtgatgatattttgctaaagaggcaaattgacagtgacgataattgacctctgtcaaactgaaatcaacagaagacacagaagaacaacctaatgcaggcagagcttaaaacctagacaacgggttgataggtgcagcaaaccaccatggcacatgtatacctatgtaacaagcatgcatgttctgcacatgtatcccggaacttaaaagttaaaaaaaaaggtgatatgtatatatatatatatatgtatgtgtgtgtgtgtaatgaaatagtattcagccataaaaaggaacaaaataatggcatttgccattattggagaccattactctaagtgaagtaactcaggaatgaaaaaacaaacatcatatgttttcactcataagtggaaactaagctatgaggactcaaatgcataaagatgatacaatggagtttggggactcaggggaaagggtgggatggaggtgagggataaagactgtacgttgggtacagtgtacactgcttgtgtgcaccaaaatctcagaattcaccattaaagaattattcatgtaaccaaaaaaagaaaaaaaaatttaaaataatggcagctaaattagggtaattaagggtaaaatagtaaagatattttaaacatcttttacagtatcaaaatataagaactgcagtttaataaataatcacaactagattggagttaactataacatactcagccatggtgagtctacactgttaaggaggcagagggacatgccacatattttacaataatttaaaacatatatattgcttaatattagtcaacttggttttaaaagactaagctctaggcatttagacacattgctttgagaaatgacatatttcctggactggccagactgctttttgagtaaattggagccacaaaatcaaggtatatattcaatccatgaatgttatgatttctcatatgcagcattttgaggttctgatacatcaaagcattctgaataataaaatctcacatctaatttttatccttatttgaagacactctcaaaatcttcacatatttccaattagactttgagaaaacagtaagctaaattattattaaaacactcttaaactatatgtttaatctgaacattgtaatgattaaaatgacccactcagattaaaattgtggttgttcaaatactgcatgttattatttataaatgagagtcaacaatgggtacatgcagacataaagaaagaaaataatagacactgagggctccaaaaggagggaggatgggaggggcatgagggctgacaaattagctattggctacagtgctcactatttgggtggttggcacactcgaagcctaaacctcaccaatatgcaatatatccatgtaacacacctgcacatgtatcccctgaatctaaaataaaatttaaaaaatacagttaaaaatcatggtcatataaaaataaatatataaggagacaaaatcaattactctgtaagatcttctatctttttttccactagagtaggaggcacattggaaacaatgacttgcatatccagctgattgaccacggagacctgaaagaagaaaaaacagaattcatttaatttttactcactgaaatttccataatcagaaaacccccacattacctcttccctactatgcatagacacagtggtttctgattttcaaattcaggaacaaatatatatacatttttaattatatgatctacacaaggggttggagactaactggggcagactgagcatgagaaactatttgttgtttacctagaaattaagaatcctgagtgatttcaattgtttttggttatgtgtttgttttattggttatttactgagacatgaagggtggcatttttttttaatttgattgttaaggaacacccaagataatgaaaaatacgttttatattttacaagtcttgagaaatcatttattcattataactaagaatctgagatatgactggttagaataattcattctatgaggtcatcacatatagttttcttgtctatttaaccaactttaaatttgtgtaggtagaggtatatatttagaactttacatatgggttaaatgagctaatttaatggctgttgataactatgtatcattcatttaaaatctactgaatttcttctatgttcttatatttgaaaaatagaagaaaaataaaaatatttattctgtgcttacaacatggcatttcatcttttcctcaatattctacaggtttaactcattgaaatctatcaacagaatcaggttgttattaatatcatttcgattttaaaacaaaaaaaataaattgaggatatatttaataacttaatcctaattaaatgcagtctgccttacaccagagcttgtgctctttactattatccaatactgatataaaaattctaaaaagccatatattatcatgcacatacatttatacactattaaaatataaatgcatttgtaccagaatcataaattgaacactctgagttaggcatatttagcaccgtatctcaatacaatctacagtagggagtaatttcacattgccacacatgtttttataggctccagattctttacatatagagaccccattaggggtcacaaactcaaatgccttcaggaaccaggcaggtaacttaaatgagaaaagtagccaaaagtatgaaatgatagaaagaagtgtaagtaacaaatccaagagcacataactctgctgaagaggtcagctactactcacctctaaggaatattgcagtgtgggaaacaaaatccagatttcctagatatttcagtttttcaggaaaaaaagaaatccaaaatattttgtaaaatgtttgcaactagttagaaatctatcaaaccattgtgtgagcatgatcaatcatgtctgaagactgtattaagacaggagtaggtctgattattacttctgagcaagcagtttatgctggcagttctaaccttgtacccctaacccgtcataggtgtctgggaccaaatgactaaatttcccttcaacatgtaaatgagtcttgattatctttttacaaaacactagctacttcactagcgaactagcgaaagggatcattacagtttttgtatcactttgtcttttcttattggtcttgagttaaagaggatatagaagttgaatagaaatattttttgttttattgtttttgagtttttagcagtaaaattacatgataaaaatttctagaagtatgtatatgaaacttgcataactgttccctccctccctcccctccttccttccttctttcttccttccctctcctcctttttttctttcttttaacattgggccagaaacggttaaaaaaaagttttgataaaaatcaaaccacccggaacaagtagtaactatagggtgttatcccaacgagaagtataatcactaggcctcattctctgttccctgaagctcccatcatctcctctaactgctggactcagaagtactggagtcctggcctcaggacagaggagcttttgcagtgggactagtgctgaagcacttcctaattccaccatctgttgggagaaagctcctggaccatgatgtgggttatggatagggtgagtagtagggaacattagcaggatactggaaaagagaagaaaatgagtaggagaaataactctttattactggttctttcagtggagaattgttaggactgtctgccctgtcaaactgtcctcttctcacatgtctgtctcctggtctggtaagcatgtgcttcaacccaccttttctggctgacagactgttacagatccgtactattagtatcccttgaattttccactgtctcttatttccctacattcatcctgcccaggccttcaaaaatagacccttcattaaactgtcttcaaattatctgactcttgcagcggagacttaaaattaaaaaaaaaaatgtttcacatgtgcatgaattttctgccaggtccttactgatatagatccgaaaaaccatacaatcaggtgtcaggctgtatataccagaaatcggtcacactttacaaatatgatatatgatgtgaacaaaaacaaaagtgggaaaggaactaagtagtaactagtggaggatagattcagcagcctcagaggaagaccaaacataagccttcctatcttagggtagaaacaggatttaatcaaggaaatctcctgctcccgggatggggatctacattatatatacccaacaggatttcagaattggcctggacaattccatatgtctaccattactgtcctcttcaaataggaatttctagtggatattctgtatttttccatcatctatactgggtgaatgtgtttgctggatcactaaaacatcagaagttccctctagacctgataaaaagaacagcatgacatctgagatccaggtgttaactttgataagactttgttctatttgtgtggaaaataatgaaataaatatttggtaatcagaagtatagactggttagctgttcatccagctctttctgtcttcccactgggaacacacagtcgatttctcagccttctttgtagtttagtggagccatatgatggagttctgaccaacgtaaacttagtggaagggaaggaatgaatgttcttaaatttgaaggatagtcactgctttctcttcatcagaaagataggttacttattcaaaatactttaagccaggcgtagtgcctcacacctgtaatcacagcattttgggagactgaggcaggctgatcaattgaggccaagagtttgagagcagcctggccaacatggtgaaaccctgtctctactaaaaatacaaaaaatagccaggcatggtggtgcatgcctgtaattccagctactctggaggttgaggcacgagaattgcttgaacctgggaggcagaggttgcagagagtcaatatcacgccactgcactccagtctgggcgagagactctgtctcaaaaaaaaaaaaaaaaaaaaaagtgagattttgtgcaaaattctgactgaaatagtaggagctaacatttaaggtatctagaatatatccattttaaggttacattttattaacaagattttatgatgttaatacattttgaaaatatacttttatattttattttaaggatataaaaataaaaaacatttaattctgataaattaacagaagtcgcactaccgggagtagttgtcccacacttacctctaaatcattactttaaaatttttaaatctcctgaatgtgctaatgtctggtttatgtagaacacacacattttgactatgcaaatgaagaaataagatattacagtttacatttggtctttgacagaaattctacatcctaactctggtttgttttatcatctataacaaggatatttagctgtttaagattagtagattttatttatgctacttttccagtatagcttctgcaaatatgcaaatatttccagaaatttgcatgtcagtttattacaccaaatatttaataattctctgtgaaattatttaattctgtagcttaataactaatgaaagctttataaatatgtttccatcatcattgagattgatatttgtaatggattcaaattactaggtattgttaaaaagaagagaaataacatttgtgaagcacaaaattaaaaaagcaatggttggaaatttacatgttactatttctatgtcctttccatttattctcataagtttcttttctttcttcctctatactctcataaattttaaatagtgctgtccaatagaaatacaatgtgagccacgaatacaaatcacatatgtaattttaaattttctggcacccacattagaaagataaaaataataagattaattcaataacacatttaacccaatatgtttaatatatgtttagtaaaatatcattttaacatgtaaagaacattttacatatttttatcaaagtctttgaaatctggtgtgtattttatacttatagtacatctccgtgtgacctagccatgttgcaaatattcaatagctacatttggctgatagctagcatattggacaacccaactttagagatattcatcatctcctgcttgaactgtctttcctaactaactaactggtctctgctgcaaactcacattttattaaataaaagaggtgttttaatagtccatttagataattatgtattttcttttttaaatactataccaaaatttagtttccacatgaaatctgaaaccatgttcagttatactacaatctatttgtctgtcttgtactttttttttcttttttgcgatggagttttgctcttgttgcccaggctagaatgcaaatggcgtgatctcagctcacagaaacctctgcctcctgggttcaagcaattctcctgcctcattctcccgagtatctgggattacaggtgcccatcaccacacctggctaattttgaatttttaatagagacgaggtttcaccatgttggccaggctggtcttgaactggtgacttcaggtgatttgcctgcctgagcctcccaaagtgctgggattacaggctgagccaacacacccggccattgtactttgaattgattttttacacgtgcataattttttaacatcctgcattggccacttggaaaatacaagtttactgaacactgcagatattgtaaatatcaacacacttcattacacaatatcaataaataaatcacattatttaatacaaccactgactcatcaagaaagtctaaatattcggaagctagtcaagtttacagtgacaggtacatttttttaatattctaatttgtgcttcaaagcttcagtattatcattagttggttgttttcaatgaaatgacaggctcccttcatccattttgtgtaaatgcctaccaaatatttaagtttgaataaccatattttgtctctaagttgctctttcatataaaaatgttagtccataaaaaaagcagcttgttcagcttgcatagtgcttttccttgaggcaaccatcttccacatacagcagatgtactctatgcatacttctcatttcatcaacaaaataatgaaaaggtgtttaggacactttcgttgataggttagctagctgcctagatagatatacagtatttactaagggaatgaatgtgaggtttaggagagaaaggagtcaagaaattttttgcctaaggaactcaaagtgatttggtcatcaaataaaatgaggaagactacaggtggaagaaatgtgatgaagaagagaaatccattaggaaacactaaataaacaccttttaaaaatattcgggtggaattgctacatgtacagataaatatgcaaatctggtgttcaggaatgatctttagtgtaaagatgtaagtatgagcgcttttactatgtagatgatattttaaagttatgggactaagtgagcttaacaagtcagtgagtgcagatagaaaagagatttaatgtctgagccctgagaaacctcaatactacaaggtcaggagaagaaaatgaaccagtgaaggagactgagaaggagtaaacagtgagatagtaggacaagggagtatggtgggtggtctgaaagcatagtgagggtaatagtcaagcattgctgatggttcaagtaagataaggactggcatcatcagtacatttcctaacatggaagtcattggtagcatcgacaagaatagtttggaagagtgtttggagagaaaacactcttatgattagagggtttaagagagggtttaagagagggttcaatagtgagaaataagtcaaatctaacatagaattttgctaaaaagaagaatagaaaaatggatggcagctagaaggtgatatagatcaagggatgttttataatttttggaagatagaaaaaaagcattgttgtgagaataatctgatataaggaggaaatttatattaataatgtagaaaagaaatgggagagctgctgaggcaatctcctagagctggcgagtgggaattgaatctactgcataagtagaggtacaggctttagataaaaacagaattcatctaaaggagccagaaagaaggcaaagaatgttggtctagatcctggagggtaggtaaatttagtggcaggagtcatagaagtgtccttctaaatgctttagtattatttttctgtgaaatagcatgccagttaatcaggccatagtgagaatgaggacaaggtattggagattcaggagcagagaagattttctaggacatcgaggcaaaatagagtgattactgaccaaagcaaaagctcatttggagggtttgttttagtcattaatttaaattgatactgatgcaggagaacagggtctggaggcagggaacctaaggccaatttgtgctgacttcctaaagctaaatcaaagggaaaacaccaaggtctggggtcagggaatctaaggccaattcatgatagttttctaatggtggattaaacaggaaactcctgggtctgggggcagggaacataaaccaattaatgccaacttcctaaagctaaacaaacaaacaaacaaaaataccatctccccacaccccacctgagtaacaaaggatcaaaggctactctccctaaaaccttcccccttcccccatgtctcagatggaaagggaaagtgccttggagtggctgtgggccaagcaggggccatcctttcatttgcttagggcatcaatccactcaggccttgggtcaattcagctcagcctttagcctcaggccaaatccttcatccagataaggggtagcccacagggacctcaaaaggagtattaaaacccagaaaactttgtaaccaggcccttgagtcacttgcttgagtccactcccaacttgtggagagctttcttgctttaataaatccctgctttccgaggttgcagtgttgcagtgagccaggatcgcaccactgcactccagcctgggagtcagagggagagtccgtctcaaaaataataataataaaataataaataaataaataaataaatgcccactttccttgctttgttcctttgtttcgttcctgtgttaatttgtgtgttttgttcaattctttgttcaaaacaccaacgacatggacaattcacactcaaagccgtcatgtaacaatactatagctaggcatggtggtgagtgcttgcagtcctaggtgctagggtggctgaggtgggaggattgcttgagcccaggattttgaggttgcaataagctttgattacaccactgcactttgacctgggtgatagaaccagaccttgtttcttagcaacaacaacaacgatactaattatagaattttgtatgtttttgcagacataatcagcatggatataggtctggagaaaggagacagttggaattaaccaaagtggaggttttgctaagtgaatatgacatagagaaagaaagcaagaaagttaaattttatatgatgtactgcttattataattggtaatgcattataaatccagtaaacaagaaagagaacatgagaggttctcatgagagaacacaatggaagttaaaattattcggctaattggactggacatcctggtaggaacaaaagaatgatgggtttagctgcaatgttaattaaatgttatggacaaagagtgggaggtttgaaatggaggttataaaggtaatggcaaggtaagccaagaacagaaagttaaacaccacatgttcttattcatatgtggaatctaataaaaagtgtttaccgatcttaatttgatcaaaaatttatgtcaaacttaatatctcctatgtcaaaagcttcttggcttagagtggccttcatttactctattgcagctttactgttaaaaatgagaatgctcctggaggactgttttggccacaatcatggtgattgttcttcaccattatctaagaagaaaaataaagcattgatgtctgcatgtatatgaaggttacgcttgtccagggaactaaatgagaagaactgcgaaaaaatgaaaatttatgatgtaaagaacaaaagacaacttattcttgatctgtttttatgtgacaaatatttctaatgaatatactttgtattagattcatcagacaaaactccaaataacccatgctttcaagttggtaaagagtccacaggatatatgcactggtgttaaatattttcaatacaagctaatatcaaacttccctttcaaatgatctatcactaaacttctgcactgcctaagtgaaaattagaacagtgatattattgactatagccaaatataacttagtcaaggctaaacaatgtcatcattgggaattttgatagaacaaagaaataaatactattggaacaaaatttgtccccaaacattttctttgttttctcaattacaaaatgctgaaagtaatttaaacaaataatttcatagtttaatttctatagtataactctgtgaagcatttaaaatttttatgtagcactggacaccctatattaaacatgagctttgaagacaaaatagaaatccagtgcttatacctttgctgttacaatcatattttttcaaatattataatgtttttctcaaaggtcaagaaaaataaacaccttacggtgtttttgtaaatatatatatatatatatatatgaacaatatatttacatattcctaaactatagtgactaacaatctgagtgaaaataataattatgtttttgaaaacccgttttaaattaatcttagaagttctataaactgaaaacactgacctatggctagtatcgtagctacttccctttcctgaagttttatctacttacgagtacatcggctttgccgctcagtcccttcccatagtcgtcagttgcaataacttgaaacttgaagtaggatctcctcatattatggaagagcatagcagttttgataagccctgtatatgtttccactacaaatccttcttttccctctttaattggtggtattatgagtctgtaggccatgacactataattgccagtatctttatcagtagcctagacggaggggaaaaaaaaagagattataattaagcaggaaaagataacccttatgaaatggcttacttttgtttgtaagaatgaggtttcttatgtaataataacacaataaagccctcctaaatgtctgttttttctggatatagttatgtagattaatagactttgtgtccacagtttcgaatggttgctattagaatgataataactgctgaagtatgaataaaagggacataggtataattctgtaccctttaacaaatttctccctacccctcctttccttttacccttaccagcctccagtatcttgtattctacactttatttttatgagatcaccttttttttagattccacatatgaataagaacatgtatgtggcatttaactttctgttcctggcttatttcatgtaacataatgtcctagatagggagaatatgttctagtgctctataccactgtagaataactacagttaacaatagtatatagttccaaatagctagaagaaggatatcgaattttcccaacacaaagaagtgataactgtttgagatgacagatatgctaattaccctgatttgattgctatgcattatacatatagaaacatctatgtacccaataagtaagtactattattatttgtcaattttaaaaatagattttaaaaaataaacagacatagacactaacagagtcaatgaatcaagacttttggtttacaggtttgttgagttcaactgtgtgtgctgatccaaattggttgaaagatgggattggttgtttacctaatgtttgtcttgctgtaataggcatacagtgtgatggtatttttgatgtagtatatagcctaaggaggataaatataaaagaacgtagtaaaatatctcgaatgaaataaaataaagttgagttataacaaatttagagatgcataaaaatattctaattaattaatgccataacataattctctaattagagttagaatactatccgacttcctttttaatcatcctgtatcccgattaaacatatttgttcctggtgataggtacttatgatccacatattaaagtttcctaccatttagaattaaaaaggactaacacattgtttagatttttttcatttgtttttaaatacagctatgagaatcatatattgggctggctttatggtgtctaattaggggtaattttttagaatgtctatttcagaaccatttcatagtgaaatacttggaaaataaatggtagataggagagttttagaggcttgataaaagactatatataccttattcatgatactagatatgtaagttatacattttcatttgttataacaatgattattatttttattatccgattattcttatttttacctatgctattattattaagtatgagtatgcatttatgatctgccattactaagaattgctaagaatcatacaaaatacaaaatacaatcacacaaaataacatcatacaaaaatagtcttatctaataacaatataaaaaactgaggaatatattgttttacttatataaattagtgatattcaataaaattttctgaaatgatagaaatgttcttaaccagctctgtcttatgcagtaggtactagccaaatatgacaaatgaaaagtggttgatgtgacaaagaaactgaaatttcaattcaatctaattttaatttaagttacataatgaaagactacataataagtagtaaagttgagacacaaatgattaaaatagtaaatcatagcaaatgtgtattaaatacagcatcaacttgatttagcttcaaattctatatatattgtgaaccatttaaaacgtttccagataatcatatctacttgttagaaaaggtaatttaaactactcaacacagataatttcacttcaggatcagctgtttcatgaattttctagggagttaatattctcttttctttatttttttctctgtcacccaggctggagtgccatggcataaactcggctcactgaaccttagtctcccaggttcaagctagcctcacatgtcagcctctgagtagctgggactataggcactccactacgcctggctaattctttgtagacacagggtctcgctatgttgcctgggctggtctcgaactccttgactgaagcaatcctcccatcttggcctaccaaagtgctgggattacagacatgagccactgtgccaaacctaaaattatctttagaagaggacaagctcaaactaccggctaatcactttagatagtttatatggcttacagcatggcagagctcagttttggtattagagtaatagtaattagttatcaatgttaggtcacattctcacttaaaggaaaaagaaaatgaacaaagaaagaaaaacagtatcaaaattttttgtacttaaactttgaaccacaggtttataatcactcaacaaaggatagcataagatagaaaaaggcatattcccagctaaaataagtcaaagtctgagtcaaggtatccaagacatttcttccacatagaatgagcaaatttgggcctaatgtcagatcagtcagatttggttacatattattctctatcttcttattaacatggatatttctatgaaacaaactttttattattaatgtaaactttataaaggaataacaaacatgcaaaaagtgtacaaattataaatgtaaagctcattaaaattttgcaaaatacacacatctacatgaccagcatttacatcaagaaacaaaacaagccaggcatggtgactcatgcctgtaataccaacactttgggaggctaaggctggaggatcacctgagcccaggagcttgaaaccagcctgcacaatatagtgaaactcttatctcttgaaaaaaaaaaattacccatattccagaatgcacttcatgcacttggagtcacaatctgagaccttcttaaggaaaaccactttcctaatctaacattgttgattagttatgcctatttttaaaactttacattgactgaatcataaaatatgttctattttctgtctgacttctttcattcaattttgcactgtaagattctaagcccttatatttaaaataaatactgtataacaacactatcacatttggaaaagaaaaggtggttaccataaaatcaccacagtgattgcttggtatattaagctactttacacagttctgactgattaacttccaatttcagtaagcaggtaatttcactttgcaatattcctaatatattaaattatgataactacaaaatagtcatattccatcttaaaatattaaagtgttctgttaaatgtgcctttcctgaaacaaattatcacttaatgcaaaagtttgggtgtggaactagacaatttaactcagaaataactattttcttttatgatttttcatataaatgccttaatatttgcagaaaatagtcaagaatgagataaaagtttttttaaaaatcttgtctactggaattaaaaaaaataaaaccctattgtcatatgtatgttatacagtaaggactctaatttttatttctttgaatgaatatgatagtctttgggatcttagagatcttatttcaggagatattcatcaaagatgattgccaggatcattagcatatttttcaaatctcccctcttcctcaagtatgttcagttgaatactagtaatttaaacagtgactgatgaaaattccaatgggtgccatacttaagagcaattgcatggatttttaatttttagtctccccaatttataacaaatacatattttaaaatccgaaacctctcctctaagatgtgactctgattgatgtggagcatatgcaataccatcatacatagataacaaccaaatgttctttctataaaatcaataacaggatacgatatctttaaatacacactgagtcacaccagagataccaataataaaattcagagcgcagttttaaatctgggtcaatatgtgaaaaataagtgagagtttcagcacagagtatattgtctctatttgttgttaaataattttaaacttacttttttgcttgttttttgcattatgttttggagtgaggtggactccaatgtcaggtgtgactttgaaaaattaataactcaaggccgggcgcggtggctcacacctgtaatctcagcactttaggaggctgaggcgggcgggtcacaaggtcaggagatggagaccatcctggctaacgcagtgaaaccccgtctctactaaaaattaaaaaaaaaaaaaaattagctgggcgtcgtggcaggcacctgtagtcccagctactcgggaggctaaggcaggagaatggtatgaacccgggaggcggagcttgcagtgagccaagatcgcgccacagcactccagcctgggtgacagagcgagacgtcgtctcaaaaaaacaaaacaacaaaactaataactcaaaatttcagatttctttattcataagataaaaataaggatgcccaaaaatagtattttaaaattttatatatattcatacgtgtgtgtgtgtgtgtgtgtgtgtgtgtgtatatacacaaaaatataaatatgaccaagtccagtgtaactattatagttacctaagttgtcataatggtgattcaaaaggtttaacattttttcatattatgtttatccatgaatatgtaaatttatgcaatcaatttagacccttattacttcagacatattatcacacaattgtaactcccttataactctacttttcttaattttcttttccagctctcctttattgcttccagttcttgttttgttttgttttgttttgttttgttttgttttgttttgtttttgagatggagtttcactcttgttgcccaggctggagtgcaatggctcgatcttggctcaccgcaacctccacctccctggttcaagcaattctcctgccttagcctccccagcagctgggattacaggcactttgggaggctgaggcgggcggatcacctgaggtcacaagttcgagaccagcctgaccaatatggagaaaccccgtctctactaaaaatataaaattagccaggcatggcttccccctcatttttgaagcaattttgcaaaacctcttcctcagttgaaatccatgaacttttgtacagtacacactctacccctccttgttgccaaacataatgaggatgttggtatcttgctctcagtctaccccttctacttcaacttcctccctctttacaaatttcagtattcattgagatgacacatccagcaacttatttttaaagtattaggcatgaataacattcatcagtctttgaacgacctcactgcatcgatttaattctacagtcacactttagtcttttgccttagggagatattccgcttaaagaaacactccatatttaatttatatattaaactttcatgtctaaattctgaccacaactttaatcatcatacttagttaagacctcttctttgatatcagtgaattttcagttctgcaaactgccttttgctcccattacttcagggtttatgtccctttctgctttatcatagaagtcagagttgatcacattgttctcatttctctctccttccacaacacctggatctttctcctcttggaccaaactaaccatcagtttactcctggtgactgaagagggcgcagagaaattaaataatcagtcagactagtgttactgtaagtccatggtctctgagtttcactgtgcctttgtctatttaggaaatccttgctatatgtaataagttctctttctcactccagaagtttgcctttttctttagttcacagattctttcagtcttctccagagataaggaagctctaattcccataaaatttgaggatatcaaatgtgagatctctcagcttttcatcacataactaaaaaagtacctatatctgtacttactttgactactttcttcaaatctcagaggagcagctgacacgtatctctcactgaaggtacttatgccttaatctgaatcactcccatcccttctgcatttaatgcttcatcagctctattgatctctgtccttttcacctctcctctacagactataaaacacgttatgtctctctcattaaaatgaaatgaaacttttcttttactgagtccacactcgtgacactagcccccaaacttccatacctatttttcacagttaagttcctcagaaaatttttatagaatcaccatctgtaattccttactttacaatcatgccttaaccgcagccagatctctgcccctgccatgccatttaatttgctaacatcagtgactgaggctggactccatctcagatcaacaatcagtctggtgttctttaaattaccaagtccatttatgttgtttgtataatgctgttgctgcttccgctgtttgctaacatttattgaacacttacaatttgccagatgctatgtaaatacatatattattacattatctcatgacatcctttccattgagtagattccattattattttataggccaagaaatggaggcacagagagattagtaacttgttcataatcacacatatggttgttagcacagtgggataagtctcactttaaagccactacattccacatgtgagactaaataccagggataaaactgcagtttaaaaataaaacaacaaatgttcgataaaatattctaagaaatcttcctagatccatcaagaagatggaaagacaataaatatgccagtcaaaaacaaagtgctatggactgattatttctccccaaatttatatgttgaaacataatactcaatgtgatgtcatttgaaggatgggcctttgcaaagcagttaagttcatgatggcagagcccccatgaaacggattggttcctttttgaaaagaggccccagagacttcctttgttccgttttgccatgagaggacacactagaaacgcagccatccatgaaccaggacggcctcgctaggcacttaatctattagcaccttgatcttgggcttccctgcctccagaactatgaggaaaaataaatttgtcttgtatataagcttccaagtctatggtattctgctatagaagtctgaatgcaaaagtaaaggtaagaatataaaaaccatagtactgatgggagctttcatttagaatttttttgttttttttactgacctgggtaaaattaaaatttaacttgtctggttttcagtagctcagacaataggaggcaaggccccaagcctactcatgaaagtgagtctattaagatttccctccccagaaagttaaattctcaccgtaagagtaaaggagaaatttacttttccccctgctaccactgctactatcaccccaaactgcaacgaaaactgtaaacttaaactttgctattgaggggagtgaagagaaaacttctttgagaatctaggacgaaatacagcccctcattttagtttgcagccattatttgccggccaccagtttgcccaactcaaggagaaatcataatattccattggtaaagtctaataggcctgatctccacctgaatggacagaaaaaccacaacctgagaatttaagagaaatcatctatgactgaaaatggcctggtctcctgcctgacagaagcaggtgctttttcaaaaacccctcctgcaagccatgcctaaaataattctaacaaataaagttccaagaaagatgaaaagttataataattatcaaaacaaacaagaaacaatcataaaaaagtccgttgagataaaaaaatcaaattcataacaacatagactttaaatatttgaattagtagacactgaatataaagcaaatatggttaatacatttcaataataaagagctttaaaatgcggaataaaaaatgagactcgttgaaaagaaatgaaaaagtatcttttagaaataaaaaaaaattagaattaaataccccaagatgggattgttagcaggttaagcgcagctgaccagggaattagtaaatgaaatgatagggcaaaggaaatgacacagaatgtttcacagagctacgaagatgaacaacctcaaaaaaaaaaagtttgagatatggagtttagaatgaaaattttggcaaatatctaatcagagtttcagaaagagagaaagcgagaatagaacagaattttccagaactgataaaagattgttatccacagatattaagaagcccaataaactgcaaacaggataaataacaagtaactcacacctagaacccacatgtcatatagaaactacagaaccacgtactgtaaatataataagtattgttttcttaatattttgggaaaattcatagagatattttagtaatggcataaataattcataaatatattctataatttattaatagtaataaggagatgtctaacaagttgggttaaattaatgcataaaaattaaaactgactcactgtggaaacgctaaatgaatacaatttactaaagaattaatatgatattactttttccaccaatttctctataatcaaacatttatgctcagttcacaacaaagtcattaatatctgggagaggtgactctggaagatttgattcactgacttttatgagtttcccttagtgaacaaaataaaaaaaaaagttagtctagagttcttttaaaagaataaaagtcagaaatgaatattataattatacttgctataattatattttaagtgaaagcttagatacaggaaaccacttacccatttctaagacctcatctggaaattttaatggatacagatgtacaacattaaaagaaaatcaccaaataattgcctctatcatacaggggagtaggggagaccattaattttctaatagcctaaataactgttcccctctgttgcctaaatgaataccatggatgcagaaatattagtgaaataattagtgatgtcctaagaactttcaaacccattaaagttcagtaatgccaagtttaactttagcttctcaattagacccattttaacatttaacggtattgaaggctcacttaccctgaaatagagtgaaagtgttttagactgtctggataaaaatactcaaatctcacatttccacctaccaaggtcactatgtcaagtttgcaaaaagcaaaaataacagagctttggcaggttagaaccactttaacttgagtcttgtttttttttttgtttttttgttttttttttgacacagtcttgctctgtcaccaggatggagtgcagtggcatgatctcagctcactgcaacctccgcctcacgggttcaagcgattcccctgcctcagccacctgagtagctgggactacgggcacccaccaccagatccggctaattttttgtattttaggagagacgaagtttcgccatgttggccacgatggtcttgatctcctgacctcgtgatccacccggctcggcctcccaaagtgctgggattacaggcatgagccaccgcgcccggccaactcttgtatttttagaaaccagaaagaaatctttattttaaagtccttaaagacaatatacccagaacatgataaaatatgaataagaaaaatgtcaggtagattgatctacttttagggctattcaaaacttttgcaaaaaaaaaaaagaagaaacaaggagagaaagagaaaagaaacattttaaatatgcaagctcaagtgtttgattttgcataagaatgtcaaacagtgactacaatgcaatattaataatttctaagttcaacatacctatttactttttgtagagttaagtaaaagtctaatataattctgagagattctaaagagtaaaatacaactcattgtagaaacagcaatgtaataatggaaacacgccagtgcaacaataatagagacatgccatcatagtttgaattacaaagacctttacagggctgggtttcggttagaatttatcaaaatttactcttaatttaaatcatggtgcaaaaaattacaggataacatctatttagaaaattaaagaaagaaactaaagaaaagccaaatgttccttttattattttaaaaaattatatggtaaattctgaaccatagaaggcttgagagtacaaaacaagcaggacttgcatgtatgttataattgaagtttccttttttattttttcctttcttttaaaaatgttttgtaaaataaatattaccctataaatggttttgctttttccgtcattattgctaataataaaatgattatacctccctcagagatgctttaaaataaactctgagctaattgttctaacttttcaaccatgtgaaaaagaaaaaaattgtgctctattatatagacaagttaacaaaagaaaacacacatgtaatttatgctttttacttgagaggaaacactagtttaaatgttggtttggttttgaatcacaaaatgctattaatttttaccgaaaatatccactcttaaacagcttatcttttacaataattctgtagttatacatcctaaatccttcagcattcaaagcaaattaaataacatacttgttatttttgaacttcctgatttttccttagttacattaggttcaatcagtccaaaccaaattcagctgctgcttcttggctcccaccttgctgtccctcttctgactatcatatgtggttctccttctgttttttctttttgcataggaagggcaacaccatctatgaactgaactgttctaaaaaatttcagcatcctccccctcggtttaatctcacctcctggctcctccctacttccagtccatcagcaagcattctgatttctacctatacaatatttctcagttctgtataatactttaggccaagcttacactggccaatttcaggctctcatcagatctcacttttaactctagcgatagcttaaaaattactgatagctcccacttgccagagatgaatgttaaaacaagtcctttaaatattctcaatctgattaaagttcatgattccaactttttgctttacatttattctacttcccagaaccatattattttgtttttctgaagaatgtgttctttcaggtttctatttctttgtatacattgtttcttctaccttaaatgaaatgtcttttgtctgctaggccaaatgatgttcacttcttggctatactatggcacacacacacacacacacacacacacactttgaatatatatatatatatatatatatatattctacatatacatacagtaaactatggcatacacacacacactttgaatatatatatagactatatatattctatatatatagtctatatagtctatatataatagactatatatactcatataatatattctatatatagtctatatatatactatactatggcgtacacacacgttgaatatatatatatatctccatatatataaaatgtgtgtgtatgccatagtatagtatatatataaatatataatatattatatatatacgtgtgtgtgtgtatatatatatatataataaaacactgaataaagcaatcaaacctcagcttaaatgaccccttttctgaaggtgttcttatctctactagggagtgctgcttctacttacatattttcattgttatgttacataaatgtgtgtgtatatattagcatttattatgacacgttttaattttgtgtgtccattatacgtcaaatttgtttcagttcatatttttcactgtggtaccacgtgcagtcagtggtcaaataatatttggcttaaatgtctatagaagactatcatagtggttgagacatcaataattagaattgaaagatttgagtttagttctaccacttattagatacatgagcttgggcaagtgattctctaaggctttgctcctcatttgtaaaatgaggaaaataggacatgctgaataagttggctgtgaatattcactcgggtgtaaaatgcagtgcctggtacaaagtaaacctaaatcaaggttagctgttgttttactattgcatttactactgagatctttgaatactttgtagctatcttcctgatctcttctatttgttctttttttttttaaatcactttttgtacacttaaacgtacctttcactttctgcatcgtgtcactggctataaattctttggaagcaggaccattttctgaatcgtctttggatctcataagtctcatggccagtagaatgtaattagaaaatatttgctaaagaataaatctgccactgaggaaagtatagttattgatgtctctttactgaatgctatataatttattgatagcaaagcaaaagcacttaaatagaaaatatttataatgatacagatataataagatgcttataaggagggtgggagccaagaagcagtagctgaatttggtttggattaatgaagactaatgtaactaaggaataatatagaagtttggaagtttgaaataacaagcatgttatttaatttgatttgaatgctgaaggatttacgatgtatacctacagaattattgtaaaaggtataccattcataaataatttaagtataggcatttttggtaaaaattaatagcattttgtgattcaaaaccaacattcaaactaatttttttctctcaaatagaaagatcaaattatacatgtgttttcttttgttaatatgtctatgtgcctcagcctctcgagtaccagggactacaggcgcgcaccaccacgcctggctaatttttgtatttttagtagagacaaggttttgccatgttggccaggctggtctttaactcctggcctcatgtggttttgccatgttggccaggctggtctttaactcctggcctcatgtgttccgcctgccttggcctcccaaagtgctggtatcacaggcttgagccatcgcggctagccgtaactttatattctatacttaaaatttgcttcatgataagctgataaatcctgtttgtaatttctgcattttgtatttgtactttttcattcattttaaatcttcttcatgtaaaacaaatattttgtactccaatgcagtgttcaatattaacttgtaatttctgaaaattttactgagaaaccactggaatatttagaaattcaaataaaataggtgttatgcatattacatataatgaagacttcacagttcataataaacatctattttaaaattacatggccacagattcaacccatgggcccaaaatttgcaacagagcaggaagacttgtattttaatatgctaacagtacaagtcatttgacctagagataaaacaatttaatattttaagaacacagggttcacgaagcaaacttgaacttactgtaaaatgaacttactgtaacatgatttcaaatatgaatagtgtataagaagtctattcatcttttaatttctaaatttaatggaaagtcaaaggaaagtaatagcagggcaattgaaaattaaatctgaatgtcgaatcctctgtaaattctgacaattttactgcctacctaataaatttacaaacagaaacaaaaagctctattacaaaaatttttaaaaaaacctttcttattgctttcatagtaaaagagtatgtcgaggcaaatataattcaatttataaatgttttaccttggaaaataaatttataattttcaaaatagactggatatatagggctatgatgaaagtaattattaccaaacaaaatgcctttagtattgttataatgacactaattgtaaagaagactgtatttatggactagaatggtactatttgtacatgggacaataagatctgtctcctcgaatttatataattgtaacatgttaatataaacaaccctcaaaaaaacagtgtctgtcctcagtgtccttcatttaaattgatggtattttggagctctccctcgtgctctctctctctctgtatgtgtatgtgtgtgtgtttaaaaacacacatatgtatatatcacatatgtatacacatgcacacatatatagttatttttatattttataacatgatgtattttgtgtcatgagtaccaacttacaagtttgctaaaaagaaatggctccaacaccagtaaaatttcagtgaaatagtcttgctgcatgcagctatactacctaaaatttcaggatttgttagccagactcaaatactgcatgttcttacttatacgtgggagctaaataatgtgtacacctggacatagagagtggaataacagtcactggagactcagaaaggtgggagggtgggagagggtgaaggatgagaaattacctaatgggtacactattagggcgatggttacagtaaaattgggaatttaccactacacaatacatccatataacaaatccacttgtaacccctaaatgtataaaaataaaaaaagtaaaaataatcattgataaaattttcttagcttaggcagcagaaagtaattgagcatgaccaaaaacgtttatgccaatagagcaaagagaaaaactgagtacacataataaaatttatcttttgaagttcacacctggactaaattattagacatacataatttttaatcattgaaaaaaaccaagccaccatgtatttatattcttaagaataatatttctaaaatgtgtatgctagattacttttgtctacataaaattatacatatttttaacccttgcgatgttttgatgtgaattgtggttcacaaaatatactgggaactaagtaaaaaaattacaacaggtaaatgacacagatctgatcaggactgagatgaaatattgtggaagcatccatggtcagagattgcagtgatttttatctgaagagttggccccaaaacaatttactatacaggatgattaacattacaattccattttgagataatttggtaaaatgttaatattatgaattgcccacttgcttttttttttttttttttaacatggagtttgtttctgttgcccaggctagagtgcaatggcacaacctcagctcactgcaacctccgccttctgagttgaagcaattctcctctgttgggagaaaagctgagtgttgggagaaaagctgagtgttggcagagaagctgaggcagggcttgcatgtctgtgagacttgctggctccttgcttctagcactccccttatctcaagcagacatatgtttctcattcacttgatacactgtttcctttcaacccccacatccacatcaccttttttgtttgtttgggcaccaataaatagcatgggctcccagagctcggggcctttgcagcttccacactcgtgatggccccctagtcccactttctctctcaaatgtctttttctcattcctttgactctgctggacttcgtcgcccccactacctggtgttgggtctgatcaccccaacattcctgcctcagcctctcaaatagctaggattacaggcacgcgccaccacgcatggctaatttttgtatttttagtggagatgggggtttcatcatgttggccagtctggtctcgaactcctgacctcaagtgatctgcccacctcagcctcccaaagtgctgggattacaggtgtgagccaccgtgcctgaccccaactgctattttttaaaaatatggttatttttcatgaaccactgatggaattgtaatacacgcatatctctttgcaaagttattagaatgtatttgtttttccctctgtttttcttttaaaatattcccaaatcatttacatctaattattaatgttctgtattatgtgtaaagatgaaaaattgtaaaaatgtaaatggccaatagtcttttataatgtgtttaatatataaaatgctttgtgcttcttgctttttagaaaaataccattaaatgcaaatggaccaaggaatacaaaaactttataattttatccatttacaggcatcattaacacattggtgtttgttcctttatgtttttttgatgtacatatgtatatacatatatgtacatacacacatatacatataggatattatgatcctagtttactgaaagaatacacatatgtatacatataaaaatacataagaatacacacacatatatacacacatatgcatacacatacatatgtgtgtgtattctatgtattcatatatgtatatgtgtgtgtgtattcttccagcaaactaggatcatgccatcctatagctttgtaatccatttttttgtcattagccagccattaagaatttttttgttttaaccattttctattttaaacatcatacaacagaaagagtaggataaaaatatcataatgatcaggtaaaattatttaaagagatatatttttttctttgcatcatcatctcctttttctcttttcttattcgttaaatctttgtttttacaaatccctgtgctaagggctgatactcggtagactgcagggaggaaactgctctgccacttaaaaaacactgaccaagaagcaggtcatctacactagttcctcacaaatgtcctttgtatggcaggaaggaagatatgtatgtttttaagtgaatacatacacatctataaattgttgtaaaataacccccagagaacaccaacattaccaaagcttgaaagatagtttctaaataacattcacatttaaaaggcttttgttttgtttgagatggagtctcactctcttgcccaggctggagcgcaatggtgtgatcttggctcaccaccacctccgcctcccaggttcaagcgattctcctgcctcagcctcccgagtagctgggattacaggtgtgtgtcactgcacccggctaatttttgtatttttagtagagacgggctttcaccatgttggccaggctggtcttgaactcctgacctcaggtgatctgccctcctcggcatcccaaagttctgggattacaggcgtgagccactgtgcctggcctgtttttgtaaaaaaacaaaacaaaacaaaacaaaacaaactggtttgtttttatttgatttggccaaaaaatagcactgctcaatctgtctttaacttacttgcctttggccaacttgctctaaaccaaattgttcttcagccaaatctgcaggggctgacactgacaactactggggcgattaaatgcaggttgagttttgtactgaaaaggagtaagagacagaagactatatttgaggaagatctgggaaatgtaagaaatcatctgaaagttgactcagtgccctgctctgttttacaccctttaacaaagagggtatcataaaaatttcttaattctggtagttagaaagaataaaagtcattccgtgggtgccatttctaaaccatggaagattaaattaatgaccccaaatcacacagttggtgagcagaacatatagtctttaactccaagcccccatgcagagttcgccaaaaaactgactgtactgagaaaagtatgtggtgggctgaagattattatcaggttccttggttcagaaacagataatacctgtactgaacagatagctttcattaaaaattacaatctaatatttctcacatttttccctctgtgtagatactgttaagtccagtaggaattagattaagacaagcagctttatctctacacctctttttcaggacaaagcagaagacaaaactggcaggacacagagttgcttgtatccttattagtgatgctacttcattaaatttcatgttgaaagataattcaatgatttaattgcatttaatgctaatcagacccttataaatgtaggtgagatacacattctcattgtattatttttcatttctcattagttacccctaattttcatgatgattactaacataatataccattaatactctcaggaggtggcagaaaagattatgtgtcatgctgtgattcattaatgccagagaaagagctgcttcgtttttcaatattttataggtaattcattctttaataatgaaaaataaattttctgccattcagaactttctatcaatacatttactttgaaaaatggcaatgttgaccatacctatatacaatggggtacttatggtctctctataaacattcttaacttgctggcctttcccaggctgggcttattttttatatagattgtgccccctccttctaaagaaaacttatttaataaatttcactgccttttcccttttttcctactttaattaagagaacttcaagatttatttccacttagcagatgtacattaattagtataatataatttcactccattttatgatatactgtggtataaggaccaaaaaaccttcaatatgccttttaaaaaaaagaaatattattttaaaaactgttctctggataaatttatactgatactgcttgaagactgtttgaagtgtttccagctgtgctgttagggtttgtttctcaggacttcatgcctgtacatatagagataattatttattttttcttaagcttaccatactcccagaaagaaaaatatcaagctacagataaccattgacaacaagaaaattctatgcaaaaatactttataacatggtgctaagataatactactcatttaaaacatataaatatgcctcacacattttaatctggtcagtattcatataagagaaccaactatctcatttaacatatacaaggatttagaaaagttatattgagtattcctcagtggaataatattttcatgtaaataatacactaaggtgtatctcaaagagaactcatctggtgacttaatggaggaatctattatgttgtattcagcttcttataattattccttattctactattaagaagacaaattagcattctatactaatgctgaaggtgaattctggaaagagaggcccagtattcagttttaagggcaaagaaaaatggctgtgtgttcaataaaactgtgtttttaataacatgtatgcactgtgcatgctgtttgaaacattttgattttgagattactatcatcttacagggaaaaagaacaactcaggtaacaggtaacaatgactattgagagatctattgagagaatgtctatttagagaatgtctaagttcagagagaggaacgaaccgtgctcagtgctttatgtgcattttctcatttatattcagataaaattcattagctagtgttgtcatcactctgcagacctgttgcttacagaaattaagaaacctgtccactcctggttacacagcccactcatggttaaataaaacctcacatttgtccttattatgcttttggaaaacggttagacttaaatatatcaaaactttatttttataatgtcctttatatattatattcattaacctttctttcacagtcttccgatttagcatacccataacatttggttaaactttaatcaacattgacttaaataaaatgttcttgtagtaattcctatcatgacttcatgtttttggggcaggagctgctagtcgtttcctgcccacatgtatgcctcttttttttttttttttttttttttttggcacctttgggctcagccgcatcttacactcatatcttagctctgaaccagaatattgagcccaaaaagagcccattcctcaaaagaggttgtttcagtatcaactggtcttgttctattcaaatgttacttaatctcaaagtgaatatgttcagagctcactgccttctgggtctggaagccacactgtttactttttcctatgatgtttgttctctgctgagtgtcgaaatccctccaactgccttttctaagatgcaggctgttccctttcacttatttttattgcccattttgggctctttatcaacgccctatattataaaacatcagcaaggactgtgtctgtgcttacgtttttgaaggatttatgaatctgtttttgacatgttggcatgattatgcaattttttcaggtccaaatgatactatactagctcatgatcctggattctgaaaccaagaaccaaagtaaacacatatgctagttcatactgactttcattctccctaccaccctgtctttcagatccaacctaaggtatttgattactggcacctctcagctactaccacctgtaatatagtatttcgtcttcctaaaacatgcattcttgctataaatgacaagaacactatgtggcattgttttaccaagcattaaatatcgagaattccttaacattaagtaaagagaagactaatatttagatggaataaactatgctaaccaataagaaaaatactagcttatccccttttgtcagaattattttatcttccatgaagaataacttaaaattaacagaaagttgaataatctttttccttttccttttaatttcaagcttgttaaacatttttagaaatgtaatatacatttctaaaattgtgtctctacagcttcacgtttcttctttgtttctacagtactctcatgaaaattcaattctcttccctgtatttttaaaaactcattaaacaggtcgggcacggtggctcacgcctgtaatcccagcactttgggaggccgaggcgggcggatcacgaggtcaggagatccagaccatcctgactaacacgggtgaaaccccgtctctactaaaaatacgaaaaattagccgggcgtggtggcacatgcctgtagtcccagatactcgggaggccaaggcaggagaatggcgtgaacccgggaggcgtagcttgcagtgagccaagatcgcgccaccgcactccagcctgggcgacagagcaagactccatctccaaaaaataaaaataaaaaacaaaaaacaaaaaaacaaaaactaactcctaaaacataggtaataaaagaatacaggatcttcaaaaaaagaaaacagtcattaaaaactacagaaatactataataatttgacatctactccttaatttggcagtgccatacaccatgggttgtaagaaagaagagaatatatagtttaaaaaatgctattaatacttttctccagcccctaacccaacccactcatgcagtttttcttcatagaagaagagattttgctggtttgtttaaacacagaccaaaaatatgttcacctctgctcaatattgtatagctgacattctctttaaatatatctgtagaccaattggatacaaataaacattccaacactatatatacatatatatatatatatatgtatatatgtacgtatatatatgtacgtatatatatatacgtatatatacatatatatatatattccatatcagttgtttggggtttcttaatattacaaatttgtcttacaaattacataggagtagaaattctaggtaaggagatatgcataagttcagatgtaatagatagataatatcaaactttttccaaaatgtcttactaatttttatcccctcagcaatatctgagaacttcagtcgcttcacaatttgattttgtctgttttttttttttttttttttttagtcattgtgatgaacatgtgttggtttcttatggtttgttttcaattccctagcagttaagtttgatatatatatatatatatatatatatatatatatatatatctcctgtggaaattgataagctgattctaaaccttatttggtaatgagcacacagagagagccaagagaagccaacaaaccttgaagacaaaaaaataagcagaagacttacactatcagatattataaaactatagtaattcagatagcagaatgatgcaaagacaaacaggtcaatgaaatagaataaagtattcagaaataagcctttacatccatgaccatttgacttagaacagagagaacacgtcaagtagagtggagaaaaaaaatggtctctttagaaaatgatgctggtcaattaaatatccacatgggaaataaaaaaaaaaaaatcttgacctcctacatcactccaaacacacaaaaaaatcccatatggactgtaaatctaaacataaaatatgaaataaaatttttggaaataaacttaaaaaagtcatgtttttgtgttactcaaagagcttttaaacaagacaaaaagttgctcaacatgaaaaaataataaattgtattaaaagtttctgctcatgaaaaagcataaaaaatagggtgaaaatgcaagccataccttgggagacgatatatccaatacatatattgaataaagatatgcaatccagagtatataaagaattctaaagacttaatgagaaaacaaaacaaacaacagaatgtccagagaaaaatgttagaaagagaccaaaatagtcgccacataaagaggatacaaatactggcaaaaaatatataaagagacatttgactatcttaactactagggaatggtaaacgaagcacaagaaaccatcacatgttcatcacagtgactaaaaaaaaaaatcagacaaaatcaaattgtgaagcaactgaagttctcagatactgctgaggggatataaattagtaaaacatttttgaaaacagtttgatattatctatctattaagtctgaacttatgaatatccccttacctagaatttctactcctaagtatatttgtaatattaagaaaccccaaacaacttatatggacagtatataggatatattaactgtaatatatttgtacaatgaaattctctagagcaatgaaaatgaatcaattattactacatgcaataataacatagatgaatctcacaaatatagtgtgagaaaatgaatctaaacaaaaaatacaattttcctaagtctataaaaatatcgtaaacaagaaaaacaaatttatggttggaagtcatactagttattcttacggggatgtggagcaggaactggtaatgctctgtttcttgacctgggcactggttacactaccgtgttcactttgtaaatatttatctagctgcacacttagaatctgtgtgattttgcatatgcaggttgcattatgtatgcagcttgtaataaaaattatacatcaaaaatattcttttaggctgggcacagtggctcatgcctgtaatcccagcactttggaaggccgatgcaggcggatcacaaggtcaggagatcgagaccatcctggctaatacggtgaaacaccatctctactaaaaatacaaaaaattagctagacttggtggcacatgcctgtagtcccagctactcgggaggctgaggcaggagaatcgcttgaacctggaggcggaggttgcagtgagctgagatggtgccactgcatgtccagcctgggcgacagagtgagacactgtctcaaaaaaaagaacaaaaaaattcttttgatatcagcattcaacatatcttggggtctattggcttcaggtgttgatagtctttcaaattactatgagcctcactgacttttgtccttttctagattactgggtttctaagagaccataaatgtctagggggagaaatcctggaaatgagtaaaatgaaacattattaaagagagaattatctttataaaaactagtgtagctaccacataaagtttctggatcaacttgatggagatgcctagtttagatgttatttttgttcactagaatgcatttttgtgaatccaggcatttcattgcctgtttttgaaaaaaaaggaaaaataaaaaaattttaaagtctctgcaattctcagattttcagtgaattacaactaaccagtgcaaattgtattctctttatgcataaaatctctctccaggcctgcgggtttcccttaaggtaaattaattgaaactaataggaagaatcatttatttcttatggcttatttggaactaaactttcttcataacgcattttaaggaactcttgtactttaccgttcttattggaaatattgatagacaattcaaaattaagatacatttatagaagtatgaataaacaatttttaaaagctcattttcctcattttttccccttatattcgtgttatagatctcctgtgtcaggtcagtacagcacaaagttaatggaggttcaagacattacaggacatcttcagacaaaagtaatttttatttgcccaatttatcttctgaattgtgccttgcaatgcagccttcactttcagaaaaattctgagattttcaaagggagaaccaaatgtcagtattcttgctctacagatgatggaggatgtggcctttgaaacataatataggagagtacacacaatcatcactactctaaaacttataaaacctcctaaaagtaaatgcaagcttacctccaaaaatagtattccatacctataccttggattgttacacatttaatcatctgagagatacaaagacatttaataaatttctaatactgctagagtgcactcaaactttaaaatatatgagccaccagcaagtttaggaaaggcaaaattatttggccatttaccaaataaactactttattttcatgtatcatgtccaatggctcttcaaattcataaaaagtccttaaactctctactttaaaaataaagtatccaggctggtcgttgtggctcatgcctgtaatcccagcattttgggaggccaaggtaggcagactgcctgaggtcagggtttcgagaccagtctggccaacatggtgaaaccctgtctttactaaaaataaaaaaaaaaaaaaaatacaaaaaagttagctgggtgtggctttcacctgtaatcccagctacttgggatgctgaggcaggggaattgcttgaaccagggaggtgaaggttgcagtgagccgagatcatgccaatgcactccaccctgggtgacagagcaacactccatatcaaaacaaacaaacaaaaaagtttccagttatcagagcagctttacatctatgttttttttttttttttttttttttccaagacagagtctctgtcgcccaggccggagtgccgtggtggcatcttggctcactgcaacctcagacgcctggattcaagcaattctcctgcctcagcctcttgagtagctgggattacaggcgcctgccactgcacccggctaattttttgtagtttttagtagagactgggtttcaccatcttggccaggctggtcttgaactcctgacctcgtgatccacccgccccggcctcccaaagttctgggattacaggcgtgagccactgggaccggcctcatcgattttgaaacatccaagcttccctcattcttcagataattatagtctgggaaaagtagtccgatttctattataagtaatacgaattaaagcaatttttaattaaattacattcaaattaataggcataaattgtttgctaggagaatgatattttttggtgtcccttctacaataacaaacaaactgatttgtgtggagagggggaagaagagtaaaacatatgcagaattatttcattgtatactcaactgacatctaaaatagacttcatcttgtccacttatattaaaagaacataacaagaatgttttacttgttcagactaataaggagaaatgctatgtatcagcaactggtaatgttttttatggttctcaactagtacaggagaaaatgcaggattagactatttgaaacggaatatcaagtttcagttatataggaggaataaggtaaagggatatattgtacaacatggtgactatagtaacagcgatatattctttaaaaataaaatacagaatacagtgtagaaacagaatagatttttttgtaatcatctgtctgcatttgtgccacagaatttcaaaatgaatgtgaagtattttctaaaaatatatgatataatctaaaaataattgaaagaaaagatgatagagagtaaacgtaaaatatataaaggaaatcagagaaagtcagtataccacaatttgtattgcattcatcttctaaaattgccaaagatggatcaaatatttgactttgagtgtcggtggaaaaaaacaaaaggaaaatattaagtacagtatagcctgtgatcatataacaaaaatagcccagttgttcaggaaaaaaaaaatcttcacatttgatgtcaccagtgaggctaaataaatgtaaaactatgatacatggataacattcataaagctgtcatcaagtctgagtttctaatttggcaagaagtgaaacccacagggaagtccagggtgatgttattctgtgttgtaatcagcccaaaagagtttaatgtaaaatgtattttactaatttgaaatgatcattcatgcaacatatgttaaacaggttaaaagacatgagtatatgtaaaaataaataaataaaattttaagaagtcattatatgaaaaaggtacttgcacacacgtttatagcagcacaatttgcaattgcaaaaaatctggaactagcctaaatgcccatcaaccaatgagtggataaagaaaatgtggtatatatacaccattgaatactagtcagccataaaaaggattgaaataatggcatttacagcaacctggatggagttggaggccattattctaagtgaagtaactcaggaatggaaaaccaaatactgtatgttctcatctgcaagtgggagctaagctatgaggacgcaaaggcataagaataatacaatgaattttggggactcgggggacagagtgggaggaaggtgaggggtaaaagactacacaatgggtacagtgtatgctgcttagatgacaggtgcaccaaaatctcagaaatcatcactaaagaacttatccatgtagccaaaaaccacttgttctccccaaaatacttttttgctaaactttttttaaaacccaggggtacaagtgcaggtttgctatatgggtaaacttgtgtcaggggggtttgttgtacccaaaaattattgaaataaaataaactaaattaaaatcaataaataaaattttaaacaaacaccaatttgaaatgttaagcccaatatataatgtctttaagttgatgggaaaacataatgtctgcttagatgaaatttaaattctagtaggaaaatcatgcacacagataaacgataacagtataattggtttaagtgctaaactagacatatagtgattcagttacagggtcatagtcaagaaggcaatgcaccctcagacacctacatatgtttgctttgttcaaagtacaaaccacacaaggtcaaacaccgtgccaaaacatgaaggaaaccagacgagatcgggcgcattcagggtggtatggccatagatggaaggaaaccagtgattagtaagaccttgtgaaaacacctctcccttgaaaccatgagagagtttcctcatacttggcaatggggaaccaaaattagtgttttattggacctttacttcaggctggttcttgtttgcatctgttctatatgtaactaggaagaaaattgtcacaaaataactcactagctttcaagtaacataaaccacaaatactgtaaaacataaatggtgattttgatttcagaactaagtaatctacgctatttgacctctaaaatgtggttctcaagtataacagttgtcacaggacacttgacattgtaacagtaaataacacataaataagcaaaccatcagcttaaagattttaaagggcacctgcttctacagcaatatttatgtgagaagatatctgtggcacagagtgatggagcataaagtctcacagagagataagagcatgcccagaactaaatccaggtgattagaatgtcagtccagtgctcttccactggaaacgtggttgagcttggtctcggaagcagaatgccaggctgtaaattgtagcctcactcccaattagctgcacatgttgggaaggttacttattgctcctgtgatgcactgttctctgtaaattaaagagatgctacttggggaaaatacattaaaaattcagaaatgtgctggagatgttttacctaagacccaggtgagcaggtatagggctagagaccaggagcccccaggagcccccaggagccctaacctctgtctagaaacattatgtattaccctacattgttaaccttgtacatttctataccttttgctactaaggaaatttgcatcctctgaccatgactgtggcttttttctatctacggcatcactctgctgaaacctctcatcaccagtttgtgcttttgaaaatgtaataaacaatcagccattaagtgttaagtcttttttcttgctgctttttcacaatattattttcttttagtccataaatttcttaaatttggcatctttaataattcaaaaatagaatattcaaaatctttttaactttcagtagagatcaaatcaacattataactcaattcttctgacactgtttttccatatgtgcaacttgtaaagaatgagattaatcctcactgcattaacttctggaaaatatcttcataattcagagttttttaaaattaatcttgatcacatttaacatctccctgtatttgcaataaatgctatttttgcagttaagacaacatgcaataaactggaaaaattagttaacaatttgaaaagtgtttttaaaatcaaatcttacttgttaccttaacagggggtgtcacaatttacacagttcatctcaagttgaaaagaaatcggttgcctttttacttgtctcctaatttttcacagaaagttagtatgttctcttattttctagcaggattctacgcctcatttctcctgggaagcaatgtaagaggttacaagaaaagttcttgaactgaggtagacctaactttaaattccaacttcactgggtatttggctgagtaatactaggaaagttatccagacttactgagcttcaattttcccaaaagtgcaataagaaataattgcatctactgcataaatcaatgtttaaatttacttgttttattttaattgatattattttatttattcattttatttatttatttaaagagtgtaggctaaaataagtaaatgacatttcacagttctcagaaaaataataatgacaaataaaccacagttattattatgaattagggaatatttatccattaacatttcttcaaagcccagcagaaacaaaaagttaatgttcaaaggcctagcttcaactttccttcttcacacaaaaaattacaaatattacaagtattcatcactttttctatttcttttttgttgactacatagttgcttttttacagttctttctatattctggatactgctcctttgagatatatattttttaatagatgtcgtgagtatttgcttttaacatattgcttcactcagtcatttatagcacccttgttgcaggagtctgctattctgatgtaaccatattcatcagtcatttttcattagtgtaggacaggggtccccaaccctcaggccatggacaactaccagtcggtgacctgttaagaactgggccacacagcaggaagtgagtggtgggtgactgagtgaagcttcatttgtattaatagctactcttcatggctcacataacctcctgagctctgcctcctgtaagatcagtggcagcatcaggttcttataggaacataaaccctatcgtgacctgcgcatgaaagggttccaggttgcacaaaccttatgagaacctaatgcctgatgatctgtcactgtctctcatcacacccagatgggaccatctagtttcagaaaaacaagatcagggcttccactgattctacattatggcgagttttatcattatttcattatatattacgatgtaataataatagaaataaagtgcataataaatgtgatgcacttcagtcatccccaaaccatccccctctgcactcctgtctgtgaaaaaattgttttccacaaaaccaggccctggtgccaaaaaggttggggaccgctggtgtaggacatttcagttaatgatgttcaactaatggcctgccctagagaaggaggactcagaattgtggggaggctttttcaacatacaaggtaatgcagattctatatggcctcctgacaggctgagaggattagcatgttcccacaatgcacatcactcccatattgttgcaactggtgttttatgaaataaaatgtttaaaaacgcagtacatagtcaagaaaaataaattgactaatataaatctttacttctgaatttgaacataagcttcacattcataagagcttcaaaggaatgaattaaattaaatatagtttaaaaaattttaaagtttaaaacattttataaattaaaaatagtttaaaaaaggtgttcacattctttcaataaaagtgatgccctctctcctctttttctttactgtggtaaaatgtacgtaacacaaaagttagcatttcaaccacttttcagtgtacagttcattgacattaagtgtattcacattgttctgcaaataccactgccattcatgctcaaaacgtcttcttcttcccaaacggtaacagagtagccattaaacaacagcttcccatttacctcctcccacttcacccctaaaccctggcagccaatattctgctttctgtctttatgaatttgcctactctaggtaagtagagtcatacaatatttgcccatgtctaggttatttcacagagcatgatgtcctcattaatccatgatgtaacatgtattagaatttatttccctttaggactaaataatattccattgtatgtgtatatcacattttgtttattcattcatctatagatgaacatatgtgttgtttcttttccctttttttttttttttttttttttttgagacagagtctcgctctgtcgcccaggctggagtgcagtggcgtgatttcggctcactgcaagctccgcctcctgggttcatgccaatctcctgcctcagcctcccgagtagctgggactacaggtgcccaccaccacgcctggctaattttttgtatttttagtagagacgggggtttcaccgtgttagccaggatggtctggatctcctgacctcgtgatccgcccgcctcggcctcccaaagtgctgggattacaggcatgagccaccgcacccggccccatatgggttgtttctaatttttagttgttgtaaatagcacttctatgaacatgggtgtacaaatacatgatcaagtctttggtttcaattattttaagtatatagtaagagttatattttaactgatattaactaattgttttaaagactaaagaaaaacgaattaccattggattttcttttcgcactcctcataattaaaatgactgattacttgtcactaacggaaatcaacttcgtagaaccagttgtgacacagatacccagcatgaaaccatagtaaatatagatcttctcagataactttttgttctgtgcacttttgatacaattcatgtacttaaatgtgacatgagccttcaaattattgagccagaaatcaagtatctacatgtctgtatatatctttgtcctagaaaatcctcaggagacctcccttaacaatcactgctcaaaaatgactcacatatccacgtgcaaaccaatcatttgcaaaggtaacaggacaggcatgattggctctgaccagccatttttcaccactttggaataggcttcacttcccctgaagcacatgatccccaaaaataatacctaaataaaactgaaattctgttaaagtgtgaggtaggagaaatagccaactaatggtgtctactatactcagacaatgtgagtatattaaaaccagagacttcacctaaattaactcagtggtacaaacagaataatttaaaactcaccttcacctaaatttcagataattatattattttccactcactatagtataaacatgaactgaaactaaattaggtattttgtccatctagatttaattataacatatgtttttatttatttactttttttcgggggggggtggtctagtttactagaatgtggcttctgtaagggtagagagagcctatttttgttgcttccatattttcagtacagagtaagaacacagtatatattttctttaaaaaaatgaacttagaacctaagtttttaagtatattaggtataccacttcagagcagatatacaattgtctttattatgttattacttatattggataattcacttcaacaatgtttttattgtgtcactttacctgtagcatattttaaaaataatgccccaaattcactactcatcttttaagctaatatagccttattcactgctatttcaaagtcttatcttactttgtcaatcttattctatgtcacatttcttctttcccttcttacacaaagcacatatttacatttaacttttatcattctgcgttatatcatggaccaaaaaaaattaacttgtatgcatggtagatgatctaccattacctaatattgtatagcaattggtagaaacacctctttcacaatcatgggctacttcccatttttaaaatcatctttccttccttcaaacaccacagctgaactggtcctgattcagtgctgtttgcattaatatttttgttgctctaagtataaaatgagaagaactgcttaactcatgctctgattaaattctggaaaggagatttcaggcttcaaggctaaaggcagcaactggaattgttaaacattaagtatttattactcccttccgctcgtaaatcccttgcctcctatcactcagatacgctctgcactttgtttcttctgagttttggcttacttagtttgtttcctctacttagactgtgtcttcctcacatatgtttcactttggaaaaaaaaatctaaccacccttcagtgctagtcttaaattcttcatcctccaggaaacctttatgttcattcaccaactgaaatgttttcttcctttgaatccacaagacaatttgcgctctgctacttgactttattattatagcatacacttgcataaacacattctttctctctctctctaaactttctctctctctctctctctctctccccccctctctctgtctgtctctctctcccctctttctctcactattgtataaagtacctagtatattatattgcatgaagttggtttcctagaaaggacccctttccctagtctgaattacccactgatagtttgaagggggagggttccttagagttctcagtagtctggagacacaatcaatcccaacactgtatacttcatctgaagaagtccatgcattctgtccagggcatatgtcctcaccctgatgcttctttcaatgcaatgtctttacacaccttattaagactcagtttctcacctgacttttacactactaccaaactttcgccagaatcccttggaaatcacagaccatcatcaacaaaatcccctaaatgttcaactttccctctgagtattacctatactttttgattccttctttctccctctaaccatcctcgacaaaagatgctgctttctgtagatctcccagtagtggctaccataatttacatagcacagagcccaggagtacagggcaagcatccttctgtctcctttgacactctgtcccaattcctctgaagtaaatcccatcagataatgccacccactaaatttccttgttatagtcatcacatgccttttgagtaatctcctttattaatggactagtttaacatttggcttatctttttttcctacatcacactataggattagtaacataagtggtgatgtaaaaatccacaagggcattctaatcacagtagcatctgacagtcaacgatcctcttttatcaatcttgttctttccatggttcagggaccttgcattttccctgtattcctgtcacctcatggcagcaacatctcagtatccccaaacccttcttctcctgatctctaagtgctgaaattcccaaagcttagtcttcgtattttttttgtcaaacccattttcagggtgatttcatcttggccccttatttctctctcaagtctagatcagcatttgcaaatgccttgccaagaattaggtttctgtattgaaaaagcctcccaaaccttgattactgccatcacaataggcagtggaggaggtatggggatctgttcaggacaaaaaccaccaagtcattcttgatttttcctaatgtcccatgtatgattcatcggcaaatcctatatgttctatcctttaacccccttctcaaggtctccatagcctatcaacgtcgttcaagctaccgtcaaatttttcctggactcgtcatgcattaaactctacttgtccaaaacactgtgttacccattcccaacatcccccatgcagcatctacaataatctttttatattggatgatgtcataactgtttaaatcattcaaaggctttctttccaacacacctagaacgaatcccatattctagccccaggtacatttctgatctcatttcctaccagactttttcattcacactagcctccagctccctgtctacctttagggctttacagagaaatcccagaatgctgctcacttaagaatccatgtcttgatcttttcctttattcaggtcactgtttcagttttatccaaaaagaactatcttaactttcttatctaaaattgcaccactctcattcttcccttatcaaacttttttgtttccttagaatttatcactacataacttactcatctattcatttcttcaactagtttgtctgcattactcgggtggaaactttgtttgtttgtttgctttgtcaattgctctatatcaaacttctagaacagtgtttagcacattataggtactcaaacatatttgactaaatgatagaactaaatcaattaagagttaatgagactaaaatataaaataagataaaaatcagctacaaaggattcctacttgtggataacaacataaattaaatgtaatgaatgacagatttgtggactacttttagttaaactggtgattcaggtcaggggtctgtacttagcatagtggaagagctattttgcaagcccaacccaattaggttgaattttttttcttactgagagtgtttgataggtgataaaactacacgtaagaagagctctaatcatggtgctcctggtaataggaaaagaaaggcaattactcatgtgcaaaactagaagcaatcaaaagctagatttgccagagatgtttaggttttatgtgcaatttacagctatttacaagttaaccattgaaatgctgtccaaaattaactccgcaattgagaatccaaaatgtttagcatctaaactttttcctcagtaaaattcaatctttaaaattttttcttagtaataaaacattagtaatacacagttgattagaaatagtcataaacatttgattataaactattataagagtaattagtaataaacatttgatgataaataaagaaaaaaattgaaaacttacaactttggtcttagatactgcatttttgaaattccaagtaagccaacattctctgagacatcaaggtttttgtaacttttagtaaagtactaaaactggtagtgttatttttttactttcattcaatcagcatttaaaattcacaatttcagaaaaaaatggttaatttattccactatttcttctattagaagtggtaattttatatttgtcattagagatttcattttgagaatcttttgagttatcctactggaggaatacaaaccattaagaaaagatatacatttcaacatcttattcaatgtaaaacatcgtaagtattttgttaccattttcatagtaaaatgaaactcaagaagttgcttagtgtttacctgatataatctgtattgagtttagataactaaactaatatagctccaagtttcaggcttttgtttatacagcataagtatgcagttaatgcaaactacaggcttacagcttatctgcaaaacctgagcttttactttagttctgtatattaacataattccgcataccttcactctgagtacagaagtaaacattcttgcatcttcagatacacctccgatgtagaattttttctgaaacactgggggatgattattttcatcctgaatctcaatgtatactttagctgtattgcctggaggacaagaaacgatgcattttttattggtggttattcatgggggaaaaaatgcactgaagtaaatatttgctgcacttttttttggaaacattgaaaataaatcaaaagccatttctagatgccatgcctagcacccccaaattcaggggacactgataatgatgcttctggtataaaaatgttaagttgctgttatttcttttaattacaatgtcctggtagttcactttacttgatttaatttggcactaaaatactgcaccctgttaattttaatgaaacaactctactgttcacgttcacaaacacttcacacacaataccagttataccaaagggacacaaatatataaaccccttatgaaatagtagaaactgccataaactattatatgaatatatatttattcttaagtataaaatcagcaatggcatttctttagcttaaaattgtacaataacttttatgttttaagactaaaagtaacagtgttcgggtgaggtgtttatttccacaaatggaaaacaagttttatcatgccttggaaactgtcaatgttagaggctaacattcattgaaaacaatggagctgaagatatgattatgactcataaatgctgcattttaccatttaaataacagtaaatgtaccataaatgatatgtcatcatcaaatgttagaacctccctcaaatcatcacacctttaatgagaaatgtggtacttgtcactagtccaataatgaccttttaaaaaacaatttaatatgtataaaaataacttataaaccaaataaaatgggaaataagtggctattcattttgtaaaaaaatagtcaaataagtattgctaatgtattacataagtcgacttttctgattcatttcagttatgaacaaacggcaattaacgtacatactatttatcaaggatgcccttattttggtgttttacctgtgtttaatgcctcctgtacaattttaagtaattaacaccagcctacttgcaggatacatcatgggtatacatttgtatttgttgaataaattaatgaatgaatagcttgtattagtaagaacttagaaatagtcttttttttttttttgcttgcccttggaaaggtcagacagaacagtgagttaacctcaagattttgctcctatcctgctgctactcattcagcttttctctgtttgtcatctgtgacctggaagaggtagaatcaagaggaaaatcatgctagcgcaacagattagagaaccaacagcgaaatagggctaatagcagattatgcttctctatcctgcagtgccagggctctgacttgtaccttagtcagccaccacaaatcagaattcacccaaaatgaaatcatttttagttcagtagcagaccacttttatctctagaataaaaaatgcgaacagctctaaatttaaaaataaaaaggaattttagaatatgtcacctttccaataacttctttgcactttcattcagaaacatatacaattcaaatgtgctatttcttttcagaactcttagagtgacagaggtctcggaaaaatactgatgacgtatattttcttctttaaatgggatgagtcatttaaaatgttatacaatttgcaaagaacaagaactttgtcatgacctgttcccttacctcccaaccctaacttcatatctggatggtaaccaaatcctacatgtcagcctcataagcaggtaaatcatcacctaataaatatatcttgtgtcatttttctctcaactccacagctgcccatatacttaagtctgttgttgtctcacctgagtgactaaacgtcatctgctcccctgtcgtgtctttctaatgtgtcctgcattctgatataacaaagacatcacaaaatacaaataggatacattaaatcaaatgttaaaccaaccaccattcatatgtacatttttttctttttcttgttttttgagatggagtctccctctgtcgcccaggctggagtgcagtggcacgatctcggctcactgtaagctccacctcccgagttcatgccattctcctgcctcagcgtccctaatggctgtgactacaggcatgcgccaccatggctggctaattttttgtgtttttttagtagagacgggatttctccatattggtgaggcttgtctcgaactcctgacctcaggtgattcacccacctcggcctcccaaagttctgggattacaggcatgagccaccatgcctggccgacaattcttaaaaataccatgtgtatattcatatccatacttatatgtatactttgtgcatataagtttaagattcaaataccaaattgttcctatgaaagctcctttgattcagtggcctgtatcagatattaagtggtttgtgggaaaaggcctatggataacccaaaatatgattatataacctgaacataatggggagagatgattatacttaattataatattttaattaaatgatatttatttatatgaaaactaatgactatacaatacaaaattccagaatacttcacaaccagcacacaaacaaaatctcaagaacattgtttagacttaaaagaacttatacatttatttattttaaaaagccacgatcatttagttcttttcacaaaagagaaacagttataatgcgatttataacaatactgtatcatgaattttgaaatttatgatgttagctatatagctaattatgtaggatagtttgtaatagtcaactaaaaataaatataaagttgtgaaaaaggtgttttcattaagtttgtgacttagatgttagaataaaaaaaattgttaacttttattttccataatgtaaaatagactagtcttcctttttttttgcttctccctgataactttaggcagttgttatgtatccctcctttgaaatgctatagtgcactaaaaatgtttctttctataaataacctttccagagcttggtttacattgcatttagttataagcatgattttattcttattagatttcaatattcttaaagatggaaattgtatctcctacatctatcagtactataatgcctcagtttgtaggtaatttttccgctcagatattattgtaacaaaatttcttaatttttgttgaacaaaaaagttgatattcaattaatttgttagctttctttgattataatcatgagattatgattaactgaaacaaaaagttaactcttagaaggatatgagggagctcactaaatcaaagtgaagtaagtccaaagaaggcttttggtaccacaaaataatcaggaagttgtagagcctttaaagcagcagatgtttgattttcttgcagatgaaataacagcaaactctcttcttttatgttattttaccccaccccttattcctctttttttttttttaaagaaacaaaccaaaaaacaacccactaggcttaagaatcataccctggggacacattacctgactgtcctagtttgggtcatgtgcttgctccttgtctcgggaaggagaagtcaccagattatccacttgagaagtcactgggacaattataagaaattgtagtgtgtctacttaaagaatgtaaaataaatgttggccagtaagaaaaggaaaagcaaataagtatacacctatagttaaatcactagaacagcgttctttttgacttttttattcatgtgtatacaatgtacatgacatcatcaatttccttggctcacgtgcttccccactaaggattgtaccatgttcttccaccaaatttggatattgattatttcaaggcagaagcttggaagcaactctgatttaaattcttttaagatagcctgctttttatctccttgagtacttacaaaaactttttttccatgttgtatcctttatttaatgtagacatcaaacacataacaaaagaaagatactagaaagagaaaggaaagcacagatagaaaaataatgttaagggaacaacgtgcgtgcctaatatcctagtattcccctccagtctcccttctggctcatctaaacaatgcaagtattggaaagagaaccacaaacagtgaaagaaattacaaagtaggcaaaaaagttatttggaaagtgttttggttaagagacattataatttttctgtgtgctttggggcaccctgccttatttttcttccattattaacttttttctccaattttctatgggacaatcttttctttggctagaacttttggctttagtaagccagaagttttaaaaatgactcctgaggtaagaaaatgtgagataccttcttgcaatgttttaaagaaagagaaaataatacttttatgtagtcaagctcaggggaaaatgtaagtcttagtatagttacctccttgaatagcacttctgttctattttagacatttaaacatggtagaaggagttcagaagagtgattttaaatacccattaacctcaacttgactctatgatttttaagaccaaatttagtttgatttttcccttcccttacttttaataatcaagactgtgatgctagttttttctttttaggaaggccctattatcctcaagatgaatccatttcatttatccacatgactaatctagtgcctacactgcactggattttcaaagaaagccttactgaataagaagccaatgagttaaaagtgttctcaactgggatcaatttggctgctctagagccatttttggtagtcacaacagtgtggataggggaacgtagtgctactggaattaaatgagtagaggtcaggaatgctgagaaatattctgtgatgaacagaacaggctcttaccccaaacgaacaaacaaacaaacaaaatatttgggccaaaatgccattagtgatgaggctgagaaaccccaagttaaataacaagagaaagaggaattagatgagttaagataaaatggaaagtttccaaatgctatagtaataccctctcctcaatccatctgcatgcacatgcctttaatgtggaacttatcaaaatatgctgtaattatttgatcacacattggttatactcttttttgactgtgtcctataaagtcaagggctcaagcctgtttacctccactcttgtcactgccttctggcctctgttcctgacattctctccatctaaaatattcttaattccaagccatttctctagtcattgccagtaaatatacatcacagaaatatttattcctgtacttgggaatgtagaagtttagtctgattaaaaaacatacactagactatattttcctcaaaccttaaaggaaaggactgtgcttttcttattgttacgtatcgttgcctaacacattaaatgatttttaaaattgttatcatgataaatgatttatagattcttcaaacagtcctattgcagagaattttttaaatgcttggaataccagatttatatttgttaatttgttggtatcaggagattgaagtcagttcctcactttaaaaacacacaaacaattttttatgctgtttttcttttaagacaatttttgtttaagctttacgggtatattaattatggaagcattgtgacttccacatagtaggtgatatggtttggctctgtgtccccacccaaatctcatcttgaactataatcctcacgtatcgacggaagaacctggtgggaggtgatcagatcatgggggcagttttccccaatgtgttctcatgtagtgagtttgcacgaaatccaatggttttataaggggtgcttccccctacactccctctttcctgctgccttgtgaagaaggtacttgcttctctttccccttccaccatgattacaagtttcctgaggcctccccagccatgtggaactgtgagtcaattaaatctcttctctttataaattacccagtctcggttatttctttataccagtgtgaaaacagactaatactgtaggtgttcaataaatgttaaattaaattgtaattgctaccacttcactactcccaagggtcctcttaaataaaataaattactctattttattcctgtaaattaaatgaggtaacagatttttaagcatttaaaaatcaaataacagacacccccattccaagacagctgaataggaacagctccagtctgcagctcccagcgtgcttggcgcagaagacgggtgatttctgcatttccaactgaggtacctaattcatctcactgggactggttggacagagggtgcagcccacagagggcaagccaaagcacggtgggacatcacatcacccaggaagcaaaaggggttgggggatttccctttcctagccaagggaagtcatgacagattgtatctggtaaatggggacagtgccacccaaatgctgcgcttttccaatggtcttagcaaatggcacacaaggagactatacccacacctggctcagtgagtcccatgcccacgaagccttgctcactgctagtgcagcagtctgagatcaatctgcgaggcagcagcctggcagggggagaggagttcaccattgctgctgcttgagtaggtaaacaaagtggctggggaagcccaaactgggaggagcccaccgcagctcaacaaggtctgctgcctctgtagactccacctctgggggcagggcatagctgaacaaaaggcagcagaaacttctgcagtcttaaatgtcctggtctgacagctctgaagagagcaatggttctcccagcacggtatttgagctctgagaacagacagactgcctcctcaagtgggtccctaccccagtgtagcctaactgggaggcacctcccagtaggggccgactgacactgcatacaggtgggtggctctctgggatgaagcatccagaagaaggaccaggcagcaatatttgctgtgctgaagcctccgctggtaacacccaggcaaacagtttggagtggagctccagcaaactccaacagacttgcagctaagggacctgactgttagaaggaaaactaacaaacagaaaggaatagcatcatcatcaacaaaaaggacacccacaccaaaaccccatctgtacgtcaccatcatcaaagaccaaaggtagataaaaaccacaaaaatgggaagaaaccagagcagaaaagctgaaaattctaaaaaccagagcacctcttctcctccaaaggatcacagctcctcacaagcaatgaaacaaagctggatggagaatgactttgatgagttgacagaagtaggcttcagaaggttggtaataacaaacttgtccgagctaaagaaggatgtttgaagccatcacaaggaagctaaaaaccttaaaaaaagattagacgaatggctaactagaataaacagtgtagagaagaccttaaatgacctgatggagctgaaaaccatgcacgaaactacatgacacatgaacaagcttcaatagccattttcatcaagtggaaaaaagggtgccagagattgaagatcaagttaatgaaacaaagtgaaaagagaagtttagagaaaaaaagagtaaaaagaaatgaacaaagcctccaagaaatatgggactatgtgaaaagaccaaatctatgtttgattggtgtacctgaaagtgatgaggagaatggaaccaagctgagaaacactcttcaggatatcatccaggagaacttcctcaacctagcaaggcaggccaacatacaaattcaggaaaaacagagaacaccacaaagatactcttattccaaaattgaccacatagttggaagtaaagcacccctcagcaaatgtaaaagaacagaaatcacaagaaactgtctctcagaccacagtgcaatcaaattataactcaggattaaaaaactcactcaaaaccgcataactacatggaaactgaacaacctgctcctgaacgactactgggtaaataacaaaatgaaggcagaaataaagatgttctttgaaaccaatgagaacaaagacacaacataccagaatctctgggacacatttaaagcagtgtgtagagggaaatttatagcactaaatgcccacaagagaaagcaggaaagatctaaaattgacaccctaacatcacaattaaaaactagagaagcaagagtaaacaaattcaaatgctagcagaaggcaagaaatcagagcagaactgaaggagatagaaacacaaagaacccttcaaaaaaatcaatgaatccaggagctggttttttgaaaagatcaacaaaattgatagactgctagcaagaccaataaagtcttgcaccatcacaagactaaaccaggaagaagttgaatctctgaatagaccaataacaggctctgaaattgaggcaataattaatagcctaccaaccaaaaacaaagtccgggaccagacagattcacagccaaattctaatagaggtacaaagaggagctggtaccattccttctgaaaatattccaatcaatagaaaaagagggaatcctccctaactcattttatggggccagcatcatcctgataccaaagcctggcagagacacaacaaaaaaagagaattttagaccaatatccctgatgaacatcgatgtgaaaatcttcaataaaatacccgcaaactgaatccagcagcacatcaaaaagcttatccaccacgatcaagtcagcttcatccctgggatccaaggctggttcaacatacacaaatcaataaacgtaatccatcacataaagagaaacaacaacaaaaaccacatgattatctcaataaatgcagaaaaggcctttgacaaaattcaacagcccttcatgctaaaaactctcaataaactaggtattgatggaacatttctcaaaataagaggtatttctgacaaatccacagccagtatcgtactgaatgggcaaaaactggaagcattccctttgaaaactggcacaagatagggatgccctctcttaacactcctattcaacatagtgttggaagttctggccagggcaatcaggcaagagaaagaaataaagggtattcagttagcaaaagaggaagtcaaattgtccctgtttgcagatgacatgattgtatatttagaaaaccccattgtctcggcccaaaatctccttcaagctgataagcaacttcagcaaagtctcaggatacaaaatcaatgtgcaaaaatcacaagcattcctatacaccaataacagacaaagacccaaatcatgagtgaacttccattcacagttgcttcaaagagaataaaatacctaggaatccaacttacaagggatgcgaaggacctcttcaaggagaactacaaaccactgctcagcaaaataaaagaggacaccaacaaatggaagaacattccatgctcatggataggaagaatcaatattgtgaaaatggccatactgcccaaggtaacttatagattcaatgccatccccatcaatcggccaatgactttcttcacagaactgggaaaaactactttaaagttcatatggaacaaaaaaagagcccacatatcccagacaatcctaagcaaaaagaacaaagctggaggcatcatgctacctgacttcaagctatactacaaggctacagtaaccaaaacagcatggtactggtaccaaaacagagatatagaccaatggaacagagcagagccttcagaaataacaccacacatctacaaccatcttatctttgacaaactgacagaaacaagaaatggggaaaggattccctatttaatgaatggtgctgggaaaagtggctagccatatgtagaaagctgaaactggatcccttccttatatcttatacaaaaattaattcaagatggattaaagacttaaatgttagatctaaaaccataaaaacctagaagaaaacctaggcaataccactgaggacttaggcatgactaaaacaccaaaagcaatggcaccgaaaaccaaaatagacaaatgagatctagttaaaataaagagcttctagccgggcgcggtggctcacacctgtaatcccagcactttgggaggctgaggcaggcgaatcacgaggtcaggagattgagaccaacctggctaacatggtgaaatcccgtctccactaaaagatacaaaaaaaaaaaaaaaattagctgggcattgtggtgggcgtctgtattcccagctactcgggaggctgaggcaggagaatggcgtgaacccgggaggcagagcttgcagtgagccaagatggcgccactgcactccagcctggatgacagagcgagactctgtctcaaaaaaaaaccaaaaaacaaaaaacaaaaaaaaacaaagagcttctgcacagcaaaataagctaccatcagagtgaacaggcaacctacagaatgggagaaaatttttgcaatctacctatctgacaaagggctaacatccagaatctacaaagaacttaaacaaacttaccagaaaaaatcaaacaacaccgtcaaaaagtgggcaaaggatatgaacagacacttttcaaaagaagacatttatgcagccaacagacacatgaaaaaaggcccatcatcactggtcatcagagaaatgcaaatcaaaaccacaataagataccatctcacaccagttagaatggcaatcattaaaaagtcaggaaacaacagatgctggagaggatgtggagaaataggaatgcttttacactgttggtgggagtttaaactagtttaaccattgtggaagacagtgtggtgattcctcaaggatctagagctagaaataccatttgacccagcaatcccatcactggatatatacccaaaggatgataaagcatgctactataaagacacatgcacacgtatgtttattgtggcactattcacaatagcaaagacttcaaacccacccaaatgtccatcaatgatagactggattaagaaaatgtggcacatatacaccatggaatactatgcagccataaaaaatgatgagttcatgtcctttggagggacatggatgaagttggaaaccatcattcttagcaaactattgcagggacagaaatccaaacaccacatgttctcactcataggtgggaattgaacaatgagaacacttggacacaggggagggaacatcacacaccagggcctgttgtggagttgggggctggcggagggatagcattaggagaaatacctaatgtaaatgtcgagttaatgggtgcagcaaaccaacatggcacatgtatacctatgtaacaaacatgcacattgtgcacatgtaccctagaacttaaagtatataaaaaaaaataaaaacaactgcatgttgtttcaattaaaagcaatctattacaaacaacagatttctctaaaaagtttaactttaggaaaatattgactctgaaaccattttggaatttgatgggctatttgaaaacatcttgaagattctggtttttatatcattattaattgtctttatgttcccctgttccagtttgtattctggataatatctggttctataggcaaattaatgtttaaaacaaaatgatcatctgagataaatgcttaagctgttcttactaaggggtttatagatacatatttttgaatatacaggtggaaatacatatttttactacaaatagaataatttatcttaatttgtgtatttttaagttattcactaaaaatataaagtagaatttgagagaaaagagagaaatatgttatagtgtgcccactagacagaattaacaggaacaaaatatacttacaaaacatttagaaaataaattattaactgtattagcatgagaagctcactggttcttctcagcttttgctctgcagagattatatttagctatatttttatatactattcattttcagtggctaggcagaaagatagattgatcttttgtggttcatttcaatagttttcaaatttagcttggacatttaattaattagcctttgcataatattaattgcttgtatctagaagaaatattttgtgtatgtgtttggctgataggttaataactgaattgagtaaataactgctgtcactactggctccaaaatgtgacattcatatttccttttttttgagacagtctcgctctgtcatccaggctggagtgcagtggcacgatcttggctcactgtaacctccacctcccgagttcaagcaattctcctgcctcagcctcccgagtagctaggattataggtgcccgccaccatgcctggctaatttttgtatttttagtagagacggggtttcactgtgttgtccaggctggtctcaaactcctgaccttgtgatctgtcgcttcagcctcccaaagtgctgggattacaggtgtgagccactgtgcccggcccgtatttgtataatatataatacttgattttggctaagtcttttcatgaagaaaatgacaacactgacactttgtcattcctcagtatctgtgggggattggtcccaggacccccttctgataccagaatccacatatactgaagtccctgatagaaaatggccatagtatttgcatataacatatacacatcttcccatatcaatcatctccagataacttataatacctaatacaatgtaaatgctacataaatagttgcatactatattgtttaaggaataatggcaaaaaattctgtgcatgttcattgtagacacaaccatccatttcttttctgaatattttccatctctggttgtctggattcacgaatgcagaacccatggatacagaatgccaactgtatagtcatgaggaaataatcaggaaaaaacagtaatattctaagtattacttaaattttggttttgaatccattttaacatttttttcctcctggaaagattttatgactaaatttatctgcaaattgtaatcaccaaaataggagttaaggatgcaaaattgtttgttttcattggtactgccaacattttgttattcctgagttcaaacggatacatttaaaagcctctgcaaccaaatgactgtgacttttagctcagtttctgtgagaaaaaaagacactattttaaatcatttttatttattaaacactagctctctacaaaaagcagctattatgatattacaggactataatgatcaacaaaactgtagtagttgtaatctgggcaataaaactttaagcataaactttggaagcagagcctgggtctaacctgataataccacatgtatgctgtgtgaccttatacaggttacttactctctctgaggtaaagtttcttattcataacatgatagtaattttacataaataaccagattaaatgagcaaatatatgtaaggcattaaatacatggtagctttactatttcatatatgcctcagagattcctggctctcaaggcaggagggagaaaatattagtaacattattactaataccagaaggaaaaaaaaataccaatagcatgaaattgaaacaaaatttcctagcactaaattttaaaagaaaatggtttttatatgagatatataggaatatagtacacatcaaataatgtagtggaaaatacatatttttagtgcaagtaaaataattttatgaaatcataatgaaataactattggaaaacatatgaaaagtactgtgtcctattaaatatgcatacttttgtttacacaagaccacaaatttatagaaaatttatttcaaaagctgagagttcaagaaaatcagacagtatataatatttgacctaagactattccactgataatacaagccgaataggaattattgtacactgaattgcaggatcatagctgaggaagacaaaattattatgtctgaatagaccattaaatgacctctgaattctttgacatataattaaaaataaaagcatatttatgccccaaaactaatgctttgtttaaataaaaaaagatgaataaatttactaaaataaataaacaagctaacagaaaaacaatcaaagatgcaaaaagattgtgttgtggaaatgcaatttgctaagcacttgaaaagatacatgggctgtagttattgtcacatgggcagttttgaactttcatatatgcacctaaacacagacacacacacaacagatattaacactatgttcttttttttcttgagactataaaggagctgtttctaaaagataagagaagaatccatcaaaaagaaatgaacacactgatacggtttggatgtttgactcccctgcatctcatgttgaaatgtaatccctagtattggaggtggggcctggtgggaggtgcttggatcatgggggtggacccctcgtgaatggcttagcaccatctccttggtgatgagagatttctcactctgagttctcaagagatctagatattgaaaagtgtgtggcacctccccctccctcttgctcctgctctggccatataacgcactggctctcccttcactttccaccatgattggaagcttcctgaggccctcatcaagagcagatgccagcaccacacttcctgtacagcctgtagaaccatgaaccaagataaaatatattttctttataaattacccagcctcaggcattcctttgtagcaatgcaagaatggcctaatacacaaaccaaatatggttttccatatttaatgggaggaatggaaggtgcgttactctttcttgaagagtttctctacattagacattttacttccaatatttctttaaaaaccttgcaacaaatccatgaaataggtattttcattctgctttgtagataaagaaactgagactcaaggagattaaagaactagtcaactattatacagaagagccagacttcattcccaggcatggttaaattcatgcccaggtttctctccctagttaaaacaagatttgtaataacagcaaaggtaaattccattagacacttttgctcagcttctagaatacaggcaatcaaatagtagtactgaataaagaattattgaataaaacgatacgtctatttcaaaagacagacaagtacagttgccccttctatatttggatatcaactgaagagttattacaaatgaattaaaggatttataaatgtctatggtattgttgaaggaagagaaaaaaatgcctttcaaacaatgtgctaaattatttaatgctgctcaaataggcgcctctgtcctttaatgcaaatacacaaacacacacacacacacacacacacacacacacacacacacacacacacacacggataccaccatagcttcctattgcttctgtaatagattacggcaaaattagtggtttaaaacaacaccagtgtattactgtatagtttgtaggtccaaatgggtctcactgggctaaaattaagacgtagcaggtctgcatttctttctagagcctctagggctgtatctgtttccttgtcttttctagcttctagaagctgcctgcttgcattccttaagcttagtgtcctttcatcagtcgaatctagcaatggccagtggattcttctgttgcatcagtctgacactgactgtcctgccttctttcacttataaggattcttgtaattgcattgagtccacccagatagtccagaataatcaccctatattaaatccttaatccaattacatctgggaagtcccttatcttatgtaaattaatatcttcccaaatttcagagattagggcatagatgtctcaagagaagggggcatcattctgcctacaagaggcatattattgtgttcttttcaatgtaaaattcgaaggatctactacatttaaaaacagaaatgtgttaggatgttcccaaatgacaaatttaggaaaaacaaaattctgttttaatacaaatatgggagctctcaagctctttttatgtgcaaacaacatcactgacagaaagctttaatggtaatactaatcactgagaagtttctggaccaagtgttttctgtgcattatttcaatttactcctgtaataacattgtacatattattgattgtccacattttatcaatgaagataatgaggcttggagggattaaataacatgtctaaaattactcaactaggagaaggcataaataagattcagactgaacccgtaacaacatatagatgtaactatttcactttatggccttaaatttgagtcattttttaaaaacctgaagtaatccttggatttgtgatttatggggagtggggagcaaggcggtttatttctatagtgaaaaaaataatttatttgtatttaggtattaggtatttaggtatatacttctatgcctaggaccacaagaaaaatgaacatttcactgggaaatttctaaaactttctaagtttttataaatacccaggaagccaagaatatagattgctagaatggggacagggaaagcaaacctacttctaaactgcatcaggaaaataatttaaggaatatgtagataatctggttggaattaaagcctcccagtggaagtatttctatatgccttcatttgaaaatatctctttcgctcacctcataacagcttgaggcaaagtaaaaacagtatggatacaagatgagaaatcccatttctataaagttgaggactttttcatcttgcacaaggcggttgaatacaagggcctgctttctcatgtataaactgtagacaaacaataagattactgtgatgattaaatgtcatcataaacaggtatatgtttataatcaccatacacctataaaacattagaattgtctataaaaagtgaaaagtgttatggcatatattctattttcaaaacatttgcatcttttaataaaaatagtggataaattatgtaaaagtgcatataagtgtatgtatagatactatataagtatatattaggatattacaatataattgaaaaagatatataatttaaaaaaatcaaaatcacgggatgatagattattttaattttcttcttttcgtattttatttttattgtatataatgataagtactgcttttctaatttaaaatagttaatgttaatgttatgatggaagactagaagtagagcggaaacagaagtcataaagcatacgtacacgaaactcttgaactttatctgttcctttctatgccttttctaaaatatctctttcatctaaagaacctgtggagatactatgtgcaaatcttcattttcttttcctccatcaacaagccctggcttacgctagtaaagcatacattttttttcctcctgaaataaaataagaattttcctgcttgtttgcgaaatatttccctaggtatattggatttactcgtgaagattcaaccaagaagcaatgaataaagagagaagtggccttgaaaaacacagtctaattattatttatctatatatctttgctgtgttcattagtcatatggtatacaacatattaaataattcattttttgcacaaattttagaagtaatataagtggaagcaatttaactacaactacttagtgtaatgaacattttaaattgagcttttggaaagtgcttaattaatacttgtaaaataggggttcacagttcttgcaatatgtcattaagtccaagcattatctttaatcttctcccaaacttctgagaggagaaaatagtttttgaagcaacacaaattgataaaccttcaaaagttgaggtaatcagctacttacatttttgagcactagtcacagtataaatggaaattaaaattccattatgacataaagtaaaaatttagcactgtaagtttcaagtaatatgccacccctctacaccaaccttaccaagcacttcattcaaccacatttcagccctaatatgactttttttttatttgcctaaacagtatcacttcctcctttattttggcctcagaagtccattttccctccttggtttactattacctccacattccatgagtccttaatagaaatgccaactattgtactcttcacttcacccctggccaaggatacacagctcaagccaggccaatcagattctctcaccttcagatgtgtgatccttgaactgactgccagttgcttgaaggtcattgacctcagctttcttaatggcactgcccaaaaaggaattgctacttgagtttctaagattgctgaagcctctccatgtttttgtttttccttagaccctattcaatttctctcttgctgtacaagccaccaagtattcttctgatatgattcctttagtataagccagtcagaagtggtttctgctgtttccaacttactaaccatgccaaaaatagtttggaatgaccaatttagttcatagcagagaatggacaccatacctccctatttatggaaaagatactggattttttcctcccaaaagacattatgaaatgtagatttttcattttgtgttgcaaaatttaatcaagtattaaattttagtatattttcttttttataatcatggattttacatcattttaatttttttttgaagaaagttgtctttgtttatgtatatacattatccggttgtcaatcaaggtaggtgtattcaaatctaaagccctcagaagatgcctggctgcttttctaacatgtcacaacctacaatccctggtaatacagagaattcagaggaaaatatgagatatctctctgtacacttatctaaaggagtagatgaagcatatttagtatgtgcttattataattttgtgtggttcgaacatatcacagctagcagtagtaataaaaaatacctttttatagagtatttcttatgttacaataagttaagtacttttctgatatgatagtccttaaaattctcaaatacccttatgaggtgtagacatatttaccctaagagaaagttgaagattataaaggttagagaagtttgtaaagatcagaactgggtatggaattcaggcctgtctgataccaaaatcatggatcttaagtaatttcatatatacaatttttatgtatctactttttctctgcttttctattaaggtaattttaaatgggaacaacttaatggtttaataatctgtgttacatagaattttccctagtatagatttttgataaaatttctcctttactgtttgtcctttaaactcaggcatatctgagcatttatgaaatatcatcaaatagggatcatttagaagcaaaactgaaccactaaactggttaaagtatccaactttcttgtgtattttaataaaacacaaatataggtcaggtgtggtggctcgtgcctgtaatcccagcactttgggaggctgggggtgggtggatcacgaggtcgggagatcgagaccatcctggctaacacggtggaaccccatctctactaaaaatacaaaaaataagccgggcatggtggcgggcacctgtagtcccagctactcaggaggctgaggcaggagaatggtgtgaacgtgggaggtggagtttgcagtgagccaagatcgtgccactgcactctagcctgggtgacagagcaagactccgtctcaaaaaaacaaaacaaaacaaaacaaaacacaaatatagcaatctctattaaacagtcttgatggcaagcatatgctgtaagtaaataactagtaacaggctttcaaaattgaaagtgacagcttttaaaataatgatttcctctaaactgcttgtctgtaattatttttaagatattacataggggactaattaggtacaagataccaaaagggataagaacaggaacaagattgattaattgaacttacgaaagttcctgggaataaaaaatgaattagattgggaagaactgactacgagacttgtgttctgaataatgattaaaaagaatgacaagctaaatttatgtttcttatctctgaatcataaaattctgtttttgcttttgcattgaagcaatgtgtacattaaattgaaatgcatgccttataaaatgtaaacattaacaaaattagggaatatttaagaataaattaaattttaaattgtgaagataaaaccaagaaatcttctacctacttaattcccatgttttcttccacatacaagccctttattatttatttggcactagctatagttattgttggcccaagttaactattatccaacatactttctttagtcataatttttctggagtatctgcaacatttgatgtttcagccatttttgacttttcttgaaaccctcttctcctttggctaacaggtcatcactacataaattgtactcattttttccactggtctcttaaatggctattcttttcctctcattcactaaatggaagagtttttctcaaactcagtctttcatttttctctcttgacagcctcagaaagacaaatgagatggggcctcaagggacaataatttttttttcttttgacagcttaatttggtcattgtgagaggttacagcctgctggcagccctcgcagccctcgcttgatctcagcacctcctcagccttggcgcccactctggccgcgcttgaggagcccttcagcccgcggctgcactgtgggagcccctctctgggctggccaaggccggagccagctccctctgcttgcggggaggtgtggagggagaggcgcaggcgggaaccggggctgcatgtggcgctcgcgagccagcgtgagttccggtgggcatgggcttggtggactccgcactcagagcggccggctggcaccgtgggccccaggcagtgaggggcttagcacccaggccagcagctgcggagggtgcaccgggtcccccagcagtgcaggcctgccagtgctgcactcaaattctcactgggcctcagctgcctccctgcggggcaaggcttgggacctgcagcccgccatgctggagtgtccccccgccgtgggctcctgtgcagcctgagcctccccaacgagcaccaccccctgctctgtggcacctggtcccatcaaccgcccaagggctgaggagtgcgggtgcacagcgccggactggcgggcagctccgcctgcggccccagtgcaggatccactaggtgaagccagctgggctcctgagtctagtggggacttggagaacctttacgtttagctaagggattgtaaatacactaatcagcactctgtatctagctcaaggtttgtaaatgcaccaatcaacactctgtatctacctaatctggtggggacttggagaacctttatgtctagctaagggactgtaaatacaccaaatcagcactctgtgtctagctcaaggtttgtaaacacatcaatcagtaccctgtgtctagctcaaggtttgtaaatgcaccaatcagtgctctggggttttggagaacttttgcgtctagctcagggattgtaaacgcaccaatcagcaccctgtcaaaacagaccaatcagctctctgtaaaacagaccaatcagctctctgtaaaatgtaccaatcagcaggatgtgggtggggccacatgagggaataaaagcagactgccccagctagctgtggcaaccagctggggtcctcttccacactgtggaagcttcattctttcactctttggaataaatcttgctgctgctcactctttggttccacgctgcctttatgaactgtaacactcaccgcgaaggtctgcagcttcactcctgaggccagcgagaccacgaacccactgggtagaatgaacaactcctgatgggaggaacgaataaccccagacatgccaccttaagagctgtaacgcttaccgcgaaggtctgcagtttcactcctgaagccagcgggaccacgaacccaccagaaggaagaaactccgaacacgcccgaacatcagaaggaaagaactccagacgcaccatcttttagaaccctaacactcaccgcgagggtccgcggcttcattcttgaagtcagtgagaccaagaacccaccaattccagacacagttggatctgagttagcagaatggatctaaacagcatttctccctgatacaagcttcactagctcatctcctcttaaagagatcattgcctcgacagggaatctcctatcattacactgccagtggatttttgtttgcctttatttccatatttcctttatatttgtagagtaatagtgtttccagtccctggtttctagtcttgagccctttctatggtgtgttcagatgtgtgcaaattaagtttttttctttgtgcttatgggaggtcaagagatactttttcctttgatgctttctttgcctggttttctcacttaagcctcattattttacatttgtaccacgtgagactagcgacgcttggcataacaattccttgacttaagtactcatgctatatgattttttttcaaaacctacctgtcagtcttgaacacctttggaagtccagttccttgtttcctgcaagtttttatttagatcttattcatgtcacccaagatcaaaagtataaaatcatccttgatttcttcctttctctttataaccagtcatcaagtcctaccaacttctcttttgcagttgtcctatattttcctcctctcactggcccaatcctagttctagtttgggactggcctatttatccaattctttttagcattcattctatctctctccaagctattctacatactgagctaactttctcatgttaattccctgctttaagaaacaaaacaaaacaaaaaactgcaagcagttaatcttcctatcagtatttcaaatagttgtgaagaaacaacaacaacaataaaaacagtaaatattcagatttccattttccatttccagatatcttaattaagtaggtttggaaaagagatcacaaaaatatgtattattaaacgagtatctcaggtaattatcaccaggtagttcaaacagttgctttatgagaaacactattttatgattcttttacttatctacttcctttttctcttcactaacttttgtttaccactagggcaattcactgtcttctgaagccactttcaaccaattgccaattagaagaattttaaatttatacaaccaagctgcacctcaaccaccttgggcacatgttctaggatctgagggctgtgtcaagggccatggtcactcatatttggctcagaataaattgcttcaaatgttttgcagagttcgaggtttttcactgacaaagctactctaatttcaaatcatgcatgtctatgtctcttgtatatcaattagtcatgtacttcatgctactacttattgtttatacctatgttatagcttctccaccaggatagaaacttctttaaagcgctaatctcaccttgtggatacgtatccccttacagcacttagaacaaatatgtgatatatatttgttaatttaacatacttttcattatctctgtagcacaaaaataatgtttcaggggccatgtgacaaaaaaacagaatcatattagatgtgcctcaaaaataaagggaacagagttgttgaaagtgaaataataacttaaaaagtactagtctgtttggaagttttgtttatatgtaaatgcaagtgtgtgtgtgtgtgtgtgtgtgaatgttaacattagtcaaagagtaagaagaattacaaggggacccacaaaacctttaccaatccatgtaatgttgtcaaagataataagtaatatctaatttcaaaatcaaaggagcattgtcccagtcattctttaccacttttaccttttaccttggaatacactaaattccattgtttgcccatgtatctattattttattaccactttatatgtttaactcatcaaatgttcttgcaaatctgatacaattcacaattcactgtgaagaattataaaattatactgttattaattagtccaggtcaaaatcagatccattttggacaaaatcaatcatgaaaatatatggttaattataatgtgatcttttatataaacgataaatatcaaaaaggtggagtagtacaacaatagatattataacagcgtttctttgaaagcattagaacatggcatcaaacataatttactagacaaattctgtattgtgcaggaaaaggagtatttactattttctgaaatacatctttcatcttcatagtgttatctatactattctcttctttgggatctatctcacatttttatcttctctgctatcatccacacagcacctgtgataaaatctgggacaaaataaaattgaataatactacatctttttatttgaggagaactcacaggccagatgtatttgttcttgtatgacagggacaatgaatgattaagcaaagtctcaaaaatgagatgacctttaaactgacccttgtagaataattgagttgatctgaaaaacaatgtagaaaggacattttaaaaagagagacttgtgcaagcaaagacatttaggtatagacattccttgaggttaagtgaaaagaatgcaatgaatatagaaattcagaaaagcagttacataggatatgcccagtagaacttcagagactggtgaagttgagacaatgaaaccttctgaatgttcactcctatgtacatcttttctatatggcacttttccccatatttctttttattatgtaagcataatgctgaatttattttcgtctatttaatgagaagctttttttttcttctttcgatagtcaaccagtaagatcagctacttgttaaagttgggaaaataaatattttactaacagaaaaaattgcattatccataagtgataaaaataaataaaaaccaatctaataactatgctaaatctttagcaagttattactttaagtgcagacctgaccttgattatattacaacagaatggggatagccaatgcctacaaccataatcaataatgaagaattaattctgataatttccctcatatctatcaatgttaaactacattttatgcttatgttattcatgtagttgcatctgttttctatttctgcaaaggttgttatttctgtaacataagtgacttaatagattccagttcttctgtgcatagtttcatttgcatttaatagggcttagtgtgcctctactgaaataggagtttttctaaagcaagaggtttagagtgactgttgtatcactttggggcctcattattaatcagtaattaatactctctggaaagcataagtttgccaaaatatttggcattcaatgaatggcattttgaatcccaatttaaatttggactaaaaaggcttagaaaaaaaatctaaattatttactatattaattataagtacgtttccaagaatgaagaaaactgtatcttctctctttagttccaggcttattcttaggtataagaaggagaactattttatgcattcctagattcttaaatattttaattttgcttgcccatggcagcaatatgtttccgtcatgaaatatatattttttctcatatatgcagaaatgtaatatttttctattttgaaaagtctgattatatatcattgtcatcagttcagcaaaccaatttgggatcaatggaagagcactgcctcaatgcatttggtttcagaaatgtattaataatagtgtataccatgtttcaaatcacatttccaaggaaacctattgtgcacaatgcaattttttcttggacagacaattttatgctatgagtccactggaatacatttttgtttcattgaaaatataattttttcaaccatatatttatataagatgcctaaaatttctgaaagaaaaaatgctgttaatgatattatcgtgttaattttcataaactcctctccatattttaaagtaatacattattaatatagtttctaaaacagtggccatatatttgtactataaatataaggctatgatcattcctgggattttaggactaaaaaataatatgtgacaggctacaatattgttacccaagttatagcagggatacttttgttttaagtcagtcaatcataggtaaagagtcattagcattatttgtcacagaccttctgttagaaaccacaaaagtcagaagaatgaaatgtattacaagcttgtaccctacagctaaaacataaaatgaaatcaatagcatttgagttgttttaccctcagtttaaagtttatcttaattgtcttgtaatttattcctgattgaaagtctagttattgaatcaaaacacaatgacatatttatagaaagctatggctttcttttttcatgtttaaagataattataattttaccataaagcaaaaattgccacttcaattatggagttacataaatcaatctgtgctgtaaacttgcatgttactgcttttgctctacataaaagaatgggaatgactctgtggcacaaatattaacataagcttctatagatgttctgggtacaggcttcttgaagcttctttgggaccaagtaacattatatcctaaaaacccaggagagtttgagtttttctgcaaagaaagagactatggataggaagaaaagatgactcataattttgaaataatgtattagaaatagcaacgcattcggctgggcgcggtggttcacgcctgtaatcccagcactttgggaggccgaggcgggcagatcacgaggtcaggagatcgagatcatcctggctaacatggtgaaacctcgtctctactacaaataaaaaaaattagccaggcgtggtgtcaggcacctgtagttccagctactcgggaggctgaggcaggagaatggcatgaacctgggaggcggagcttgcaacgagctgagaccgtgccactgtactccagcctgggtgacagagtgagactccctctcaaaaaaaaaaaaaaaaaaaaaaaaaaaaagaaatagcaacgcattcacatttgtctttccttttgaaactagtccaacagtcccacagacagttgttttcagataaacacagagattggctcttctgctgctaaagcttaaaacttttatttgttttatctgagctctttcctcagcaaaggaggaccttcaggcctctgaaaaaagtttcagttatttgaaacttaccagatcactgccccagaggcctccttgctcctccccagttcttgttttcttacactcttacgtttcttccctactacataaaccccctagctttagtcaatcagggagatggatttgaaactgaactcccatctcctcagcttcaacacccgattaaagccttcttccttggcaatacttgttttctcagtaattggctttctgtacagcaagcagcaggacctagaccaaactcctggtgtttcattaacactttgtaaaaggaagataattatttgatcaaattagtggtcaatatgggagtaaaggaagaaaatacggatgcttaacagaatgagacaggaagaagagataaaatgtagggagtctagagggccagaaagtttgagtgcaggaagaatgaaaaatcaacacctaatttctaactgaattgaagagagagaaaactccaaagcttttcagattccctgcaatttcaagtactgggaggaagctcctaagcacattcccatgattaaaacagtgtactgtctccatctgtaataatgactaaaccactgttatgaaaaggctgcaaatcaggggtggtgaggtgggagtgggcagaactggagcttagttagcagtcagccatcaggtggattgtatgagtggtatgtatgctacaaatttgcatactgttagcttgatatttaaaacgcttcacaatctggccttaattttccagactcactcatgcattggacaaatctttattgggggtatttatgtgccatgcattttaggctattgggatacatcaataaacaaaacagatacaaacttctgtcgttgcgcagactaaatccattttaacaatatccactaaattctgttctacagtctcactgaaacaatattcttaatatgaaaatatagaattataaaactctattattttctttcatactatctctttaatcctgctaatatgggctaatatctttcctgctgttgaataaaagctcaagaaattttataatttttaaaaaaattgttaatagtactatggtaaaggtaactttaaaaagaatttaaaaatgattctctagttcaatatatgaatctaatactccaaatttcatttaaaggtaaaatgtccttccccagcttagatatgttaatggaagttcctctgcctttggggaagaggctgtaagagatttctttttacttttttctttattaactaccaccacctccttcattcactagcagttgatttttatcactcagacttctattacctgaccttggagattatggagaaaaggcatgtaaggtaggtagcgaagttcctacttcaatattactgttgtgaaatggctgaatactctttgggtcagacctgggtttaaaacagacatggtcaatgagagcatcttcagcactggtatgcttttcttcagcaacttcagtttgccagcatacttcagttaattccagtttgtcattttataggaattctgcggtctatgtccagtttttgccttttgcagtatcatcactccttcaggtaatcctaccgaacaggatttaagaaaactggcattcacctgtgtcccaaatctggtcctttgggttggtttgggtataattatgcaggcaaagaacagtcacaggctctttgcctgcatacttatagaagcacagacctttctagatgtagctgtaatataatgtaatactccagtcattgtaattgcttgttgctctttttctgtctacatttatctgatatgtctcaaacatggatttgctgtgctaggccaacataagggcagcgttttttactgtagttgccaatgttaaacttgagaagggaaagcatatatttccccagccattgtattttggggaaaagtatactgttgaagtgaattcaagtacaactttacaacaaccctcccctataaaggaatactcatacaaagtcacttctaaattttaattcgcgtgaccattttcaattctcctcgagagtaatggtgttcagagtgttaaactctgttactggaacatgatggttttggtctaggttctgctgcttgccacacagatgggcaatcactgagacaatgagtattgctagggaagaaggttttaatccaatcgggtgctgcagctgaggacatgggagatcagtctcatggagacagatccctcatggcttggtgttgtctttgccatagtgagttctcacaagatctggttgttgaaaattgtgtggcaccttcccccaccactctctctctcccttgctactgcttttgccatgggatgtgcctgctctccctttgacttccaccacgattataagcttccggaggtctccatagaaccagagcagatgccagcaccatgcttcctgaagagattacagaaccatgagccaattaaacctcttttctttagaaattacccagtctcaggtatttcttttttttttaaattttattattattatactttaagttttagggtatatgtgcacaacgtgtaggtttgttacacatgtatacatgtgccatgttggtgtgctgcacccattaactcttcaattagcattaggtatatctcctaatgctatccctccccccttcccccaccccacaacagtcccccgtgtgtgatgttccccttctgtgtccatgtgttctcattgttcaattcccacctatgagtgagaacatgtggtgtttggttttttgtccttgtgatagtttgctgagaatgatggtttccagtttcatccatgtccctataaaggacatgaactcatccttttttatggctgtatagtattccatggtgtatatgtgccacattttcttaatccagactatcgttgttggacatttaggttggttccaagtctttgctattgtgaataatgccacaataaacatatgtgtgcatgtgtctttatagcagcatgatttataatcctttgggtatatacccagtaatgggatggctgggtcaaatggtatttctagttctagatccctgaggaatcgccacactgacttccacagtggttgaactagcttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatatcttcttttgagaagtgtctgttcatgtccttcgcccactttttgatggggttgtttgttttttcttgtaaatttgtttgagttcattgtagattctggatattagccctttgtcagatgagtaggttgcaaaaattctttacagtaatgtgctctaatacaaagagatgagcgagaaaatgatgaaaagataagagaagattcaacacttgtatactaggaatctcccagtgagacagaggagggatagaactttgggttcagatcacctctactagagcattatttcatgcagtcacactagtcaccagaccttgcaccactgtaaggtgatggcagcatcacctcactcatgccatccccactgaccacaagactgtgcaagctataagttacctagagaaactaagatgagggacattctaccatacatcttactcaaggaagttggcccccaatacccacatgcacagaaggctaaaaaaatgactgtggtggcaggcgcctgtagtcccagctactcaggaggctgaggcaggagaatggtgtgaacccaggaggcggtgcttgcagtgagcccagatcacgccactgcactccagcttgggcaacagagtgagactctgtctcaaaaaaaaaaaaaaatcacacggagatgtaacatgttaatgagacgtgtgacacatgaagaagcaagtcatcaaactgtgcaaatgctataaattcccatttctacatgctttaatgtcactcctttcatggctaggcctgttaaaattactctcttggctatctccagggaggcagcaagagcactttctcttttccgggctgctttccttgtgctccagcataagttccaataacgcctggagtctgggaaattttcttagccttctgtcagtttctattgcacaagagcataagaacttgtggccagtaacaccagaatagatgccacattaataaaaaaaaaaaagtctagaattaaaaaaaaaatccctaaatgagacttgaacagttatactacatatatagaaaatgacccagaattgccaacatgtagaaatacattgacaaaaatactgaactctaaagaaaaaataaaggcaattatttggaaattcagaaataagaccagtttgtcattacacatttttttacagtaatgcttcaaagaataagaaaatggaatgaaaaatttaatttaaaaaaagaaaatgagtcaagttatccagtcaaattggtcttcaatgttaaagccctaagataagcttttcttaatgcaccaaaacataggaaatagtgtctctataatcctgcatcaaggactttacttgggaatgggttactgataacaaaatgactgaattgtgttattaagagggataaaacaatatcactttcaattagatgtgtgggaaaatataagagatgaagcagaagcattgctcacaacaggaaacatatgagcagtgcaaaaaaaaagtgtaccatgtaatgtaaaagtaagtcgtagaacaaatgtgggcaaactacagccctttggtcaaatccagcccacagacagcctgttttagtaaaatgaattttatgggagcatagccaaaccctttggtttacgtattatctcttcttgcttttaagctacagcagagtagagtagttccgacagagaccatatgacccagaaaactaaacatatttgtcatctcagtattcccattttgagtatgatagtgaatcaactcattattttgaaaatcaataataaaaggaaagaataaagtttttttttcttgtttttcctatagttggtggacctcagggttactgagtatttgctatggagacgtttttctttataaaaatattttggctaatgaatatagaagtaataaaaataaaaaaataatggatttagaaaattactattggtggttgctactatctatatcacaaaaagagaatcaaagagatttaatgtttaaggaaggagtgaatatcacctatgatttatttgtttaaaaacaaaccaaaaataacctggatatgatcaagcctccagatctaactacttatttcctggaaattaaggaagcagaaagaatatgaaatgaccacttggagagacagtcatcaatccaggcttcagaaatgtggtttcttgcacaaataaatatcaaggtgaataaaagagcgtagtggtgaagcctacagattaaaagagacttaacagacctatcaaccaatggcaatgtatagaccttattttgattctgatgtaaataaatgttcaatgtgaactggatatgtttaatatgaactatgtttaataccaactggatatatattgatatcaaataatttgttacttttggcagcagtaatcatgatattttaattgttttaagagtccttaagatatacatatcaaaatatttacagattgaatgttatgactctgacctgcttcaaaataatgcaatagtgggtagttgagagcatagaggaacaactatttcccagggcgtgattatgttgaattagggagttgatacatggaggttcaccgtaatattctctgtaatttttgtatgtttgaaatgttccaagtaaaatgttaaaatatttaaatattcctagtgttaaacttatgaaattagctctaaaattttacattttaattaatttgcatttaaatattaaatctaatcacatcatggttgcacaatttactttgaaaataatttcattaacaaatttttggtaaagaagtcacaataaaatacttctttaatgaattacacttctgatttttattatccttattcaaatgatatgtggtagggcaactaattctgctgcagagatgaatatttagctaactaattaacctcaatttacataatggttgtatttgcataactaatgggctggggattgactataggccattaacagttattaattaatgagattgaattagaaatatatgggtttttatttcaaacttaggaggcaaaggtcaatcataaaaggttaataacaatattcaaagaatcaggcagtaaatattttagcttttagacttcatgcatttctgacaggataattcaggaattggtttcacctctacatgcatactggggcacatggaagtatacacatgtgcattagagaaacttttattagcctcagatttacatgtaaattaaagtaatgggagctagttgtattcacatataagaacttaatgcacctctattcataaaaatcacaggtatcacttgagaaagttctacaacctaaaatttttctttcttaaactgttcatttgtttcaaggaaagagtgcaggtacacttttcaattaatcttcctcatttttgcatttgcaataaaataggttacattatataatttagagttactccaacctttccactcctcatttatccaattcagtttacaattggaagcatcctctatatttttaaaaacataattgcctgtagtttaaagattttagaaactcaaagaattcatctgctatttttaaacaatttaattatgtgagtgatgcataattattgaggacaattcaattcctttaatttcaaagacacctgtataatctgatttttcaaatgatttggttgtatctctacaaggaactgagcagctctctacactgaatcagtaaatgaggttcacgataaatgaaaaggagtgatttctttttatgatcaactgccaaactgatacagaaaattctgtcctgcatcttctgcctgttgctcctgtcttgctttcttttctctcacactgcctgggttcttgctttatgcctctgccctcttctttttccctcttctcccttctaagaacgctcgcttgctgaaatgccttgaaatgatgtccagggatagtccctgggtgaatgtttcagatcctgtttctcatttcacactctgtctgggcctctattctattaatagttaacttaaactggattatcttgagtcttctagattttaaaagggttgctctgattacaaaaagatgattgcttaaatgcaaaagagtattacctcaatagatgggaaaagaatagcatttattgcattattgataacatctttaaatctgtgtcagttcccttcacaaattggcttttatatgcttctctgtgggggtaaactatatgccacagaaatgttgaagttcggagtcacagaacgtgggcttaaatctgtgacgctttgtttactgtcatttaaaaaaataacctttttaattattaacaaaatcttgcctttgtaaaacagggtagtaattctcatttcatagattaaaagtgtaggttaaaaagtgtaaattaaaaatgaaaaatgatgctacatataaattacaataaatgttagtcgctaattttaagatgattttttcttttctcgaagaaaatatgtaaatacaagaagccacacaattcaggcaatttctagaagtcattcattaaaaatatctatttcccaaggtttatccagagcttcacagtgggactaagttttattatttaacatacacagacaatggtggtattttaacaatattggatacacaatttgaaaacggtgttttattatctcgacatttcaggagtatgaaatcactccctgccttgtcatatattagctgtttaaacgaataggcaatcatctcagagtattaatgatctttctatgttgtccactgagaatgatattttagacataggtatttcatttaaaaaattagcagagacaccatacaattctggtaaaagctttaagtagtataacttactttttgaaggaactcggagattggcaaggaccacttccagggaatcagcttggactcgaagtacatagcttgtcctggtctcataatccagaggtccattcacatagataacacctgtgatgttattaattccaaatgtatctagaaattaaaatacaattacctggtcattgtctttacgctataaggaaagaaattctctttaaaaggcactgtgatttcaaaaacactaaaaatgcctatttataactagagtgatgcatgaaagtgacaaaatgctggcttttggaaactgttccagctctttgaatgatcaacatcaatacttcgctaaagtctgccttgaaattgtagggtttttttgtttttgttgttttgagataatcctggaaaacaaagttctatggtcaattacatttgggaaacactgaataatatattctttaccttagattcagatggtcttctgtcacactaaaggctttcagaagttgtttcaaagaaaaccatctaattttgtttaaccaaaattttctgaacttactggattattatactctttgtaatttatgaatattattattttgtagatttagtgttttgctaagaacacttgagagaaaataaaaaaatggataatttaatgttgccctgtgtctgtttatttaaataaatttgaatgaaaatcagggcactttggtaaactttataatatctccccctcttatgctctccatattctctccttactttattttttcatgtaattaataatcccttataatactatatatttctttgtttaataatttttattattaatctccgcttactggaccattaacttccatgagggcaggaatctattttgtacattgttctatctgtagtggctagaagagtagttaatacataatagatgctcagtacatatttgttgaataaataaataaatgtacaacagtcactgtgggggacagacgttaataaatatagccactctgctgtcttcaaagaaaaggacaaatagaatcaaaagagaaagtttcgggacggaacaggttgagaaatcatagctttagtcagatgttcgaagtccaaggaaaaaggaaatttagttatttttagggaggacacatagtagcacagtaataatgtagaaagaaaggcaataaaagtaagatattgaccacttgctacactacacgggcagcaatacctagtaatagtttgtcattaaaaagcttaacagggcctttataatttccttgcaaactcttttacattcactcatttctttaatatttactattgattaacttattacatgtatattaactatttcctgactacctacaatatactaggctatctaacataccaaaagggaaaacagaggagaacttgtggagaacaggtaaaacaaaaattaatgcgaaagattgagctatgaccttattcccagaggcctgcaaattcctatgattcttaaattacaaaaacttatatttttatttttaatcatgaattgtatgtctaatttgactattttgggaatcatataacatgcatagcttttaacatggatgtgactctttttaaaattcacaacttatttacaaccttgaagttccttcaggattagttaaggtatgaccaacatggagtaagggtcatggatggttcagacactggggcggacgaagctactgtaggcaatgatcatggccaaaagctgaaaatttcatgatgcattaattttgaggaaatgtcattaaaatattaccaaatgaggaaaagggcaaggtttcattaattagatacttaatatttcttaaggtacttaatatttcttaagggaaaaaatcactttagctaacatcactggatttttaatcgagttcaggatacatggttaacaattacatttaagatgggcacaattttattagaaaacaatagaatagataataatttcaattcaatctgaaattaggccaaatctaagtttactggttgatggtgagaacacaaactaaaagtctactcaccttcttcatttcctgaaacaatggagtacacaatactttgattaatggcagcagcagaaattacaccaaccatggtccctttggtggcaagttcacttactggaggaggtctgcaggtttagagaagatgatgtatttatttttaaatataatttttgatgtaactttacgttcacagaaaaattgagagaaagataagagatttctgatataccctctgccctcacacattcatggcctcctccatgatcaaatcccccacccaactgctacctttgtgataaatgatgaacctacattgacccattatcactgaaagtccatcatttacatgagggtgcatattgttgttgtacattttatgagtttggacaaatgtgtaatggcatgtatccgctttcatgtagtatcatatagggtattctcactgttctgaaaatcctctgtgccctgtatattcatccctcccctcaactcaacctctggcaaccactgatctttgtagtgtctctatggttttgccttttccagaatgttgtatagctggaatcacacagtatgtaaccttttcagattgccttctttcacttagtaatatgcatttaatgctcctcaacatctatggcttgattgcttatttcatttttagcactacataatatttcgcggtctgaatgtacccacagtttatttccataaataaaaaacatcttggttgcttccaagttttggcaattatgactaaagccactataaacatctgtgtgtaggtttttgtgactctaagatttcaactcttctgggtaaatactaattagcatgattactggattttatagtaagactgtttagtcttttaagcaactgccaaactgtcttccaaactgactgtaccattttgtattctcaccaacaataaatgagagttgctgttgccccatattctaaccagcttttggtgctgtcaatagtctggatttcagacattctaataggtgtgtggtggtatttatttttatttttttatccatatttatgacagagttttgaacttaatagaagaatgtacacggtagttcttccaagctacattatgcaattacattgtgctttcattgaaaccttttacaaaaaatcctgaaatacaaatttagtctgaagtataggctttataaatatctggtccaaattgctttgtttttggtactgctgtccatacacttaattgactaggttatctaaatgtaaagcagtctttctcacagatactctagcacctaatggtggtccatatattcattgcatgagcaataactgcttcttgctgaagaataagaaccaatctgtatcattttaaaatgaagtgtgtaaagtagatatttaatttactagtttatttacttacttattttactgtcctgcattttctttttgctttcttttgataacatccaaatattgttttcaataatcttgcctctttccttctctgtacaagtgctttgggtaaggctttgccaatccccatggtacatgcataagcacattaaccaactctggtcaatgggggcattttatcctttgctcagtgttcatgtgatgtatacgtctcatgtaaattcaatggacatactacataagattatgacttgactagattctcgctagccaactttttgggtatatccctcactggatttgatgaagtaagctgccatatggagcagtcctcgtggcaagaaactcaaggtgatggctgactaacagccagcaaggaatcgaggcccttagtccaacatcccacaagaaactgatttctgccaacaaccacatgtacttggaagtggatctttctgcagttgagcctcagatgagaccgtagccctggatgacaccttgattaaaagattatgtaagtccaaaaaggagaggacacagctaacccatgcctggattcctgacctataggaaattcaaaatgatatatgtgttgttttaacccattaagttcatggtaatattattatgccacaacacaaaactaatatttgaacaatggattgttaatttatgacagatcaagatacatactacttatcaaaagtttaatacaagaaaatatgtcagtcatattaggggataattttcaaaaactgaattcctatttgtggaagtagacattacttaaattgtttacttgtctatcttgttactgcacaagatagaagctaaattttatactttccataattcatctgtttgctattccttatacagtatggaaacaagacgtctgcaacttatgcacctttagctttaacatgagaaaaatgctatgtcgggccgggcgcggtggctcactcctgtaatcccagcacttttggaggctgagccgggtgaatcccctgaggtcaggagttcaagaccagcctcaccaatatctctactaaaaatataaaaattagccggttgtggtggtgtgctcctatagtcccagctactcgggaggatgagacatgagaattgcttgaacctgggaggcggaggttgcaatgagccaagatcacgccactgcactacagtctgggcaacagagcgagtttaaatctcaaaaaaacaaaaacaaacaaacaaacaaaaaaaacaaaacagaaaagaaaaatgctatgtcttctttcaaatattaaaaaatgcacgtgtacatttttgctaaccttaactgcacaattaggatagaaataatactaaaaaaagtaattggcataatttaagaagacatttaaatcctatgcataccactaaaagcatttaaaattctatttgttagtaaatgtttacaacagatttacttctagacaaaatttctcctcattaacctttgtcttaattgttccagtacacttgtttctatcagaactaaaacactatacaaatacaatcttctcccaaaaagaattaaatgaacctccatgataatgagcattagattaaaaatatcaattattttctattttttggcaggattacaatgtacaatattaataaaaataatattattttattattgttttaggttgtggaaagtaccagttacatgatggaggcaaattgcatactctctttggagtcacatatgtcttgaatacaaatgatggagttggtataaatcaggattcattaagccagatggacagagaaggtaggaacataaccaaattgaataaaatgggctgaatataaattaatagggagaggaatggaagttaggaatgagagagtatgtaactactgtacaataattcaagtctggtgtgatttgtaaatcaataaaggaaattgaaaattttgtatatgtttatgaacgatcaatgggaatttatttttttaaagcatcaatgactacatttgatctatgggctgtcagtttacgatttttaaagcagattaactatctctaatgtcttttctagttctaccattctgaacctgatataatgtgagttatcattcactcttctttctgttgagtataatcaaaatctattgctcaatttcagaagcaatgaattatggccaaatgaaacatttctcagaaggttttctaaaaaaatattttctctattaaattcataaatcttcaattcatccatttatgaaaaaaatgcatcactagctctcttccaatttaagcttttcgcacctgatttataacaaataattgtgagtgtctgaaatggaagaatactatctttcaaagctaaatttactgccaatacaactgacaaactgcactcttaaaagaaacacttgaaacagcttcagtaatggaactatacagcttactgatgtagcttgagatagataccaactagatggccattttccaaagatggctaagaggatgctaaaggaaatggttatttagcagatatgaactggaacatgggagaggctagtggtttcatgttttcataatggccttcagtaagggcttcctcaaaggccctttcacaaggcttgacctgaattgggtttgatgtccttgcatatccatgatggcagtgttggttcctatttactccacaacggcaatgcttctaactttcttggccgttttaaacaaaatctacaggctttgactaaaattccaaaatcacctcaactaaaactgaaatagaatccgaaataatatttgttttataaatatatttcctcattgttactatttgcattatccttaccttctaaattttacatgtaaaacagctgtgtattttcaaaattaataatatttttgtttttaataaaaatgttattgagaaataaattaagataaaaatactggcacaatgcctatgcatttcagtatatttatacttcctcccagaaaagttcaatggtctcagaattttttgtattcttatttattttttaattggcaaatagaaattttatatacttatggtgtacaacatgatgttttgaaatacgtatacactgtagaatggctaaattaaactaccatttgactacctcacaagtttattagtggtgagaacatgtaaaatctattcccttagcaatgtacaatattgtacattgttgtcaactatggtcaccatgttgtaaaagaaatctcttcaatttattcttctaacagaaattttgtatcttttgacaaatatctccccaatccttcccttcctacccagccccatgtaaccatttttttacgctctactttcatgagttcagctgttttagattccatatatattagctttattagatcactattagaacatgcagtttttttctctgtgcctgatgcattttagttaacataatgtcctccagatttgagacaaatgaacgtatttgagacaaaatagaatactaaagtctaggttcattcacattgtcccaaataaaagaattcccttcatttttaaggctgagtaatatttcattgtatatatatatatatatatatatatatatatatatatatatatatcacattttctttatccattcattcactgatagatattttgtttgactccatatcctattataaataatgctgcaataatcatgggagtgcagatatctcttccaccaatagcctgatttaaaaatggaccaaggagcagaatagatagttccaaaagaagacatacaaatgaccagtaaatatgtgaaaaaaatgttcaatatgagtaatgatcagaaaaataaaagttaaatctacaatgagatatcacctcacatctattagagtaactattaataaatccacttcatataacttgtgtgtgaatatgtctctcaccaggttcaggcactggtaatactgcagcccagaatgcagtggagggaagcatttgagttcctattccggctggttcacatagtgacactgtgtgctatcttccacacggtgagagttttcccttaggatcagttattagtgaacttccttcacactgacctaaaatgtttctgtttttcgtctactcatctcacttttcacctgaacccctggtaaccaatgatctttttactgcctctatatgtttaacttttctagaatgtcacatggatgaaatcatacagtatgtagtttttttggactggcctctttccttatcaatatgtgcttaagtttcctctatgtctttttgtattgtgatatctcatttcactttattgctgaataatattacaatgtattggatgtatcacaaataactgcacttttgtaagaagaaaactgatcaaaataactccaaaatggtttaaagtaaatatttgcagattaaatgcaaaccgaaaaagttaactgctttggaattcgcatgcacaatacttacaatataacctcatgaagatataaactaattcatacatatcctttttgttttgtttagacggagtctcgctctatcgcccagactggagtgcagtggcgcgatctcggctcactgcaacctgtggctcccacgttcaagcaattctctgcctcagcctcctgagtagctgggattacaggcgcccaccaccacacctggctaattttttgtatttttagtagagatgaggtttcaccaccttggccaggctggtcttgaactcctgacctcatgatccacccatctcggcctctcaaagtgcaggattacaggtgtgaaccaccgcacctggcccatatatatccttttaatatttctaagtgttttttgaaaatatagattacaataaatctttcaactgagtatatattaactaattttctgaataatgactatagtagaataacataatttgcaatgtctaaatgttagacccagtttttaccgtataaatatagatgaaacaattacaatttaaaatctacttttattgttgagttcaagaagtaacaataaaagtaaatgttgtatgtgtcaaataaagcttctaattattttaaaagccaggcaatttaggatataaaagtgtttgtaaatagatgctataaaatttcactaggattcaatctggctctattgctttctttgtactaagagacaaatctaatttattttgacatgtttgagttcaatatatttgcaaatcagtaccaattaagatactgtttttctacctactatgagaggatttaataaaaatgggaagggaagaataaaaaaaaaacacccactagaactccgattatttataatcttggagtaattgcatcagagtgatctaattttacatatttaaataagaaaaacagtttaaaaaagacatgaatcaggagagagatgctagttcttccagaatacttaggatggattttagataagaaaattaatgaagggccaaaagactagacactgctttttacgtatgttccaaagaatgcgtgctttctgtcactaagagttttgcttctattcagttccttaaagaatcttcatctggaggatacaaaaactgaagtataaacaatttatccaaatatttgaaagcaaaaactgcaatctaaggtgtttggtttttcctttgcttaaattattatattgttctcattaaaatagtgtgttctaatctctcatagtcattggctcttaaagcttaaatccataagaatgcgctggagaaattttttaaacttactaaagtacagaagatccctgatttatgatggtttgactttcggttttttactttactatgggtatgaaagtaatatacattcagtatgctcctggacttacaacggggttaggtcctgataaacccatccctgtttgtctactgccctaccttaattattatagagggcccttctcactctcaaaagtgccctgctttggacaataaattatatggtcttacctatgctggaaactatatggatatattaaagtagcaaatttattcctctcgcttgaaaatttacaatttttttttagtgagaccgagtgtacaggtaatcagaattctgttttgaattatacattatttgacattaatatagtaatttctgctttcccttgtttgtaattgccagatatacattttctgttcactctatttttgtgcatgtgattttggtttaagtacattacttaatggcataaaatcatgtgtgaaaagtttaccagaggtaaaaagcattcttagaagattaagtaaatggcacagctattaagcaccggaggagttgggaaatgaatgacttatccattataaattggtgataaaaatgtgatgattttgaatcaagatttaaatagtataaaattctactttccatggagattgtggaagcacaaagtgacttccattaagaggatatgcatatgtcatttgcctgtttaacaccattcaatgtcttcaaatttctctgtgataatgaacaaagtttttagtatgactcagtaagtcccttcacagtccaactctccctacttctccagactcatcaccataggactccatttagtatgctattttgtctcaaatatgtttgcattgattactaataaaataaaattaatgtatcctactgtatgttttacttggatcaaaatttcccatagatacaatacaatgaaataatgggacgtataaaatcactctttgtattgaaaagtttgtgctaaattctaaacagtggatgtaagttgaactgtttggacttgagtcctttgttgaaggaagacttgcttcactctgctacatgagcaaatgccaaaatgtgtataaccttggaaatgtgaaagagaaattaaattccatgtaggtgcacagggaacctatcaaaactgtaatgaaagattgtcagaatcattttgtcaatagttaaatgggcgaaacctattatgtttgaggcaaggttttaatagtgccataaaaagacaggaaaggctatcttcaggtaaagccagctcttacattggacaacaaatctaaattaaaatagaaaacaattttagcaatcgagttatgctctctgcatatgcatttgttttacattattttaatagtcttcagacagctttcattaacttatttgcaatcaagacaaatcattctttccaaactattgttcatcttattaaaatcttttctcaaaatctgtaagtccaaacttggaaggttttataagaatgatagcctgggcaatatagcaagacactgtcactacaaaataattaaaaaaaaaattagctgggcatggtggcatgcacctaaagtcgcagctacttaggaggctgagggctgagatggaagattgcttgcagtgagctatgaccgagccattgcaccacagcctggaagacagaatgagatcttgtctctaaaaagaaaaaaaaaatgatggctatgttcctcaacataaggtaattttaattctctttaataatgaaatgttaactagacctgctcacttgctatttctttggccactgtgataatattacttgcattttcatagtttacaaaaatgaatgccttgattataaattatactttttctgttttgtatatcaagaggtataatgctaatcctttgttaaatatactctaattttattctttaatataaagcttcttgagaaacttattttaagtataaattgtgtaaaactttcaacctgtcatttattacaaaactaattcgtatgaatcaaccaactagcaattttttattttaacagagaaagtggtaagattatcttttgaagaagagttaaagtttttcaaaatttcagaatgttcacatgtataatattctgattttgaatttgatatattaaattttaataataatagaaattgaaaaggacttatagtatattctctgagtttagcaatatatcaacttaagaggttaacaaatataacttagggatatttgcccttattttattatatatataccagtataaattttgaatttaggttgttatggaaattacacttgcaaatatacaaatcttaaaaattaacatgaatgtgacactaaatcatgcaatggttaatattcaagttgatacatttccatttttaaataaaaaacaaaggcctacctatataggtggcatatatctttgaaaattttgcaattaattgtatttggcaaattttttgataaattgtgtaatataatgcatttcccactcaaaatcaatattcacatttagactctatgatctattccagacgtgttgaccttttcatgatatttacttttaaaactgatgacaagtgaatttcagtgtgtataagtcttagtccatcatcctgaaatgaaggtcaaatgtcattctcattcttcagaaggctaacttacttcacctatgggagtcaatgtaatctcaagtagtatgtgtttgaactactattaggattttgctatttctgtagggtttaaatgaaagatatataaaaggaatttaatgactctgacattgtaactaatttctaaaatatataaagagataattgaccgaaaatctcttagtaaatatgaacatgcagtgacaatgagagtatgcctctcagatcttcaactacaggaagcacaattggtcaaggtcccagttactgtggactgaaatctgtttatgtttgtatgaaggacatagttcctaagggctgcttaaggagtcaagtattgaaatgattattaggccaactaaatgatctctatagtctatttcattcattgcataatgtgaatttgagaaaagaatttttatgaataagattaacacatttttctcaatttctaatgaaaaacaaattgtagaaaatgatttaaacaaagatatgcaattgtaaatagatatgaagaaactacctaatcacttgaatggttaaaaaatcaaagtttataattggaatatttctgtgtaatagggatattacccggacttaattcatttccctcccacccccaccaaaaaatgaagctagttggagataattttgagaaagagaggtggaggatgtttcaacaataaagaatgaagaaatgccattagctttttaagaactctttgtttagctctttgttcaaggaaagatagtagagcaagaaggaagaatgatcacatggggcatgcaaattctaagacactaatatcattgttatatctttgtcaaaaatagaaactgaaggaaccaaataaaagagaaacaatgcatgtggaagatttgttacaatttgagatttttggtcgtgtgtatgcttctaaaatatacaaacgtttgtttacagttgtagaaaatgtcacaggatccttgggatgttgcttttccagtaggaagcctctgtggctggtggcacctttacatgaatttttttcaggcctactgggcttgtttcacccactcagcctggcaggcttcacttggcttcttctaccggcccagatcccatgcctgccaagggtgagccaggtgcagagcagcaaggtggggatgagagtgagtgtggggtccaccactgtgcacagccaggcacgctggctgctgtggtgggaagggtggccccaggtgccagcacagatgccagctccatacaagccagtggctggatctggtgcactgcaagcagattccactgaaggcacccatgtctggatgaggagaacgtggtggcacccagtagattggagacaacagaaaccagagtcccaaagacggtgtcatagccctggctcagggagctcctaggtctgggatccctgaagggccacttcgcttctcttctctccttctcattgcccacaatgtggcaagcggggaggcatgtttcagccctgctggtattactgctctttcagtcctgccattcagcaggtcccaagttcttgtcccacatctaggaagaattaggtatatagccatctgaagggtgagcaaggcaaagaggtgcttcattgagcaacagtacatctctcaggagacctgaaataggcagctcctatatgcaggcaggctgtcccgatgtctgcagccctcagtggcgaggagacccagagtgggtagctcctatcctcaagcaggttgtcctgatgtctgcctgagtctggttgagactggggtttttatgggcttcagaagggagaaagtgatattgctgattggtccatgggcagccatgggcagccataggcagcctggagaaagcaccataagttctcactccagtccagggaactggcaggctgggcaccagccttcaggcaatccttggctagaaggtggggtttcaccagacccatccctttccacccaggagcctgtctgccttctgctgccattcatggcacccaggctgtttgtgcccaagaggttcctgcaggcccgctccaggccacccccagccccaccttggcttctctcccatgctcattggtgcccaaagtccagagtgggctgaggtggcaaggggctggtatgtcagcaccacatgagtgtgggaacacacagccaggtggtgacaatgctcggggcttgatgacagctttgctctgaaattggagcaggccctggaagcagggagaggccaggcattgggagaacacactttgagcatgcagcaggaggggggcccaggtccacagtctcagctgggtgattgcacctgcacctgagagctctgggctccagcccctccaactcagaagtgggtggggcccctgcctgttctcagctctcactgactctgcagagtgcatagccccagctgtgtttccctggttgcagccagcgtctttgcagcaaatgctccagacaggtcgctgttgtcatcaaaaggaatagtatacagtatgaagagatatatatttcaaaagttttaagaagaactcattgttttctggatagaacaattgatcattaatgacaaatgaagcacacaatgtcttgatcctccatttcacctaagtgactccataaaagattgatgtgaaaaggtcaagaaattaacaaaatgagtctgtttcaattactataacagccctacaaagcaaagagaatcaagtgtatagtaattcttatctactataactctggccattataaaagtaaacatatgaggcaattttcttgccattatgtgattactcctacccttaatgattattgaaagccagccaccaggaaataacatcagttcacaggatttgaaaaaaaaaatcaaatcttttcccaatacatataaaatatcttaatattataaattataaaccagaaaaacatcattttccttgagaaatgtgtttttaaataatgacaacctaatttattttattgagtatagggttgtctttgtaaaattcttcaataattttcaaacttcattaagggagcattagcagaaagtaaagaagtaatttttttgttctgttttgttttgttttgttttgttctgagacgaagtcttgctctgtcacccaggctggagtgcagtggcgcaatctcagctcactgcaagctcagcctcttgggttcatgccattcttctgcctcagcctcatgagtagctgggactatgggcacccgccaccatgcctggctaatttttttgtatttttagtagagacagggtttcaccgtgttagccaggatggtctcaatctcctgacctcgtgatccgcccatctaggcctcccaaagtgctgggattacaggtgtgagcaactgcgcccggctgtaaagaagtttttaaatatgcaaatgaaacagaggcagagcatgattaactatgtggaagaaggggctggttttttattatgttgttacttttacataagtcagaaagcctactaattatctgtcatcaaaacttcacaggcaaaccagtaggtttttcctttagtaaatattaaagtacttactgtggtgtttattacttgtgtctattattttgctattttacaattttggaagaagacaatgataggtctattgttatattccagcaactaatcaattaccaatagaacaacatagaagtgctttcaattctaaaaaaagaacaatggattttgtttctctgtctagctagaactggtatactgaaaaacgtatgccaaatagtaaatgcgaactctgaaccatttttgatcaaggtcttcacaatgctagttttcagctcataactcaaatttacactttgccattatgctttcatttttattttctttatattttacttctgtgaccaagacactgcaacttctcagaaaactggagaaagtaattcattgtataaaatattcaacctttagcttgaagtccagaaaggtttggcttggaatatgtaatgttaatactcattaaactgaaatcactaaaaatacagatttttaaaacaaccagaaatgttaatctgagatttgctttgaattaagaaaataaatattcattctcttgatattttaagaacaatttacttcactaacgcatatttaaatgtaaaaatgtttctattctatcattagctcatgtaccccatggtgcattctaactaatcagtcattttaaaatcactgtggcaattaaaatctatgaatctgtaaattgtttacaatcacatgtttaatgtgctaggtcttcacctacaccatttcccctttttcctcaacaactgaggttgaactaggacacagttgcctagcaaggaacagcattcctctcccctagttagagctaaatgtagacccgtacctggattctcacaacgtaatgtgagctgaactgaaatgtgcaattctcacctcacttggttaaggaaatctctagatgtggacttctgtctggtttcccctttctgctgactaaaatggtaataatgagttattttgaaatagagtgttgaagatggtgacccctgagttgtcccaggtccctgaactttaaaccattgatatttggtggtttcctattacagtgacctaaactaccctaactcagtctgattaccctgagatttaatgatttaatgactgtctaatagaaataagtcaacggagtcagtgacagaacggggacgtatgggtcaataattcagttaaacattctacgataaataaatactttatctttaaaatctctcttttatacctaatcatttgttaaatgctaatttttcctatggaattcaaacacaagtattggaacgaagacattcctgagatgtaaaagccatgtgtacctcagcttacagtgctagattactgctttccatttgtaacacattaccttcccctacaccctacaaagaacataaatcttgagctatcatttttatatttcccccaaatttgatcacaagaagtagaagttttttcactaggagcaatcccaacacgaaagaccatcctaataatcaaaaattaataatgtcatttagcatctctgggaataatgtgcatccagttgaggcagtaaaatgaatttgaaaaaattagagaagaatgaggcatatgaggttggcagaaaccattctgtgcttcactttttttcattaagaaaggaaagtgtgttggcctctaaagcagcctgaaatggcataggcatattgccaaagctagcaattgaacatattaaaagaaaataccatacagaaataaaaatattctaccatgaatattttcatatttccatatattcatattttgcaatatgaatgagaatgacttttaaatatgattaattaattatgcgattagttgttggaaactaataaaatgttgaacaacttatattagttgaaacaacagtagctaataggactaagcctgctcaggaaatgatgcagaccacttagttccatatttttttggccagaaatcagtcaaacggcagaattcagaattcatccctagttaataaggagaggaaatgtaatccagctatatgcccgtgagaaaaaggatttaggaggcatccagatactgctatgtatttcctcaatggtcttcaaaaagaatgaagagataattgaagatgataatcattagccttaagtttctttatagttcagttaaaattttggttcaaatttagacctatataaacatttatattcaattatttgcatttatccaaaaagtagtgtccttgttcatatttggcataacatttatttttcaaattttctggttatttgataaaaaattaatccttttaagtactcaagtactactaaatgcattatgatcaagatactgattcttagcatctctgggagttatgtgtgtacagttgtgtatattattaatacacagtaggatgcaacaagattaccaaattctctttataactcagaataacaaatgaactgggataatcaagggcaattttgtaattgttagaattctggaagatcaaaattctcccacatgtacccatgtgactgttgttaattttagtaccatataattggctaacttttgctctctaagttaacaacaactttattaagagaatctatttgtagttaatagttctatgcagagacggtatgaaatggtaaattatacgttgaacaacacattcgcatttttaaaacatggcattaagcaaagatacttaataaagaaagttaaatgagcaatgccctgtttcaatttatgaccttggcctcaatgccacaatattttagctaaaagagaagtctagaggcatatttctattgacaaggaaatgagctctaaatgaaaacctagagaaacagtacaccacttaagtttatttaaagaggaagtttaagcaatatatcactttcttctcttggagtttccaaagataattagacttgccgcaaggggctttgaagaacacagatgggaattttaagttaaaactgtgagcgtttttttggatccacttagaagactaagtatattttttgagaacacctgatctagataatttagtgagaaacaaagtgagtttatatccgtcctgttcttgagaactccaaaattaacatgttcagagaagttcttccaaaacagaaaactgtgcataggagtccccctttatttatgggggatatactccaagacctccactagaagcctggaacttcagatgacaccaaagcctatatttactatgtttttttttttttcctgataacccagacagttactaagtgactgatgggcagcctggatacaatggacaaaggaatgattcagctccagggcagagtgacacaggacagcacaagatttcatcatgatactcagaatgccatacaatttaaaacttacgaattgtttatttctggaattttccacttaatattttctgaccacggttgacctcgggcaacaaactgtgaaaaatgatactgtggataaggaggggactactgtattccatagcaaagaattggaatccaatccaaaggattggaagcacaggttactgtgtcagaaaaaaaaggaaaataatagataataatgtacatgtgggtgagaataaccttttaaaacagattaaacaagaattcttatttgttttacatatggtttacatctcgatgatttacatacatgctatggaagattttctggtaattatattacataatttaattttgtgtagattcttctaaacgcagctttgtatgagaggatgaaactgcttggttcagtgggttaagtgcttgcagatgtatccctcacctaccttattcctcagtaccttagctgctgttctagcttaaaattattaattcattctaagaaagtaaaaaacactaaagtcatcctagaacatgatcaagttctccattacctgaaatattcatttttcattatcctcaattattatcatcatccaactttcaatttttctttggatagactaaactactaaaatattctggaatttaatgtagactcccacaccccttatttatatttctgcataggctgaatatttggtgtggaatatccatctatatctttttggattgactaaactctacatttccttcaatctacaacttaaaactgtgttaatcatgttcaaatatagttaagtgtcccttagcctgcttcctcaatactgtgatcttatttctaccattgtgttctcacagtgtattatatttttcatatagttatttgtttccagagataccagagagcttgctttctctctctctctccagataaggacatggcaaaaaggcagctgcctattaagaccagaagagaccctgaacctgaccatgcagacaccctggtcttaaacttggattgtcagctaccagaacaataagaaaataactttctgttgtggccgggcacagtgcctcacgcctgtaatcccagcactttgggaggctgaggcaggtggatcaggaggtcagagatcgagaccatcctggctaatgcagtgaaaccccacctctactgaaaatacaaaaaattagccaggcatggtggtgggcacctgtagtcccagctactcgggaggctgaggcaggagaatggtgcaaacccaggaggtggagcttgtagtgacccgagattacgtcactgcactccagcctgggcaacagagcaagactccatctcaaaaaaaaaaaaaaaaaaaaaaaaaagaacagaattttctgtcgtttaagccacccaatttatggtattttgttatggctgcctcagttgactaaaacagtatatatactaaccataaactataatatataatattggtgtatatgcatatagtgtatatatataaatgtatatgtattatatatgtgtatatatagtgtgtatatatatatacacacagtatatatataaatttatgtatacacacagtatatataaatacacacactacatttatatatatatatacacactatatatatacacatgcactacatatttacacacacaaacgtacacacatacacacatacacactgattagatggaaaatatgattgcagattgcatgccaaaattggaaattgaatgaaatgttccacctggcaataatgagaaactaaagatctatttctcaccattcagatcattaattagaattgaaaccccaaaatataatgttgtattttaataagtttgcactaattttttaaaaagtatccattattcattaaaccattactaaaacatattttatactaaattgtcatattaaccatttaaaaatttaaactatattttatgttaatttagaaacgcctaaaccaaaattggaagtctactcataaattcatattacatcaattttgagagactcctttcaaaaatgccctaaacatttcgtgtatttcaaaatcggacagaaatcaatacctatattcctcctgtgtgaagcgtgggatctcaccaggatgtaagacaagaatcttcactgtggcactgctggacatcacaggctccccatcatcaaaagcaaccaccaccaacttaaaaagcaataaaaattcatgttaaagattataagtaagaacagcgtaacagcacaatttttatatgtatgtttttacttattggattgcctggttccagaaggggaagcaatgatcatttcctcactgcctaccaggtggcagacactatgctagaaaatactacgttctcacttaatctttacaataatccagccagataaatgttattattttcacttgctagatgagaatactcaaagaagtaactaactctatgattaaaaaacaactaccagtaaaacaagtgtattatactatatctctccaattaaagactcatttctataattccactgaagcccacagtaaatacacatgattttatagcaccaatacacttatttaagaagtgttaaattcagacacataaaaagctaattatcttgctcaaaaaagaaattaattttcctagtgaattagttgtttttgagattatagggcagaaatactttactctagaggataaaattggaaatctttatagtttaacactctttggtatactatctcttaaaaacaaattataaggccaagttcatttggtatagcagaaattgttcaaatgatgaaaactaagaaaaagctttagtgttgagatgtgatgtctgacattatttatcactgcaataggatttataattgattattttctttaataacctacattacatcaaagtaattctatgtttactttaagacatgttaaatactttcagaactatgtgcttctttggaatataaattgttttggaagctgcaggttaacaatgtaaactaattcaacctagatcacagaagactgtaaccaaggatcatcctgagagccacaattgacctttgggttaatgctaatttacaaactgatcagctgttccaaacagcggtaaaatcatgagagacatagtgctcactgatccttacgtggttaactgataaagctatttccctactgtagagtcaaagactttattcacagtgacaaaaattattctaagtaactattaaaaatggaaatgttcaaacacttaataaaattgtctacttatggtaatgcaaattattgttttaataccttgccaggtagagacaggcattattttgtcaaatatatttttaaatatgtaaaaaacaaaagagggaatatgttctgtttcattagtatttgaagaaaagtaaaatttgacaaaaaatcaaatagatacagatattttcctagatatatgcaaagattaacataacaacaatcagtattgagtggtattaggaaaatggatactctcaggaaagatgaagaatgcatacaaggggtatttttttcaaattttctaggattgtaatatatcaatcttatcttaaaaaagtgagtaagggaaaaatgatattcatacaagtagttgcatgatagcatttattgtaacaaaaaatggaaagtctaattataaagcaactcagtattatattaaaaagaaaaacaaaatgttatatagtaaaatactatgaaaccactaaaataatagtattaatgtcacttattggcatagacaacatcatattgaatttaaaaaccagtatgtataagactatgtgatttgaaaacatatatttatatatttgtgtttgtatgaaatgtcatcatgaggatagagatcaaaacgcaaattctagctatttccaagatgtgagataccaagtggttttctttttactatttttgtaagtttctaagagaaaaaaaaattgtaatttaaaaaaattaaaaaggagaaaaattgaaagaaaaaaatgtgctgtcatctgttaagccaaattctctatcaaaaattaaacatcaaatagaccacataatgaaaagagacactgaccttaaaaattgttgtaggttcttcattaagattgactcgtgttattactcttccagaatcttcttccacttcaaaaatactggcagggtaaggaaactgtacatcatctactctatacctcacacgacttgcaggtaatccctaaaataaaattattaattattaatttgctgttaccaagttaaaacacagtgcaatgataatattaaatggatctttaaaattcatggtcttttagaagtgaaaatcatatttccatattttcattctttcagagctgaaatgtagccagatcattatttcttcatgataactcaatctgaatcaatgaagtatctctactacaggttattttaaaatgatttatatgagagaaaaattaatggttgctttgggcatcttctctaccactttcctttaattatgtgaattacatcttcctcccaaaacacccaatatctccttttttaaattcagagacagggtcttcctttgttgcccaggctggagtgcagtggcatcaccatagttccccataacctcaaaacttctggtttcaagtgttcctatcccactttagcctcccaagtagctgggaatacaggtgtgtgcaaccatgcttggctaatttgagaggactgtagtaaagtgcaggaatggacatgaaagctaaaaaaacaaaaattatttaccatctacactgtgttgattaccatgctaggtatttctatacatcattaggttaatgctcaatcttttaagatgacattaataatgaagatgatagtaataatggtaagttaatgacgctaacaattgctagatgcttaccacttgccggaaccacattaaagatgatgtatgtgtactctgttacccattttagagctaaggaacttgtggcttacaataagttaaagagtgctgaaatattccagagataggccaagataagttgggacaccaaacaaagtcacttttaaagaaaacaattaaaatttgataagtttttaaaagaatcaaagtgattgtaaaggaacagtcaaaattttgctggctgtcctcacttatattaggtttcagattggtttcctttggaactatgtagggtgacattgaggtgagcactgtaacatttacagtgcttaggccttgtaaatttcttaaaacctagaagtcaaataaatatcttgagcagagaactagtatgtggtaaagttttacttcaaacctaaacactaaattacaacattaacttcttcagagaaagaaacactcctatttggcattattctgatgaagaagaagtaagaacattaccccccacagggtgttgatttggctggacttgacactttggtgtaaaaactgttctgagaacattgctttttatatttccattttcttcaagactgtccttgaaaataatctgttgctcatgttggttcctgaattacagttgggctatgagataaatatgagttttcaggatttgtataattccctattttctgttagttcagtcctttcatatactacacgtcaccactgatgactgtctccttgaatacattctttatttaacctttttccactattctgccttttctccttcccatctggtgctctgtctcagactctgcttgttcccactctttctggctactaaatgttggagttttccaaggctctgtttcaagaacttctacattttctacttctactctcggcccctggaacctctcccagtctgatagcttcaaatatcttctatttgttcataaatatcaaattttaatatctggctaaactctgaacattttaagtccaaactagtacacataattgtccacagatatgctattttcaaataaatgtattcaaaaccagaatgatttcatctcccaaatttataactcttctactatagataatggctctaccttttactaaggtgttctatctgaaagcctaggggtaatcattgatcctttctcttaagccccatagccaaatcatcatcacatcctgccaatacctcaatgagtataggccctaatgtcttctcatatcctctgtgttttctgtagtagactcttaattgactttctgcttccattgtattaaaattatctcatgactcctgcttaaacccttccaatgattttgcatcacacacaaaaaaaataaatacaaagttgttagtaagggcaatctgatcctaaaaacatttcttttttgcctactcatctgatttcatcttgttcatttccctttcacacattttccttgttcctgcctccttggctttgccaaggcaatagtcctttaccaggaaaataaggtggcaatataatacactcatctctcagatttttggctaataaatttaccttcctcttctccaggcgttctctaatactccctttaaattatctttcttcagcaaccctgtctgaaattatagcatatattttatgtatttacttgtttactgtttgtctcccacataagaatacaagctttattagggtagggactgtagctgagtaccttgaatgttacctgacccataatatgtactcaaggagtatttgaataaataattttttatttataaaaaaatttatttataaattttatttattcataaaatttttataaattttatttattcataaaatttttataaaattttatttattcataaaatttttataaatttatttaaaaattatttataaaaattttatttataaattttatttataaaaaatttatttgcataaataagtgaatggataaccacacatcaagggtgcccagacacttcaactgatatctaaagtattcatatatttgaaggtttgggaaatagagaacattgaataaaccttgaaagcatgttagggaactgccagttctgggataatatttttatataaaccactgatttcacctagtggtggatggtcagttcacccactgaagatttatagaaacaaggacacatttttttagaaaaactttggcctatatggacagaatcagacttattataatcatatacaatggcaaaccttgtatatgatttgcttgtgaaagagtgggggtttagcagaagacatcgtaggacttggggcacagtgtcatgcaatgtcagcaactttgcttgcatttgaataataatgataataacaagagttgttagctatcagtttgagtattttactatgtatcagactgcatgtattacatgcattttcatacctacaataagttcagaagttggtattaatagtacctacatttttttttttttttgagacagagtcttgtactcttacccgggctggagtgcagttgcacgatctccgctcactgcaacctccgcctctcaggttcaagtgattctcctgcctcagcctctcaggcagctgggactacacgagcccgccaccatgcccggctaatttttttctatttttagtagagatagggtttcactatgttggccagccaggtcttaaactcctgacctcatgatccgctcgcctttgccttccaaagggctgagattacaggcgtaagccaccgcgcccagccctactacctatatttttaaaataataaaatctaggctttaagaattatcttctgaaattttcttagctggaaaatgccaaagttattaattgaacaaacttggctcacactaaaaccgaagtcttttaataacaaatcaacttaacatttttcagtactatcttaaaggcaatagtcctttaccaggaaaataaggtggcaatacaattgagcaaaagtgcttggcaaagatactatagaatttgataccctagtaaatctcgccttagaacactttctaagaggttatgcagcacataattcaagtcacctccagaacaggaggtcaatgatgaaagaggataattatagcaccaactgcttcaagaacaaatttttagagtttttgctagcatgaggacccattcagtctgtaggacggtgactaaaattacttatgacaatcagattggctctcaaaaacataaaataagttaattatacttagaatcttctttttaataaagccaaaatttttttttgcatatggaattatgcctgtaattgataaaatgaaaaagaaaacatgctggtattatggaatgttatctctcagatgcctaaaatagtttgctatccagaacatcttagaacttcctggatgatttttacagataagattgtatgtatataaatatgaacatatgactaaaatagtttgctatccagaaaatcttagaacttcctagatgatttttacagataagattgtatgtatacaaatatgaacatacatgttacatagtgactacatcaataaactttttattctaagattgcaattattctatagatataccacaccatcatgaaagtgtggccctgagaggactcatttagcctgcaagaaacattttgattcttttatcacccttgttatcaaagcacattttattttatatcacatattatgataactatactaaataactaaaatgatgtagactttcctctcaaaacatttaaaagtttttttctctctctgtcctttcctaaaatcttccttcccttcttcccttctttttgctttcccttcctccctcctttcctttctttacttctttccaaagtctttttaaaatagttgcataaataagctatataataggtaaaggtaataggctttgggaaacagctctaattcctaatattatttctgggaaatttacaaaatgaatcaagtcaaattcattgttttaagaaattataaaaatagctgtggctttaatcttggaaaaaattgtcattttgaaacccagaatttcaagtactctaaaaaagttataaacttgatcacttaaaattatgaattagcatttattaagtatcttttaatactttattccactaaaatataatagatatgatcgaagtattctaatgtataaaactcacccttattagttatgttttaaaaactaaaataatatagtaaatgagtttatgaattatatattttaattattatatatgtgacaattaaatatttaaataatcattcatatatatatgtatatatattttaaagacaggatcttgtgttgtcacccaggctgatgtgcagtggcatgattatagctcactgcagctcacacaatctttctgcctcagcctcccaagaggcttgatatggtttggctttgtctccacccaaatttcatcttgaattgcagttctcataatccccacatgctgttggagggacctggtgggaggtaacttaaacatgggggcagttaccctcatgctgttcttgggacaatgagtggcttctcacgaaatctgatggttttataaagggcttttcccccttttgcttggcactcctccttgctgctgccatgtgaagaaggatgtgtttgcttccgcttccaccatgactgtaagtttcctgaagtctccccatccctctggaactgtgagtcaactaaaactctttcctttattaactacccagtcttggacagttctttatagccatgtgagaatggattaatacatagctggaactacaggtgcatgccatcatgctgaactaattatttttaattatttgtagagataaggatttctttatgttgcccaggttggtccagaactcctggcctcaagtgttcctttcagtttggcctcccaaagtattaggattacaggtgtaaaccactgcacctggcctagacaaacattaaatttccaaatatttgcttttattttaaattgtattaggaatagacagaagtctcttttatatatacccaataagttaatgtttctttcaattaaatacttcaaataatcatattttttaaagtaaactatagaaaacatttaaaatcaatatgaaaattttaaatattaatttctacttcattcatgataatatagtatgtatattctaccgtatctctctatgcatagctgtatatatgtcaagaggaattttttggaccatgaataatgataaaagctatctatttacaagtaaatcaatatttggaggaggttccaagatggccaaataggaacagctccagtctacagctcccagcgtgagtgatgcagaagacaggtgatttctgcatttccaactgaggtaccgggttcatctcactggggcttgttggacagtgggtgcagcccatggagcagggtggggcattgcctcacctgggaagcacaaggggttgtggaatttcctttcctagacaagggaagccatgacagatggtacctggaaaattggtacactcccactctaatactgcgcttttccaacagtcttagcaaacggcccaccaggagattatatcccacgcctggctcagagggtcccacacccatgaagcctcactcactgctagcatagcagtctgagatcgaactgcaaggcagcagtgaggctaggggaggggcatccaccattgctgaggcttgagtaggtaaacaaagtggacaggaagctcgaaccgggtggagcccaccacagctcaaggaggcctgcctgcctctgtagactccacctctgggggcagggcagagctgaacaaaaggcagcagaaacttctgcagacttcaatatccctgtctgacagctttgaagagagtagtgcttcccccagcacagagtttgagatctaagaacggacagactgcctcctcaagtgggtccctgacccccaagtagcctaactgggagacacatcccagtagaggccgactgacacctcatatagccggacgccactctgagacgaagcttccagaggaaggatcaggcagcaacatttgccattctgcaatgtttgctgttctgcagcctccgctagtgatacccaggcaaacacggtctggagtggacctccagcaactccaacagtccagcagctgacggtcctgactgttagaacgaaaactaacaaacagaaaggatatccacaccaaaaccccatctgtacatcaccatcatcaaagaccaaaggtagataaaaccacaaagatggggagaaaccagagcagaaaagttgaaattctaaaaatcagagcacctcttctcctccaaaggaacacagctcctcactagcaatggaacaaagctggatggagaatgactttgaggagttgagagaagaaggcttcagaccatcagtaataacaaacttctccgagctaaaggaggatgtttgaacccaccacaaagaagctaaaaaccttgaaaaaagattagacaaatggctaactagaataaacagtgtagagaagaccttaaatgacctgatggagctgaaaaccatggcacgagaactatctgaggcatgcacaagcttcagtagccgatttgatcaagtggaagaaagggtatcagtgattgaagatcaaatgaatgaaatgaagtaagaagagaagtttagagaaaaaagaataaaaagaaatgaacaaagcctccaagaaatatggaactatgtgaaaagaccaaatctacatctgattagtgtacctgaaagtgacagtgagaatggaaccaagttggaaaacactctgcaggatattatccaggagaacttccccaacctaacaaggcaggccaacattcaaattcaggaaatacagagaacgccacaaagatactcctcaagaagagcaactccaaggcacatgattgtcagattcaccaaagttgaaatgaaggaaaaaatattaagggcagccagagagaaaggtctggttacccacaaagggaagcccatcagactaaaagtggatctctaagcaaaaaatgtacaagtcagaagagagcaggggacaatattcaacattcttaaagaaaagaattttcaacccagaatttcatatccagccaaactaagcttcataagtgaaggagaaataaaatcctttacagacaaacaaatgctgagatattttgtcaccaccaggcatgccttacaagagctcctaaaaggaagcactaaacatggaaaggaacaaccagtaccagccactgcaaaaacatgccaaattgtaaagaccattgatgctaggaagaaactgcatcaactaacgagcaaaataaccagctaagatcataatgacaggatcaaattcacacgtaacaatattaaccttaaatgtaaatgggctgaatgctccaattaaaagacacagactggcaaactggataaagagtcaagacccatcagtgtgctgtattcaagagacctatcttatgtgcagcgatacacataggctcaaaataaagggatgaagatctaccaagcaaatggaaagcaaaaaaaaaatagcaggggttgcaatcctagtctctgataaaacagactttaaaccaacaaagatcagaagagacaaagaaggccattacataatggtaaagggatcaattcaacaagaagagctaactatcctaaatatatatgcacccaatacaggagcacccagattcataaagcaagtccttggagacctacaaagagacttagacttccacacaataataatgggggactttaacaccttcaggtcttcagagcagaactgaaggagacagagaaacaaaaaactcttccaaaaaatcaatgaatccaggagctgtttttttttaaaaaatcaactaaattgatagactgctagcaaggctaataaagaagaaaagagagaagaatcaaatagacacaataaaaaatgataaaggggatattaccactgagcccacagaaatacaaactaccatcagagaatactataaacacctctatgcaaataagctagaaagtctagaagaaatggatgaattcctggacacatacaccctcccaagaataaactaggaagaagttgaatccctgaatagaccaataacaggctctgaaattgaggcaataattaatagcctaccaaccaaaaaaagtccaggaccagatggattcacagccaaattctaccagaggtacaaagtggatctggtactattccttctgaagctattccagtcaatagaaaaagaaggaatcctccctaactcattttatgaagtcagcatcatcctgatactaaagctggcagagacacaacaaaaaaagagaatttaaaccaatatccctgatgaacatcaatgtgaaaatcctaaacaaaatactggaaaaccaaatccagcagcacatcaagaagcttatccaccacaatcaagtgggcctcatccctgggatgcaaggctggttcaacatacgcaaatcaataaacgtaatgcagcatataaacagaaccaaagacaaaaaccacatgattatctcaatagatgcagaaaaggcatttgacaaaattcaacagcccttcctgctaaaaactctcaataaactaggtattgatgtaacctatcttaaaataataagagttatttgtgacaaacccacagccaatatcatactgaatgggcaaaaactggaagcattccctttgaaaactggtacaagacagggatgccctatctcaccactcttattcaacatagtgttggaatttctggctagggcaatcaggcaggagaaagaaataaatgatattcaattaggaaaagaagaagtcaaattgtcccttttttcagatgacatgattgtatatttagacaaccccatcatctcagcccaaaacctccttaagctgataagcaacttcagcaaagtctcaggatacaaaataaatgtgcaaaaatcacaagcattcctatacaccgataacagacaaacagagagctaaatcatgagtgaattcccattcacaattgcttcaaagagaataaaatacctgggaaccctacttacaagggatgtgaaggacctcttcaaggagaactacaaaccacggctcaaggaaataaaagaggacacaaacaaatggaagaacattccatgctcatggatacgaagaatcaataccatgaaaatggtcatactgcccaaggtaatttatagattcaatgccatccccatcaagctaccaatgactttcttcacagaattggaaaaaactactttaaatttcatatggaaccaaaaaagagcccacagccaagacaatcctaagccaaaagaacaaagctggaggtatcacgctacctgacttcaaactatactacaagtctacagtaaccaaaaacagcatgatactggtaccaaaacagagatataggccaatggaacagaacagagccctcagaaataataccacacatttacaaccatctgatctttgacgaatgtgaccaaaacaagaaaaagggaaagcattccctatttaataaatggtgctgggaaaactggctagccatatgtagaaagctgaaactggatcccttccttacaccttatacaaaaattaattcaagatggattaaagacttagatgttagacctaaaaccataaaaactctagaaaaaaacctaggtaataccattcaggacataggcatgtgcaaaggcttcatgactaaaacaccaaaagcaatggcaacaaaagccaaaattgacaaattggatctaattaaactaaagagcttctgcacagcaaaagaaactaccaccagaatgaacaggcaacctacagaatgggagaaaatttttacagtctacccatctgacaaaagggctaatatccagaatctacaaagaacttaaacagatttacaagaaaaaatcaaacaaccccatcaaaaagtgggcaaagcatatgaacagacacttttcaaaagaagacatttatgcagccaacagacacatgaaaaaaatgctcatcatcactggccatcagagaaatgcaaatcaaaaccacaatgagataccatctcacaccagttagaatggtgatcattaaaaagtcaggaaacaacaggttctggagaggatgtggagaaacaggaacacttttacactgttggtgggacagtaaactagttcaaccattgtggaagacagtgtggcgattcctcaaggatctagaactagaaataccatttgacccagccatcgcattactgggcatatatgcaaaggattataaatcatgctgctataaagacacatgcacacctatgtttattgtggtactattcacaatagcaaagactttgaacaaacccaaatgtccatcaatgatagaccggattaagaaaatgtggcacatatacaccatggaatactctgcagccataaaaaaggatgagctcatgtcctttgtagggacatggatgaagctggaaaccatcattctgagcaaagtattgcaaggacagataaccaaacaccacatgttttcactcataggtgggaactcaacaatgagaacacttggacacagggcgaggaacatcacacaccagggcctgtcatggggtggggggaggggggagggatagcattaggagatatacctaatgtaaatctcgagttaatgggtgcagcacaccaacgtggcacatgtatacatatgtaacaaacctgcacgttgtgcacatgtaccctagaacttaaagtatattaaaaaaataaattaaaaaaacaaatcaatatttaaaattgcgttactacggcgatatatttcttttctatatcattttgaaattgtgataaaattgctttaatatgaacactaaaagcagtatacagaattactttcttaaagttcttactgaccagtaaattacttttttggttccgtactctcatcaaccaaatatagtgttctctatttaggtttagaaaaatcttgaggtcattagttatttccctgtattcacacagtattaccactagaccacagcatttaaatagatttttaaaagatttttagaaaaaaaaatcatagccattgctccttcactgctgaagacagaatgagatttggtttcaacaaatacttagatatgaggaagagcctttctaattggtaaagtaacatagtctccttcagaaggatacatgtattttagaaataaaatattcaaaataggagcatgctattacaggaaggttactaaatcaaagtgagctgaaaacgttgccaacatagaataataactgaatttaatgacaattttatatttgtttatttgtttattttaccttatttttcttgagacagagtttcactctgtcgtccgggctggaaggcagtggcgtgatcttggctcactgcaacctccgcctcccaggctcaaatgattctcgttccttagcctaccaagtagctgcgattacagggacgctccatgcctggataatttttgcatttttagaagagacagggtttcaccatgttgcctaggctgctctcaaactcctgagctcaagtgatccacccaccttggcttcccagagtgttgggattacaggcatcaaccaccacatccagccagaaattaaacacaatttaaaacaaatctctaggggctttttgttttccattagataaaatatacttaactttaaagattagtatcatacaactaagtaataatatacttatttatataagatatatttgtaagagaaatttaaaaattgtctaaaatattagaaattaaaaattttataaactactaacctgtcatcatgctcatatgttttatttctatttatttgtgaaatacagcattttttcagtccttgtttatatgaaaactgtctaaaggtttgatagttaatcactctatctttcctggaacactctttatatgggttatagaatatcatattccacactactggctgccttagtgatcactcttcattcttctatttagctgattcgtttacctattcacaactttcaagtgatggcgaccacaggcgcctctgccctttttcttattttttttttaaatttcaacttttattttaggttttggggtacatgtgcaagtctgttacacgatgtttcataatgctgaggtttggggtacaattgatccagtcatcgaggtagtgagcatagtactcaatatgtagtttttcagctcttgctcccctccttcccccacctcctctaatagtctccagtatctattgttcccatctttttgtccaggtgtacccaatgtttagctcccacttataagtgaaaacatgcagtatttggttttctgttcctgcattaattcacttggtataattgtttccagctgcatcaatattgctgcaaagggcgtgctttcattcttttttatgtttgcatagtattccatggtgcatatgtaccacattttctttatccaatacaccactgatggacactcagattgattccatgtcttagctattgtgaaaagtgcagtgatgaacatataagtgcatgtgactttttggtagagcaatttatttttctttggttatatacccagtaatggaattgctaggtcaaatgatgattccattttaggttaattgagaaatctccaaactgctttccacagtggctgaattaatttacattcccaccaacaatgaataagtgttttttttccccccataacctcaccagcatctgttttttgactttttaataatcaatactctgactggtgtgcggtggtattttactgtggttttgatttgtgtttctctgattattagtgatgaacattttttcttatgtttgttagttgcttgtatgttttcttttgagaagtgtctgttcacgtcctctgatttttaatagggtgtttgttttttgcttgtcgaattaggttctttatagatgctggatattagacttttgtcagatgcatagttcataaacactttctcttattctataggttgtctgtttactttgttgatagtctcttcgctggggcaaagctctttagtttaattagttcccactcatcaatttttgtttttgttgtaattgcttttggtgactgagtcaaaacttacgtgccaagagcaatgtctagaatgatatttcttagatttccttctaggatttttatagttttatgtcttaaatataagtaatttattcatatcaaaaaaatttttgtatgtggttgaaggaaaggcctagtttcattcttctgcatatggctagcgagtatactagcaccattcactgaataggcaatttttctctatagtttgtttttgtaagttttgtcacatgtcagatggttgcaggtgtgtgactttatttctgagaactctattctgttccactggtctatgtgtttgtttttgtaccagtaccgtgttgttttgattactgcagtcttgtattaataatatagtttgatgtagggtagtgtgatgcttccacctttattctttttgctttgctcatatgagttatagtaccatgcttaaccctaggtaatgtggggttcattcattcattcattcatttaacacgttcactaaatagaaattactgagttgtgagagtataaaaaatgaaaaagctcacaaggagatggagttgatctcacacccccttctcctgaatgttctttagaaataattcatccatattgaccttatcaaacaccaacctccttcctacctcaagcttttccatttgcttttgtctttgcctgtaagactcttgcatcattatcctcttttaacattctggtctcaaatgacacaaactcctctgcatatactcatccacaaactactctatcactattatttttatagcacatatgcttatgtgaaattatgttacatatttacttgtgtatggttttgcagcctgtctctgtccatcatctgtaagctccattcgagtagattttttttgtgatttgccattatttaagagggcaataataatttgttaaatgaatactacaactgatttaaactgtcccatagaagtgatatttacggtgtcttttaaataaacatagaaattaaccttctcagtcttaaaacttgagagagctacatttgttttatctgagttattttctaaggacaccaaccatcgggcctcccagagagtatcaaggaactgaaacttactagagcactgcatctgggcaacgagatacaagacccttcactgtcatgactggctaactgagtccctgtttactgttaaccaactcatcttctttatctgtccctaattcctgttttcctgcatgtagttacatttcttctctgcaatataaacccctgattttagtcagtctgggagatgtatttgacactaacctcccatctcctgggctgcagcacctgattaaagccaaccctggcaatgctttttgtctcagtgatcggctttctgtgcagtgagcaacaggacctagaccaaggatgtccgatcttttagcttccttgggccacattggaagaagaattatcttgtgccacacatataatacactaacactaatgatagctgaaagctttaaaaaaaatcacaaataaacctcataatgttttaagacagtttatgaatttgtgttgggctgcactgaaagctctccttggctgcatgtggcctatgggccatgagttcgacaagcttgatcctagaccaaacccctgacatttcagtaacacttacgtgtatgtgtatcatgagctgccaagatgtataacacatggggattatgagaaaaacagttcaagataagatttgggtggggacacagccaaaccacatcattccaccctggcccctttcaaatctcatgacctcacatttcaaaacacaatcatgccttcccaacagtccctcaaagtcttaactcatttcagcattaatccaaacgtccaagtacaaaatctcatctgagacacagcaagtaccttctgcttatgagcctgtgaaatcaaaagcattgttacttcctagatacaatgggggtataggcattggtaaatacacccattccaaataagagaaattagctaaaatgaaggggctacaggccccatgcatgtctaaaatccaggggggaagttaaatcttaaagctcccaaatgatcttctttcactccatatcatatccaggtctcactgatgctagaagtgtgctgccatggccttggacagcactacccttatggctttgcagtgtatagccccctcttggctgctttcatggctggcattgaatgcctgtagcttttccaggcacacacagcaaactgtcagtggatttaccattctggggactggaggacagtggctctcttctcacagctccactaggcagtgcaccagtggggactctgtgtgggggctcccaccacacatttctcttctgtacttccctagcagaggttctccatgagaattctgcccctgcagcacacctctgcctggacatccaggcatttccatacatcctctgaaatctaggcagaggttcctaaacttcaattactgtcttctctacacccgctggaccaacaccacatggaagctgcctaggattgagaattgcatcttctgaagcgatggcctgaactgtaccttggcccattttaaccatggctggagtggctaggatgcagggaaccaagtcctgaggctatacacagcaggggggtccctggacccagcccaggaaaccatttttccctcttaggcctctgagtgtgtgatgggaggggatgctgtgaatgtctctgacatgcccagcagacatttcccccattgtcatggtgagtaacatttggctcctcattacttacgcaaatttctgctgccaactggaattcctctccagaaaatgtttttttttttttttttctactgcatcatcaggctgcaaatttttcaagcttttatactctgcttccttttgaacactttgctacttagaaatttcttccaccaggtaccctaagtcatctctctcaagttcaatgttccacagatatctagagcaggggcaaaatgctgcgtctctatgcatagcaagtgtgacctttactccagttcccaacaagttcctcatctccatctgagaccaactcagcctggactttattgtccatatcactttcagcagtttgttcaaagccattcaacaaatctctatgaagttccaaactttcccacatcttcttgtcttcttctgagccctccaaactgttccaacctctgcctgttacccagttccacagtcacttccacattttcagatgcctttacagcagtgccactctacctggtatcaaattactgtattaatccgttctcacactgctatggggacataccagatacttggtaatttataaagtaaataagtttaattaactcatagttctgcagggctggggaggcctcaggaaacttacaatcatggcagaaacatacaagacatccttcttcacagggtgacagcaaagagaagtgcagagtgaagtaagggaaaaatcccttataaaaccatcagattttgtgagaactcactcactatcatgagaagggcatggaagtaacctccccatgattcaattgtctcccactgggtctctcccactacacgtgaagattatgggaactacggttcaagatgagatttgggtgaggacacagcaaaaccatatcaccctctaagaatttatttatctaagaatggggatacattgttggcaagttttcaatctataacctataaatatctgctaattttcgcattgacagcttctcatattcgtctctcaagatggtggacaaggatgagaaacataggtatgcttttgtactcatgggcctcacaattggacaggttggagagacaaaatgtacacataaaaacacaattatttcccaacatttctgattaaaactgtgaaaaggaaacatgtggtgctattaaacggaggtgctacaactagagaacagatcttaagatttatagtaaactagactttaaaactcactgcagacactcacaaatcacaaaatacacaaaatgtattttagttcatagagcgtatagtaattgtgttatatgtacagtctaatttagtatatcatttgagtattaaaatgataaactaggccaggtgcggcggctcacgcctgtaatcccagcacttcgggaggccgaggtgtgtggatcacctgaggtcaagagttcgtgaccagcctggccaacatggtgaaactccgtctctactacaaatacaaaaaaattagtctggcatcgtggcgggcacctgtaatccaagctacttgggaggctgaggtaggagaattgctagaactctggggcaggaggttgcagtgagctgagatcacaccactacactccagcctgggtgacagagtgagactccatctcaaaaaaaaaaaagaaaaaaacttaattttattaggattttgaacaaggggtaaaagtagacatatatcagtaggaagttacataaattaaagctgtcttttaaacaaaaagtcttcctaatttttggtaagaacgttattaaaatatgtatattttaaaaatgtgtgggattctaaaggccctgtcagcatattttcacgaaaactttcttctcgaatattacagtgccatggatgacatcagagttacttcaagagtttaggtattaatatcctaaagtttacagttgatgaggatgtaagcactgtaccaaactagatgcaaagttgtgtttttccatcactctggaagtgaggagaaagaggaggaaaaattaactaacatcaatgtgcttcacatgagctaagtgtgtcattctccatcaagcccaaacaataatccagcaaaatagttcttcttattcctatatgattacaaggtttaaagaggttaattaactgctgtacaatataatttttatgagttaaacaaaaacaacaacactagtgacatcagtcaataattttcatatactctagagtgcccaaacctaacggcactcaggaagaacatgatttatgacatctattataaaggaatcaattttttttggttcatgatttaggtatctttctaaatatgattgggggtagtatgtaacttatttaaatattatgtggtttccaaaatatgtaacaaatgatatcagctttgtgatgtccttttatctgctaaatttgaaatgtgtaaaattcaataattatgagtatggatatttactcatatctgtattaacatgaataacacatggcagacaaatcctgcattggtgatgctcacattagatttttaaaataaaaatgtgatataattctacagagtaataaggcgagaataattaatatagcagaatgaatgtaaatttacaccaagaaaatagaataataagatttcaattattttcttcattattcagcacattttctacttttgatttctattcttacagtgtgtgttaaacacaatatgtttcgacttagttatcatgagaatataattaattactacagaaggtaattgcatacctgtatgaaggatgtttcaaacttgaaaacttagggaatttcagtgaggcatcacgctacctgacttcaaactatactacaaggctacagtaaccaaaacagcatggtactggtaccaaaacagagatatagatcaatggaacagaaaagagccttcagaaataacgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaaggcaaaattgacaaatgggatctaattaaactcaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaaggtggcaaaggatatgaacagacacttttcaaaagaagatatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacacttttacactgttggtgggagtgtaaactagttcaaccactgtggaagtcagtgtggcgattcctcagggatctagaactagaaataccatttgacccagcaatctcattactgggtatatacccaaagaattataaatcattctgctataaagacacatgcacacgtatgtttattgcggcactattcacaatagcaaagacttggaaccaacccaaatgtccaacaatgatagactggattaagaaactgtggcacatatacagcatggaatactatgcagccataaaaaatgatgagttcatgtcctttgtagggacatggatgaagctggaaaccatcattttcagcaaactatcacaaggacaaaaaaccaaacaccgcatgttctcactcataggtgggaattgaacaatgagaacacatggacacaggaaggggaacatcacactctggggactgttgtggggtggggggaggggagagggatagcattaggagatatacctaatgctaaatgacgagttaatgggtgcagcacaccagcatggcacatgtatacatatgtaactaacctgcacattgtgcacatgtaccctaaaacttaaagtataataataataaaaaaatataaaaaaagaaaatataatggactaaaataattaggtccttagtatcaggggaaatcttgatttagtcatttttcttaaacacataattatcaagaaattacttactcaggctcacattgtttccttcataatttcttcatagttatagcaatcacattgtagcagggaataccaaacttattattatcattaaaaacaaatattaagtaatttgttttcaagaacacaaatattttaccccgacatggtttccaaaattctttttcccaaagtctttgaggcaactactctgactgattttgtaacagtgcaattcacaaaatctcccaagtatgatttaacatcaggaattactataaaggaattactataaagtggtttgggtgtgtgtgtgtttgtgtgtgtgtgtgtgtgtatacatatacacacacaaaatatatatatacgttttgcaggcatgtgacttagtcatattttagtgaatttaactggatgtcaaggtatccttaaaggacaaaagagaaagaaaaaaaaaaaaacagcaggcggaactcttcatgtaaccactgagaaagtcctgtgctttttttacttcttcctccctcttccctgtttttaacacctggaatgaccaatatgttttgacaacatgttggcaagttccttatgcagtttgacacttaatataaggtgtttgtatagttcagtttctacagataggatattgacacagctatttaagattgtaaaaaatacttgctttagggctatttaccactaaatgttttgggaaatgtgcttttcaaaggtaaacgtaactcgacccttaaaggtatgaaataacacattccttgtaaaatttatttatttaaacacagttgttaagtttatgaagttgacatttggcacaccgtcagactttcctaatacaaaaaattcatgtagccaaaggaacttagagatgaaccttatctgagctagtaattagtgaccctatattctatgccttaaattcttaacactgtcttcacaatctacaagattaagcaggatccaacttaggtttccctctccatcctcctgaaaaaaaaatggccttggtttttgaaacttactgttcttcctcatacttcagggcctgattcttttgttacgtgactttatcttggcataaccttcagacctccgctcagaatcacttctagaaccttccttgactctctagatacaatcatgctccctcttatctggtttcatagaaccctaaacatttctaagtgcttttctttttttttttttcttttttcttttctttttttttttttttttttgaggcagagtcttgctctgtcctccatgcttgagtgcagtggtgcaatctctgctcactgcaagttccgcctcctgggttcacaccattctcctgcctcagcctcccaagtagctgggactacaggcgcccaccaccatgctcggctaattttttgtatattttagtagagacggagttttaccatgttagccaggatggtctcgatctcctgaccttgtgatctgcccacctcggcctcccaaattgctgggattacaggcgtgagccaccgtgcctggccttacttgattgactttttaacttttatcctttcaagtttgaaataccaaggcttggaaccatgacagttttcccttatgcttaatctagcatctcttatataatagaatctctttaaataatattcaatgcacaaacatatagtaaatcttgaggaatttttattgtgtttggatctcaagggcacagatttgagttaaatattacctatagtttatgaaacattatcattgatggatcttcaaggcatatttgtttattcatttctttctcttcttttattctcatacctgtttttcctatctctctttgccaccaatggcaatctttttaatacatttaaggagtatcttttaactagaccatttatggtacattgtattatagtttagcaaatatcccctcccctttcttctacttcctattctgattttttgggctaggccatgtgacttgctttggtcaacagacatgaagaactgtgacacgggagcagtctttacatgtcatcatgtggttaggcaagttctcttaggattctattctcactatgtgaaaagcaggcctggttagccatgcgtccctgcagaaggagatatgtggaacagacatgagcccagacaaggtcagccaactcctagctgcctcacagacccataaataaaaatattgatctttgctattgcagaacagtgagattttggtgttgtttactaagaattgtttttgtaggaaaaactgtagaagcttctgtgtgcttaaaaaaaaaactttatataatggtattgctttctttttctattttcattgagcactcagttcttacacttcattctttttgctatgtgttaatcaaatcctgctgcaccagaagttcacagggtacttcacactaactaatgatcacagttgtataggaatctctggtatatgttagaaagttcataatatgacatacaatgttcctgacagtggcattgtcttgaatgcttttaaattatttgactctgtagtaaagatggcttgaggttggagagaggatggggtggcaggctctccattaccatggtgagtggaacagccaggtgtgaagccaaacaagctgtagcatttagccacaatggtagtgtagtcaaagggaaacttcaaaacagaatacttgggtccagtccttagattataaacacaccccgagaaaagatcaagcagggaaaaaattgtcatggtcatgtttcagaggcatagcaccttcctgactccctactaccttatgctacccacttcttctctacaacttatgctcaggttcctggacctctgacctttacaggattttccagaatgcaggggaaaagcacaaagagaaggaagcagatcacaaaatataaatatggatgacagatctcatagacttaaaccataaaaaaggtcagagtaaacataaaaaaaagatagttaatatatattatttactatgtagtaggcaccaactgttccacataaatgacatcatttcaacatcacagcaaccctataaagtatttcttttgtttttagaacacatgaaatatattctttaaacaaatttttaagtgtatcacacagtattgttaactacagtcacaattttggaaagcagatccttagaacaataccagaaaaacaaacaacaaataactcaattaagaaatgggtaaaggatttgaataactttttcaaaaaaaaacaacaacatacacactcgacatacaaatggccaacagtacataaaaatgtgctcaacatcattagtcataatggaaataaagtcaaaactacaatcagatatcgcctcatgctttgtaggatggcttttatttaaaacaaatttttttaaagttagcaagaatgtgaagaaattgctacacttgtgcattgttggtggaaatgtaaaatggcactgtcaatatgagaaacagtatggggtttcctcaaaaaaattactaatgtaactaccatatgatccagtagttccacttttgggaatttattcaaaatatttgaaatcaggatctttaagagatatctatctgtactcccatgtgtactgaagcattattcagagtatccaagatgtggaaacagactaaatgttcattgatggatgagtggataaagaaaatgtggtatatgcatacaagtgaacattactcagctttaaaaagaaggaagtactgccatttgtaacaatgtgaacgaatcttgaggacattatggtaagtgaactaagccagtcataggaccaataccgcatgattgcatttacatgagatatctaaaatagtcgtcaaactcaagaagcagaggtggttgtcaggggctaagggaaaggggaaatagggagtagctgttcaagggttataaagttttaattgtgctatttttgttctcattttccagatgccagaactgagggttacagtaaattaagtgacttgaccaaggccacagggctagtcagtgggagtttttgaagttgaaaccagacattcttgctcctgagcccacacttttgaaaccacttaaaattttattgagctgataaactatataaatttgcatatgaggggccatcatacaccagacacaattcatacaaagaaaagaatatctaaatatatactagtaaaaaactttaatataaaaatggagatttttttaagcagataaagctaaaatatctaaaaatgaagaaaaattaatttggcttcacactttataatttattaaataataaaaacatagcgaaacatcatctatatagctttaaagggaaaaacttttgacccaagactctagtagtctttcaagttttctaagtataagcaaaaaaaaagtgtcatataagaacttacaaagtgtatatcctcaataaattgaatacataaataaactaagagatgcagcaaatgcagagcttaagagtggatgggtcagaatataaaaggagtgttgcacgtcatacataggtttaaatatggaaaatataaatggctgtttaaaaatgcctaggaaatataattaaggcaccataaattatttttaaataaaatgtatgtgactaattcttcaaagaaaatataatgaaaataaacttacagagttaaaaacaaaaaggtgagtcataaataaatgtcatgtccccagatgcctcagacacatgaaaattaaaagagtaagaaggcagcatcaggagaccagaggccaatttaccatgaaggccgcccatgggttcctaatcaacagaactatggtccttcatttaaatttcattgtccttaccctgtctgcaaagtttttcaccattcatttccttctctccattgaaaacttcttttcacctgtaccacattactagcaggtttcccttccatcttgtcagtctttaatttctctggctctttccactaatcagtccttgacatatccccaaattctgagagtctatttccaggtttttctcttatctaattatgttttcattcttagagaatggatttactttcagagtttgaacctcaactcaggtaactcctgtgttcacgtttcttttttaagctcttagtctgatattttctgcccgatccatcccaggctctttaaatgcaaccacatcatccccgcgtcagatcaaagcaatcaaagcagctgcggcaactcaatacctatcatctagggtccttctcacggagttgctgatctgtgtgaaggcaaccttagcctcacactgccatctgcctctagcctcccctcagcattaggtttcatgtactccttggtttgataactgggcaacagataaggtttctgccagccccatggtacagctccttcagcctccatcctccacacctgaggccgaggggatgggggagggtgtgggtgccaatttttctcattctatagatagttgcactcagatgttttgaaatcatttaaaatttaatttgtcctaaaagtgacctcaggctgtgacacagtctctaggctatgttaggtctgtgtttgattgtagggctacggtccaaacatagccaccatgcaagaaaatgaacgaattgcaaagaggacaaagataagaccaggaattatgagtggcttaatttagagggtgttaaggccaagaatccaggtcatgagaagccaagataccctttcagagggtctgtttccatttcccctggcaagacactcagaataaagaatatcatttaagccataagggaggtctgtgggccagtcccagagaaagtctattatatttcactcaattttcttggaaatctgtcttgtttaaagtatgttgggacccaggtcctgtgaggtatattcttattccccactcccgaaatatgtgaattattgatactgttaaaagaaaagctttagacaaatttaagagtttaattgagaaaagaaaaaaaacatgatttccaaatcagcccctagaatcaaagaaaattcggagagactttggcactgtcacaaggtcaaacatctatgggaaaaaaatgtgatgtgcaaaaactaaaactgagatacagaaacagctggattggttacagctcagcatttgccttatttaaacaaagtttaaacagttggccgcctatgagtggttaaagtatacctactggaattggctaagactaagctgtcattacagggaaacatactactaaagttaggcttttagtctgtttacctgctaagtatctgagtatggacattttccaggctagattttagttttatttagtaacacattatgggatctgaaggacacttttttaaaggttgaaacaaacaaattttacgcacatttccatttataacaaaagaaaaatgcccctttagctctggtaagtatgacaatttctaaattaaaagagcattatttacatctgaattgttaattctaatattaatttcaagtattattaataatataatcatttttcactaagccttcccttttatacccgtttacactttcaaatctaattatattccactgttgttttaaagatcaagccccaactgtttcatggtgtaccttctttctaattaagtatttgagacaaatgggagtcaggctgggactatagcatgtcaattttcacaagctgacattcacagtaaaagtagttcttgattatttccctaacagctttgatgttaaggggaaaaaaagcaacaacaacactgagctgtgtatattccctcctcatgctcctgggtgagaaatcatagttagtagctgctgatcttaaaaatcagagtctctgctacattgttagcaataatctaaatcaatacagactaacaacacaagccagtatgtggtgagtcatgaaaaataaatcagtagtgatatcaattgaaaatgataccaaaaaactatattatctggaaggaaaaatacaattttataacactcttggtcctgaatagttttgactatggcacacaaagcaagcaagcagcgaattacatgactgttactttctttctactgttagcaccctccgctaatagattgtaacagaatgactgtttggagggttaagcattgggaaatgtccataattacatagcatgtttggtaacatcgtgacattttaataaaacacagatatacattatagaaaagaagatctagccatctttttacactctctagagatcaataaatgtacccttgaatgacagatgggtgttgaaacccctttgcaaataattcctcaggtagctcttctaagctctgaaacgctacaatagttctcaaaatctcaacagagggaaataaaatacttcacagttgtaatgattttctctttatatatatactttctgaaaaagtatagtgagaatactaagtatttgggaactgattttaaagtccataactattaaaaattgcaagaatttttatggagcatatttatttcataaatcagtattaaagcctgaaaaaagaagtcttaaaagtctacataattctcacaatgttatatatatgttatatatatatatgttctatatatgttttatatatgttatatatataaagaacatatttctcacaatgttatatatatatgttatatacatatatataaaagaaagttggtcaaaattgttcatattgagaggtgacaacatgctggtggccctcacttgctctcagcgcctcctcggactcggcgtccactctggccacacttgaggagccccttcagcccaccgctgcactgtgggagcccctctctgggctggctgaggctggagatggctccccctgcttgcagggaggtgtggagggagaggtgcaggtgggaactggggctgtgcatggtgcttgtgggccagcacgagttccaggtgggtgtgggcttggcgggccccacactccgagcggccgtctggcgccaccggccctgggcagtgaggggtttagcacccgggccggcagctgcagagggtgcactgagtcccccagcactgcccgcccgcccacgctgcactcgaattctcgccaggcctcagccacctccccacggggcagggcttgggacctgcagcccgccatggccgaaccccccccacccccgtgggctcccgcgcagcccgagtctccccaacagggtgctgccccctgctccatggcgcccggtcccatcaactgcccaagggctgaggagagcgggcgcgcggtgcgggactggcaggcagctctgcctgcagccccggcgtgggatccactagccaaagccagctgggctcctgagtctggtggggacttggagaacttttatgtctagctggaggattgtacatgcaccaatcagcactctgtgtctagcttggggttcgtggatgcaccaatcagcactctgtatctagttaatctggtggggacttggagaacttttatgtctagctaaaggattgtaaatgcaccagtcagtgctctgtgtctagctcaagtttgtaaatgcaccaatcagcaccctgtgtctagctcaaggtttgtaaacccaccaatcagtgctctgtgtctagctcatctagtggggacttggagaacttttgtgtctagctaaaggactgtaaatgcaccaatcagcactctgtgtatagctcaaggtttgcaaacacaccagtcggcactctgtgtctagctcaaggtttgtaaacgcaccaatcagtgctctgtgtctagttaatctagtggggacttggagaacttttatgtctagctagaggattgtaaataccccaatcagcactctgtgtctagctcagggattataaatgcaccaatcagcaccctgtcaaaacagaccaatcagctctctgtaaaatggaccaatcagctctctgtaaaatgggccaatcagcatgatgtgggtggggtcagataagggaataaaagcaggctgcccaagccagcagccgcaacccgctcgggtccccttccaccctgtggaagcgttgttcttttgctctttgcaataaatcttgctgctgcttactgtttgggtccatactgcctttatgagctgtaacacttgctgcgaaggtctgcagcttcactcctgaggccagcgagaccatgaacccactgggaggaatgagcaactctggacgggaggaaggaacaactccagacgtgctgccttaagagctgtaacactcactgcaaaggtctgcagtttcactgttgaagccagcaagaccacgaacccaccagaaggaagaaactccaaacacgtctgaacatcagaaggaacaaactctggacacaccatctttaagaactgtaacactcagtgcgacagtctgcggcttccttcttgaagtcggtgagaccaagaacccaccagtttcggagacaatattaaacatgttccaattactactctactttaaacaagaaccttataaattcctaaaatatataaaatataaggaatggtacaaataatgcttcacttgttggagatgaagtgaagatgaaacataaaccctatttatttatcccaattattccatgttcacatactcacaaaagactattctgtcacaatttaaccctgttccccaaaatctcctcataaatgcagtttcaaaaagaacaaaactatgcaaataaacattacacctgtagttttgttctgtcaaatttgggaatgaaacgtctctggtgaaaagaaataaacggttagccatttttaatttcaaaaatgatcagtcattcactattcatgtctcatgtgaactacataatgtcaacgctgtcacgaaagcacggtagaaaaaagagatcctctcagcttcaatttagtagagggaaaagttcctggaatatgtttttcctccctctggagcacttcagttttgcaaaacatgtattttataattcttattttgtattcaacaatagtgctctctctggctttcagagtttttccagtttctctgatatttcaaaaagttatggtgttgtcattttatagtttaacatgagtggttctcacttcattcaaaagaaacaggataccttgaaaacgatgtggccaacctctagaaatgaaaattattattgcttaataatagtaatacctaatatatgcaggggcagaagcctggttgagcatgtatatacatcaatcatttaattctcatagcccttacatggccaaactaagtcttggagatattaagaattttttctacagtaatacaaaattaaatttctggaagtctggcacattttgtcaatcctgaagaatacagaataaacgtttatttattcacctattcaattattcaacaaatgtttcctggcagactagtaagtagcaggcttagagttagacatgagaatacaaactgaaataagttttgattcctgtcctcaaggaccttacattctagtttggaagagagactattaaataaacctacagtgttaagatagatacttacagccccaggtagtggtataggatccctgaagagtatgaaattgaaactattttcttctaattaataaacatttataacagtaacagagtagaaaacacttggcaagcctatctgaataataattattctgtctttatggtaccaacataaaataagggtaaaaagcataacatttaaaaaaaagtaattatgtaatatagtaatttcaaaaacgttcatggaattgagcttttacttaggattcgtgtaggtgcaaccaaattgcaactatgctcacttaagggtcccagtttgcaacaatgattcaaaagctcaattctgatcatagctatatcaaaagattgttggtgtttccaggggcaaaactgagtctgataaatatatactcaataactgaaataaatagattcagtatttcaatggaatgactggcatccactttctatctaatgaaaggccaatatcaattattaaacgctaaaaattactactgggagtgcaaaactgaaaacctcttccaaagaaatatgaaatttaaatctggcaattttatttaaaagagcttcaaagtgtaaaaacagagctttctctttacataaatacttacgataagtaatttatcttctttatagaacagacaacagaccaagacaacttttcgcaccttggtggatgcgctctgaatgccaagccaggcaccacagtcattactaccaaaggggaagtaataaatttactgtctatacgaagactttcaggtctgtcccatgtaggtgaaaaatagcgcgacttttaatctctcatcattaacgccattaaactctatattaaattctgtgctgatgaaaattttttttaaatgtatgttagtattgtgtttccttacactcatttattacagagtgttatggtttctatttgcaattctgtcttttctataaaattttcagtttcttgagagcaaaaactggttgccacaatgaccagtatatagttggtgctaaaaacacatatgttgaataaaattgaatacatattcctaatttcaaagtaattgtacatgttacaatgtacttaaaaaacagaaaaattgccagtttcacattcactatctttattgatgggttcaagtctatgaaatttttgcctatcatatatcccaaagcacaataaagcagtttcaaagacattttaacacacttaagaaaaggagcttctgaattaaagcccaccactttcatattaacattaatacattttgattccatatagtcacaatagagtttataagacttgtccaaatcgaagctgaaaaatgttatgatggccattcacttttaattaaatacaagcattaaaagaaatactatttatattagcaatagaaaacagaacttctaaatcacttataagattcaggattttattttcttactcttctaaaatagttcatttaacttttatttgtatttttctaaaatttatcagccaccaacttacagtgtgagcccactcagagaaaaatttaaatcatcaggataataattaatatttataaaacaaggtatttatagaaagcttttttatatgtatactattaattatacatggtattttatcactctcactataataatattttaattaaaaccttgccttgaaagataatttgggatatctcaaaaaagtaaagttctatatgataaaagaatgttaactattttctgtaagcaatcttaagctttttaatttaccaaaataaacacattcaatataagtttcatgtgatatgttgatttggagtttgctaacaaaatagtcatatatgcatacagtggaaaatacataaatttaaaacatatccagattaagtgaagcttacaaatggagacaattcatatatatttatcattgttagataaattagtaattagtacattgtgcattctagaaaaacaaaaagcatattctttgtctaggttcaataatagtcatctgaaatatgctctgtacctgtggatgaaataagtaaaagaacataaaatgtatgaataaatagggtgaaatttacagagactacttttgctgtcttgtgattcggtcatttatgagtgttaaggatttttctcagtacagttcagaatattaatcaatgccttctacttacaggagggtctgcatcttcagcataaactgttgtgataggtgtacccttgactgcatccggagccaccatccctttgtatattcgtttactaaagacaggaggataatcattcatatcctgtaaaacacaattaggagtttagtacttcagttgaaaccaggttagggatacagttactagattgactcccagtcttcatatcacacaacttatttaccactgtcagccttccatcctctcaattccattactctcatttcagactggcacctcagaggaaactgccagagttctcatacaatattaatgtgtggatatcaactgaaggccgttccactggaataaagtctttcaccctcaaaaacatgccttttggagactgaagtgaccctggaatttttttctaacttctaatggtaagaggtaaaattttaacatttgaaaataagaacaagtttctttaaaagctacattctgtgaagcaggcgtaaaagattttttttaaatgctctttatatgtttttatagcaatgtaaattattttatatacttagcataatactgactagaacatttcagatacaaactgtgaaatatcctttgttgccattttacatgataaaaggagattttctctgcagcgcactaaaataatgacacttaagattagatatatttatacacagaaaacaatgttaatttactgaatttttttcagagcaacttatatgtatcttatttttccaatttggcgctatatatgcattgttattcatgcattgtcaagttcattaaataaatagttatcaggtatttcccactttcatcagatatttagcacttcagtgcgaggcactgaagatactgttgtgactcaagaaaaagatgtccctgtctttgtgtcacttaactgccattaggctagtaaaaatactaatctgcagaaaggctagtaactttgactaaattaatctacttatcagggccaaaataataaatcaagtcccctgaaaggaagaccatatttttctgaatcattttatcttttagagataattgtatataatcttttgtcaataaataatgcttattcatatggcagatttatttatttataatattttaataatccttaccctaccgtgttttgggtagtgtgggtcaaacatatttgaactgaaacctaaatttgttaattatctgctcttctcctccaagtcccctttttctcacttgctagtaaaaacaaaatttaaaaaattctacatattctttgatatttgcttagacacaacaattttcctgtacagtattaagctggaaacacataaattaacagatctcaaacttctctttttgcaaagaagtcagaataattatttcttactatcaaacaatgcttccttttatattcgccatagagttgagttctgagtagtcaatatgaataaacctgcatattctaataggagaacttgaactgtacacaaaactgaaaaataaaaaatatcatttcttctgttttgaaatacagtattcaccatctcttctatgaaaaatatttttacaataaattatggactttagaatctgaacaagtaaatgaaccgagaagttttagttctctataatgaggactgtgaagggtattgatcttgaggctccatgcagggagtaaatatataaaacattagcattcacacattttcgtgccctttccaagagtgccaattaacttaataagtggatgtggtaactaagggtgtggaaatcctttagcacccctaaattgtaacttctgaaggttcgaaaggaaggagcccaacactgcaatgtttccatgcatgagtttccaatgagctcattatgttcttaaaaattttattctttattttattctcaggggaaatttaaaaccttaatgtcacaaggtactttttggaaaatttgattcttcagaaacaaaaaaaatgtatatacttttccaattatgtcaacacagctgttcacagtgttgaatatgatgaactttttatttgcttgggaagtattcattggattcaccttctaacttgaatgtacagtgattcacaaactgattagacacacacctaagactgtaaatgactgaagcctatgaaaagattggttctcttccccctttattttctattgacaggatgaagaataaattaatgtagttattgtagtagtatttctttttatggcacgttgtacatactttggggttataatctttcattgtggttacaaaagcagctagttgcatatagtttttccacaatgcattatttcaagaggagaaatgtattgaaatgcaattccaacaagcataatcaatagttcactgtatttatgctcagggacatctgaacaaaaatgtatataaatcggcttctgtgcaaatgttctcttgtgcagtaaattaaggactcgctcagcactccaaaaccatgctcttttctcttgcccattattccactagagggtagtattagcaaaaagaaatatttcctcctctgtagttaagaattgtatcactaaaacccataatatttgtttcttttggtaaaaatttttattggtctcaacaaaaaatagttttaatgcttcaaaagagtattctgaatgttatgatttacaacttgaaaaaccttatggtttttttcttaaggaaaactttaaaaaatggttatactcataaagcctgcaatttgtttccatgtgtcaagcaaataaaattatacctgaaggtgtaggtagctaacaggagaaaactatgttttatttatttatttgctacattagagtctgtaataatcacagaaaccttttctcctttagcagactaccaagaagatgtaaggaatctttttaatgatcatgctaggaagataagaacttgctggtaagtttgtaaatgtaatgacaagttgaagttctacacacacaaaaaaaataaaaataaagagaaaaagatgataaaatttttgattttctggaatcacaggcaaaaacctatagaacagtttttatttagaagataagtagaaagttctaactagttggaacttgatcatctttttaaaaataacgtgtaggctgggcacggtggctcgcatctgtaattccaacactttgggaggctgaggtgggcggatcacccaaggtcaggagttcgagaccagcctggccaacatggcgaaactgtgtctctactaaaaatacaacaataagcctggcatggtggcgggcacctgtaatcccagctactcgagaggctgaggaagggagaattccttgaacccaggaggcggatgttgcagtgagccgagatcgcgccattgcactccagcctgggtgacagagtgatactcagtctcaaaaaaaaaaaaaaaaaaaaagatatgtatatagcaaatgccagtccttaccatactaaagctaattcaggctctatgaggagacacagacagtataagccaatgggcggaatgactttagttgtttctgtcttatggtctagcattagcattatccttgttgagctatatggctgctctataatgccttgaggtttatggagccgatacctacttttacgtgggtgtatggttgattgtttgcctcttaccagttctgttttccactactagacactttctatttgctgtccaagttgctgtttctcatatttctcatattattagcattctgctgggtttttttctctctcaatttctgtattgtctccttgtctttactgacttatttcccttcttttatgcttctgcataaaaagtcataaaaggctacatctgcagctaaagaaaatatttgatatttttactgccaggctaggcatattcaccacaagctgatttaagaggccatgggccataagtgaacattggtggtagcctggcagtactccccaagggtctttgatagtggcacagggtaaggctcctctgcttgtggagaaggactgtttctcataggttgagtgcctgctcagccacagtacacaagaacacaaggtagaattctaaggttttgacttccagacggtaactttgaacctgttcagggcctgggagatttttgccaccctgaagggaaagacacaggtctggctggctttgccacctgctgattatagagacccatggccttgaacaaacttaagtggtagccagggtggttacagcaggtcttggacaagacccagtgctgtgctgggtttaggtctgacccactgcagtcccagcagtggggtccacaggggtgcttgtgtcaccccaaccccagctccaggtggctccaaacagagacactctgtctgggagagagcaagggaaaagaacaggagtttctgcctggtaattaagggaattcttctggatcttatccaagaccattaaggtagtaagagtctgccaagaaccacagtgttactgggcttgtggtgcctcctaaagcagatacagctttagcaacacctacatcctttcaaatacctgaaaagctttccaaataacaaatacgaagaagtccagactgtgaagaatacaataaatacccaacgcttaaatgcccagacacagacaaacatccacaagcatcaatatcatccaggaaaacatgaagtcaccaaatgaactaaacaagccaccagaaaccaatcctggggaaacagagagagtgatctttcagacagagaattcaaaatagttgttttgagaaaactcaaaaaattcaagataacacagagaagaaatttagaattctatcagatacatttaacaaagagattgaaataattttaaaaatcaagaagaaattctggagttgaaaaatgcaactgacaccctgaagaatgcatcagttttttaatagcagaattgaccaagcagaagaaagaattagtgagcttgaagacagcccatttcaaaatacacagtcagaggaggcaagagaaaaaaaagaacaaaatcaatgaaacatgactacaagatctagaaaatggcctcaaaagggcaaatgtaagtgttattggcattaaagaggagacagacaaagagataagggtagaaagtttattaaaaggaataataatgaagaacttcccaaacccagaaaaggatatcaatatccaagtacaaaagattatagaactaccagcagatttaacccaaagaacactagctcaagttatttaataatcaaactcccaaaggtcaaggataaataaaggatcctaaaggagtaagagaaaagaaacaaataacatacaatggagctctaatacatctggcagcagacatttagcagaaaccttacaggccaagagagagtggcatgtcatacttaaagtgctgaaggacaaaaaaaattcctagaagagtatatctggttaaaatatccttcaaacaggaaggagaaataaagactttcccagacaaataaaagctgagggatttcatcaacaccagacctgtcctataagaaattctaaagaaagttcttcaataaaaaaagaaagttcgtgagtaataagaaatcatctgaagatacaaaactcactggtaatagtatgtacacaggaaacacagagtattataacactgtaactgtggtggtgtataaaatattcttatgttaagtagaaagactaaattatgaaacaaaaataactacaatcacttttcaagacatagtaaaataaggtataaatagaaacaataaaaacttaaaaagcatggagatgaagtatagagtttttattagttattttttcttgtctgtttatgcaaacagtgttgttatcagcttaaataaagggttgtatgatagtatttgcaagcttgatgataacctcaaaccaaaaaatgtacaatagatacataaaaaataaaaagtcaacaaaatcaaagcaccagagtatactaccttcacttaaaggaagacaggaaggaaagaaagaaagaagacaaaccataagacaaccagaaagcaaataacaaaatggaagcaataggtccttagttataaaaaataacattgaatgtaaagggattaagctctctaatcaaatgacatagagtggatgaacggattaaagaaaaaaaagacaaaatgatctgttgcctacaagaaacacacttcacctataaagacacacatagactgaaaataaacacatggaaaaatatattccatgctaatggaaaccaataaacagcaggaatatctgcaattacaggaaacaaaacagatttcaagacaaaaactacacagagagacaaagaaggtcactatataatgataaatgtatcaatttatcaggaagatataacaattgtaaatatatatacatatatgtatatatatacatgtatatatatacatatatgtatatatacatgtgtatacatacatatgtattcagtgtgtgtgtgtatatatatatacacatacacacacacatatatattttcaacattggagagctcaaatatataaagcgaatattattaaagctaaagagccagatacatccccaaacaaaaatagctggaaacttcaacatcccactttcagcactggacagatcttccagaaagaaaatcaacaaagaaacatcagacctaatctccactgtagaacaaatggatctaacagttactcatagagcatttcatccaacacctgcagaatacacattctcctcagcacatggatcattctcaaatacaggccataccttaggtcacaaaacaagtcttaacacattaaaaactttgaaataatatcaagtatcttctctgaccacaacagaataaaactaaaaatcaataacaacataaattttggaaattatactaacacatggaaattaaacaatacattactgaataaccaggggtcaatgaggaaattgataagaaaattgaaaacttttttgaccaaatgataatgaaaatacaaagtatcaaaaccaatagtgaggtgtggagttggcaggacttcctgggttgatttggggactttcacaaaagacccctgtgactcagggttttgagttcttaatcaataaagtgaaggattcaaagttaaccactccaagggaggattgaaaaaagagccactctcaatggacaaaaagaaagaaaggggagggggtaacacagggatataagtcctagccaccacagccagcagtggcaacccttccaggtccccttccaccatgtggaagcttccctttcgctttgttcaataaactgtgctgctgctcactctcctggtctgtggactctttttgagttgtaacactcactgtgaaggtccgcagcttcattcttcgaagttagcaagaccacgaatccatcagcaggaaaaactcttgattcaataggatatactgaaatttttactacgtgggaaatttatagctataagtgcctacatcatgaaaggaaaaaaacttcaactaaacaaaacaacctaatgatgcatctttaaaaactagaaaagcaagagcaggctgaagccaaaattagtagaagaaaataaataataaagatcagagcagaaataaatggatttgaaatgaagaaaacaataaaaagatcaatgaaacagaaagtttgtttttttaaaaagttatataaaattgacaaacctttagccagactaactaaaaaagaagagagaagacccaaataaataaagtcagatatgaaaaagaaaacattacaactaatactgcagagattcaagggatcattagtggctactatgaacaaacatatgtcaataaattggaaaatcaagaagaaacaaataaattcctagacacacacaacccatcaagattgaactatgaagaaatccaaaacattgaacaaactagtatcaagtaacaagatatagcaaataacaagtatcaagctgtaatgaaaagtcacctagcaaaggaaaagccagaacctgatggttttgctactgaattctaccaaatatttaaagaagtactaatactaatcttactcaaactattccaaaaaaaaaaaaaaaaaaaaaaaaacaggaggagggaatactttcaaactcattctataaagacaataatactgataccaaagctagacaaagagacatccaaaaaagaaactataggcaatctccttgatgaatattgatgcaaaattcctcaacaaaataataacaaagaaattcaacatcgtatttaaaagatcattaatcatgaccaaataagatttatctcagggatactaggatggttcaatatattcaaatcaatcaatgtgatatatcatcaacagaatgaaagagaaaaaccatatgatcatttcaattgattctgaaaaagcatttaataaaattcaatgctctttcatgataaaaaccctcaaaaactgggtgtagatggaacatacctcaacataataaaagtgatatatgacaaacccgtagctactcccatactgaatgaggaaaaactgaaagcctttcctgtacgatctgggacacaaccaggatgcccactatcaccactgttattcaatatagtactggaagtcttagcaagaacaatcagaaaagaaaacaaaataatgatcatctaaattggaaaggaagaagtcaaattatccttgtttgcaaatgataaaatctaacacttggaaaaacctaaagactacacacacacacacacacacacacacacaccacacaaagtattagaactgataaatttagtaaagttgcaagatacaaaatcaacacagaaaaatcagtagcatttctatatgccaacagtgaacaatccgcaaaagaaatcaataaagtaatcccatgtaaaacagctacaattaaaataaaatacctaggaattaaccaaggaagtgaaagttctctgcaatggaaactataaaacatggattcaagaaaatgaagagaacacaaaagaatgaaaagatatctcatggtcatggattgcaataatcaatattgttaaaatgtccatactactcaaagcgttctacagattcaatgcaatccctgtcaaataccaatgacattcttcaaagaaacagaaaaaaaattctaaactgtgtatggaagtacaaaagacctagatagccaaagctatattaaacaaaaggaaaaaaaaaaacacctggaggaatcacattatctgactttaaataatattacagagctatagtaaacaaaataggatggtactggcataaaaaaaaaaaacacacatatatccatggaacagaattgagaacccagaaataaatttacacaactacagcaaagtcaattttgacaaaagtgccaggaatgtaaccagggaaaggacagtctcttcaataaatgatgccaggaaaactggatatccatatgcaaaagaagaaattaggccccatctcatgccatatacaaaaatcaaatcaaaattgattaaagatatgaatctaagacctcaaactatgaaatgactgaaagaaaacatgcggaaactctccaggagataggactaggcaaagatttcttgagtaatacctcacaagcacaggcaaccaaagaaaaatgaacaaatgggatcacatcaacttaaaaagcttctgcacatcaaaggaaagaatcaacaaagtaaagagacaacccacagggtgagcgcaaatatttgccaactacccatctgacaaggaattaaacagaatatataagcagttcaaacaactttgtaagaaaatatctagtaatctgattttaaaatgggcaaaagttctaaacaaaaatttctcaaaagaagacatacaagtgataaaccggtatataaaaaggtgctcaacatcattgatcatcagagaaatgcaaatcaaacttacaatgagacaccatcttacaccaggtagaatggcttttatctaaaagtcaggcaatggcaaatgctaataaggatgtggagaaaaggaaccctcacacactgatggtgggaatgcaaattagtacaaccactatggagaacagtatggaagttcctataaaactaaaaatagagctatcatacgatccagaaatcccactactagatacatggccaaaagaaaggaaatcagtatatgaaagaaatatctgcactcccatgtttattgcagcactatttaccatggccaagatttggaagcaacctaagtgtccatcaacagaataatggagaaagaaaatgtggtacaggtacacaagggagtactatttaaccataaagaagaatgagatcctataatgtgcaacgacataatcaatgaaggttaaaagtatatgagagaggcactttctggtgtctcccagaaaccagtgggtgatatttatggagccatgggagagattctttactacgtagatatactatttttaatcctggacatgcacattttctttgttttctctggtttggatttttataggaaatatgttatatcttagtcctaaaactctagaatagtagaattaaagatattttctcctgctatcaccaagttcactgacaaatataatataaagaacacaccaataggaatctgaaaatgcggactagaagagagggaaacatttgaaagccatacttcaaagcaaccccaacagaacaattagcaagttgtaaaaaacaatattaaatctgaccatacaccaactagctggttcacagaaattatcatttattcaaattcccacctccagacaatacctcttacctccatacaataggtatgctgtagatgaaatgtccagaatttctgttttgtttgagtctgggacaacctcctggtctctcaagcatcagcttttctgatgaaatcaaaagcaggaccctatcaacactgtcatgatggagcatcagtagcacgtaactgcctctcaggtgtccacggtttcacaaatgctgccttggtactgggcactgagttttcatctagaaaagctatcctttttcttctattctatggggtagcaatatttctttctggagaagaaaactcctctgaaaggtggaaatcttagcttcattttccaagactcactgtgtttaacaacaacctcagcccttgttacaaggtgaacctgatgatacttcatttctcgtcatttcacccctccctgcctactcccacacctgcacactaagacaggcaaacacaaccaagggtcaatctagtctcccgtcttcacagaagcatgtctccctctctcctactcccatgcagccattctatccaaaattataatgagcaaaatgacttgggtcatctgtttatctcagacaagttctttatactccttataatgctgcttagtataatatatccatttacatattcagcttttcagattcatattcagttttcagtttgctgtagaacagcccttttctttctgtgtattttctatattatgttacaacgcagactctaagaccaggtttctattataacttagtttgtaaggctagttatcactctggatcttttaaaattgtttagaattttattttcactttccagagatttgcttatatcatctaatttactatcatcacagattcagttcttctaaatatttagtatatctagaaatatacaagaaaaatatttacaagtaaaatacacaagaaaatatctctaatttactatcatcacagattcagttcttctaaatatttagtatatctagaaatatacaagaaaaatatctacaagtaaaatacacaagtaaatatcttgtatatacaaggaaaaagccttgttacattgatgttctataaaatcttttcaagaaaaaatgtatgttatttgtttgatcatcacaggttttgttttggattcttaaaacttgacactaagaaagctgtgtgcagatgtcttgataaaaatttttatttatactgtggaaatattgtttttccaaataatacttgaattttcccattcttgctccaattttaaacaggtttgatggactaggcattaaacacttcatcttttattttttcctcttgtttacaaaagaaattatgtttctgctcattttgaaagaaagaacttcaagatgttttcctgtggtgactttttgggtccaagtatctcctagcgaataccatacaattatgttatcaacaaaacagcttttcagtactgcgagtaattagaccaagtatagacaatttgaaaagctggtaaagactacatttgtagagaactgagaattgtactccattcttctcttaaaaaaaggataataatattttatgggcctcagtagtatatactagaattttaaagttatatttgtgataatccccaccctgagttatcagaaaagaggaaagcaagtgtcagtctacatttgggagaatttcctacaaattttattatgcttagatgaacttggaataaaaaagtggtattacatatgtctagagttaaatgttaagttttgctttaaatgtataataaataggcaatgactttgcatgagtcaggacgccttgaccaaaggaatggtgtgatttctctaaataagataaagcaattgatacaacacgaattaaaccaacactcttctctatctgaggaataaattatcttccagctgctgatgtagaagcgttaagtaatacccccatattgaaataaagggatgttgaggcaacattaagaacttttttaaagaggtatgaggcccagatacagaatgagggttacttagggcatatcttgctttttgaggtgataattttggacataatttaactcccctaacattttccatcaaaacaagccaagcaaatatatccaaattgaatccagagctgccaagtcagaatctatgagtgtttaccataactgtctgtcatcaaccacaccctcatcagagaaaaggccacaccatttgaggatctatttttcgatctgggaagaaaaggggaaatgtcattaatagcaagtcttttttttctcttctttgtccaaaatcatcaataaatgaattatttttctatttttaatgttttaactgttcaattccaccaagtcatatgagtagacaagagtaaaccaaggcaaatttttcacctggtccagaagatattttgctatttagtctatatagatcactctcaccttagtctttttcatctgcttacatattatggcatcttcataaccaccaatattatattccctaaatatttttgtaacagatttctaaatgttataacacaatagtgtgacaaaatcatatttcaaaatacaatacaatcaaagccctcccttcaggcaatccataattttgtcttgtcccttgatcctttttccagaccactagagcactgataattattgtctcgggaaagagaggtatgaaaagaaaaatcaggttaccccagaaaagattttgacagtttgagttcctatttccaaagaaaatttagtactgaataaagttttaatttcctgaaatagacacatttcttacctcctgaaataaatatcttaggacagagagacacaagaacggaataattaagtatatagacatgtggacccccgagaaataaagaacccagatcctgataaaactctcccaacaggtttagggtgtccgaggatggaaggagcttacgatctccattccaaggtagtttagaggtggaaacagtatccatagaagaaatggcatcaatttgtgtgctagcagataatccaggtcaagtgtaaaaaaagacagcgaaagaggtgggggccaagagaactaactagagggagctggtgtgtgtcaatctcattgagaaaagaaaggctggcgagtggacactagctcatctgaaaaatccaggtggagacacactggaattcatcaggaaacagcataacacatagagaacagaggagagcaagacaagacaactgcccaccctggggtggcacagagtcaggggagtcctcccactgtggagaaacagtgagtaagtgagtccctggggacccaccttctgccatggacttttgcatccctggactcaggagatctcccccatgagctccccaccggtgcctccaggctgacacggagaaccatgtggagtcttggcagagccatactcaggcacacagggagtcccaggagacttgtatccccagacactctggcaccagtggctgtagctcctgcagcagtggaggccagacttgcatgcctccagtaaaggggccaaatccacgaggctgagcagtgaaacattgcaggcctcatctcagctgcaccttgcaggataaggcctactgtccattccagccccacctgagttcctgggtcgggagcagctctgtacttctctgggacggagctcccagagggagaggctggctgccatttttgctgctctgcaaccctccctgtttttgctcttaggcttgggagggacagggattagggactaatgccgacccccaacacagcgcagtttccttacagaaaagcgggtaggctgttttccatgtgggtccacacccttgctacttctcaccgggcagggcttcccaacctaggacctcggcaacccccgacctgggctcttgggccagtagcagctctgtactttcctgggacagagctcccagagggcaaggcaggtcaccattttttgctgctccacagtcctcattcctgttgccctcaggctcaggagggaatgtggtggttggagactgatgcaaacgcccagcacagcacggcagcattacagaaaagcagctagactgctttctatgcaggtctctgcctctgctactctttactgcccagtgcctctggacttgggcccctagcacaaccaccttgtcaatgcctaacacttcagtcagtggtgagaaaaccccagagacaatccacaacctctctgtgactgcagctacccttgggctggggaggaacaaagggcttggccactatgcaggaactccagcacaccacagccacaatatggacagaagcccagtgtctgtttcccgtgagcccccacctctcactctttaccaggcagtgcctaagctcgggagcacggaacagccaccccatctccagctgagcattctcactgctagtggctttgtgtttccttaaggaggggctcctacagtcaactaacagccactctgccactgccacagcagtagttctgcccctgctgcccttggactggagaagaaagaaagggccaaaggttttactcactcttccaggaggacacagtcatcatatagagagaagcccagactgtcctccctgtgaatcctcaacctcccgttctttacccagctcaggccagcagtgcagccaccccactccctggctggacattcccagtaggagcagttttgagtttccctcaggttgagcacccagggacaaccgaaagcccctctaccactgctgctgcagtgatattgcccttgctgccctcagactgtggagggagcaaagaccctgagtgctttagccacacctccagacagctgcatcacccacaagcttggtcctacaatgcagccaccacaccccaggctgactgtactgattagtagtggctctgtatttttctggggtggagcaccaagagacaagtgaaaggccatctgccacagccacagccaaggtcccttcccttgttgtgtctaagctggggaaagaacataaagcctgagcttgccccagagctacaatgtgtagcctgggagtgccaaacagatatacagccagcagtcaagtgcaaaaggagccgacactttcagatcactgagaaggggcacaacaatccttaggaaatagaggagactgacgaagagtctacctactggccattccagttaagtgccatctgctggatcacagcccaaactttactattaaaaatattttgctaatatattcttctgtgaaaccaaggacaagagctcagttacaaataaaggtcatgcacaaaacctcactcctctgaaaacatctaaataaaccaactgactgtactcaaattagacagttgaaagaacatcagcgaacacagatgagaaagaaccagtgcaagaactttggcaactcaaaaaacaagtgtcttctttcctccaaacaactgtactagttccctagccaggattcttaactcagctgaaatagttgaaatgaaagaaatagaattcagaatatgggtaggaatgaaaatcattgagaatcagggaggaagtcaaaatccaaaccaaggaaactaaggattacaataaaacaatacaggagctggtagatgaaatggccattataagaatgaaccaaaatgatctgatagagctgaaaaacacactacaagagttttatattgtgattgcattaacagcagaagagaccaaactaaggaaagaatcagagagcgtgaagactggctctctgaactaactaagaaggacaaaagtaataattaaaaaaagaataaaaaagaatggacaaaacccctgaaacatatgggattatgtgaagagaccagatctacccctcattggcgtcactgagggaaatggggaaaaagcaggcaacttggaaaacatatttcaggatattgtccatgaaaacttcccaacctcactagagaggccaatattaaaatttaaaaactgcagagaactgcaagatactatataagaagacaatccccaaaacacataattatcagattctctttcattctttttaaaatgaaagaaaaaaatataaaggcagctagaaagaaagagcaggaaacctacaaagagaacccatcaggctaacagtggacctttcagcagaaaccctataagccagaagagattgggggcctatgttcagcattcttaaataaaagaatttcaacccaagaatttcatgtccagtgaaactgagcttcataggcaaaaaagaaataaaatacttttcagacaagcaaattctaagggaatttattacaaccaggcctgccttataagagctcctgaaaggagtgctacatgtgaacagccactacaaaaacacacttaaatacacagatctctgacactataaagcaatgacataagtctacataatatccagctaacaatatgatgacaggctcaaattcacacacatcaatattaacactgaatgtaaatgggctaaatgacacaatttaaagctggataaagaagcaaggaccaacgttatgctgtctttaagaggcccatctcacatgcaatgacatccataggcccaaagtaaaggtttggagaaaagtccaccaagaaaacagaaaatagaaaaagctgaagttgctatccaaatttcagacaaaaagagactttaaatcaacaaacatcacaaaagacaaagatgagccttacataatggtaaaggatacaatgcaataagaagatctaaatatcccaaatatatatgcatccaacacaggagcacccagattcataaagcaagttcttacagacctacaaagagacttcgatttccacacaatagtgggacatttcaataccccatggacagtaatagacagatgatggaggtgacaaagtgaaaaagatatttaggacctgaattcaacaattgaacaaatggacataatagacatctatagaactctccacccaaaaacaacagaatatacatacttctcatcaccacatggcacatactttaaaattgaccacacaattggacatcaaaacaatctgtaacaaattgaagaagactaaaatcataccaaccacactctctgaacatggtgcaataaaaacagaaatcaatactaagaaaaacattcaaaaccatacaattacatggaaattaaccacttgttcctcaattatctctgggtaaacaataaaattaaggcagaaataaaatatttcaaactaatgaaaacaaagatccagcataccagaatctctggggcacagctaaagcagtgttaagaaagaagtttatagcactaaatgcccacattaaaaaagtcagaaggatatcaaatgaacaatctagcatcacatctacaggaactagagaaacaagagcaaaccaaactcaaagctagcagaagacaagaaataaccaaaatcagagctcaactgaaggaaattgagatgcaaagaccatataaaagataaatgaatttaggaattatcttagttatttgaaagaattaattagatagatggatgaatagctagacaaataagaaaaaaaaagagaagatccaactaaacacaatcagaaatgactgactgaatgaaaaaagacattaccactgaccccacagaaatataaaagaacactcagagactatgaacacctctgggtacacaagctaagaaacccaagaggaaatggatacattcctggaaccattcaacctcccaagtttgtgttaaaaagaaactgaatccctaaacagaccaataatgaattttgaaattgaatcagtaaataaagagcctaccaactaggaaaagcccaggaccagttagattcacagccaaattctaccacatgtataaagagctggtaccatccctactgaaactattccaaaaaattgaggaggaggcatccctccctcactctatgaggccaaaatcatcttgataccaaaacctggcagagacacaacaacaacaaaaaagaaaacttcaggccaatatctttgatgaacacagatccaaaaatcttcaacaaaatactggcaaaccagcagcacattgaaaagctaatccaccacagtcaagtaggttttatgcctgggatgcaaggttggttcaatataggcaaatcaacagaagtgattcaccacagaaacaggactaaaaacaaaaactacatgatcatctcactagatgcagaaaaggatttcaataaaattccacatactttcatgttaagaacgcttaacaaactaggcattgaaggaacatactttaaaataataaaagccatctatgacaaatgcacagccaacgtcacactgaatgggcaaaagctggaggcattctccttgaaaagagaaacgagataaggatgtcctctcttattgccactcatcatagtaatggaagtcctggctagagcaataaagcaatagaaagaaagaaaacccacccaattaggaagagaggatgtcaaactacccctgtttgcagatgatatgattctacacctagaaaaccccatagtctttgtccaaaactccttgatctaataaacaacttcagcaaagtttcaggataccaaatcaatgtacaaaaatcagtaatagcattcctatgtaccaacaacatccaagctgagggccaaatcaagaatgcaatcccatttgcaatagttacacaaaaaagtacctaggaatacaactaaccaggtggtgaaaaatctctacaatgagaatttaaaatattgctcagtgaaatcaaagatgacagaaacaaattgaaaaacattccatgcttgtggatagaaagaatcaatatcattaaaatggccatactgcccaaaacaaagtacagattcaatgctattcctattaaactaccaaaggcattattcacaagaaaaatgtattctaaaattcatatcaaaccaaaaataagcttgaatagctaagacaatccaaagcaaaaagaaaaaagctgaagatatcacatttcttgacttcaaactatactacaatgctacggtaaccaaaacggcattgtcctggtacaaaagcagacatatagaccaatggaacagaatagagatcccagaaataatgctgcatacttataagcatctgatgtacaacaaaataaataaaaacaagcaatggagaatggactccctattcagcaaatgatgctgggataactggctatacatatgtagaaaaatgaaactggaccccttccttacaccatgtacaaaaatcaactcaagacggattgaagacttcaatgtcaaacctaaaactataaaaacacaaagataacctcggaaatatcattctggacataagccctggcaaagatttcataacagagatgccaaaagcaattttaacaacagcaaaaattgacaagtgtgacttaattaaactaaagagcttctgcatagcaaaaacaaaacaaaacgaaacaaaaaaactatcaacagagtaaacaggccacctacagaatgggtgaaaatgcttacaaactacgcatctgacaaaggtcaaatatccagaatctataaggaacttacaaatcaacaagcaaaaagcaaacctcccacttaaaaagtgggcaaaagatatgaacgcacacttttcagaagaagacatacatatggtgaacaaggatatgaaaaaatgctcatcatcactaatcatgagagcaatgcaaatcaaaaccacaatgagataccatctcacaccaatcagaattgctattaaaaagtaaaaaagaaaaaaaaaaacatgctggtgaggttgaggagaaaatggaacaaagcagtttggtgatttctcaaggacctcaaagcaaaatgaccatttgacccagcaatcccatttttaggtatatacacaaagataaacaaattgttgtaccataaagacacatgcacatgtatcattagtatcatgctattcacagtaataaagacatgaaatcaatcaacctaaatgcccatcaatggtagactaaataaagaaaatgtggcacatatatgccatggaataactatgcagccataaaaaagaatgagatcatgtcctttgcagcaacatggatgcaactagaagccattatcctaactgaactaacataggaacagaaaaccaaatactgcatgttctcacttagaagctgaaggtaaacgttgagtacatagggacacaaagatgggaacaacatacattgggggctgcttgagggtggacagatggaggagagtgaggataaaaaaactacctataaggtactatgttcattacctgagtggcaaaataatctgtacagtcaaaccctgtgacacacaatttacctgtataacaaaccacacatgtatctatgaacctaaattaaaagctttaaagaaagaaaagtgttggaaattactcagaatcatttgaattactcacccgaccattccctaaaccttttgaattaaaataataatatgttttcagttacaagagacaacatatgttaagatataacatttattttattttattttttgagacggagtttcacttttgttgcccgggctggagtacagtgctgtgatctcagctcactgcaacatccgtctcccgggttcaagcgattctcctgcctcagcctcctgagtagctggggttacagttgtgtgccaccatgcccagctaattttttgtatttttaatagaggtggggtttcatcatgttggccaggctaatctcaaactcctgacctcaggtgatccacccaccttggtctcccaaagtgtagggattacaagcatgagccaccatgcccagccaagatataatatgtatttatcaaagttttatgagttacaataacaaagacatggaatcgacctagatgctcatcaacagtgaattagataaatacaagggggtacatatacaccatggaacactatgcagccataaaaaagaataaaaccatgtcctttgcagtaacatagataacagcttgaggccattatcctaaacaaattaattcaggagcataaaaccaaatactgcatgttctcacctctaaatggtaactaaatattgggtactcctggacataaaaatagccactgaaaattaatagacagaaattgggtggggtaggaagtgaagaagcgggggttgagaaactaattattgggtactatattcactatctagttgacaaggtcattcatatcccaaacctcagcatcatgcaatacacttatgtaacaaatgtgaacatgtaatgcctgaatctaaaataaaatatgaaaatgtaaaataagacactaaaaaaagaaaaggtagtggaatacttccgtgtttcactgtgactgaagaattatcttaaaaaaataaaatccataccccaaaattttatggtcaagaacattaacctactggaaaaatacagttatactaattatgtattggtgaaatcttttttcacatcattactttgttgtctaagaaaaccactagcatatggctagctatttagcaggataacaatcatactgcaacctaagaaaagtgatgatttcttcttccatcatttcaaataaaagaaaatcttatttgtagtccctataatatgagaattgtagaaaagttgcctatgaccttcttttccttaggaccctggatacatatagtcttctactaaggtccctcagagacatttgtgttgcacatgcagaatctgaatgatctcacataatagctttgctattgtagtactggccactaaacaaaataaaaataaaaataaagaaaaagggagtaatcctcaggaacttttatttttaggaataaatgtatctgcactttcccacagtcttcaggtaaccaacagaatccaaatgatatggaattgtcagtaattatcataggtaaattctgctaaacaattcaccttaaacacataatggactttaactataatcacttcaaaagaacaaatgaaaaggcattcatgggaacaaaatacaacctgaaaatataatactggcaaagattaagtgaacatagatgcctagagttatctgcatgatctccaggattagataacctaacaaagttggtaagtcatgtaactttgatcccactcagctcttacacattttagcgactatatgaagcatgaatagtatcaccatgtagtagacaatatgtggttgccaatatttcattccaatcctatggtatgatcctgcaactaaacatttattaaaaatgtccacatctttccacatttttctatctaagcccatagatttcattgttttttaacatagaaacttgatatctatagtcacttggtaaaatctgagccataattatcaattatatttttgggggtagaacatagatacaactgtgaataaaatataaatcaaaacatgtatactaaagttaaattgtttattcaactaattactcatattcatctattttattcatggtcattgatatactctataggcttctttgcaagtgcttcatttatcttatagatcttctgtctttttcctccctccactgcccttgctctgtgcaggtatctctattcctttctgaccagccctttttcatcattccaagtctattcaggaagcagaaaaaaacactttaaataagacttttttaagtttctattttcttcccttaccaaaacaaaaatttttacaatgtaccatgatagtgaatgaacttttactttatattgcctaagaaattattgtcatgtaaagtcattttttagtaatatactcatttagtaaagtaacttgaggatttttgtatatgtatctttgtaattgaagtaaatttctcaatatgggattcagatgtcttgtataagaaacatctgtgtacttttctcaaatgctgatgtttatgatggtccccatgggacaggtccttctttggggaaggagtagagaaatctgaaagtttaagatgacgctcagaggatcacggtatgtactactatttgagaactgatcaacttacagtacttcttctcatatctacttttgtctcttaaaaatcactagaaattcaaaaagttaaaaatgccatgctctttcaggcaatcatctggcacatggtattataataaatgggataacaaatccagagaggttaacaaagtccccaaggtcatagagcttaaaaagggttgagccagaatttaacctcaattccatctaacttggaagcttatttcattccagaggtttgggccctaaattaattttagggcctaagaactcttggcccttcagagtcatatataaaatttttttagttgaaggatttgtaccaaataattatgcctgatgctgtggaatttgaactaaaatctagtctagagaggttaggacttgatggaagtcacagagctgatgcagactcaaatttccatggtctttgtacacatatttactgcctctttcaaatttatcttttatagtcaaaaatatagttatttcttatgtattcataaatatttccattggaaaatctatgttatgggtctggtaccactgtgtcattaggaattgttatcaaaacatattataggtataatagaaggaacaaaacctacatgtagagagagcaaagcaggcaaccagaagtcatctctagcccttacctttacaatcactgtgacagtagcaataccaggtggcattgttccataaatatcaaaggcctctaccagaaaagtgatacttgcttcttggtctggaaatgcctcataatctaaactccttaaaagcgatagttctcctgtaaatggatgtagtgcaaaaaagtgcttcacttctgggcttcttatccggtaagacacatttgctccaaggtcgacatctttggcctgtaataagcagaagaatagttttattagtgacgttaccaaaataaagaaatgcaggaaggatggaagtcatgcgttagtgcctaggacagcatcaatttaacgaggacaaaaagacacgttttttgtttttgttttttaaaaaagcacattatttaataatttaccagggaagagaaggagggatgggggagagaaagatggaggcagggaggaaaggagggagacagtgagagggagagtcagagagagagagagagggatctttctataagattttgtcattgttgacgttattactgtatctgtttaacttgaaaaatcactaaatgaactatatcacagtaaaaaaataaatattgtcttaaatgactgtttcttattttctactgatttgataatcatgaacaaatattttaaataaaaataaatactgagtgatttccataaacataatagatggctaaagtactataagaaaactgagaaaatataagtagtaattatttgtcacagggatcctataatacatttctagagatcactctaccatacttcctttgatttaactaggatttgagtagtagttacgcacaaggtgctgtagagagcaccaaaatgaatccagacacaattactgccctacaggttatggtctcagagaagaaacaagacacaaatactaaaatagaaaggaaaaaaatgtgacatgctatctaaaagatgttctaaattgggaacgatatcctttagctgaaaggatgggttttcatgggagtcttgtagaatggctatttcactcagcagtacagactggcaaatgcacctcaggtacagaaaaccgaatggagcaagaatgaaaatggggaagatccagagtatgctataatgtgcatttttaaatgcaaacacctcctatggtgaacctcagccttggtctcctccaatcaattattgacttaacaatcagaaagatgctattaaagcatacattttattatgtggtttttcctgcttaaaatcccctggtttttaattcaattttcaatcaacgccattatccttaacatggtaagagccactacattttctagacctttagcccctcacccctcacactttcccatcttccatgattttgaccaggctttttccccccaactactttgaacaatctttcttccttttctgcttggatagctcttacttgtccctcagttcaccatttagaaataagtttctctagcaaatattctctttgccttaagattaggttaggagctccacctctattacctaggccctttgtactgaggacctacgttttaactactaattttcttgactgatagctaaaccagcctgaaaactcgaagaaagcagtaaatttgttttgttcacctttgtatccccaaagtctttgcatcccctaggacagcatgaatttaacaacaccagcaggagacttggcatactatacatactgaagacatgtttgttaaataaataacttaactaattaattaattgacagatgaatggtggaatagatgaaggaataattgttctctccctggccagtatttgccttatttagatttgttaatgtttattgctgagttcaattatggaagggatacagagtctggaaaagtatgctaaaaacattcaagttgtggactgcaggtggaaaaatggctacttttttttttttccaaaacataccttatagaccaactgagtcagtattaaatgaggtggttgcttaaaaatgcagatttatggatcagcctaatctactgaatcaaaatgttcaggactgtgtaatttatagttaaaaacttaaaaaagaggcttgatacagagatgtcattaaaaaggagagttagattactagaagatggcttttgtgtattgaatgtgaaaacaatacagaataatgggtataaacaatatttgtaaaatagaggggaaaccaatttgtaactctctatattttttctgtgtgtacacatttatgttatatatgtataacccacacaaattcatatatatatatgtattttttgacatttgtgtgaacacaaagataaatgtgaaataaatttaatgctgagtactctggaggcacaatgtgggagattattaacttttgcttcataaactattgtattgtcaactgttggaataaacagaatattacttttgtaaattaaaaaactattaaaaagtatatttttaatttcttacaaatagatctttctgcccttaatttttgggatatctttaaagtaggcttgccacataaaatacaatatgcaatattggagaaataataaaaatttattcattgtttatctgaaattaaaatccaacttggtatgttgtattgttacttgctaattttggcacacaaaccctaatagcaaatctcctaatgtaggattcatgtaataaatgctttttcccacacacctctatttgaaggatggtagtcccagctggcaaattctcttcaacaaggacagtgtatgttgaattggtgaacacaggactgttatcatcaatgtccaaaaccttgatggccaaggttagagttgaatgacgagggtgtactgctccatctgttgccacaacaacaagttcatagtagtccctgacttctctgttaagcttcactgctgtgtaaatgctcccattggatgtgatacgaaaaagattattaaagttacccaaactgtagtgcacttgaccatttattccagcatcagggtctgttgcctattaaataaaacaaaaaaacaaaaaaattcacgtaagttttgacgggctactgtaaatgaaggtaacagttaacaaattatggtatttttctaaccaaaaattatttggccctctaaggaggaaatgacaatgacaatacaatgcaaaatttaaaacatgaaaaatattatactttaatattcttcatttaaaattaacataacaaaaacggataatgtcattagcaataacaatactatgttatgacagaaaactcataaaaatactgaatctttgtcttatgattttaataggttttgaattctaaagtgagaaaaaattttgtttgtaattcatttaacataatctgccgagtgacaatttaagattatgtaggtttttgctcactgtatatattcattttatatttatatatgtttagtaataatgttacacattatgtttgtttataataaataatattttattatgttatgctgttatttatgtgataatgtttattataataaacattaatcatatttaccataaataatatttataagtataacctgacttaatcctcatgatgttgttatgagtaaatattattaatctcattttacaaatgagaacactgtggcttatggaaggttacacaagaaagaaatatctcagtgtcccagttcttaacacaatacttcatatataaaagtacttaacaaatgcttgtggaattaatgaacattagatgaaataaaacagatttgaaactaaatctgttccaaaagtcaaataggattaaaactacagtaactgtaatgtatgtgcaagggactctttttcaacattagaatatacatctctgcataagtaagaatgtttgataccataatatacctatatttactgaaaatttgaagtcatgtaaaatcactttgcatcaaataaaatgagaaaatattgagtaaatattcatcgaatgaaatgtaataagaattaatcttagctaaaactcaattgtgatactaattatgaatctcactatcagctactgtatattttgttttgaaaagttccatgtaaaagaaactgaaataaatcttagaaactgtaaaatattatataattatgccccaaactgtcaacaaggaaaggaaggaaaacaagacacttggctgccttatgagccagggacacaaaaatcactcgaggtccataaagcgtggaatgcaatatgatgtattttaacagcacatatgcagtggtatatccagttttacaggcaatggtaaagcatgcagaatggggatgctgaatatttgcatcttctttgaaacaagaatgtctaagatgtgaaaatcatgtttacaacagtgctcctatatgtcataatgccaagcatttcagcaggatttgtctctttgactcatcaaaacacaactgcccctgggagtttgacatctctgaggtttaattctgagaaaagatagaagaattgcagaaatacctgaagagaaaaaatacggtgacagagtagaatagtttctgttgatatagtttcttttacttttatactttgcctagaatttgtcttacgaattattgacaaatcagtcaagctgatcattctagtgaaaacaaccaacactgccttctccctttttcaccaaaaaaagagggtgatctctttttttggtctgaaattactcatcaagtaaatagataaaattgtaagccaagaacaaaatataaatatgttttgtttcataataataatacccttaaaaatttcagtcactttttctgtctatggaatatcttaagatcaaaaaaactaatcatttatgcaattagaaatttaaatgactcttgttcaagttgtttttattgacccatataattgaatatttattatggtagaatggctcaatttgactgatgtggctgtgtgtccgtgtgttttatacatgtccagctgcttaactatacatccactaggaaacatatctaaacatatctaaattagttttgtttttgctcccatagcaaattatcacaaatttagcagctgacacaaaacaagttcattattttaaagctctataggtcaaaaattcaagatggtctcaccagggctatgtttctttctggagactctaaggagaaacaacttctttgctcattcaagttgttgacagaattcagttgctagagtttgtagaactgagatccccacttccttgatggttgtcatgtgaggaccaatcccggttgctagaggtccccatatcccttggttcatgacacatttccaccatttttttttttttttttgagaccaagccttgctctgttgcccaggctggagtgcagtggtgcgatctcggctcactgcaacctccgccttctgggttcaagcaattctcctgcctcagcctcctgagtagctgggattacaggcacctgtcaccatgcccagctaatttttgcatttttagtagagaccgggtttcaccatgttggtcaggctggtctcaaacccctgaccttgtgatccacccgcctcggcctcccaaagtgctgggattacaggcgtgagccactgcgcctggccatttcttccatttttaaagccagcaatggtggtcaagcccctcacattttttgaatccctccctccatctttttccattttatctttctgacctactcttcaggcatcctccttcacttttaagggcatgtaagattacattatgctcccttggacaatccaggatagtatccccatctcagaatttttaaccttgatatatgtgtgtgcacatgtgtgcaagtgtgtgtatactgccatatataaatatatagcaatctatattttaggatgggatttttttttttttttgaaacaggtcttgctctgtcacccatgctggtgtgcagtggtgtgatctaggctcactgcaaccttcacctcccaggctcaagcaatcctcccacctcagcgtcctgcgcagctggcactacaagcacatgcccccaggcctggctaattttttgtatttttatcagaaacggggtttcctcttgttgcccaggtcagttttgaacttctgggcttgagccatcctccccctttggcttctcaaagtgctgagattacaggcatgagccatctcacctggccggataggagtttttagagaaaatatccaagcagatattcattaagcagactgacagtaaatgctaaatggggcatcctcaccaatagagtttcagaattttaaataatcagtttaaattggtataaattacgatatgtcaagtacacacacattttgactgaatctatgacaacttaattcactgaattcaaagctaccatgacaagaagtatatttgatgcttatggaaaaaaagactacaatatctttggctctgtttatatgctggattacatttactgatttgcgtatattgaaccagctttgcatcccagggatgaagtccacttgacagtagatgcagaaaaagcgtttgacaaaattcaacgacacttcatgctaaaaactctcaataaattaggtattgatgggacttatctcaaaataataagagctatctatgacaaacccacagccagtatcatactgaatgggcaaaaactggaagcattccccttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagaggataaaatacctaggaatccaacttacaagggatgtgaaggacctcttcaaggagaactacaaaccactgctcaaggaaataaaagaggatagaaacaaatggaagaacattccatgctcatggataggaagaatcaatatcgtgaaaatggccatactgcccaaagtaatttacagattcaatgccatccccatcaagctaccaatgcctttcttcacagaattggaaaaaactactttaaagttcatatggaaccaaaatagagccttcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgctgcatatctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagacttaaacgttagacctaaaaccataaaaaccatagaagaaaacctaggcattaccattcaggacataggcatgggcaaggacttcatgtctaaaacaccaaaagcaatggcaacaaaagacaaaattgacaaatgggatcgaattaaactcaagagcttctgcacagcaaaagaaactaccatcagagtgaacaggcaacccacacaatgggagaaaatttttgcaacctactcatctgacaaagggctaatatccagaatctacaatgaactcaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaactacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactagaaatcatgctgctataaagacacatgcacacatatgtttattgtggcattattcacgatagcaaagtcttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattgtcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataataaaaaaaagactacaatatcccccagaaagctactctaaaaattttaaggtgactgagacacacatctaatggaaacaaagggaacagaatataaaatgcagagctatttccttatctattcctatgtccccattaaattaaggagcataaataaggtgatgtaagttaagcaacatgagctggctaagcaaggcagttttacttctttactattctagatgaacatgtagatgttaaacaagataaccaaacatagaatcccttattatcagcagtactgtcaagaactttgcattgatgtttaatatttagtcaagcagctcagtgtatgatgctataatgaaaatatatattttcctagaaatcaattaaaagttaattaaatttgttaataagaaaaataacacatctcttttccccttgtactacatcaaagcaatgaacagtaatagctgcaactttataatcatctgtccatggttaacacatttttgtaatatacaccttactatggggcctgatttgtggctactaatttgtgaatgcatattgctgggaaattggctgatagcctgtagtcaaataaagacctcactggacagaactttgaataattgccagaaacaccacttgcaaaccttattcattaacaccaaagttagagtatatgaaagacaaccaagtaattacttaagaaaaaagtcaagggaatttattgaaccaaagttttttgtataatttttgagaagcgattttatagcatgccacttgaaaagggaaaagggaaatatatttcttaaacactaaattcattccccacccctttttttctcattatcttcttagaatggtctgttacacaattctttccatccataaaagtggaagtccattactgggtttgctaccctgggggttaccagtcctgtagagaagaccttaaagcatgcctgtatgggtggaatatactaggataaaacctcaaagaacaggttgatgtttgcactccttccactgagaagtccctgggtaggttacttgtgtaatttacaatgattcatttccatttaaaatatgtcaaatatccattcagattaattatttagatagaaaattttatgacaaaaatcagccccaaggaaataacttgaggacaaaaccaaaatgttatagctattataaaggtgtgaactaccatgtagcacctaattggcccagtgtgaagctgagagagtgctttgctctaccttttgcttgtcctttacagcgatttaagaggtcgtgtacatctttctcactttgaagtgggaaccataaaagctgttgatcagggaggttgggcagtgcatccttcatgacattattagtgaaaatacatttttaaaattattatctattaacttcaaaaagatgtacaatagttgtctttttttttttttttttaaggagctgagctatttcaagggctgtgattattagtgtaaaaggagacaagcaatttaaagactcataatgcaggtaaattttttcactctccacacaaatgcctcataatcattattgaacaatggcaagtagacttactggccagaagataacttgcataacttgaattaaaatcactaaaaacataaccagaatgaatagcttttcattctagtccctagaaatctagtccctagaaaacacatatttaacacaaataatttctcaaggggtcagctattattctaagatacacaataaactacattttatcctagcattcaaggctctacctggtcttgttctaacctatctttatgcatttatatccctcagactaactctctgacacaaactctgtgttttagtcaaaggagtctatttatggtatgaatcaccaccaagaaactctcaagtgtcagtggtttgttaccactgatgtttctttctcgcctatacagcacccactgtgaattccaaatccagctttactctatcttgtctttactcagaagagaagctaaaggagcaggcttcattggaatatgaagctcatgtggtgcaagaagaaaaaaagacatgagatagccaagctgcagcttttaacgcttctgcttggaggtcaacgtatcacctatactcctgcttcatcgttgaaggcaaatcacatgacaaggccgatgtcaaggggtgcagaaattccattccctcacacagtgggacagtgataaatcagaaacacttttacaatgtactaccctggttttccttgaaatgaccatgctctccctcaccttccctgatataggttttttttttgtttgtttttattttcccccaatccaacttaaacgttcaaaacctagcttcagttctacttcatctgggaaacctcttctttccatccagccttctggtccctcttgcacatagcaaaactcactttttattgctatttaagtatgctacgcaattaaataattggcctaaaaatctgtggtgtatccatgtattatgtaataggagacactgttagagaaaagaatctgtaaattgttttgtggagtgtacaatgtatgagaagtggaaagttggagcacagatggaaatatggtagagaaggaaaaaaaaaagatagcaagcaaataaaaataaacaatattcctgtagttgggtgttatttaacgcaaatgaactgaaggtgtcaaattaaataagacagtttaagctgttccaacataacctgcaggcctcttactaagtaagcattaggaagaaactttgcactaaaaacctttacatattcagttctcatgttaatggtaaacacttgaagattatgacatcaatgcttcaggaaaagagttgttgtcatgttcacgctcatacagcaaagaaagaaagtaatgttgtttcatgttcattaaatgtatttacatagtaaggctgtcttttccctttttcaaatattccttatagtgctgaaaacgaagaggaaaacctgggaggactcatttcatatttccccaccattgcttagtatttgataattatgcagtataggttgagtgtgtatatacctctttatgtgatggtaaaaaaaattatatattaaattatatttagttttccaacctcttcttacttctatttctccaacttcttcattctcatctttttctctgtgggcgaacatattcttaccactaaatctaagtgcattttgccatactaaccatgctatttcatgtctgctttatccagtcataaaatcttccccttatttccaaaactgattattcttcagccctagtatcacctctcagaagcatctgagtaagctaaatgcctcatcttcatgctcctgaagctcattgtatgtttctttaccacatgccctattgctttttttctgtcattttttaatagcccacatgaaattaagaattcataaggacaggatggcttatttatatcatacaatgcctgctttatttttctttttgcaatgacataggttagatatgcaataatttctgccaaaatttcttctgaagctatttccatttttcaattacatatcattcccaccccaaccacccaaacacatgaagaaataaaaattgccaattagtatttataattttgtcttaaaagaaggtatgttttctgtttattagaagaaatataagaaaataagacacattttgttctttaaataaaacttaagtgatcacataactacttattaaactttgtccttttgttacattttattgctttcttgttttcaattttgtcactatattagtcagttttcacaatgctataaataacttcccagaaactgggggatttataaatgaaagaggtttaattgactcagtttcacatggctggggaggtctcaggaaacttacaatcatggtggatggtgaaggggaagcaggcaacttctttacctggtgacagaaaagagtgaagaaggaactcccaatcacttataaaaccatcagatctagtaagaactcactcactgtcataagaagagcatgggggaagcctcccccatgatccagtcaccccgctccttggacaagtggggattataggtccctccctcaacacatggggattacaaatcgagatgagatttgggttggtacacacagccaaaccatatcagtcacctagaattctttaaggaaatctatttctaggtcagttttaaagtaagtacaatatatatacctatttttgtataattaaatatattagtttaacttttaacagtctattctagcattgcttaacctttttcattatcaactcctgtcaaaagaggattttaagatttttttctttctaatagaacccttataaatttgtacttccacagatatatttatgtatatatattatccatgctttatacataagaaaagtaaggttttcttgtctcccaaaacctgattttccacattggaaatgatctaccaccgttgagaatgcatgctctagccaaaagagagtcctctgtaacttccttatataccataaacatttccacataagcattgttctttcagcactcattacagtggcatcactttctaaaatgtctgtccatattactatatggggcaactcagggtatctctgagcttgtactcaatactcatcacttcttaagtaatgaaataagggaaaaataccatctccatgaattgcattttatgtgataatctgcttagcccaggccttcctatttatttgattatgcttacattttctgccaagttataacacaaagtattgtggtttgttttctgaataactattttaaatagtcttctctatgcttattgaatatgtgacattttgcttatcaggtgtttttataggtcctatatactaatccaagttttaattttcttttttctagtattctgttgggttcaatataaacatgcccatgcccttctctgaagagtcaagagtaatgtataccttaagcattgtccttctgtcacagggcttttcattatattacattgtctcacaaatcattttcttgtatcatttctagaaaaaaaattcttaactggaaactgaaaagaatgtgacagccagattggattctctgtgaaattctatacaattaaattttctggataacattcaagtaaaggattaacagaattgtaagtaaaacaagagcaataaaaatgcctctggctaatataataactatttaatgagagaaaaatatctcttaatttcccaatactatcaatcatttcatttgctgaatataagctcacgtttttcccaaacaatacccataaaattaaaggtgtttttctctattttacacacattgtcacaatttgacctaccttgataacatcacagggatagagccagatataggttccagttttattttatcatcactcattccttgagctagtttagtaattttcagctgtttcattaccttaatttgggatgtctccaaattggttgatttaaaaatgtatgttaggtattcattttgctgacaacaattcactgaagtaactgaggatcatgttttctaatgtcttgtccaacacagtaatttaaattaggaaaacagaattaattggaagaaacaacttatgtttctctatctactccctgggactgcattcaaagagctaagatgtacacaatgtgaaactgccttttgaattagaagttatgaactcagattctgctgtgtccttccttttccagctgccttccttcagatatactttcctagtaccttcctgtgtgctactatgtaaatagtaggtaactattttagaatcattcctcagcagcaggctttatgaaaagtgctgtcagtttgttttctttaattgtggtgtaaacagtactgctgcttaccttaatattaattatatacacacatttttagaagttacagatatataaaagggccaggtactttattaacatccttttttctttctggtaaaggtaaaataagccagattggagattaaaaagtgtaggaaacttcatttggatgccattcctttgttaattgttagcatgtaggcaataagaggaatatttcaatatcaattggccaagcagaaattttcctgagaataacagaatgttttcaatgacatgttatttatggagtgtaactgttccacaggagcagtctagtcagtagaattaaatgatactgtatactagaactggaatctgagataaaatagaagtggtaagtttacaggcacactctgtttcattgcacgtggctttattgtgcttcacggacgttgcattttttacaaattgaaggcttctgacaaagatgccttaagcaaatatattggcaccatttttccaacagcgtgtgctcatttcatgtctctgaggcacattttggtaattctcagaatatgacaaacttttaaattactactggatctgttatggtgatctatgattagtgatcttttaagttactattgtggttgtgttggggtgccgcagaacacaccatatgagagcaaatttaattaataaaggttctatgtatacatttttttgacacatggtccaagatgagatggtgtatgtgttctgatttctccacccactgaccattcccccatctttctcactttccttgagccttcctattctctgagacacagtgaaattaaaattaggccaattaataaccccactatgtatgggctctaagtgtttaagtgaaagagttgtgtgtctctgatttgaaattaaaagctagaaatgattaagcttagtgagaaaggtaggtcaaaagctgagaaagcttaaaaacttggcctcttgtgccagttagccacattgtgaacgcaatggaaaagatatttcataaattaaaagttctactccagtgcaaacacaaatcataggaaagtaaaacaacctgatgtgaagctgatgtgaagaaagtttgagtggtctggatagaagatcaaactagccacaacattcccgtaagccaaagcctaatctggagcaagaccttaactctcttcctttctctggagcttgagagagggaaggaagctgcagaagaaaagtctgaagctagtagaggtgggttcatgaaatttaagggaaaaataaaaagccatctccataacataaaagtgcaaggtgaagcagcaagtgcagatgcagaaggtgttgcagctagttatccagaaaatccagctaagatatttgtagagggtggctacgctaaaaaaacagatttccaatgtagataaaacagttttctattagaatatgccatctagaacttccgtaacttaaaacagagaggtcaatgcctagattcaaggtttcaaaggatgggctgactttcttgttaggtgctaagagctggtgactttaagttgaagccaatatttattgaccattctgaaaatcctagtgcacttaagaattctgttaaatttactctgtctgtgatcaataaatggaataacaatgcctaataaaagcatatatttatggaagcataaactatgtttacagcatagtttagcaagtattttaagcccatggttgagtcctactgctcaggaaaaaaaaaagacttctttctaaacattactgctcattgagaatgcacctggtcactcaagagttctgatggagatgtaaaaggacatcagtgttgttttcttgcctgttaacacaacttccactctgcagctcatggataaaggagtaaatttgaggttttcatcttattatataagaaataaatttcataagattatagctgtcattgatagttattcctctgatggatctgcgcaaagtgaactaaaaatcttatggaaatgattcaccattctagatgccaatagcaacatttttgattcatggaaggaggtaaaaatatcaacattaatagaagcttggaagaagttgatttcttccttcatgaatgactctgagaggttcaagagaggtttaagacttcagttggatgaaggaattgcagatgtgatagacatggtgagaactagaattagaggtggagcctgaagatgtgagtgaattgctgtaatcttatgataaacttgaacagttgaggagttgctttttatggaagagcaaagaaagtggtttcttgatatgatacctactcctaatgaagatgctgtgaacattgttgaaatagcaacagataatttagaatattttatatactttgcagcaaggattaagaagattgactccaattctgaaaaaaacttatttagctacaatgctatcaaacagcatcactagctacagaaaaaaatttaatgaaagcaagaagtattcaatgcagcacaattcattgttgtcttattttaagaaactgacacagccatcccaacttcagcaaccaccctcctaatcagtgagcagccaccgacagtgagacaagaccctctatctgtataaagattaagacttgctgaaggttcagatgattgacagtatttttttaagccataaaacactttaattaaggtatggacactgtttttcagacacaatgctaattgcagtatggagtatacttaatggagtatagtatagtgtaaaaataatatttatatgcactgggaaacctaaaaccttatgtgactcgctttgttgcaacatttgctgtattactgtggtctggaagagaactctcaatatgtctgaaatatgcttgtattaaaaatgtgtattgctttgagaaacagaaactctacaacctatctaccaagaatctttgcagataataaagaaagaagttattgacttatttcaaacttaaagtctgaggagtctaaatggagactgaagttacgtctaacatgacaagtgtgaaccactttgatttggtttgcccagaggaaacattactcctgctactttcataaagactgattgcttttgacagaaatctgtctgtgcagagttggatgagtatgatactgagaagtcataaaaccattagaaaagactgggctcagaggatctcctcataaaaatgttcacatagaaggaataagacagtgaaaaagaggctgtatttgctatatatccacgttttgaattatgacacacatagggaatatttccagagcttggtttcagaaatcccaatgaactaattcttctgagatatcataaactaaatagtgggaaagcaagccaaagaaatactgtctgatttatttattttgcagactgcacttagattttttaaaaaagagcctctcactttgattcttgtatgacttgaagaaaaagctatactgtataaaggtgtttgcaggtgggttctctggcaagcagacaatgaggcagagattagttgcaagagttttgttggggtatgctttgggggtcaacatttttggagggcaaaggacaagaccagaattggattcagggagaaagtcaaactactgtgcagggtcaactacagccttggccaacccaaggaaggagctgcagaattgcaattgcatgtcacagtttttctgagctggggtaaaatgtccagcattttacactcaggcatcagtcaggatatgggctacactgaaatgggtgtgactatgggcaagggaaccttctgtagataaggtcatctctgaagtggctagcagctgtacatccctctttactccttcatccctacatcactccaaaaagccaagacattcagctctaccttcaagggagatctgcttggcacacagtcttcataacaagcctctatcttggattggtttttttcttagagtataaaatccttgcttaacagaatatagcaaattttatacacatacacacatatattaaattattacaatatcattcattgttttcaaatgaaacagccagctacattattacctcaaaggtgaaaaagtctagggtttgatttttttgatccaaactaatatttgtcattttccacccctgtgcccagagacgtaactcatattttcctgttgaatttgtttcccaagtagaaacagaagtcttaaatatgatgaactttaggttttttcttttagttcttataaacacccagtatggcagttattattgtccatattttacagccaagaatatttcagaaaaacaaaaaataagttcattttcctttagctagcaaataagagtatttggatttgaatttagagtatgaatgtgccatctgtttgtaatttttgtgcaggtaggggatgctgctataactagtgtagcattattaattattctagctgcatgatagattggagtccagagatagaaagatgagctggacataatttagaattcactctgaattattttcatgatggggattaagggccatatcacacaaatacacacttgaaggttatcattacatagcccctcagactttacatatatttcattagaaaaataaaaatctaagttacagagaattgtcagtgggttccctcaatgtctcccttactctgtggcaagctagtctgacatgatatctaacagaaggaaaaacatacttcagataagtcatggaagtcataccatgaagtcatgagaattacagtatatagtgtgcccagagctgtgaattccactaattattttgaaacattgaaatattcatttcaaaataaatctataaaccatccaacatctgtacttatctttatcattctcctgctgctaaaattgaggaaaactccacttcctcctaggttctcaagggaacatatgacacttgagcttttgggactctgttgcctctctttctggcatttctacatccctctttactccatctattgccatcagttttcaaacctgctgaagaatttatcattacaaaataaagagaaatgagaaagaaaatataattgcttcctactatgtctgttttcctacaatctcttcacatcccaagattctatgtgagggcagtgggtgggggaagaaaaggacaacatatatatccattgcactcatttattaatgagttattttgttatttagtcatgcaaatcatgcactatacaaaacatacactatgtttcctaatactgtttacttaattactcttaaaaagtcataattagttctttaaaatgtaaaactaaaatatgacaaatgatgccatctttgctattgagatggtttggctgtgttctcacccaaatctcatcttgaattgtagctcccctaattcccatgtgttgtgggtgggacctggtgggagataactgaatcatgggggcggtttcctccatactgttctcttggtagtgaataagtctcatgaggtctggtctgatggttttataagaggtttcccctttgcttggctctcattctctcttgcctgctgccatgtaagacgtgccttttactttctgccatgattgtgaggcctccccagccatgtggaactgtgagttcaataaacctattttttctttataaattaccctgtctcaggtatgtctttatcagcagcgtgaaaatgggctaatacatctatattcagttactaaatgtgttctgtgaatgaagttggatgttgaatgcagatgctaatgtactgccacatgccagttagacacaattatgtatgtatggagatatatataataaagggtacttgtttaggaatattttacaaaagcatggcctgtcagtgtgcaccatacatttcagagacatgatgaaaaaacattaccactagagtgtcacactacaaatgtgattttttgaattctctataaaaatgtcaatttcccaagcttagcatatatgtgtgtctaaatgtaatggcaagcttcataaatgatgagcatgccaatatacgaagatttggatgcaattatttactctaaaacttcatcaatattatgtggttgcaggtaacttttaaataggcccttttggatctcacatgaattgaaataggaaaaaaatctatttaaagaagtcctgaagtagacgtatatgcttaatattaaacattgtttgaaattgaagagtctggcttaacacactaaattaagaaagaagaaagaaagcaagaaagttggatgttgaatgcagatgccaatgcagtgccacataccagttagatagcatgtggcaagttctaatgggcacaaaatgtgccttgttcacattaatgctttagtgtagcactgaatttgcctctcagtaaatgttaactaaatttaaaaaatagtattattttccccaaatacatcaattcataacattacaaaataattatgctataagtttgatttgacttaaccatacatgttttcatccatcaattcattcatttattcacccacatttattgttgactttaagctgaacaacattttcagggctggggctctaactaaggacaagagtaatgtgttctttgatcttatgtcacttgaaccaaggtgaaaaagtagatattaaaaaataattgccttttaaaaattattacagtgataaacctaagtaataaagtaaatatgcattgcataataagagcatacagcaggacttttaacccggcctcctgaaaattacattctaatgggaaagacaaatgtcaaccaaaatattaagttacgaaaataaacaacttcatattttaatggacattatgaaaaagtaaagtgaactatgagagcacataaatataggtacttaaatccaatattgtgggttcaaaaaggaaatgacattcaacagcatccagaactcttaaactttagttttcacactgtcaggaagtttggaatcccaacggtgactttcacattacttgtattaaataaaagtcatgacaaaatgattacatttttcccattagtttacaatatttgtaaatacaggaaatgacaatagatacagtacctcttgatgttagtaacattcttgagattatttgatattagtaacattcttgagattatttttagtaattaagatagaaaaaaaatgttttctatataatggcataatgacttagattcagggatgactgaagaatcattctcaagttgaatgtcaaactggggaggctctgatggcacgaagcagctttctataacaatttcccatggatgaaatattgccagacatttttgtaacgtcttgggtgatggtaaattctctcttttaagttttagggaatcctattaattaggactactctctccatttcatagctaaggaaactgagtttcatatggattagatcatttgcccaagtcaatagttactaagtgatgcagctagaatttgaatgcagacaacctaaataggaatatgctatatttgcaggcagtcaaaaatgctgtaaagaaaatttaatgttggtaaagggaaagggggtatacttgtttctggaggacagggagagtgctattgaaatggggtactcagtgaagtcatccttgcaaaagatgtctttttgaatgaaagagtgaatcacacagagagttagagaaagagtgctccaggcagaggtaacaacaagtacaaaatccatttgaaggtttggtaagcgtagctgtgttcaagaacagcaagaagcccagtgtggctggagtggagtgatgcaaatgatgttggagagagcaggaggagccaagtcatgtggagatatgaaggctatgaaaaaggagtttggattctgttctaacacaatgagcatccactgaaatgtctgagtggcaaaatggtgtcatctaatttgcatttttaaaatatcactcttgctgtagtgcagaaattgactgtaagaggggtagcacaggtcaaaaagtaagatactatttacataatctaggggaaaaatgattgtggtttagaataggtgaggagtacttgcctttggaatatgtttcagacagatttactgataatgcaagaatcagaagtggtcctaggaagcagatacttaagatgagattttggaatttgctaatttgctagccaaatggcatgcttactgtacaggagttcagagtaagtcatgattcatttgaagccttcacctgagatgaactgatatggtatatgggggaatggggagcctggtttaatgccatatctgtataatttcagatttatcggtgaacattaattcataaaacttacagagttgattggttgctaaatataacaaaggtgttgaaaaagaataaatgaagctcagaaccagcaatatcaattcagaggtaaagagtaaaaaccaatgacctccattagcacgtttaaagaagctccatatccacagacaatgacagactttactcaaaatcatgctcaagatgtaattacaacctgctctctctctctctctttctctttctttcttttttttcgagacagggtctcactcccatttcccaggctggagtgcagtggcacaaccacagctcactgcagctttgactttcctagctcaggtgatcctctcacctcctgaatagctgggactacaggtatgcaccaacatgcctggctaatttttgtatttttttgtacagacagagatttgccatgttgctcaggctggtctcaaactcttaggctcaagcaatccacctgcctcagcctcccaaagtggtgggattacaggtgagccactacccctggtctcaagacataattacaaggaaagatgcaatcaactccctgacaagtcttccacaccagtattggtagggaaggagagctggtctgggcacatgtggctacaaacacttcaaaaaaacatactgattctctggaacttctagactgaaaacttcactttcttttcatttttagatgagaacagtatccctcgcctggagatcaggtaatgacttcatctgaattagataccttaccatcttgtaagcaagatgatagatgtcctctgtacctatgtccctgcattgcttttgcaccaataactaaagtcaagttgcagcatgttctaactgtccctgctatgagtagaaaaggattattcccaaaaagaacagcaggatatgccttatagtattggcagcaccaggaggacatgactgaggatagatcttgattatgttggaaggggttgaagggagaaaagtacatcttaccaagagtttagtggtatggagatactttgtcataattgtggccaggacacctggagttgattctaaggtactgctggattattccccaaaggttgtgaaaaacagtggcctataataaacaaggtgtaggtagtgaaagtgcctggacagggatttgaagttaaaggtatatagaagtgggcattttagcatggatttcttatgtatgaccagagaaaccatctattagttttgttcctcaggagagcctaggtagcactcccaattctgaagcaatatagaaaggtgcaacaagaggtgctctggtatcattgaaaagttcagtgatggctctcctcaccaggccagagtagagggtagtgaatgttgctatgaaacttgtgttccttagtgtcaatgtgagtggaagaattctggattcagaatccaggtggaaatactccaatatcagaggcagatggatgaaatgtatcatagcaatcagcaaaaaacaacgtcaaataagctgctacgaagtgcaaagatctataaggatggctatccaaccacggtgttcccaaagcaaatacagaaaggcagccaagaaggctattgctggatttatataatctaaaaacatcaaaatcaggtaaactaaagccgcatcattgtgttctttcctgtgattaatacacatttgaagtatgagttgcttttttattgctgcagtgatttggccaatattaatagctgaggacactgactattctgactttgtccagaaaattgcacataacatcaattccaaccaagaagttcatctcatggcaaagttaggtgcaatcatatgcataggaccactggatctgttggcactaatatacagtaccacccagcagtgctgacctagtagaatactggaaaagcctcttaaagatagagctaaggatgaatttgggaatgaaatttttcagggccacagaaggaatgaccattgtatggtacatttttcttgataagaagactagatggaaatgacaaatcaagggttcagggtgggaatggcctctctcatcatcatcttgactaacccatttgggaaaggcatactttcgtccttgcaaagctaggctctgctgcactagagatcctggttttctgaagaccggggtgatgttttcactgagatgacatagtaagggtcccattaaaccaatatttatggttagtcagtagaaattattggctctttatgccaacaaatcacaaagtacagaaagaaatcactacacctatgaaaatagctaaaatttgatgaaaaagatgagagagcttgctctgctaggtatcaagactgtatgtaaaatcactataattgagacagtgtgctattgctgcaagactagactaataaaccaacacaatagaatagagagcccagaaacaaaccctcatacacatgtatatgggatttatgataatatgtattgcgagtcagtgggaaatatatatatttatatagaagaaaacaaattatactcccacctcactccacacacaaaaatcatttcagatgataaacctattacgaataacaagacaataaatctttaaaaagcaggtccttcatgacctgaggaagtaggctattttttaagcaaggtcaaaagaatagtaacacttacaaaatgatggataaatttgataatcttaaaatttaaatctgtgtgtcaaaagatatcttgcaggaagtgaaatggaagctcgagaatgggagaaatgtttgaaacatatataacaaaggaggggctcatttctataataatcaaagaactcccacagataaaaaagaacattcaagaagaaaacacatttactccaacagataaataagaaactcaaataggcatttcggaaaagacgaaattcaaaatagtaagtaaatatatgaaaagattctcaatgccattagcaaaatgctaatcacgatcataatgcgatatcactgaaaccgtaacaaggtggctcaaattagaaagactgacataccaagcacacagacaggaaccatgaccaactctcatatacaactcttggcatagttactatggaaaacaatttcgcatttccaacaaaattgaatagacacatgttcataacatagagaaactcaggcacatgagcgccaggagaaatgatataaacatattcacagcagcactgaagataacatcctcaaactggagagctctcaaacactcatcaacatgagaatgtgaaaataaattgtggcatagccacaaacagcaaataaatgaatgaacaggtagaaatgtggctgaatagtaaaaagttaaatatgaatgaaagaagacagatactaatgcacacacactctaaaattctgtttacaggcttcgaaaaaagacaaaactaaactataatgtttataaatgcttacttagatggtaaatgtgcaacaaaaaaacccaggaaattaacatagtggttaactctaggtggaggaaagcaattgcgcctgagaaggagcatgaagaaagattttctggtgatgcattctatacctgatttggacttacatttatgtttactgtataataatatactaaactgtacatttatctttaaatcacttttgtgtattacattttttttcttaaagtttaaaggacaagagttggtcttaataaaaatctccggatatagctggaattctttctgtaaaaccaagttggttgccaagcttattcctcaggtaggcaataaagtccacgtaagtaattgtagtgagttataatatttgtagagaaggaaaactgaactgaactaaagtgaataggtcatgaattttcatcagtctataaaacagaagtgcaatttgtataaagtaggatctcataaataagtaatgtagcattaaaatatatagctagatagatgtagcaggggtttgtgaggcaaaattacttggtattgcttcttggatatacattaaataatttaaatggggaaatggaaaacacaatttcaaatacatgaccaaataggctgatagcatgtctgttatacttttcttccatgtagtttttacgcctgggaaatgccttcattatctttgcctgtcccatgagtgggtaaagagatgtgctattttttccagtaccaactataaatttcaattgttctttgcattcacactgctgtgtgtggtggggggtgggggtgataatcacttttttttttttatttcaacttttatttagattcatgcatggatggtacatgtgtaggtttcatagaagggcatatcatgtaatgctgatatctggggtactaataattctattgcccatgtagtgagcatagtacccaatggttgtttttttcagttttcaacccttgtgcccctcccccagtctcttctctagtagtccctagtgtttattgttcccaactttatgtccatgtgtacccagtgtttcagtcccacttacatctgagaataggtggtattcggttttctgtccctgcattaatgtacttaaaataatggtctccagctgtattcatgttgctgcaaatgacatgatttcattttttatgactgtttagtactccatgctatatatgtaccatattttctttatcaaatccaccattgttgggcatctaggttaattccataagtttgcgattgtaggtagtgctgtcatgaaaatacaagtgcatgtgtctttttggtagaatgatgtattttcctttgggtatatacccagctataagaatgttggttcaagtggtagttctgtttttagttcagccactgcagaaagcagtttggagatatccacatttacatttccaccaacagtgtatatgcattcccttttttccacacctttgcaaacatctgttatcttttgactttttaataatagtcattttgactggtgtgagatggtatctcattctggttttgatatgcatttcttgatgatttatgatgtggatcattttttcatttgtttgttggctgcttgtatgtcttgagaagtgtctgctcatatcttttgccaaatttttaatggccttatttcttttttgtttgttgaattattttaagttctttatagaatcaggatattagacatctaaaagctgcatagttagcaaatattttctcccattctgtaggttgtttactctgttgatattttattttgctttgcagaagctccttagtttaattacgtcccacttatcaatttttgtttttgtggcaattgtttccaagacttagtcataacttctttgccaaggctgatgtccagaatgatatttcctaggttttcttccaggatttttatagttttgcatcttacataagtgattagtgcatcttgacatactttttatacatactgaaagggaggagtgcagttttattcttttgcatatggatagccagttatcccaacatttattgaataggaagtccttttctgattgcttatttttgttgactttataatcaaatggtttaattctggggtctccattctgttccgttaacctatgtgtctgtctatgtgtagcctatactactgtaggcttgtagtatagtttgaagtaggataatgtgatgcctttggttttgttctttctgcttaagatcgctttggctattcaggttcttttttgtttccatgtaagtttcagaacagttttttttttttctaattcagttaaatggtactggtagtttgataggagtagcattgcatctacagattgctgtgggcagtatggtcattttaatgatattaactcttccaatccatgagcatagaatgcttttccatttgtttgtgccatctatgatttctttcagcagtgttttgtaggtctccttgtagcaatcttccacttccaaatttagatgcattcctaggtattttattttcacttgtgactattgtaaatgtaattgcacacttgatttggctctcagcttgactgttatttgtgcataaaaatgccactgattttttttaccttgatttttgtatcctaaaactttactgaagttaccagtttcagtagccttttaatggagtctttagggttttctaggtatagaataataatttcagtgaggagagatattttgacttcttctgttcctacttggatgtcttttatttctttctttgcctgatttctctaactaagatttctggtaatatgttaaataggaggggttagagtaggcatccttctcttgttccagttctcaaggtgaatgctttcagcattttcatgttcagtatgatgttggctgtggatctgccatagatggatctgattattttgaagtattttctttcaatgcctagtttcttgtgggtttttatcatgaggaaatattggattttatcaaaagctttttctgcatctattgtgatgattttttttttttttgagacggagtctcgctctgtcacccaggctggcatgcaatggcgcaaccttggctcactgcagtctctgcctcctgggttcaaacaattctcctgcctcagcctcccaagtagcttgcactacaagcacccgccaccaagcctggctaatttttgtctttttagtagagatagggtttcaccatatttaccaggctggtctcaaactcctgaccttgtgatccaccctcctcggcctcccaaagtgctgggattacaggtgtgagccatggtgcccagctttgtcattttgagatactttttagtatgctgtgaaattcagttaggtagtattttgttgaagatttttatgtctctgttcctcagtggtatgggcctgtagttttccattttaactgtgcatttaccagattttagtatcagaatgctggcctcacagagtgcgttagggtggagtccctcctactcgaagttttggaatagtttcagtaggactggtgccagctcttctctgtatgtctggtagaatttggctgtgaatccatcctttcaagggcattttttgatcggtagatttttcattactaatttaatttcaaaactcattatttttctgttcaagcttttgatttcttcttgattcaatcatgggagcttgtgtgtttccaggaatttatccatttcatctacattttctagtttgtgtgcatagatgtgttcataatagcatctgaggatcttttgtatttctgtgaggttaattgtaatgtcatcttttgtcatttctgcttgttcttaattggatttcctctctttttatttgttaatctagctataggtctataaatcttgttcatcttttcgaagaaccaacttttggtttcattgatcctttatatagattttggggcctcaatttaattcagttctttctgattctagttatttgttctcttttgctagacataaggggttttgtttgtttgtttgtttgtttttccctagatcttccaggcatgatgatagagtattaatgtgagttatttctatatttttgatgtatgtatttagcactatagactttcctcttaatgctacttttgctgcatcgctgagattctggtgttgtaacactgttttttaaatcaactgtattgatatggtttggctgtgtccccaccaaaatctcatcttgattgtagttcccataatccctacatgtcatgggagggacctggttggaggtaattgaatcatgggagcagttacttctatactgttctcgtgatagtaattgagttctcaaaagatctgatgttttacaagcattttttctctcccttcactctgcatttctctgctcctgctatcatgtgaagaaggatgtgtgtgcttccccttccaccatgatcgtaagtttcctgaggcttccccagacatgctgaactgtgagtcaattaaacctctttcctttgtaagtatccccgtctcgagtatgtctttattagcaatgtgagaacagactagtacagtacattggtaccacagaaagtagggttgctgtaaagatgcctgaaaatgtggaggcaaatttggaagtgggtaacaggcagaggctggaacagtttggggggctcagaagaagatctaaaaatgtgagaaagtttggaacttcctaaacacttggaaggctaggaagacagaaagaagtgggaaactttggaactctctagagacttgttgaacggctttgaccaaaatgctggtagtgatttgtacaatgaagtccagctgatgtggtctcagctgaagatggggaactcgttgggaaatagagtaaatgtcgctcctgctatgcaaagagactagaagcattttgcccctaccccagatacctgtggaactttaaacttgagagagattatttaaggtatcttgtggaaatttctaagtgccaaagggttcaagagaaaacagagcattaaagtctggaaaatttgcagcctgatgatgtgatagaaaataaaaactcattttctggggagaaattcaagcctgctgcagaaatttgcatagataacaaggaaccaaatgctaatcaccaagacattggggaaaatgtctccagggcatatcagagacctgcacagcatcctttcccatcataggcccagaggactaggagagaaatggttttatgggtcaggtccagggcccactatgcagcctcagtacatagttccccatgttctgcctgcttcagctccagccgtggctaaaaggggccaatgtataggtccaggtgttgcttcagagggcacaagccctaagccttggccgcttacatgtggtgttggtcctgtgggtgcacagaagtcaagaattgaggtttggaaacctctgcctagatttcagaggaaatatggaaatgcctggatgtccaggcaggagtttgctatagaagtggtgccctcatggagaacctctgctacggtagtgcagaaaggaaacatgtggtcagagcccccacacagagtccccactggggcactgcctagtgaagctgttagaagagggccaccatcctccagactccagaatggtggatccaccaacaccttgtaccatgtgcctagaaaagccgcaggcactcaatggcagcccatgaaagcagttaggaggggggctgtacccgccaaaaccaaagggttgaagcttcccacggctatgggagtgtcactcttgcatcagcatgacttgtatgtgagacatggaatcaaaggaggtcattttgaaactttaaggtttaatgactgccctcttggattttggacttgcattgggcctttagcccctttgtcttggccaatttctctcatttagaatgcatgtgtttatcctacgcctgtaccctcattgtatctaggaagtagtaacttttaattctacaggctattaggtggaagaaacttgccttgtctcagatgagacttaggacttggacttttgggttaatgctgcaatgacttaagactttgggggactgttggaagggcataattgtgttttgaaatgtgaggacatgaggtttgggaggggtcaggggcagaatgatatggtttagctgtgtccccacccaaatctcaccttgaattttagttcccataatccgcatgtgttgtgggaggaacccagtgggaggtaattgaatcatgagggcaattacctccatgctgttctcatgatactacgttttcacaagattgatggttttctaaggagcttttccccgcttcgctctgaacctctcctgcccccatgtgaagaaggacacatttgcttcctcttccaccataattgcaagattcttgaggccttccaaactatgtggaactgtgagttaattaaacctctttcctttataaattccccagtctaaggtgtgtctttattagcagtgtgagaacagactagtacatgtaagtatactcttacacatactgaaattctaaaagtggacatatatccaatatcaaagctttttatttatttgtcaagagaacttatttatgtgtttgtatgcttgtgaggtaagacaaatatgtatgtttagatgctgacatatactttaccggttctctttttacatttaggaatcttcattacaaaactttacttttagataattttatgtcattaaatttagtttcatttcatgtatgtacatacattatgcaagggctaagccaagcgttgggctatgtagtgaaatttctaacatcaatctctactttcaagatgtttagataaatagacaacataaatatactctagcaattactatcaaaatttgtacacagtattacatgagaccatgaatagaaaacaccgagggtataggaaagttcacaaaagattttctggaaaagattatagtggctaaattttcaagtatctgagttatctttaaaaaatggagaaaaagaaaatcaaggtgggggtataaacagatgcaaagagacatatattagcaattgtgagcaagtgagtatggctagagataaagttgtcaaagtaatagtgtgaggtgggtactgtgttttgtttgttctgtgggtaataataaccatattgtgtacttaagttatttgttagttagagacataattccagaatttacatcacagataattataaagtgtcaagaccagtatcaggataactaactcacaggctgtagcaatagttcaagtgagaaataataagagcctgattatggttgttatgagagagagaatgtgagaaaaatttgtaacatgtaaaatgatcaatattggtgattacttggatatggagagtgagagagaaagaggagacttagatggctccttagcatttggcttggggaatagttaattgaggtacagaattcagaaggagccctttctggggaagacgaaaataagacttcaatcttaaaaatgttgaaatttagatgctttctggaaattcaagtggatattttacagatatatgtctatttgaggctgtagcttaaaggagtagaaggaaaataagcatctcaatgtaagtaaagctgtcggctttaatgtaattgcaattgataaaaaaggaatacatagagtcaaaagggcaacttagatgatactttcaaaatccaaagtttaaggagcaaacagataaggggaagacagaattagatgtgcttaaacatgaaaactagcagcaagcaggtagtagaatcttaagaaaaaagagagacagagagagatcctatagcaatagagcagtaaagtgacttagataaagataacatttaaaagcacagtggtcatttgtgaccataaagtggacacagatatcattcattgtatagctgggatttcacaactataaatatttacacatacacacacacacaataatgtgtatttttctaatagctgatattaagcctaaacattgctaaaggggtaggccctaaataaatattgtaaaaatatattcttaaaattttctaatctatttatgagctgctaattgaatatctgaaacatgaccacatttcaaaaatagtcacagacattaggtagatttctattgtaaatattattatgtagcacatttatattgacataaccaatttttcaaattgtgtgggcttttttctttatcagaatgagttacagggtttgcattatatagtttggcttaaaaagagaactcataaaattccccacttgcagcccacttaaaaaagaattattacagttttaggcactgttgagtgtcatactgagctacaaaaaataagaaatcaccataatgctctccaccttcattttagttttagaaccccacacagggagacaactatagtaatcagagttaggccactgaggttcagatttattttgtttaatattaaattgtatagttgaaggaaacatcatttttttaatgactgtatcactacccttccaaacactgtagtttactaatgattttaaaacttctttaagtgcttaagacagaaacattcctacaatatcttagctaagatttagcatgcaggtctcatactgggaatacatttgtgttttaagttaaataaattcagcctcttatttagaactggaagaacatgttgtagacttatggttctatttttgttacctagacctcaaagaagtcagttcagtagaaaaatttatacaaggtattacatggaagtttactgggaatcagcttactctatattatacaatgctgagaacattgtttaatctttgtttaaacattgtttaacaggcagtatagtttccaagtgtgccttctctaatgcatttgtgcaagcatttatgcccagggttgctatgaaaaacagagataaataatttagtccttaaacttgagaattctgaccttagcagactcctcaatgagatactcctacaaaggccagacacctctgatattagctgaaagccttcctacctccacttccctcccccctcaacctccatccacccatgtctcacatacagaaatgcactaaagcatatagtgtgataagtgtgctgaagtaaaaggccacctctttttcttttatgctgaattatgttaataagtacaaagaagtttttctcatgatcatgtatcttagacagaatttactgaaatagatctttatcttctcactttctaacccagactgatgattgaattcacagaacattagttgagaaaacaaatgaaaatgacagaaaccatgttgaactatgcatcatgttctcctacttctgatgacatcaggtttataatgagaccagattcatctgtctgactgttacacattagcataaattattcccaggaaatccttcaattctcttttaggaataaataagattctgagaggcacatccaagtccattgttgggattatgccatttttaattgatatataatatatgtacatatttatggggtacatgtgatattttgctggaatgtgtaaaaatcaaatcagggaatttggggtgtccatcacttagagtatttaccatttctgtgtgtggacattccaagttctctcttcaagccacttgaaaatatacaacacattgctgctaaccacagttgctgtattagtctgtcctaatgttgctaaaaaaggcatacctgagactggataatttataaaagaaagaggtttaattgactcacagttccacatggctggggaagcctcgcaatcatggcagaaggtgaatgaggagcaaagtcacaccttacatgatggcaggcaggagagagcttgtgcaggggatctcccatttataaaaccatcagatcttgagagacttattcactaccatgagaacagtgtggggaaaactgcccccatgattcaattatcttcacctggcccctcccttgacacatggggattataattcaaggtgagattttcgatgaggacacagccaaaccatatcatcccatccccagcccctcccaaatcccatgtcctcacatttcaaaaccaatcatgccttccaaaagccacccaaaatcttaactcatttcagcattaactcaacagttgaagtccgaagtcttatctcagacacagctagttccttccgtctatgagcctgtaaaatcaaaagtgagttagttacttcctagatacactggggatacaggcattgggtaaatatacccattccaaatgagagaaattggccaaaacaaaagggctacaggccccacgcaagtccaaaatccaatggggaagtcaaatcatgaagctccaaaatgatctcctttgactccatgtgtcacatccaggtcatgctgatgctaaagatgggcttccacagctttgggcagctccacccctgtgactttgaagggtaaagctcccactcctggttgttttcatgggctcatgggctggtgttgagtgtctgcgacttgccaggcccaaagtgcaagctgtcagtggattactattcttggggctggaggacagtgaccctcttttcacagctccactaggcagtgtcccagtggggactctgtgtgggggctcccacccacatttcccttctgcactaccctggcagaggttctccatgagggctctgcccctgcagcataactctgcctggacatccaggcatttccatacatcctctgaaatctaggcagaggttcccaaaccttaattattgacttctgtgcacctgcacgatcaacaccatgtggaagccgccaagacttggggcttgtaacctctgaagccctggcctgagctataccttggccccttttagccatggctagagtggctgggatacagggcactaagtcatgaggatacacacagcagaggggtcctggacccagcccaggaaaccattttttcctcctaggcctctgggcctgtgattggagggcctgccatgaatgtctctgagataccctggagacatttcccccattgtcttggtgattagcatttggctcctccttacttatgcaaatttccactgctagtttgaatttctcctcagaaaatgaggttttctttactactgcctcatcaggctgcaaatttctccaacttttatgctctgtttcctcttgagcactttgccacttagaagtttcttctgctagatatcctgaatcatctctttcaagttcaaagttacacagattcctagggcaggggcaaaatgccaccagtctcttgcatagcaagagtgaccttaactccagttcccaacaagtttctcatctccatctaagatcacctcagcctagactttattgtccatatcactatcagcattttggtcaaagtcatttaataattctctatgaagttccaaacattccctcatcttcctgccttttgagccctccaagtctctaggaagtaccaaactttcccacattttcctattttcttctgagccctccaaactgttccaacccaggcctgttacccagttccaaagttgcttccatatttttgggtctctttccagcagcaccacactctactggtacccattcactgtattagactgttttcatgctgctaataaacacatacctgagactgggtaatttatcaaggaaagaagtctaattgactcacagtttcacatggctcaggaggcctgctttcatggcagaaggcaaatgaggagcaaagtcctggcttacatggtggtaggaaagacagcgtatgcaggggaactcccatttataaaaccatcacatcttgtgagacttactcactatcccaagaacagcatgagaaagacctgccctgatgattcagtcacctcccacctggtcctttccacgacgtgtgggaattatgggagctacagttcgagatttgggtggggatacaaccaaaccatatcggtcatatccccaaaccatatggttggggatacaaccaaaccatatctgctatctaacattagaacatatttctttctttctttctttctttttttttttttagaccaagttttgctcttgttgcccaggctggagtgcagtggtgcaatctcaactcactgcaacctctgcctcctgggttcaagctattctcctgcctcagccttcctgggtagctgggattacagagatgtgccaccatgcccagctaattttatattttcagtagagacaggatttctccatgttggtcaggctagtctcaaactcccgacctcagatgatccacccgcctcggcctcccaaaatgctgggattacaggcatgagccaccacacctggccagaacttatttcttctaacagtatgtttgtaacaactttcttcatcagccccatcctccaccaccaccactcttctcagcctctggtatctatcagtctactctctatttccatgagaacaactttttcagctccagcctatgagtgaggacatgtgatatttgtctttctattcttgatttattttacttaacataataacctccatttccattcatattgctacaaatgaaaatgattttcattatgccacttttaaacatgaacatttgacaagaaattgacttatttattattgttatgtaaagtaactagtttaggctaaattgggtctactgttgggagtatgcacaataacagtaatacaataataattatgcataaccccaacaacagacccagctttaccctatttatcttatataacaataagtaaatacataatacataaaagaattttatatttttcctctaacacataatatttctttatctcccttttcctttttctctctttcttacatatacacatgcgcttgtgcatggcacaggttagtataaaccagaatcaatggcagagctcactaaaacacagatttctggccccaacactagggtttctgattcaatctctgtggtatagagtatagcagtctgcatttctaaggtgtttctattggtgctgatgctgatgctgatgctgcttttccaggaacaacactttgatagccacctaacgcatgtttgtattttttcagttcagatacgcatgagcaagtcacaggaagcatggtcattggagaatcctgtatagtagagtggttaagaccaaacatttgaaagtaattcaaatatgtacaatggaaagcatttagaatagttcgtggcacattgtaagaattcaaaaattgatagtcattattactgattttttactagagctgtcagtctatccaatatgcttctttcaatgcaagctccacatatcccactagctggacttattttaagatgaataaacaaaaatacaaaaatcaggatcgcaaccatgagctctattttgataataacaaatatctttcatttcctttaaatttctaaaatatcctacaaatgtgactatatgcatatatatgttcatgtactaaatgttgatttgtacatttgttattatcaaagaccaagctttggctaacacacttaaaaaggataaacgctgtttataatctgactgactatgattgtttgtagtgatgcagtagaagaaaatcatttatcaacttaagattttatagtttcttaagaacagtacttccattaaaatgttctctaaatatggtaatattaggcaaatgcaagagtgcaactaccgtatttcgaaaaatcataaacaattgtttgcatttagttcatagtgttgtaaaaaatattactttctataatatacgtagccatactttataaattatttagtatttaacataattataataaaaattaagtgcatattagcttcattccttattttaaacctgtacatatattatgtgtatgtattaatccttcaaatcactacttgagatgaattctattattatctccattttgcgatagcgaaatccagtcccagagaagctaaattagttatccaagattgcattagttattttggcaagtcaaatttgaactcaggtagttttattccatggcccatattttaagctgttcattaagttctccatcttgttgggatgctgggtctggattcatggagtcacgtgatctagtgacaggatgaaccaagtgaccagggagtggtcgtctcattaaagtatgtaaggagcataagaggtgagggttgttaggtaagatgagaagtccgggatccctgtgtggtgagtctagaagtcacagtccagtataaaacaggcttttaaaggtaagtggctggaaagctggacactgatttagtagactggcttagagtcagtctatctaaaggctgaatggaccttcacagaagttatatcatgctctgctgttgtatattcccaaatgcctattcctttgagacttgaggggtccaggaccaggcctgcagatttgatcagaatatgactgcatttgggggcttctactggcatctgctcccccaaagacttgggatcatctgagagttctgcagttgagtatgaggcctctagtaagaggcctctcatatctgagacccattctaaagatcaattatttgcatgcttgtggtccacagtcaagatatgcatacaaatcctctagattctatctcctgtgaaatactctcaaggatactaggcaaaatattacactaagtcttcatatcattcactatttcattaggccccatctgaactcaatgtatttttaatcatttttccagaactcctttaaacagctcttccattattgtcagaatactgacttagagtcctcaaattgcttcttcagctggattatatttcatattacatttttttggctggtatttttatttccttttttttttaaatttccaacaaagatttcactaatacattgaaaagaaccaagaataatctgcttttctcatgaaccctaacctggccacctcagtctattataatgtctctttttccttgcagtaaagaatttatagcacccatttgacacttgacacagagtatatacttactgtatttactaggttttgagtatatcttttcatacatattgttacagttttcaattctaaatgcacaaggtataatatgataccttgtgaataaaaagataaacattaaaaattgttgattggtaggttattttttaatatgctggataaaactttttgctatgtataatccataaatttgcttcaaaagtattccttagttattatttgttactacaacactacctttaaaaactaaatgaggccgggtgtggtggctcaggcctgtaatcccagcactttgggaggccaaggcgggcagatcacctgaggtcagaagttcaagatcagcctggccaacatggcacaaacctgtctctactaaaagtacaaaaatttgctgggcatggtggaggttgcctgtaatcccagcgactcaggaggctgaagcaggtgaagtttgaacctgggcggcagaggttgcagtgagccgaggtcactccattgcactccatccagcctgggtgacaagagtgagattctgtctcaaaaaaaaaaaaaaaaaaaaaaaaacaaaaaacaactaaatgaaaactcccttcagcattttaattcaaatattggattattcatattaaaatatcaatagaatataaacacaaagttgataactcaaattcagtatagtaattaacaatatgtatcttggttttaagtcttaatagtttttgatgacaattaaaattaaattttacaagcagagcatgagtaatttagtgaaattaatatatgatataattatcattaggtagcaaccattatgagcatcaaaattccatcctataaacattacactgtgcagaatcagttagatgcagcctgccttggatgtcttcctcttcctttttgctttcaacatcgttttagtttttatgaaaacaagttattgcctaaagaccaggctaaggtccatatttcaattttaaaaactgaaataaattatagaggccatttcttatcaaatttaagaaccaggagacaacaacaaggttaacacaataattcaagaacaaagaatcactaggaaaagcgggaaaaaaaaaataagaaaaaaaggaaaagaaatttaactaaaaactaatcatcatgttgatgtctacttgtgtgtttttagttatatattccatctgggctttatctctccaagctaaataaattaagaaaatgggaaagatcatttttgtaaataatttcaatgcttgtttgtttttaactgaatagttaatatatatatggctaagtgaagtttttcagttttcagcaatgtggcattttaaactgacaactgtaatataacttaattatcattaataaagacgattacattagttcaagcctcatatgcctggtttattacaattgcctcctacttctgccttctggatttagaatctcccatttcaatatatcaggagtaatttttataaaatacaaatcagatgttgccatacctcagaccctttagtggctcccccgtcaccttctacaacatggtatagaaaagtgtttatgacatggtacgtcttattcattgtaactatgctatgtcacactctgatttctctgtgcctttacttatacaactaactttccctaacagattccaacttctctcaacttctctcttacctgtgttcttccttcttgagtcaacttcagcatttctcctttgatgataatttttgcacatgcccctgttatagactttattaccttgttttcttggtgtagccaaacttgtcagtgtcctatgcatgtccctcagagcatttggtatgctttggccaacttccacctcctggtattgtcactggatcctaagggtgttgcttttccagccagaaacctctgcgggtggtggcgcctttgcccaagttttgctcggactagctgtgtttgtatcacccactccacctggcaggctgtgcttggctcatgctactgggctaaatccgacactttgccagggcaagccaggttcagagcagcgatgggtgcatgagcgagcaagtgcagggtcttgtcactgtgcatagccacgcacgctagctgctttggcgggacgggtagctccagccgccctctcccagcaaaccttagattgaatcagatacagggcaagagccttctgctgtgagcacccgcgtctggatgaggggctccctgaagagccgcaactcttctctcctttttgttgctcgccacatggtgaggggggtggcagctaaacaaggttttagccctgtttgtgttaccgctctttcattcctgccatttggtgggtcccgagtttttggcccacatccaggaagaatgaggtacgcgcacagctggagagttaaggtggagaggaactttacaaagctacagaacagctctcaagagaccgaagtgtgtagctcctatccataggcaggttatccccataagtgtccagctctcagcagagagaagacccggaataggtagttcctttctgcagaaggtggtcccaggagacacgaagaggaaatctcctccctgcagctggtattcttgatgtctgtgtgaggctggctggctccagggtttttttgggctcagaaaggaggaagtacatgttgattggtccacgggtggccatgggcaggcccggtaaaagcaccgtaagttttcactctgggccacggactccactggaactgatgggctggtccccaggcttcaggccatccctggcttgaaggtggggcttcaccagggacaccccactttccacccaggagcctgtcttctgctgccatcaatcatgttgttcatggtgcccaggctgtttatgaggagaagtgcctgcaggcccacagtgagcagccctctgtcccctcttggcctccctcctatgttcattggcgcccaaagttcacaggaggctgaggtggcagggggctggcatgtcagcaccaacccaagcacgcacacacccagcctggttgtgacagcacctgggctcggcctgaactttgcttcaaaattggaaggggtgccaggagctggaagaggtcaggcagggggaacaggcacttccgactctgtgggggcaggggagcttcctggatccctgagagcacagagatgcctaggtctgcagccacagctgggcagctggagctacacccaggatggcagggctcccaccctgccaacttggaagggggttaggttcctgcctgctccttgctcccaccggctccctggagcatttagcccaggtcatacctcctctgctgtagctggtgtctttgcagtggctgctccagatgggccactgctgccatcagtatctacagcctgactcagtgcccttctatcagattatgctgagggaatttgactacttgcttctactggaggcaagaaaatccaaaaacttggcagcccattggccaacattgcagctaattactctcaggatttagtgtatatgttttccagttccataacctctcaggaactggacaattaaaactatcaggacagataactctgatgcatgagtttgcatctttttctagagtttgcccttggagtgaagtttcagttctccttatgattgctggtttaatagcaatcttgttactggctaccttctcttctttgcctcactttctcacttccttatcactgttatctacacttctcaaaaaatatttatacatgaatattttgtgtccagattttctgttggagaatccacagtaagccattggacaccagaggtactacagtgtggggagcagagccttcagatgggatgctggagttgaatcgcttgttggccagttggtatcaagaccagttggcattttataacatcacaatgaccaagattatcccctatgtgaattgggatggcataaacatataaggttatgtatgccttatgcagtatttccagaatttgagatagtgacaatgataatgataatgactgtggagttggtagttgcaagtattgtcagtgatctaaaggaaaaaatgacttttaaaaaagcttcaactggtcaatcaaaatctcaggacatggtgtgaacatcacaagatctctataacaccatttaaagcaaccctctccttttgcagtttaaaggagattgagctaaaaatcagatcttgtgcctggttataagaatagcagaacagtagagaagcctcacttgaaagcaccagcacgccttctgtggaaaagtcagaaccttcacagggaaggagtaggaccctgaactctgggtttggaacatctgggtggctcacacctcactaaaccaagattctttcctcccctgaagaccacataaacacctcatctgaggttgatacttcaaattgtgcacatcttcctccaatttttttcttctttgtgacttctagaccaattattatgttcaagaccaagaatggcccaaatgaggaagtactgtctctgttttaacaataaaggaattattcatcaaatgaaccacagacaccggctaatatgtccaggtagatccagaagcacttagaagaacactaagagtaagtttactacgagtaaatcttctgagtgctggaaaaggtgtgtgtgcaaaatattagaaacacacggtagactctaaagatagtatttacctaatgtaatgaattcaaatctaaatatatatattttgaggtctaaatgtccacatccatacctagtagtatacctaattacatgtttctgtaaaatgttttaatttcagaaactaaaaatatatattaaattagcatactatcacattaatcaatgtttaaattatacaataattataaaatgtaaatctgtatccttgaaagttaattaaaatatataggatatgattcattttttaaagtcttgaagaatatccagcacagtcatttaacagattacattagctgagtttcttttgagaattaaaatgtaataaacttacactctttgaaaaactacatataagatctatataaatattccacttacttttacttgacccacaaaggcattggcttcttcttccaccacagataaatttcttggcagataaggatcaaacactggagcattgtcattgacatctgtcaccactatgtttactgtggcagttgaggtcttaaagaaaaacacaagcattaaatgtgagaggagctatttttacttagaattcatttaagtagtcattctggcatttgtctatctgaaaagcatctcatttttctttctaatccttagctttccaaaaaataaaaataaaaaaataaaaaaattaaaaaaaagaagcttgcaaagaagcttcccacctcaaaaaacagatgggaaaagcaaatgatgatattaaagggcaaacatctttttggaaatgtcaagtatttcctggaggaaaacggttttacctttatcttgttcacattttatgggtggcaagcttttgtttatacacacgtacactgctttatctctgaaatgtgccatttctgtagtttttgctgcttgtatgtttgactgtttaaaaataaaaccagtacattataaaatagcatggtacatcaaatgagcattttctggaaagctcatgctatcgaaaaatgctaccttaataattttctaggtgtacatttaaaccaagagtttgagtaccatatactaggcatgaaatgattatcttataagcatacagcttacggaaatggtatgcaggtaaacctaccagtagtgtgtgctacctagttaaaagttaaatccctggcctgctgcagtcaatattatgtaggtcaatgacttctgcacaatcaatgactatcttcataagtgattcaagctggaaactgctctctctaatcaaagcctgagtacagcacagaacctctacctagctctgtcacagtgtggggctgatcacaaaaggctgagagcaaaggtacagagagaaagaatattaacctggaaagtaagaaacctggtatgctatggtattaaatatttagtaactataaataaaaaggaggaggaaaaagcaaggtgatactgtcatgagagaattatccaccttttgtttaaaaaaatgcaagttccattaattagtaagtgatttgtagtgagaggctaaaatcctgagcactaagaagtgacttgagtgaagctgaaaaggttttgcagcagtcatggggctaaggagtcaagtgattttttttattttttatttttttttatttttttagctattaaagaggacagatcttggtaaatacccaatgctttctgttggggtcacagaagttctataccatgcaagtcatggtgcttgggaaaaagaccaaacctccctcaaatgtaaacccagtattgaaactctgattggatttaggtgatctgcccttattttaacagaagcaaaagcaaatactttttttagtaatgtaactttatcccaagcctctataaattttttcatgcacagtgttcagtagtcacttaataattaccatgcatagcagggaattcctgggtattagtgatggcttatttctttatttgtatgttggcttaccctttgaaaatttatgttgctattcatatgtgatttgcacacatttttgtatttaaagttaaataaaatttttatttaaagacacgtacaaagatggtcagaacatcattatatagtcaaaatctggaaacaacccaaatgtccatcgatagtagatggttatacaggattgtgttttatatatgcaatggaatcatatgaagtactgagaatgtacgaactactgctataagtaataacatggattaatttcatgaacctaagtttctagaacataaataacacatactatatgattccatttatataaacttcaaaaacaggcataatccctacatggtgataaaaattagaatacgggtcactttgaagaagaagatcgaatagcgacagaaatgatcacaaagctgagcttctggagtgctgattaatttctgttttttgttatgagtagtggttacataggtgtgttctctatgtaaaaattcattaagctgtagaattattgtttgtgcattagtctgtgtgttatattttcttaagattatttactttaaaagatgcacacacacaaacatacacatgtgtgtcgatatatgtaagtatgtttaaagaaattcaagtgctacttgactagatggaatccagatcatttcattttcctcgttacttttatatattttctaaatgttctcccaaaaggctaccatgctttcatgacaaaaagtattttaacaaatattatttctttaaaatttgccttagaattgaaagcagtaaagaagatgtgttttttacagttgcggtagttcccaatttgcctgagggttaacaagacattgaaatttacagcctggatccaaaatctaagaatggtgaccctggagtttgctggcttttcttcaaattgcctgaccccctttacaccagcctgtctttacctgtcaatccactgtttttctcatcctattctttaaaatttatattcatgttttcagagtattctgtatcctcagtttaagactgtaactcttaagtggataatgaagaatacaaccagatcactaagtaaactaagaagtcaaataacaattccataattttgtgctaataggggatgatatttatgggacatgcaggcattttcttcatttcttactgaattttatatgacatgaaaaaaatccatgtcttacagaaatgtacagtcacatctatacatagaataatttccagtttatatatttcttgaagttttttaataccacttgcttcagaaatacttatgtaaaaatgaggatttcagggctatccattaggtctattgactattgttctgaacctatggaaatatttataaattagttaggtgtaaatcatatttatttaatttttcttgattggttcagaaggatggcaacaatatgcttcaatgtggatctgtgccatagagaatgtttatgtcttattaaggaaagacttcttttcattgttcaagcttaaaaattagcaaatgaaaacagatcactttaattaattgttaggaccatatgtcattaacacatgttcacaattaattttaaatatgaatatatatataatgccagttaaattaaaaagatctcaaactaataaacctaataaataaaaagttacgtattttccatcaacggagtttgctcactgattatttcctcaaaagttgtattaacttataattccactagctggaaatacttgcatgttagtactaaatactgtaattgaacactttcatgttcattatttaatttaaatgtgtcttagaatttccttttgtaatatcatagaagaattttcaaaatatatgtctcattctcaacaatgcaagatatttctgtttttgtttgtttgtttgttttgagacaaggtatcactctgtcattcaggctggagtgcagtggcatgatctctgctcactgcaacctccgcctcccaggtttaaacaattctcctgcctcagcctcctgagtagctgggattacagacatgtgccaccatgcctggctaatttttgtatttttagtacagatggggtttcactatgatggccaggctgatcttgaactcctgacctcaaacaatctgtccgccttggcctatcaaagtgctgggattacaggcgtgagccatcgcacccagcttactgttgtaatttgaatacacatttatttttataaactagtatggctctgaaagaaggatattaatatagcatctttttttattttcattgttgttgttttttttgagacatgtctcattctgttgcccaggctggagtgcagtatgtgatcatagctcacagcagctttgaactcctaggctcaagtgattctctcacctcagtctcctaagtaggtgggactacaggtgcacgccactatgcccagctaatttttatttctttattttatttttgtagagacagagtctcagtatgttgcctaggtggtctcaaacttctcatctcaatcccaccttggcctctcaaagtgctggggttataggtctgagccgcgatatccagctcatcttttgttttttgttgttgttgttgttttttaatagtataaaaaaagtgagttataaagccatagtcaaagaaagtagtgtaaattcatctatcaatacacaatgcattatttgaaattcgtgagaacatacattaagagtatcttatttattctcttctagtatttcctatctcaggaaatgacatggcaaaataattaactaattttctaagtcactttatctcatacatgcaatttattagtcaccaagtcctgttaatttgaccttgtaaatgcgccttgtattatacagttttgagcaatggataaataatacaattttcatttcctgagtaaatagctggaagtcagataactgggttttctgattagcatatgtttagctatgtaagaaaaccagaaatgtgttttgctcaataatttaatgaataatttttaatacattttcttgttaatcaacttaatgaacacttttaagggcagtgtgtaatactacgaatttaataagcaattttggctttaatcctagagaggataagagaagggatgtttgttttttatttaatcacaaaaaaatgcatttttttatcatttaatttttacatcttttgacacaaaatttgttaaacatttcatggctagaaaactatttctttatattttgtgtgcatctcatagcacagccatttgttttgtgctattacatttatattagatgattgaaattcaatgacattcaatacatggtttaagaaacatgtatgcttagaatttatctgagcagagactcatggtatgtataggaatcagtcaggaatatttcaatttgttcattaagaaagcagaaaacattatcagaggtaaggtaacactataattatggagcacttatcatttatctatttcttaaataaaaacatgagtgtttaatttcaaaggtgcaatttcttttctatagtcaacaagattcactatatattctcagaaataataaagacattattttattaagaaatgtgtctaacgtgtttactaatagaacacacaatgtcagctcaatgaatatttttagatactttaaatatctatttttattataatttgtactacatgctgaaataaattaccttataacttattttatttaaatgtctgaaaaaagaagagctagaaagaatattgaaaatttccatctgtgagaaaacacaagaaatgttatttatagaacacaaagttttcctatctgaataaaaatcttcactactatatctaaaattcttttcaataacaatgggacaatgaggatttatagtttagaattcaatcattttttgtttaggccaataaaacaagaaaaatacatattcaataataagtatagtatttagagaatattaatttaaaacattttcatccttaagcgcaagtcatcttgttgctacacagttcagagccaagccaacttcattcagattgtagagtttcattcatgatgtagagtggaggtccttcctaccattaaagattagccaggaggctttctttccttctgaaggaaaaaaatatacataaaatctagaatttctttgagaaagagaaaagggaagttccttctattatgaattacgggaaggagaaagggagacacagaagagacatgaaggcaggaggcagaggtcctcctcctcatcccctactgccactttggacccctccttaagtgaagaggcactggagaaacattttggaagaagggggaaatgatgactgggaaactaagagaaatttgggtgaaataatcacagtagttttcaggagtatgtaagcctccagaaaatttccacaggttccatgggaggtcccatctaataggttatggcactgaatatacagcaatggcagagagaggtgtcaagagagagaagccatactaccagcataaaggactggtaaatacatgttacatctagaccacaattttagaatgaagtcagggaggagaggtttggttggcagcttaactagtgagtatttatattgtcttaaacagataatgctgaaatactgttctaagaaacttaagtgtgacccagattacatctattccctacctgtccaaacacatatttatacattattgtctaagtaggaagattgcatcaggtataaaaaataaagaagcttttttttctctgtgcacatctgagtgtagtgtgtaaagattatatatgtatgtgtgtatgtatgtatacacattttatgcaatcgtgcatgtttttatataaatatatattttcaaaaatatcagaaagtatttatagtatacctgtatactatagtatatataatatagaactatagatataaatatttatatatttgtacataaacattttgcatgttacatatattgtaaagattcacatatatgacttaaatgtttaaagttttactattctataaccatacgtattgtgttctaaaatattaaatcaactattttgaaattcaaagttactttaacttcacacattttctcacgcatgtatttttgcttttgttaaagtttcctatttgattatgaagttaaatgctcaacttttaaatgttaattgttcatttatattgccatgtttcaaagaaatttaggaaataatattgcttcaagacaaaaacaaagatgctaagtcttctagcaatctgaaattgtgaaatattacaagtgttcagactgaaagccataactgagtaattcaatccagtaattcaagagcattttacagaaatcaaaccatgatggaatcaagttacctattgtatcaattaaggaggaaaataatattgctgaacacacggaatctggtcagaaatatctaggctacagaataacttcacattttaaatgaaaaaaattactgatcactgttcgcatatttatttatatctttcactgtgttattggttgattaacacagctgcaatccataagccctacttcctagctatttttctacccactgttgctacttacagataagaatatctaaaaggaaatctgctagatggggtttctgaaaaaactttggtgctttgttaaaataaagcaggggtgcagactcttctggcattcatctttatactttgtctggtatagagaattgacgtctagagttgcagaagatgggaatgaaagtagacaataaaaatggcaaagcagaaaatagccagcaggcatcctcaatggcactgatgtgcacctgcaccatctcttcactgtccacctctagattttttttctgtatttgtttgtactatctcaatttttaaatgtaaaatgttgtggtattaagtatattcatattcttgtgcaaccatcatcactatccatctctaaaactcttttaatctagcaaaacaaaagctctataacattaaacaataactccccatttctcttttctttatcctctggcaaccatcattctactttgagtctttgtgatttttgaccattctaagtaccaaaatataagtggaatcatatggaatttaacattttgtgactggctaatctcacttagcataatgttctcaagatttatctgtgatatagtgtatgtcatactttcttccatcttaaggccgaatgatatttcattatatgtatataccacattttgtttatatattactctacataaacatggaaaactgggttgcttttacatcttagctattgtgaataatgctgctatgaacatgggaatacaaatatctcttggagactctgctttcaatttttttgatatataaatgaaagtgtgattgggggctcatatagtaattctatttttaattttttgagaaactaccactgttttccacagtggttgtaccattttacattctcaccaatagtgcacaagggttccaatttttccacatcctcatcaacatgttatgttgttgttgttgttttgttttgttttctgtttgttttttataatagcgtctctactgggtgtgaggtggcacctcattgtggccttgatttgcatttccataatatttagcaatgctaagtgttttttcatatgtttactggtcatttatatatctcctttggaaaagtgtctattcaagtactttgccaattttgaatcagtttgtttatttttgttttctttaaaaaattctcgggctgggcgtggtggctcacacctgtaatcccagcactttgggaggctgaggcaggcagatcacgaggtcaggagattgagaccatcctggctaacacagtgaaaccccatctctcctaaaactccaaaaaaatagccaggcatggtggcaggtgcctgtagtcccagttactcgggaggctgaggcaggagaatggcctgaacccgggaggcggagtttgcagtgagccgagatcgcgccactgcactccagcctgggtgacagagcaaaaatccatctcaaaaaataaaaaaaaagatctatatattttgaatattaatgacttatcatatatatgatttgcaaatattttctcccatttttatgttgcttttttattctgtgtctttgacacccctttacaaaatcacaaattccaacttgtctattttttgttgttgttgtctgtgtctttggggtcatagccaataaatccctgacaaatgcaatgaaatgatgcttttgccctatgttttcttctaagagttctatagactcagttttcattttaggtcatgaatcacttttgagtttgtttttgcatatgatgttagataaggtccaacttcattcgtttgcatgtagaatgatcatagcacccatcttaaaaattatctgaccaattaagtgaaagtttatttttggattttctattaaattacattggcctgtatttctgtttttatgctagtactactctgttttgagtattgtagctttgtagttagtttgaaatcaagaagtataagttctccagctttgttatttatttttctttttggctatctggggtcccttgaaattttaaagataagttttagaataagtttgtttttttaaaaaaattatttctacaaataacatcattgggattttaatagaaattgcagtaaatctgtagattgcttgggagagtattaacattttaacaatattaagtcttcccatccatgaacatgggatatttttcaatttagttatgttttatttaatttctttccaaaatgttttgtagttttcattatacaagtcttttatctccctggttaagttaattcctgagtattttattcttttggatactattgcaaattgaattgttttcttaattaactcattcattttcaatctatgaaaatgcaaatgattttgtgtgctgattttgtactctgatactttgcaaaatttcttagttccaacatttgtgtatgtgtgtgcaaacatgaaacatgtgtatggaatcattaaagttttctatatgcaaactcatatcacctctaaacagagataactttacttcttccttttcaaattggatctttctctctttctctctctctcttttctttctttttttgcctaatagctctggtgaggacctctgatactatgttgaacacaaatggtaaaagtagacacccttgttctgaatcttcaaaaaaaaattagaatcgaaaaagtatagttttatctgtacccccgatagctaaaaaaaaaataaattacatgacacatgcaacttatacagatttttcaacaatcattaacaaagaaaatttagaaaaggacagtcaaatcaaacttcctccatactgtctacaaataaactcacaatgaccaatagaatgtgacctcttatctccatcatccccattttgagatggtagaaaacgtgtattctcatgatcaaattttcaaactcatcctggcaatttgtttcacacaaattgcttgttaacattttcatttcaataaattccatccatctgtctgtgtttattaaatatctgttttaaaccacatgattcttaagtttaaaaggttaattttactgtaattactaaatatttagataagaaaagtgctattaagacgtgagaatattattgttatataatcactttttttcttcaggaacccactgtgtatgcctacatataagtatatccgtaaaattatataaatgatggaattaactgaataaacttttgtttgaaatctaaatgctttctactctactgatattctcattacaaactttacaaatgaacacaaaatttactcagaaaatcagaattttaaagcaaaatgaaacctgagtgattatatgaggaaacgaggacctagaaatgctaagtgtcctgtccaaggagaattaaaatatacaaataaattactgaacaatgaactagaaagaacaaaactactgattttagcccagaacttattttggttttaagtagtcaaaagtattattagtagattgtgactattttccttccatctgtttccttgtctaagaaactttaaggacagacttaaaatgttctagctaatattactgccattagtttctgatttataatgtggcatatttcaaagctatgtattatcctttctttttttcctattttattggttgacctgaatgctttcttaatttcacttcactgtaattatacctcttaatctatgctaaataatttctccttctcctccttagaatattttctctcacttattgcctagccgagttaccctctaaactttcatcataagtcaagttcttcaattacttcctccagaaactctcactgacttctttacatacatctaacacagacatactgtaataatttagggcaggctgggcgcagtggctcacgcctgtaaccccagcactttgggaggccaaggagggtggatcatctgaggtcaggagttcgagtccagcctggccaacacggtgaaaccctgtctctactaaaaatacaaaaattagccaggcgtggtatcatatgcctgtaattccagctacttgggaggctgaggcaggagaatcacttgaacccgggaggctgagtttgcagtgagccgagatgtttccattgctctccagcctgggcaacaagagcgaaactccatctcaaaaaataataataataattaggtggattgcttatataaaaattagccataggttttatttacttttctatcatctaagtacctattatcctcactgtttactacaactgttctgtatattttattatatgtataagtatgtttatttatgtaatgtctgaaaaatgttaaatagcttactatggacagactgcaattaccaaatttaattatttctatttatctcacttttagttaagatgagaaaactattcaggtatcaattttatatttttattataataaaatctcagaaatcctcctaaaataaatgtgaagatacatttattttacatttattattacaataataaatacattattattgtatactttcagccaatgtagtatatagattaaatagatcatttcaaggagccaggagatatgttgatatttaaattgagtgagccttgcttatcaatctgtaatgggtttgaaattatttctagacaatagcactgagttgacacataagcacctgattgaaaaaaaaaagagaatcacctaacacatggcatagaaatggtgaaaataattattaacaatggtaatattacaatacatagaaagcgggatgctggcagttgtgaatgagatcgttcaaataacacagacaagtgattttaaagcagttcagaatgtctaacaattttttttttttaaagtgagttttaggtccaaaggaaatagaatttatcttctttggaattataagcccatttaaattatttagataaccaagaattacttatgattcttactgctacttacaaatgcctgtggaaacaagcaaatcactttcctaagtgcttaaagatatttatccacaaaatccactcttcctccctgacccttaaaaaaatgacgctaagtgtaacaggttccaacataataaactgccagaacacatttcatggtgcagtgcaaatgacagacacaatggaatacctgttagaataaagtagatttcattttccctacaagttaggtgagaatgctgatctcaagtatctgttctgtcaagtcaaaggttgcagcacaatagcaaattcagagtataggtgcatgtattaatagcctgttgaagaaaagagcaacacttctagtaattataagaagttgctccagatgaaaaacattaattcatgtctgtgatacattgtttaagactctctcagttgccttaatactatttttaaaaccccttcacagggagcatactcaccccatctggcctgccatctgaagctgtgatgatcagaatgtagcgatcagtgctttccctgtccagtgctttccctaaggttagaatccccgtgctagtgacaaaacaaacaaacaaataagacaaaaagagatattatgtcacaaggagagtcttcttagtatagtgaattacttttgatagctttttttcccctctcagtaatcacagcttgagtattttagatgtataatactaagattcattctgaaaattgaaaacagcttttaaggctgtcaaatttcttagcagtatccatgaaactgacactgagctgatttcctaccttccaggaaacaaaacataacaaaactgtgcttaattcattccaagaagaacagtatctatcttgttttcgattatttcaagagaaaagacttcattattccttagcagtctcagaattctttgaaacaaggaatggtttcctataactaatgtatatcacctcccaatttatgtcatatgtatgtccattatgaaaatgcaaaaacccatctaaatgttatctctgacaaactctatggataaaagtttttcttttttcttacttttaaaataacagagacccattgtacaaaattagaaaatagaattttttcaaattacagaaattatgttttttgtaatgtttctttttgtactttattataaccacatttaaatatatgattgtttcagaagaggaatcattctgcatattttacattttttaagaaaatataattgtattagaattcatgttctcattttataatttgtttaaaaccccttttgtggctacactaacaattttagtattttgttattctttggaaatttagctgtttcttaatttaactgatgtataatgggagattaacagcacttgggaaaattattgcacttacaatatttttaatacctactccttatcttttcactgctcagaataaatgtttccaaatatttaagactttattcacccatgtaatttattttataacagtttggcttgctctctaatgtaggttctacatttatttcttaaattttacatctgatattgtacacattttaatcgagcctaacaagtatccactgtgtagaagagtttatctgaatataataacacattaaaatatatgtaccaagtccaaaacataaattgtttctaatggataaaatgctttcattttaaggtaagtgcttttattgtaaagaaaatttaaacaattcatatcacatatggtagttgagtacagagagtcaaagccgatgaatcaaaataagaatcacagttactcaatttgcttattatgttgtaatggttgacgtggactttttaaaaagttctgaacatatggcatgcccatgaaaaactgactttgcttcctgtacattttaaaaatgttttgtcaaaataattgaaaaccagttcccagagcatgttcacaacaattaagtttggaccagcttcctacagtacagaaggtccagataatcccattttaaaattacattaaatgagaaaagtaagacatgtatttcttctgaggcttattcacaagtatcttaagaaacaggaaagctgaaaacctagccatggtataataagagaaagaaagaaaattgagttaccattttcattttgtttcttccctcagttaattatctatattcctccttgtacattaaattagaaaattactaaaaagtatattgtatatttacgatgaattacaaaactcacgtgataactgagttgatttcctaccttccaggaaacaaaacataacaaaacttcgcttaattcattccaggaagaaaaatatctatcttgtttttgattatttcaagagaaaagatccattattcctcagcatgttcagaattctttgagacaaggaatggtttcttataaataatctatatcgcctcccaactgtatatagtatttggaatatatatgtatactctatatatactatttaggatatataatactatatgtattattccaaaaatactatatgccgtgaacaatatagtatacagtatattcatacttagggccattttaaacacaaacagctaattgtctatggtctggtgattattatagaggtagtttttatgtaatacgcgggccttgcgactcagtgttgtaggcagttgtgtggtatatttgggcaatgcagaaggggagaaacacaggcagtgtattttgggattcatagctgaaagactagtttatgggtttacctgtgcatccttttattaaatccgagaaatagctcacaaaaagtcttattaccagctagatggaggctatcaggccaggatacattggggtacacttagtaatgcaatacaccttataagttcacatattaaaaatacataagcttcttcaattgataaagcatcaataacactgctacttatacaggattgaaaatacatttcccaggagtgatgtcagtggaaatggagaagacagccccaagagatggtctcgccacaaaacgtcaaaaaatcacaattaagcagggaccttcaacagcaaatttgatgaaactctggaaaacagtcacaggtttatagcaaccagatgaaggcagaatttgttttaaaaaaaggtaaatcaaatctggtagaagaactctgtggcattttgacttgtctttatcctaccatctcactggctcagagtggccttgaaaacatcagtgaacattcccagtgtgacactatggtctttgtttctggagggagcgagctatccttattcataaagaactgtgggggtctattctagtctgtctggagactgcctgaaggagtgattcatggcacttatctttgtttcatcaaacttggaaatcactcaaagcagaaaagcagtgggcattcctcagaaatattgtaaggcaggggatagcccacaaacacttgaggcgtataatagagtgccaaaaacttgccaggaaagtctgggtaaatagtttcatggaaaattcaggcactcaaaagtgtactggggaatacagaataataaatataattgagaattcataaatatacccacacatctacagtcatctgattttcaacaagaatgccaagaccattcaaaaggaaagaatagtcttgtcaacaaacggcactggaacaaatggaaatctatacgtaaaagaattaagttagactacttcacttcatacacagctattacctcaaaatggatcaacaatttttctaaacacaagaattgaaacctgtaaacaactcttagataaaaactagaggtaaatattcataatcttggatttggccatggattcttagatatgacaccagatgcacgggaagcaaaggaaaaaatagatatactgaacttcgtcaaaataaaaaaaaaaaaaccttttgtgcatcaagggacattatcgagaaagtaaaaaaaacaacgcatataactggagaaaatacttacaaatcacatatctggtaagagtcttatttccagaatatataaaggattacataacttaacatcaaaaagaaatcccaatttaaaaataggcaaaagactcaaatacacattttttccaaagaagatatacaggatatacaaataatcaaaaagcatatgaaaatatgtcattagtcatcaggcaaatgcaaatcaaaacccacaaccaagtatcacttcacactcactatgataattatatttaaaaaaagaaacaaccaccattactaacaacaacaacaaaaaataattgttggcaaaaatgggaataaatcagaatcctcatatatttctggtgggaatataaaatgcttcaatcactgtggaaaatatttgacagttcctcaaatggttaaaaacacataattacactattccctagcaaatctattcagtatatacttaaaaaagccaaacacaggtacttaaatacacgtacatatatgttcacagcagcggtatttgtaataccgaaaggtagaaaaacagcttaaacgtctatcaatttatgaataggtaaacaaattgttgtatatgcatgtaatggaatattacgtagccatgaaaagtagggacctacttgcacatgttgcaagacagacgaatcttggaaacattaggctacaaaaaagaagctagacacaaatagtcacacattgcatgattccatttctgtagaatattcaaagtaggtaacttgatgaagccagtacgcagattggtgtttgccaggggctaagggaaataaggaatagggagcaattgctaaatgggttcaggtttctatttggagtgatgaagctattttagaactagacagagttggtaggtgcatgagttctgaatctcctaaacaacactgaattgttcactttaaaatggttaattttgtgctatgtgaattttgcctcaattatataaattatattgcagagtattttccatcaccaagcttttgggctacgttcctgaaacatattatgcttggcatactcaattattatagaaaatagggtttgcctaactataaaaatggtgttcaaacataatttaaaaatttggccaggcgcggtggctcacgcctgtaattccagtactttgggtggctgaggcaagaggatcacaaggtcaggagatggagaccatccatcctggctaacacagtgaaacactgtctctctctttttttttaatgtgcacttttttttttttatttttttgagacagagtctctctctgttgcccaggctagagagcaatggcatgatctccgctcactgcaacctccacttcccaggttcaagcgattctcctgcctcagcctcctgagtagctgggattacaggttccctgggagcttatttaaaagctctgtgccatcagttttcccttctgtcaaatgggaaagtgaaaccccatctctactaaaaatacaaaaaattagccgggtgtggtggtgggtgcctgtagtcccagctacttgagaggctgagggaggagaatcccttgaacccaggaggcggaggttgcagtaagccgagaccataccacagctctccagtctgggagacagaacaagactccatctcaaaaaataaaaaaaataaaaaaataaaaattatcacctgtagtcccagctacttgggaggctgaggtgggaggatcacgtaagcctagacttttgagactagcctgggcaacagagtaatacccagtcttaagaaaattcaatgatgtaaatagaaagtagcagaggatatctacttccaaacaaaacaagctaccgaatttaaaacctgcttctataagtaactgtttttcaaaattccgttattaggaaataccgatgcagcatcattataaactattatctcacatatttcatgatgtataggctttgcttatttaaaattttgttaaaaattctacagcttgtgactgaacatttacacttggaggtgtctgagcctttgacagatttatcacattgcttttgggcactgagtttcaggctttacaatgatatttaaagagattagagtatactttaaaatgtacagttgcttcaagtttgacatggcatttcatattaaatagcaattagcaattaacaaaaacctactaataaagggagctaggtattgacagcagtttggggaaaagatgatggtggcatgaactaaggtagtagagtgaagtgtgagaaatagtttgatttgggtttaatattttgaaagtagagctgagctgtcagggaataaaataaatatctttcttatatattatttaattttcaatataatcataaaattcaaactgatatgaaaaatataattgagcattacatgtaatgtcaaaacaaattaatcaccaaagaaaaaattaaaatgcaagtgaagaaaaaaaattttaatagaatttggaccagagatggagataatttttgaaattctcttatttagcactgattttaagtgttggcatcacagaccccatgcttcagtgataacaatccataaatatttgagagatggcatttcctcaacctcccttaataaataactataccattaggccatcatatttataagggaagttgccatatatcttatttaaatgtgtacttatttgtggatgattgctgagtgaatatttgctaaatcatatgccactatcaagacagacactatgaaaagatactagaaaaatgcattatattagaatcatacagatatggccacttaatacatgacactgaatgatttgtattaccaatgtttgtgatttttaaaaaaccaaggctttttctttaaagacccagtttctttcttggctgtgtgactaagccaatttattaaaataataattcagtactttgtaaaaccctactgacattaagatgattattcattactactaattttttaaaagaaatacaagaaaattttggcatacttttatttcattaaaggaaagtaatggtattataatgatgcgtattgagagaatttgcattatagcataaaataatatggtatttaaagtatacaatagacatgtaaatattttttcattttgctttaagatataaaatataacccaaatagcatatattgaagtgtctgatgaggtagaacattgtttatttttttagcgtacctgtcttagtccatttgtgttgctataaaggaatacttatggctgggtaatttataaagaaaataagtttatttgtctcacagttctacaggctgtataagaagcatactgccagcatctgcttctggtgaggggctgagagtacttccactcatggccaaaggtgaaggggtgctggtgtgtgcagagatcacatggtgagaaaggaagcaagaaaggaggggtggtgccaggctccttttttacaaccatttgttgtgggaactaataaagcaagaactcattcattacctctggtaacaagccattcataagcggtctgcctccatgacccaaacaaatcccattaggccccatctccaacatgagggatcgaatttcaaaatgaggtttggagtgtcaaatatccaaactatagcagtacctggattgttcatatccttgaaagttatagagaagtggtagtgcaaagttttgaacatgaatctcagaagtttcaaagaaggtggcagttgaaatgtcagttattgttctccatttcaaatgcattgaaatgtattgctagtggttcaggctactctataaatatcaatgagaacaacagcattgaggtggtggaaacaaagtgaccataggatagaaggcaaagggcccagtgtacaggaccctgaatcaagaatgatcatcaaaagggatcacacaaccattatagggacatgttctgctttagctttcctggaagcagtttgtgtcttaaggagatgtctgtccaggttgacctaagagctttaacattaagaatcatggtcaatttagactaaaaggattttgcattgacataatttacacctttaagaacctctgtgacccagccattatctttttcattccaaatgcagagatgagaggagcactagagatataggaaagcagtgcatttagataatttatttggcaaaactagtagctcactggatttcacaatcagcaattgaaaaatctcttggcatcaagggaaaaacaggaatagaaattcttaagagacctgggcttcctgcttaccagagcaggtgaaaacttcattgttgtctttttcttttgttgacagctttgttaacattttaattcagatatcataaaatccaccaatttaaagggtacaattcaatggtttttagcataatcgcagagttgttcaatcatcactgtaatcaattttagaacattttcaacaccatatctattaacagtcactccccattctctcccactcctcattttcaggcaatcattgatcaactttttatcttatagatgtgcctattatgaaaattttatagaaatgaaataatataatacgtgctctttttgcaactgacttatttcacttagcataatattttcaaggttcatacatgttgtagcatgtttcagtacctcattaccttttattgatgagtaatattatattattacagacaggcaacattttgtttattccttcctctgtagatggatatttgacttgtttccacttttgtaccattgtaaataattcttttatgaactttctttgtgcaaactattatgtagatgcacgtcttcatttctcttgcatatgagcagaatgctggcttatgcggtaattctgtttaccatttggagaaaaggccagttctccaaagtgtagtcatagtttgaatccatgtccttgcccaaatctcctgtcaaattgtcaccaatgtaggagataggacctgctggaaggtgattggctcatgggggcagtttctcatgaatggttgagcaccaccctccttggtcctgctctcttgatagagttcaggagatctgcctgtttaaaagtgcgtggcacttcccctccctctctcttcctcctgctcaggccatgtgaagcgctgactccccgctttgccttcagtcatgacttttaagtttcctgaggcttccccagaagcagagcaggtgccagcatcatgcttcctgtatagcctgcagaaccgtgaggcaattcaacctcttttcattacaaaatactcagtctcaagcacttctttatagcagtgcaaaaacgaactcacacatgcacattttacatggccacataaatttacgcagatttcagtatctccacattcttagtcatacctggttttgcctttctttatcactacagacacaaagtatgtatgaagtcaaatctctttacagttttaaattgcatttctctaatgacaaatgaacagtgatcgtgatcatatttccatgtgcttgttggccattcacatatccttttttaaagaaatatctattcaaatattttgcccattttaattagattatttctctttattaagttgtaacagttctttatgtattcttgagacatgtttcacaccatatacattattttaaaatattttctctgattgtaggttgtttctcactttaggatggtgctccttgaaatacatttttaaaaattgacgagacccaatttatcaattttatcgttaatctttgtgcattttgtgtcatatctcaaaatgtactgactaatccaaataatgaagatttacttctgtattttcttctatgtggaatgcagttttatctcatatattgcaatttatgatccactttgagttcatttttgtgaatgatgtgagataaaaattgaaattcattctcttgcatattgtcccagcttcatttgttgaaacaaagttctttcctgattggattatcttgacccctttttgaaaatcaattgaccataaatactagagttatttctggattcttaagtctgtccaggtgcttatatatctatctttatgctaatactacacagccttgcttaaagtttttaacatttttattttctttaatgatgattgtaaattgtagctaatttttgatttctacatccctatgagataaaaatgaaaacagttaaggctttttatttttcaaatagaagtttacttatctgtggaaaacactgttcttgtctatagtttcccaggcattactaactcatgtttgtaaaattctatttaacgtgaaatttcaggtatttctgggaagactaattgaccagcacatggttctcttgttttggcattatgccccacatgttcctgagtctgatgtggcaatgtattcatttgtcaaagttttaactttataatcattggccaagtttacatttctattccttctgaaagtaaaactattcacaggtacacaggaaatatcagggaagagccaagctctttagaaaccagccacatgtgacagcagaacagctaccttgctattgcaaaagggaagcatacagtctctctgaagccctaaatgcctccttttaatgcctgctcccagttttctcaatagttatcattagcaatatctcagatgtattcagagagataagtagaatgacactgatctagacctcaaagaagtttggcatgaacacgtattttatttcattgtgctttttttcttaaatatacctatgttaatctgaaattgaaggatgtgtttgtaacacatcttgcctacaagcctccctttgaatacacagtttggtgctaagtaaccctttgtagtaatgtccttgtcattatcagtagctgacaacattaaaaggatctaattaatcccagttgtgccttccaatgaaatgtttccacctcagtagattttacctagtaaaaatgttaaaaataaacagtctcctgggtaatatttctgggctcagaattatcctcccagctaccattagcattcatagaaaacagaaagggaagtacaactacaaacagctgaaagcctctgattagaagtctgctttcttactaacagtacgttgctgtacatttttttaaagtaggaaatcatttttaacttacgtttctgaaagattaaaaactctctgaggatctccattctcaatggcatatgttattgagtctccctctcgatcagttgccttcagagagaaaacataattcaattatcaagtaattgatatggcgcccactcattacagagtaatataaaagcttgaaactaatagcacagaatgtccatgacactgttaaagaataaagattaaagcatggcctaatggcaaggtgtaaaatcaaacatttcgtatctgatccatttctgaatatgtaatcctacctgatgtggaaataatcattttcccaaggtttacttatttaattaacttaattaatgaatttaatttcaatgtctgtttataatttaaataaaagctgctggctgggcacagtggctcaagcctgtaatcctagcactttgggaggccaaggtgggcggattacctgagatcaggagttcaagactagcctggccaacatggtgaaatcctgtctctaccaaaaacacaagaagttacccgggtgcagtggtgcacacctgtaaccccagctacttgggaggctgaggcaggagaattgcttgaacccgggaggcagatgtttcaatgagctgagatcatgccactgcactccagcctgggcaacagagcaagatcttgtctcaaaaaaaaaaaaaaaaaaagtgctaaactatgtttacagtgtcgataaagtgtttaatgtatattcttttctttttctgttcagaatatatcaagacaataattcaaatcagtctaactttctggttaaaaatcctgaatttatagccacaaagcatgacttcaaaaccgggctccaattgtcctatgtgattatttctgtgtatccatttctaaaacgaggactatacaacaatacaaatgttaatagatgttgagaggtttaattgaaataatatatatcaaggcacatagactaatatctggtacattgtaagctttcaataaatattaacctttttgttggtttttcttcccttcaacacccaagtcggagaagaaaacatatagtttgactttgagttccgagtttctcttgaccaaaataaagatgctcttgttttatggcactgaggtctggagttttaccttaaaaaacatcaaatcagttctttttccagtgagtcattcgatcctcttataaaagacatggataaagaaagaaatttggatgctatcagagagttgacagaatgatctgcctaagcatgatgctacagggggggatatatctgataaaggttcagatgtattttatttttaggtgactagcctggcagaaacaccagcctctccacagacaggaactgccctggagtcagcaggattctgagagaggaataagtatgtgagtttctgtcagtgactacataataactgtcccagccataagaggctgagtgtgaaattccctgtccagacaggcaggaacgtattgttcttagtggtagatcagttggctttgacatggattacacagtcctgctcacagaacgtccttatcagctaccacaatggattgatggccagaagcctctcttggaccacaaaaactacagaatcaagggaaactgaaaataatatttcagtcagtaataaactactgaatattgactatgtgctaggttctgtaagaaaatctttgcaagattatttaatctgtctctcataaaagtgatatacttccttcgcatggctcctatgacatcatattgtcctgctttcaatcctcacattatcaatggtagttcctcattttcctttgctgatttctcctcattttataagacttattttatattggattgttccaaaggttggtccttgaacttcacttatttagtcaactcattcaacagtgtagctataaatactgtctatctgctgaagacggtcatatctctaggctagccctttcctctggatttcagatgtgtatccaattgcctacatggatccacattagatgaataataataagcctccccaatttaaaaggttaaaagccccaaatctagatctcctttccatcttgacgtacctcaaaaaataaaagaaattcaaacaataatctattgttttcactgcttcatcatctcagtaagtacctgcaactccatcctcctactttctcagggctcatagctacactttgagggctcactcttacattccaatgcaacccatcagcagatcccaccagatttacctaaaatatctgctgtatctggctgtgtctgaatttcttctctgccaccaccttcctcatggattatggtagtaactattttactaacgtgttgcttcttcccttgtatcctcacaatagtcaattttcaattcagcagacaaaagtacttgtttttccaggccaattcttttatttctttggggtaaagtctattgctttctcccccagctccccaccctccccatgccatacacactaaaataaaatggaatcaaaaaaagtaaatgaagaagaaagtaataaattagccagggtaaaatatttttgaaacatcccatgttagtcaaaatccaaaattttatatttcattgagttagtcataatggaagcctaggagtagaaaaaaaagaagcaaacaaatttctaagaatacactcaataaaatggatagtagacgcttgatatttttcccttgcattctgttctttgctagataggaaccacaaataatgatactcagctaacattttgaagaatcagagaattatatctggagactatatcttaaccccaaaaagcttacagtgaactttttctgttgtttttctctcggtcaataaatttttcttattatgttgttatagatatgatcatgttcttttggtttgtttattgatatgtggttgctgttttaatttttttcttgagaaacattttataatcttgtgtttcataaaagccagaagaaatgcattctgaaacaagatagcttcatgtaaacaattttaagaccagattaatatcgaatcttttattatatcagatctactctaatatttaatatcctttatgtaagatgagaacactgtatttatatttattatttttatgttaattcctttcaatcccagaggtagcttgaaatatttcttcagttttatttgaccactcaaatacctcagtcttttaaggattgtgaatgtcaacaatttgcctacttcattcttatgtgaggttatgcccatattggaaactttgaagacttaggatttaaaagaaaattcttatttgattcctttcttcatttttatcttttcacacaatcctttattggtgttccagggtcgagggtggtataataattaggaagtatttatagtttttcagccaagaaagcaaaaggaaatggtgtaatctgtatcaaagttctgcaatctatgcattacatgagttagcacttgtatagacaatatcatctttctttgtcaatgtccaaaggtgagaaataatccataaaaagaaaaattggaaatatcaacagaagcatttacccttcaagtattaggatttgattatgtgtgtatatgtgccctaaacatatttctatcagcaatatttaaatgttttctatatataaatctaaccagccatctcaaaataattgcttataatgtgtcagaaactatattaaaattttgcatgtcttgtctcatttaaacctaatagtaactttactggtaaatagaaaatgcatatgacttcaattatattactatttctgccatcattccaaccagatttctctgtactttaattaattgaaagatgcatcttttttatctagagatagtaataactgtatcatcttgaaaatgggagcatagtgttattcagtattttccataatataagagatataaattgcttctttttagtgaaaaaacattttatgtgcttatttttgataaatcaagtcatatccgagtcccttcttcaaagcctgagaaaagtatgacagcagttatctttctggggcttattttgagtttaacgggggagattctggagccagctacctggattcagcctcagctatactatctcttctcagacaatgcactcaagtacaaaatgagaatactactactactacttaatcactcattaattcaacaaatatttattgagcatctacgctgtgttaggcactgaggctgcagcagtaaaccacacagacaaaaatcctgcccttatacaatttacatggtagtggaggaaaatgaagttaaaaattaattagaatattttgttttcagatctttatacgcgttgctcaactacaaaatatttcacaaaggacatatatggagagcagggtgaggatttacacttatagaagtgatcatgacagacttactgaaaatgtgaaattttggcaaatgcttgtaaaaggtgaaagagtaagtcacgtggggaagaacattccaggaagagggcagagcaagtgataaaggccgtgaggtgaaaacaggcctggtgagtttcaagaacaacaacgaggttgtcaggtctggaggcaagcagcatgtggaagaggagctcctcagtgtacttcgaccactttaatacctcaggttaaacgaataaatgatgtgtattttggatagctggcaagtaatgcactttagccactggtttgctaatatatggttaataacatggttaagattaaagccaatctttcctttaatttttatttaatttaatataattttaattttgcctgaagaacaaatgattcctttaaaaatcaaagcaattactctttccagtccactcaaccagattacttgcagcatctgacttagagtccctgatttttcagaagcaccaatagggaaacaaaagtatttatccaaggaagcagtgttcttagacactggcaaatggaaaatttggaaaagaaaacaaattttctctaaactaatcttctgttcatgttaaagatgaatacagccatcaaataccgtctgatagagtgcattttatgtgcaaggaatgattctacacatttcacaggacattaagacaaagtaactgcccttagggattctaaaatagataaaaatcaatggatttggatgattttctcacttaggcaaacaagttctgatttatgttattaaaccacttgagagcaacaaataaagctttcaattcagtacagcagtgtttcaaaaaatgtatacattcattcctggtattacattttttggcctttaacaaaatgttataatatttaaataaaaattaatgaatatattttattcatgtcaagtactgttattttgtcattcataatgataatataaaatgttattttgaagtaagtgtaagtaaaaggtcagttcattaaatattccaaacaatataaaatgaataatattatatagaatatacatataacatatatgaaacttggaaatgtagctaaatctacaatgacaaaaatataaatatgctcaaaaataaaagaatgttggaaaactgcacacaggagagccataaaacagctctttttcttacaatattggtatggattaatgatcttttgcccaggaagcaaaataaaatgccttatgctaagaaggcatagcagaatcactgctggtagtgttgaaaataaatggcatttggaagtgagcataaatttatttgtcacatccagagaagtgtctgtaaattaagaagtccttaataggaaaaatacctagacttccgttagatttagggatactctatgaaggcttagtcttaaaaaaattttgttgtacaaaatgggtaaccttggaatacaaagagatttaatcaattctaaaataagcctgcaattctaattttgtctagggctcaaggaacaatcaacaaaataaacttagaactaatgtaaatattcaaaatgacgcatccaaataatggttaccattatgtattaagcacttttaatatcccatctcatttaatcctcaaaacaatcttctctggagagcactacaatccctattttacacataataaaatcttaagcttaaaaattaaataatttgccaaagtttacaaactatagaatcataattcatattctatgccttttgaaactcattttctatcactagcaaagtcccctatgtcctaaacttatctcgagtttcccttcacctgcttgcttgaaccaacaccaagttcttcttaagaaccctaatttcccagtatcccttttgattggtgagcctcagagtagccttcttgtttctcaatgtcactgccagattattcttctggaaatgcatcagctttaattcttataccataagcattatactgcattaactgctactcttcattgttaaagtcatactctacactatttatcatacttcctgttttttgctcattgtcagtctctctctttgcctgtcattgctgtcattgtcaacttaatccaatatcaaagtttcaaataatatgtaaaatgctaatgacttcaaaattgtatttcagttctggggctgagagattcaagatcatggcactagcagatcccatgcaccttttgtggtctgcagacagctgtcttctcattctacacttacatagtagaaacagagagctctggtttcttcattccccataagggcactgaatgccattcatgaggactccactctcatagcctaagtatctctaactaccaaatgtcctacttctaaataccatcacgttggggattttggcttcaatatgtgaattttgggggaacacaaacattcagtccatagcagatgtcaaaaagtcttttcaaatacagtatggccaatattgaattactctttctctaacagtcttttaattttggctaatgacaaatcaatgtttccagttactcaagctgtatcttaatacctattcttaacttctatctccccttctatatccaattcattaacaaatcatgtagtttttaaccaccaaaatataaccagattgaaatgacttctcattatttctggaaagatcactccaggcctagaatgtgctgacagagcatatcaacaactctccataatttttcccaggcttcttccacagaccattttcaatgcagcatccaggattatcctttgttaaatttggttgattatgtcactgctatactcaaatttttaactgtacctaatttcgtgcagagtaattatatctatccctctcctattactgaatgatttcatctctactactgtctgtttcttttactttactctgtaaggaggagtatttttcttcttccttaaacatatcaggtgtgtctaaacttcggggtcttacctttgcacctgaaatacttttcctcagatacaaccatggctcatcctctcaccttattcaactatttgctgtaaggtcactttctttgtgaaataatcactatcaaattgtattttcccatgcacttcctctctagctttccttctttcattttccccataacatcttctaaaattccacataactcacatatattttgttaattttcttctctattagaatggaaccttcataaaagcagaaattttgtcttttttatttactattatatcctagcatttttagttgtgacaccataagaagttaatatttacttgtcatttggtccttgcaaagttataagccttaatgattacattataatgagaaaaatgaatgaaagaattttggaaaaatgaaaaaggaaggtattaagtggacacaggtctctccctgctcctgttttcactgggaggcaggaaaatgcacacctcaggaggggagggcatgggacattctggcttctccctgatttattagactgcaaggataaactaagtccaggaaactcagtcagagctctgttctgtatatgcacattcttcctcagtatcataaagggccttcctttgtacttcctatgactgggagcctaactttaatatactgaaggaagtacagcatttcaattgtatctggtacttgaagcaactgaatttacagtaaaacaaaacaaaacaaacaaaaaaagaaaccccacatgctttttacctattgtatatactctgtgtgtctctattaattgcttccaaacttgacagagaaaataaagttgtgtgtgtgtgtgtgtgtgtgtgtgtgtgtgtgtgtgtgtgtcctattctacattttcagaatacctgtcctaggttaaacacattccaaaagactgttagggaacagtttgttctgggcacactgatataaatatttcagttatctttatttataattattaaaaaatttgctatcaccttcatgaatattggacatgaatattcattgctaacatgaatggctcaagataaaggaggttatatgaataaactatatgaaaccaggaaggcttttgtcatctggaatgatgctgaaaagatgattccataagtatgaatttagcccaattattcttagtttttattgcccaatactaactgtaacattaccctgagagctgtctctagaatagtgtttggtttgcctaaattgaacttaaagaaaaatgttgtcaggcctctgaaaggacaaatcttacttgctaataaatatactgtgcatagtagtatttggcctgagacaaacttttccaacctttctatgaaggttgtgacagagaatcctagccctcttttactactacttattcgtggctattgatacttagaatctaattattgtggaaagacaattggctttggtcagtttacagccctcaacatttaatgacaaaccaaatagaaaaaaatcagaatcaacatttctgtcattaaaaaaatttcttcatgatacagctcttgtccagatttatataaatagaagtttatttgttctttgttttagaactatgaaaaactggacacctacgaagcaatttacttaaactcttagaatttagttcaaggttttctcaaagctttcctcagagcctactcacttttctaactagttagatttctcagccttcactagataaaaaccagatatgtaaaataataaagttatccggacacaggcaaacagtgaatgaaatcagtacacagtgaatggcttgacagctgtgagagaagtagacagaaagtgcaccttaaaaacaatagacacaggctgggcgcagtggctcacgcctgtaatgccagcactttgggaggccaaggcaggcagatcacgaggtcgggagatcgagaccatcctggctaacatggtgaaaccccatctctactaaaaatacaaaaaattagctaggcatggtggtgggcgcctgtagtcccagctactcgggaggctgaggcaggagaatgtatgaacccaggaggaggagcttgcagtgagccaagatcactccactgcactccaacctcagcgacagagcgagactccatctcaaaaaaaaaaaaaaaatatatatatatatatataaaacaaaaaacaaaaaaacagataaaacaagcatagttatcaaagatcaattgtccattaagccccacacatcacagcactacttatagataaaaatatgtaatccaatttaggaactattaatcacacaatattctgaattaaatagacaaaaacaaagcattaatttgatgcccattataaacaatatatgtactgctagaaatgagaaataatataaaactattcaatatagcccctaccttgagaaaatattaatctttgtgaaataaacattgagaaatagtgttcactatatgctggttaactgtgcatttgtaaaagtaatccaggtctagtatctacaagattaagaacctagtcttaattctctcacttttagccacctagggtctagggaactagcatgtatccctagacatctattctaaatcataaaatgaaataaaaaatacttcaagcatctactttatgtagtagatatagaatcagatgaggtaatagatatttaatacacttcagaattccattcaaatagaaggtattgctcagtggtcgggcatggtggctcatgactgtaatcccagcactttgggagcccaaggcgggcagatcacgatgtcaggagtttgagaccagcctgaccaacatggtgaaacctgtcactactaaaaacacaaaaatttgccgggcgtagtggtgtgcatttgtaatcccagctactcaggaggctgaggcaggagaatcgcttgaacccgggaggcagaggttacagtcagccaagatcacatcattgcactccagcctgagtgacagagcaagactccgtctcaaaaaaaaaaaaaagtattgctcaataaattaatttaatagttaaaatcttaggctttggagtgaaaagaaataggaatgaaatgggactctttcacttataagccacatcctctttgagcaagatttaaggtatttatatctcagtgacatcattctgatactcagataaaatggcacaaggctgtcatgatgatagaatgaaagagttcatatctagaattcagcatagtgcttagcatgcatttactaaactcttactattgatgttaatatttagaaagaagaatgcacaatagaattcaggcaaaaaaaatcgatttgtaaagcagtgtttcttaaagagactacaactctgttatcaataaaactctcacttctggaatactcagcaacatatagtaagtgatatgataccatattagcagagatagtacatcaaattcccggcaaccacttaaggtggggggggatttttttttttcctattcttagatacaaaaattttcatctgcaaggttacatgtatactttaagcactgcttgctcttcatgtccactttatatactgataaacagaaagaaagatctccagttaaggtctgaaaatgtgtctaagataggtagatattggttgatatggcttgtctgtgtccccacccaaatctcgtctttaattcccacgtgttgtgggagagacctggtaggagacaattgaatcctgggggcaggtcattcccatggctattcttgtgatagcaaataagtctcatgaaatctgatggtttgaaaaatggtagtttccctgccccagttctctccacttctctgccgccatgtgagacatgcctttcaccttccaccatgattgtgaagcctccccagctacatgaactgtaagtccaattgaacctctttcttttgtaaattgcccagtctctggtatgtctttatcagcagcttgaaaatggactaatacattggtcaactatattggcagtggatggtggggaggggaacataaataaatgtttataaacctggccatcaacactttgagctaaaaaaatgacaaatgagtgaaatacacaattcacaactaatacttagcatgtattattttgagcaaattaatagatcaaacactaacataaccccttagtatattttcagttgatacatatatcaaaaagtaaaaataagcaggattggagcatacagcagagacacttctccaatgacaaagtgaggagctacactgaccatctcccagtaaaacaatcacaactgctaaaaaagaaaccttaaaaattaaagtctcagctaggcgcagtggctcatgcctgttatcccagagttttgggagactgagaccagaagattatatgtggataggagtttaaaaacagcgtgggcaacatggtgaaactcatctataccaagaaaaaaaaagataagaaaattagctgtgtgtggtgttgtgcaactgtagtctcagctacttgggaggctgaggtgggaggataacttgagccctggaggtggaggctgcagtgagccatgaccacaccactacactccagcctgggcaacagagtgagaccttgtctcaaaataatattaataatcataatagtaatataaataaagttttaaaatagtctctaaatactgttctaaagacatatggcaagtggaaaaaatatttattcaataaaacctactaaatctcactaagaattgtgaaaactgttcttagtgagttcactaagaacagcctgtctttctccctttccaaaaacctattcagcacagcataatgcaggcatagtcaagaacatgggaattcttcctcacagcttcagtctgaaactaggctatctgcccatgaaggcaggccacacaatttcttatcacccccagcaatgtgctgcagtggctgagaagtctgatgtttccggtgggccttatggacaggaatggagaaaaaggcatttgccaagtcaatggctgtatatcaggtaccaggagatgtgttaatttgctcaagcaatgaaaccacatctggtacggaagctgcaattggagtcaccacttcattaagcttacaatagtccactgtcattctccaagatccatctgttttatgctcaggccaaataggagagttgaacagggatgtggtgattaccacccctgtagctttcaagtccttcatagtggcattaatctctgcaaaccatccagggatgtgatactgtttttgatttactatttttctaggtagaagaagctctaatggcttccatttggcctttcctaccataagagccctccagtcagggagccaatgtgggggttctgccagcttctaagtatgcctatgccaattattcattccagcactggggaaatgaccacagcatgagtccaaggacccactggataaccactataagacagatccgagctgaaaccccattaattatctgacctctataagcccctactttaactagaggaccacagttttgggtccccaagaatcaacgtcagctcagagccagtgtccagcagtccccaaaatgactgataatttccctttccccagtgcacagtgaccttggtaaaaggcccgaggcctccttggagaaggatggaagaaagattaacagcataaattggtgggtagtgtaatgggattcttcctcaaggggacctggcctccccttcattcaaggagttctgggtctgtaaactggctcaactctggaaattgactgaggggtcatgattctctgtttttataattcaaattagtcttttgtccattctacatagaagttttctgcttaaattaagtaggaatgcagtaggcttcctattaatttcacttctaggaacaccctgattaattagccaatgtcagagccttacatgagtcagactactctgatgctgctttgcctctgctgtccattatggtaactacacccaccttgcctttgatggttgagcgccaccacttggcccatgccaccttgggatccaattactcctattgtatttaaattttgtagttgagtgactgtggttcacactgtttgatctgacatacagagaagagcaattatagggctcttcaaagatgcaggtgctgccctcataaatctcttttgcaaagcactggtcaagggtatatcttcaggacccacccagcagggatgagtaggtctaaagtgactagtccactccaccatcccaaactccctaagcctttagatccctttctctgcattaaaccaagagagatccggcatttccagcaagctcagagttggctctcttttaatccatattttagctaaccagacaaataaattattataacctttttttaactcctgaagctgcaacattaaatgcagaatccctacttggtgggcccagatcaataaattcagcctgattgaactctatgtttcttccaccattatcccatacccataatatccattcccatgcctgttctccagatttctgcttatataaattaaaaaaacataacaaaacaaaataaactcgagcagttcttttcaagtgtagcacacttcctcatgggtcacactctgaacttacctctaggggcccacaaggactttagtctagttatagattcagaagcaaacaggagtgttggggctggctcctgaggagaatcaacattatttttcctggcaactgccttaggggaggccatcactgttgcttcaggcagtgcaaggtttctctcctcagacaaaagtggaaaggctgatggcagcatggattagagagaggaggtttccacgactaggaatggagaagccatttcttctgacaaaaaagtttcatcagagtttacaagctcagtgtccccagccttatcagggtcctcccacacatccccattccaagttgcagggtcccattcttttccaatcaatgccctcactttaacaggggacacctggcgaggctgtgattacacctgttgttgcaggtcagccactagcatgataagagtttgtgtctgattttccacaattttagctctttctctacaggagctaagactctcactcgggaaaatcttagcagatttgaggctcagtatctgcttctgaagccaggagttagaatccctgagttcagccgggcgcggtagctcacgcctgtaatcccaacactttgggaggccaaggcaggcagattacgaggtcaggagatcgagaccatcctggttgatacagtgaaaccccgtctctactaaaaatacaaaaaattagctgggcgtggtggcgggcgcctgtagtcccagctactcaggaggctgaggcaggagaacggcatgaacccaggaggtggagcttgcagagagccaagatcgcgccactgcactccagcctggctgagagagtgagactctgcctcaacaacaacaaaaaaaaaaaaaaaaaaaaaaaagaatccctgagttcatccttttctttcatcactttgtccagtaaacttaggagcaaccaaccaacttcatagtcaaaggtattatgtatagagtcactaaactctttgcctctcacaagtggtgaatcaggagtgtcaaatgcatttattttgcataactgtctaaataattcagagcaaggactatcattgttcaccatactattagaagtaaagtacttagcattttttgatctaatcatattaaacagccaactccagaaaccccaaaaccaatgaaagaactccatccttaatattcagttcctctagaaccactcctggcaccaaaatctgtattagtcagagttctctagagggacagaactaacaagagatatagatatagatatagacatatagatggagatatatatatatatatatatatatatatatatatatatatacacacacacatacatatatatacacacacacacacacatacacaaaactaataggatatatttaggagtttattaagtagtattaactcacacaatcatgaggtttcacaataggctgtctgcaagctgaggagcaaggaattcagtctgagtcccaaagctgaagaacttagagtccaatgttcaagggcaggaagcatccagcacaggagaaagatgtaggctgtaaggctaagccagtctagtcttttcacatttttctgcctgctttattttctgattagatggtgcccacccagattaagggtgggtctgcctttcctagcccactaactcaaatgttaatcacctttggaaacaccctcacagacacacccaggatcaatactttgcatctttcaatccaattaagttgacactcagtattaaccatcacagtatcatataacacagcaattccattcttaggtttctgctcaagagaaatgaaaacttatgttcacacacaaaaatatatgtaaatattaatagcagtattattcataatagtcaaaaattagagacaatccccatgaccgtcagctgatgaatgtataaagtgtagtatatgcagacaattgcacattattgagaaataaaaaataatgaaatatcaatatatgctagaccatgggcattaaaacgttaaactaagcaaaagtaaccagatacaatagatcacacattgcatgattacatctaaacaacatgtcagaatagacaaatttaaagacacagaaagcagactggtagttgcctaggactggtgactctggagtaaatgaggagtataggctttttttatggtgtgatacaaatattctaaaattgactgtggtgatggttgaacaactacgtgaatatatactaaaaacattaaattgtgtactttaaattggtagattttagggtaaatgaattatatcttaatatagctgctaataacaagcaagaattattccacagagatgatggagttagcacagcttccttgctgtccacactcagtagcaatctatttgttttcctggagctaatgagcttcttgtggcttacagacagggaccagagagaaacacagaaagtgtcaggtcatgggatgtcttaacacacaggtatcttcctaagggaaatgttaacataggtggatcctataggagtgagtctggtctttataaagcccaaaatcaagaaacagctaaatagaatggatatggaaagcattcctcctgttactgaagccacaaaagtataacgagcataaaaaacagacttgcttcaagtggtataggattagacaattaggttcgtacaatatgaagtgtggatccacacacataagaaaatttcacacacaaaaaagagagttgacagtacaactagttaggaaaaagcaaagtccttcatatatgatgctgtttggtgtttattcagacagaagaaattgaaattgatttcaaatttcattatatacacaaaaatacatgttatatagcttgaaggcttaagtgtaaaaaataaacagttaaaacattggaagattattttgtcaaatacacatataatccaggtcaagagatcagtttattcaagaaatattgaatctggtgatatgaagatatatttgactctatgaacttggataccttgcctatcttccttccttcttccttctttctcatctatctcagctgtctatctcctagaaccagtaaccaaatgtttatacatggtattaattttcacgtattaatattttattaatagaatcaatagcattgatagaattttctattttgttatgttctgttctcttatatactacttgatttcattaacaagagataatattaacaccaaaaattgattttgtgatccaaagtatggcttgaaaatctgctgtagagactttgaatgtttgcatctctttagtgtcataaatatatgtatgcttcctgacttcttccttcctgattttcttcttgaataagtaatttcataaaccattacaacgcttagtatgataaccgtttgctcctattgcgggtatgggctgtggtctggtagagagaatcagaaccccagagggggaggaacatgcagtagtatttgtggcagcaacgtgcacagcaggaagtattagagccttagtcaaatgagaaaggcatctgagagggtgggaggcaaatgtggccatgtttggaagatgaaatgttttggggagccaaatggactggcagtgaagggccagcaagaattgttaagagtctaatgagggtgagtagggcatgcccatgaagtgggggacagcagcagtgtaatttggggtgtcctagactgagtgatatcaggctatctgggctgggtggggtgttgtggaagtgatcaatgtaaagaatcagagcctgggtggggtttcagaaagtaaacggtgtcaaaaccttggaaaagggttgccacagcagcctggcatggggtcatcaaacccaagagaggaaaaggaggtcattcaagatgtctggaatgggaggtcagaacccaaagcaggtaagcagaatgtttaggactgggtcagaatgggaatgatgatttggtgtgatttcaaagcccaaagatggttacaagggcatttgtgtagactctcatatgtgttgagttagggaataatgagggtaatcatggtgtctgcatgggaagggtgtcagtaggacagcagtctacagtgggatgtcaaagcaagagtggagagagtggagcaagatggtcccccagtaatcatcccctgaaacaaacaactttcataacaagaaaatgtcaggtgagcactcacagtacctggctgtaaatacatatcactgaaagagtcactgatgaggataggaaagaaagtcttgaattgctgatgccacccctcccccatcccctggcagaagacacatggcaagaagagaggatctgtgcacttgagagagggagagtgcagcaattgtgaggctttgcattgaactcagcactgttctgtcacagcagaaagcaaaaccagaatgaattcagctgatgccggctcacagaaggagtatataaaccaatcctatccagaggagaataacccaaaccagcagttgaaacttaagttccagccagccttcccaccacaggctaaagggctctggggttctaggtaaacttgaaatgcagtctaggccacaaagactgcaactcctatgcaagtactagtgctgagctgggcttagacccactggactaggatggcatgtgacctacggtgacaatggctggagcagctaagggagtgcttgtgcaacccctccctcaaccccaggcagcacaactcacaggtcagggggatactctttacttctgctgaggagagaagagggaattgtaaagggaacattgtcttacatcttgaataccaggtaagccacagtaggataggacactagtcagtcatgaggctcccatttcaggttctacctcatggctgacatttctagacacatcctgggcaaaaatagaaacctctgccttgaagagaagaacccagtcctggtaggacccatcaactgacgcaacaaacaaacaaacaaacaaataaacaaaaaaccttggtccctgaataaccagcagtgatacccaggtagtacactgtggtgagatttatgagacttgctggcttcagatgagactcagtccagctgtggtggctatgggagagactccttctgcttgagaaaactcttgcatgctgttcgtataaatgtaaatcagtacaactactattggcaacagtatttgaaattcctcacaaaactataaatagaagcatcatatgatccagaaatctcacttctaggtataaacacagaaggatgaaaatcaaaatatggcagagctatctgcactccgtgtttattgcagcactattcacaatggccaatatttggaagcaaaataagctcaataaatggtcctgggaaaactggatatccatacactgaagaataaaactagacacttatctcccagtatataaaagaaaatcaaaggcatcaaactctgaatctgtcatggtaaattgtgtatgcatccacaatggagcattattcagccataaaaagtgacattctgtcattttcaaaaacatgattgatctggacatcatcaaattaagggaaataagaaaattaagggaaataagccaggcacagaaagacaaactttgcatgatctcatttattcatgtgagctgaaaaataaaactattgaattcatgaagatagagagtagagggatggttcccaaaggcagggaagcgtaatgcaggtttatgggggaagtggggatagttaatgggtacaaaacatagttaaaaagaatgaataagacttagtatttgttaggacaacaaagtgactacagtaaaaagcaatttaattgtatgtgttaaataacaaaaatagtataatcagtttttttgtaacataaaggatagatgcttgaggtgatggataccccattatcctgatgtgactattatgcactgcattcctgtatcaaaatatctcaatatcaccccaaaatatatgtacccacaaaaattaaaaatgaaagaaaatttaaaaatacaagtacaagtggaatgaagaaggcaatagtttggggtatggtatttgtggcatgtagtgtgaagtgttggactttgaacttggtaataagtttgtctgcgtggttgtcggtggggtgagggctgcatctgtgctgcgccagtggcagccaggcgtgtggtgtcaaagcatgagtggagtgaggagaccatttgtatggggtcataggcaggagattggtttaacccagtgacatttacttagtacataaatacaatgaaggtaagaagcaggtttcctatcagagaatagagacaaaagtgtggaaagattaaaaaaaaaaaaaaaactagagtaaatggtatgggatcagattggaattgaagttttagtgtgaactcataggtatatatataagtaaacaaaggaaaaataagtataaacaggtctttttagcctgctatttggggcattacactgtgaatttttcatctttactcatgaagacagcttctgattccaaatcactcagcacacagtggttaaattaggacaactgtagcagcaatcaagttttgctgtgctttctaaccatttatttatcaaaatccgaatgaactacctttattttggaggagggaggtaaggaatggctcagtccacttctattgctagataattgtgtctttgtgtctgaaatttatgttttttaacctggagctttctttaaaaaaagctttgttcttatgtgtgggtgagacaagtgtatgactgggaaaatcagagacgaagatgacattttttcccttattttcttttaaaaactggttttggatttaatgaatctatggtttttaaaaaagtatttgaaaccacgagacatataattgaatttttcagttttcttaataactcttccaatgtaaatattctttacttttcaatttaaaatacattgttttcttagctccaaatcaactaattcttggtagttaagtatagaaacaccatagggactttgcaggatcagttgagtctcccattgttctcactagacaactgatacttattagcagtttattgagtatacttcactaacatggtttttgttcctttctatttatcaaaatctcagaaaaattacagcctttatatacttacactttaatcaacaatagctgacagcatgtgaagcaataaatagcttcaagacatgcaataaactctgaggtttatttacaaaacaacacagtgagaatcatttattgccaagttactaaaggtaatagtgattactgctattaaaataccagaagctattaaatagttgcccaagcaaatagtctacattcaaacccagaattcaaattagtcttttttcatttaactttagaaaaacagaatagtttaactctgttcaattagaaaggaaaaaaaaaataaccaagaaacaacaaaaattctccaattcaaacaggtttagaaattgtaagcttttctttgggtcatacaatgggcttttggcctgaagcaaatggaagttttcactttctactatagtcataaacttttgctgataggtcatttataagaaggaatgaataaaagtaggtctctaccatttccataaagatagactaacagagaacatgcagtatcagttgattatcacttaggaaactggaaagagtgtttcttggctttaaaagagacatgatagaaatctaaaagcacagcagataatagggaataaaggtctatttgaagtgtctcttccccagaactccaaaatacacctttattatgacatataattccctagtgattgcctataaaattctattaaagataaagatcttggccaggcgtggtggctcacgcctgtagtcccagcagtttgggaggccaaggcaggtagatcacttgaggtcaggagttcaagaccatcctgcccaacatagtgaaaccccatctctaccaaaaatacaaaaaaaaaaaaaaacaaaacttagcttagcgtggtggtgggcgcctgtaatcccagctactcgggaggctgaagcaggagaatcacttgaacccaggaggtggaggttgcagtgagtcgagatcatggctactgcactccactgagtgacagagtgagactctgtctcaaaataaataaataaataaataaaataaagatcttctattctacctcattcctctggcgaccatattcctctaagtcggggttcctcagtttggtaccaatgacatttttgaactggaaaattctttgttggagaggggatttcctgtgcatttagggtgttcagtagcatctctgacctctatcccttagttgtcagtatgatctagtccccagtcatgataaacaaaaatgtctgcagatattgccagttgtctccaggtggggggtgggggcaaaattgtatctgacagagatccattgcttttatcaatctcaaaatgcattatctgtcatagagtccaattaaaacaacacatagtttttgaaattgagactatctcataaaagctgagacatatgcttcctgaagtcagagttattgtaaccaaccacttgttactcatctcaaaacacattcactgatttctacagtcctcccctgctctgaggatttggttttcaggcaggtggagacataaatactatttaatttctaatgcatcatttcccatgtctctcaaaatgttcccaatagaggtcacacatttttacatataagaaaaaaattcagagtgaaaatccacacaattttaaataataatatatttaaagctaatctaaactcacaataatcttggggatatgaaacctggggtaacagttcattacagttcaagaagtctcatggatgtttgaaacttcaaaggagagcactattgctgattagttacgtagactgaagttttcagtctcttgagaaaagtttggtatttcaaatctgaaaatgatttaagcttactggggaatgaaataaactgcaaaacctttctagcactctaaatcctgatatcacagagattacatctgatattagcatattttgtggtgcctaaagcagttttaggagctgacaattgccagggaaaaagagaatttccgggaagtttggtcctaggaactggacatgtgtaggcatttctccaaattcaaattcaaatatgtataacaataacaataggcatttgtataatagtgtacatataaaacaaatttatagttgaggggatatattttattatatttgtagtacagaggcagatactatattaccgaagatgttttgtttactccagataaacaataactaattcagcacgtttaagcattcatcttgactctcctcactttccaactctacatcattctctgaggcagcaaaacatgtacactcagtggcctcactacagcagtctctccatcttagaacagtgtgaatgtgctctgggcaatatctgtagtgtgaagaaatgtggcttgagtttgttaatttgtaccgtgtcctcatatgcacactttctcaaagggagagtcccagagtccccataacagtcttttaaataaatcttgttctttatactgtgttctgcacttctctaccggtccttctcccaacacagacacacacacacacacacacgcacatcttaatttagaaagaatagcaatcattatttgtaaagacaactgttgggacagcaacaattctctggagaaaagtctaaaacatatcttcttaaaatgtattcctttactattaattatatttgtattagtttttttcacactgctattaaagaccccaaactgtgtaatttataaagaaaaaaaggcctccacatggctatggaggcctcacaatcatggtggaaggcagaggaggagaaaggcatgtcttacacagtggcaggcaagagagagagcatgtgcaggggaatttccctttataaaaccatcagatcttgtgagatttattcactatcatgagaatggcataggaaaatctcgcccacatgattccattacctgccacctggtccctcccacaacacgtggggattattacaattcaaggtgagatttgggtggggacacaaaaccaaaccatatcaatattctgtctgctttttaaatatttttttattttttgaatttctatagtgtatttattatacttcatcacttgggtttctttttattttagaaaaccctgaatccgccatttcctagatgtcatctcaaggctacataacactaagtcctcattacagagttagtaaaaaacaagatggttatcataactgtcttcattacagaggctgcttgaaaatgaagtctacacagagctaaccaataagaagacagtagaaagcaacacaccaaggcaccatttgaaacctcagttgcagcctttcttaaaatcagatccacatgatagtcaacaattttttattgattacatagtatattccaggcactgttgtagttactagggatataatagcaaataaaacaaactctcggtgattatggacctaatataatacttggcatgacaatataacacaaaataagcacaagtgcatataggattacagcaaagaggataaagttaacagaaagcacagcatgttggaatattattattttttataaggtgggtaggtaagaccacttcactccaaggaaatgtaagcaaagtctgcaggaagggaaaaactaagtcatgagaatatctgaacaaggagcctttcaggtagtggaaatagcaagtgaacggttccagaggtaggaatcactcagtgttccaggaggtcagtaaggctagagtggaatcagtgaaaggatgagaagtaggagatgaggtcaggtagctatcagtacaacatttgtttttatcttaggtaatctgagaagccatgtcaggaatttaacaaaaatgtgaagtcattttaggtaatttttttaaaaagtattattctgttgcctgcaactgaccacaaaagggcagggcggtgggctggagcagtccagtagggaagctattgcaataatctaagtaggaggtaggtgatggtggctaggattagggtgaaagcagtgggaatggtgagaaattgtagaatcatgtaaatatctttggaccaaccaaatttattgattcattggtgacaagggggcctgtggataaagagaaaggtcagggttcacttaaagggttttggcccaagaatttggaaggataaagttgccatttactgggtagggaaaatgcagaaggaccacctgttttcattaagataatggaaagtaagtgtcaagcattgagcatgggaaatactaattttgagatgctctgataaaaaacaccatgatatgcttcacacatcctccttcaaggaatgacgggattattcccttatacattagaaatgttgcacactgaaaggcttcagctatcagtcctattcagagaatgcctcatctgaggaaagcccaaggtcaagcagctttctgaggcaacctgcgtctaatgaatattgatgcagacatataaacagcctatctccttgtcacagccttacaaccctgaaggaccatatcacatccataattttccctgtaggcagctgaaagctttacttggactgcactgaagtttaacttctccatacatacaatactgctttcttcccctcccttcaataggagttgataccccaaacactccctaataaagatcctgtaattgaatcttaatttcaaagtctgcttcccagaaaacccaacctacaaaagatgtttctttagtaaccaaagggaaatactgttgttacagattgacatggatctatagttttgagacagagagctaaactagacatttgaattagaagttatgagcatataccacttaaactcattagatctgttgaaataatctttggagtgaatggaaataggaaaagaagaggttaaagttgaaagaagggtgtttcaatttttaaaagtcagggaagttaaggggaagaagtatcaaagaaaacaaaaatagagcagcctgggagtatggaaaaagtcccaggagattggggtacactgtaggtcaactaattaaatttttaaataaagaagaaactatcaattctgtcacatcatgaggatgggttgagtaagatgagaaattaagttgtcaatggaatgggcactgaaaatgcaaaaaaaaaaaaaaaaagccatttgagtggattaatgtgactgaaatcctggttacaatggagtcaacagataatcctggaaaggagaataaccacaactttcttcaggccagtataaacaatatatttgagaagtttccacagtgaagggaagcacagaaatggataaattgctagaaggtttacgggaccaagagaaattttgttgttgttgctttgtgttcaattgcaagatataatggcagtattgcatgctgatggaaatgatcaggtagagcaatggatgcttatgatgtaagaagcacatagggaaattatgaagcaacatccttcagagtagacatacatggaatcagtagaattcaatcagatcagagtcagagtaaagagcccacaattagaaggtgtgtgttttagatttgcattgggccttgccaattacatttccagtcctaagtgctagtgaggtccaataaccagtgtcattctgcaaagtgattatggatcatgatgagacattaaatactgagttgtgtttagaaaattttaaagtgatttgacagtaattttatatatgttgaatctaacagttaaaatggctttcattttacatcttttgtatttcatttttctagtaattcatttaaatgcaccctttataacagaaactttaagaagcactgatctagcatgcaagtgaaagaaatggtttatacagaaatgaggagtgcttatttttaattactgaagtacaagtatcacaggagctttggtgttgcttcgccagctggaaacttctgcggccaatggcaccttctacctgaggattgcctgtgactgctgggcttgttccacctatgcagcctgacaagctgtgctcggtttgtgctactggcccagatcccacatctgccaagtgtgagccaaaagcagagtggcaaaggggtgtgaaggtgagtgaatgtggggtccagtcactgagcacagccaggcacactggctgctacaagagggcaggcagctccaggtgccagtataggaggaaggtccatgtaagcctgtggttggaccagatgcaggcacctgcatctggatgaggggaatatggtggcttgtggaagcttggagatgccaggaactgcagaaccccaaggagggtgtcacagccctggtttggggagcccttagatctgggttccataaagggccacagctcttctctccttcctgttgtctgcattgtggtgtcggggatggggtgcctgtttccgtcctgtttgtgttacagctcttcttttagtcctgcccaaccagcaggtcctgagtttttttcctacatctaggaagaatgaggtacatagacaaatggagggtgagcaaggcagagaggagtttcactgagtggcagaacagttctcaggagacccaaagtgtgtagctcctttcctcaggcaggtagtcccaggtccagcttgtcagtggagaggagatccacagtgggtggctcccttctgcaggaaggtcatctcattgtctgtgaagccctcgtggagaggagacccagggtgggtagctcctatctgcaggcaagttgttatgtcatttgctggagtctggctgagtctgggggttttaatgggcctcataggggaggaagtacatgctgattggtccatgggcagccaggggcaggcccaaaagcagcaccctaaattctcattctgatctgccgaactgacagctgggcccccaggctattactataaagctaccaatgtcattattcatagaactagaaaatactattccaaacttaagtggcagtgaaaaagagcccaaatagtcaaagcaatcttaagccaaagaacaaagctgaagccatcacactacctgcattcaaattatactacaagtctacagtaaccaaaacaacatgctactggtagaaaaacaaacccatatactaatggaatatattggagaacacataaataaagccacacatctgcagccatctgatcattgacaaagtacacaaaaataggcaatgaggaaaaactccctattaaatcagctggctagccatacatagaagaatgaaactggattcctagttttcatcatataaaaaaaagtaacccggctgggtgtggtggctcacgcctgtaatcccagcactttgagaggccaaggagggcggatcacgaggtcaggagatggagaccgtcctggctaacacagtgaaaccccgtctctactaaaaatacaaaaaattagccaggcgtggtggcaggtgcctgtagttccagctacttgggaggctgagtcaggagaatggcatgaacccaggaggcagaactggcagtgagtcgagattgtgccactgcactctagcctgggcaacagagtgagactctgtgtcaaaaataaataaataaataaatattaaaaaaaataaattaacccaagatacattaaatacttaaactaaaaactaaaactataattcctagaagaaaacctaggaaagttttatttttatttttttttgtcaaaatgatgaattagagactttggtgcgcctcagccacttgaaaatagcaaaataaatcataaaaatgaactctgtgaactttaagaagaaaaacgggaatccaatggaattatgaagaataccccagatcctggagaggaaaacaccagcaaacagctcccacgatggtgtccagttgataaaaagaaagaaagaacaaagaaaatatcccacctgcatgaaaaagttacagaaattaaaaatcctagtgtctccagataagaaaacatcagtgcaagaattctggcatcatgaaaatctgaatgtagtgataccaccaaaggattccactagattttaagcaatggtccctaaccaaaatggaaactcagaaatgacagataaataatataaaacatggattgcaaaaaaattcaataagatccaaaacaaacttgaaaattaacacacaaaaaaattctaaagcaattcaggaattaaagaaaaagataaacgtcttaaaaagtaatcaattacagcttctggaatcaaaaaaactcttgaaaaatgttaaaatatatcaaaagctttattaatagactggatctatcagataaaagaatttaagagcttgaagataagccttctgaagtaacccagtcagacaaaaataaagaaaaaagaattttttaaaatgtacaatgtcttcaagaaataaaggattatgtaaaacaatcaaacctattaattattggcatttctgagagagaaagagaaaaagaaaacaacctggaaattacatttgagggaaaaattcaagaaaatttccctgatcttgccagaaaggtagacatccagaaacaagaaatcaagagaacatctgtgagatactatataaaatgacttcactagggcatacagccacgtgactgtccaacatcaatacttaagaaaatttttttttttagcagtaagctcaaaatagcgaatttcattgtttttttaaattattattattatactttaagttctgggatacatgtgcagaacatgcaggtttgttacataggtatacatgtgccatggtggtttgctgcactcatccacccgcgatctacattaggtatatctcctaatgttatccctcccctagctccccactccctgacaggccctggtgtgtgatgttcccctccctgtgtccatgtgttatcattgttcaactcctacttaaaggcagatagagaaaaaggaaagatcacctacaaaggtaaccccatcaggctgaagcagacttctgatcagaagacttacaagccaggggagcctggggatctattttcagcatgcttaaagaaagcaaattccaaccaagaatttcatattccatcaaattaagcatcttaagcaaatgagaagtaaaatattttcctgacaagcacgtactaagaatatttgttaccactagaaagccttcaaagaaatcctaaagtagttctaaacatgggaaccaagaaccatatctgctaccacaaaaacatacttaagtacatagcccacagaccctataaagcaacaacaaaatagaaactacaaagttaccagctaacaacttaatgatagaatcaaaatttcacatatcaatattaacctggtacataaatggcctaaatgccacccttaaaaggcacagagtggcaagttggattaaaaacaaaacaaaaccaagatccatatggctgctgtctccaagagacccaccttatatgtaatgatacatgaagtaaagtaatgatgctcaaagtaaagagatggagtaagatctactatgcaaacagaaaaggaaaagaacagggattactattctcatatcagataaaacagagattaaactaacaacactaaaaacaaaaaagaagaaagaaagaaaggaactacataatgataaagggttcaattcaaaaagaagatttaactatctagaacataaacacaccccacattgtagagtctagattcacaaaaccagtactctagacctatacaaagacttagccacacaataacagtgagggagatcaagaccccactgacagcattaaacagattgtcaaggcagaaaactaacaaagaaattctggacttaaactcaacacttgagcaactggatccaatatgcatctacagaatactccacccatgcaccacagaatatacattcttctcaactgcacagggaatatactccaagatttaccacacgctgagtcataaagcaagtctcagcaaatgaaaaaaaaaaaagaaatcacagcacccatattcttggaccccagtggaatgaaaatagaaagcaataccaataatatttctcaaaaccccatgattacatggaaattaaacagcttgctcctgagtgacttttaagtaaacaacaatatcaagccagaaacataaaaaattatttgaaataaatcaaaacagaaacacaacataaaaaatctctgggatgttgcaaaatcagtgttaagaagaacatttatagtgataaatgcctacctcaaaaagttagaaagatctcaaattaatgatctaacattatactagaggaagtagataaacaagaacaaactaatcccaaagctagaaggaaaataagacaactctaattagagttgaaccaaatgaaattgagacccaaaattccacacaaaggataaatgaaaccatagtttcatagttggttctttgacaggataaacaagatcaatagactgttagttagattaataaagagaagaaaagaaaaattcaagtaggcacaatcagaaatgacaaaagtggtgtaatgtcacagccgatcacacagaaatacaaaactccctcatagacaactatgaacatttctatgcacacatactagaaaatctagaggaaatggaaaaattcctggaaacacacaacctctcaagattgaatcgggaagaaattgaaacactgatgaaaccaatattgagttcaaaaagtgaatcagtaataagaaacctaacaaccaaaaaacagtaataataagccccagtccagatagattaacagctgagttctaccagaggtccaaagaagagctgatagtaattctattaaaactattccaaaaaatcaaggaggggtgattcctaactgattctatgaagccagcatcacctaatatctaaaccgggcaaagacacatacacacacacacacacacacacacacacacagagacagacacacacacacacacaatgaaactactggcccatgcctctgaagaacacagacacaaaaattctcaacaaaatacttacacgtcaaattcaacaacacatcaaatatttaatttacgatgatcaggtagggttaattcctgagattcaaggttgtttcatcatatttcaacatatacaaatcagtaaatgtgatccgatcacatgaacacaatttaaactaaaaccatatgatcacctcgagagacgcggaaaaagctttcaacataattcaacatcccttcatggtaaaatccctcaagaaactaggcatcagaggtacatatctcaaaataataaaagctatctacaacaaacccatagccagcatcatattgaatgatcagaactgcaagcattcctcttggaagtggatcaagacagagagatcttgtctcaccactcctattcaggacaacactggaagtgctagccagatgttaaactttttttttcatatatttgctggaggcaagaggaagaaacaaaagcatccaaatagcaaaaaaaaaagaaaaaaaaatcagactatctgccttcactggtgatatgattttatacctagaaaaccctaaagactctctcaataagttattagaactgatcaacaattttagcaaggtactaggatacaatcaatgaacaaaaatctgtaggagttctatacaccaataactaagagccaaatcaagaacacaattcaatttacaacagccacaaaagaagtaaaatacctaggcataaatctaaccaaggaggtaaaagatctctgcaggaagaactacaaaacactgctaaaaaaaaaaaaaagggaacccttgacaaaaataagcactgtggaaaggactccctattcaataaatggagcttggatagctggtgagctatatgcagaagaatgaaactggatacctaccttttactacatacaaaaattaactcaagatggcttaaatattttaatgtaagaactaaaactataagaatcctagaagaaaacctaggaaacactattctggacatcacctttggcaaaggatttatgattaagtcctcgaaagcaattgcaacaaaaatgatcattgataagttggacctaattaaactaaagagcttctgcacagcaaaagaaaccatcgacagagtgaacagataacctacagaacaggagagaatattcccaaaatacgcatccaacaaatgtcttatattcacaatctacaagtagcttaaagaattaaacaagcaaaaacaaaaaattccatcaaaaaatgagtaaaagacattaataggcacttctcaacagaaagggatacaagtagccaagaaatatatgaaaaaaatgcttaatatcactaatcatcagagaaatgcaagtcaaaaccactatgagatacctactcacaccagtcagggtggctattatttaaaagtaaaacaacaacagatgatgggaggctgcagagaaaatagaatacttatatactcttggtgggaatgtagattagttcagccacagtggaaatcagtttggagatttctcaaagaactaaaaatagaactaccatctgacccagcaatgccacccaaaagaaaataaattgactgaaaagacacaggcacttgtatgctcacagcagtactcttcatgatagcaaggacatggaatcaacctaggtgcccatcggtggtggagcatataaagaaaatgtggcacatatacactacggaatactacatagccctaaaaaaggaaattgtgtccttcttagcaacctggatacagctggaggccatcatcctaattgaattaacacagaaatagaacaacaaatattacatattctcacttataagtgagaactaaatggtgcatacatgtagacataaacttgggaacaaaagacactggggagtactagagggggctggctgagagggagcgtagcaaggctggaaaaaccaactgttgggtgctgtgctaactaccttggtgacaggattaattgtaccccaaacatcagcatcatgtgacatacccatataataaacgtgtacatgtaccctttgaatctaaataaaaacggaaaaataaagaatggcaaaattaaaagaaaaacaaacaatacattttgctaaatgaaataagtcagacacaaaaggacacatgctatatgattccacttatataaggtagctataacagtcaaattaatagagacagaaagttacatggtgggtgccaggagctgtgggctggtgtttggggagttagtgtttactgagtacggagtttcagtttgggaggatgagaaagttctggaaacagacggtgatgatgttgcacaaaaatgtgaatgtacttaatgccaaagatggttataatggtaagtatcgtgttccatatttttattacaactacaataataaaagatatgtaggaatttgccagatgaacaagatgaaaaagggcattgccatgaaataaacataatgaatctgaaaaaaataaaagcatctttgattgcaaaagagcaaattgcaaatatccaaagtaatccttgtaatacacgtgacattataaattttacgatgcagtgcctatgattcacgcacactgtacctgaaccagctgtgaaacattcatgaatcataaactcctgtatcatcttcagagcaaaaatgcatcctattttacaagaaatattcatcaaaaaagggaaagagaagtaaaaaccctgaaatttctagaacctttcaaagatatcagaaaaacaaatcaatacctctgacaggacctgttaattcagagggtcatgctgtaagacagcttgcatttaattcaaactgttttggaacaagatcaattctgtagtgagatcaaggcagcagaaatttttcctcagggctaaaaataataattccttgaggcccagacattaaattccatggcttcttgaaactattcaaaaatgagaagaatggataaagattaaaagaaaacacatgctgcaagctgacaaaacacctttttagacttacacccaattcgttcattagtcaaatgtgtggttttttttttcccttcaggtaactggaggtgtcaacattcaacttcttggtctgtttctcgtcattttctattttctcctgctatttgtctctgagctgttatacctgttattgcagtttccaacaagaaaaagccaggaaaaggaaagagaatcaaagcatcagagcgagtcacctcactgggaggtggaaccagaagttttaaagcagtagcaaaatttgtatgttctgggtgtcagtggacactttctgtataataattttattttacttttgttaagaatcatgaagcaaccacaaaaaattaaatcaaggcttatcaagtagatgtttgaaagagaaacaatgattcaccttataggtagatgtactttgctattgaagggattgtgggcaagtctaagcaaagctgaagggaataaggaaatttcattccttagagaagacagcatagaataatagtacagagagtgtagggtagaacagcttgcattctaatcccacatctgcaacaggattctctttgacataggaaaagttacttctgctttgttgggagtattaaaaatggagaagttttcaagtgcttagtgtagttcctggcttatgatagcatcaattaaaattaggtattgatgctattattattaatattgatctcttagccatctatatcttcagcatccaaagtgtcagtttgttctttaaattgcaattgacccttttttctcaatagaatagctagtaaaataataaagtggaatttcttggaatgtatccattctcctcttttacatttcatttttttattcattatttcaaatgcccagtaccttcttgttcaccctaaaatcttttatgagtttatgagttaacaggaaaacagattccttttagaaaattggaataaaaagaattaccattttttttttttttttgagaccgaatctcgctctgtggcccaggctggtgtgcagtggcatgatctcagctcactgcaagctccgcctcccaggtgcaactgattctcctgcctttgcctcccaagtatctgggattacaagcatgcaccaacacacccaggtaatttttgtatttttagtagagacagggattcaccatattggccagatgggtctgaaactcctgacctaaggtaatccaacccctcagcctctcaaacacttttttctacatttcaaactctttgcaatttacctgctatctcatttaatctcctcttccctacactgaagacaatcaacctccctcctattaaccaaccacttatcctgcctccttatgtaccttaaatacgaaagataagatagtccccattattttaataaatatttattgaatatattcttgacaagtaatcctgcttgtatttttagctagctaatgtgagatacatctttgacatggttaaatgtatgatcccttaattaatttaatataataaactaatgctacattataggggtataaacacttttaaaaatatattttctattttaaagttggctttatacttaacataaatataatggacactttgtttatttttgaatgattatcaatcattcaaaggtcagtacatctgacctttcacaaaaaaagtaaaaggtcaaatgtaaaaattgtaggttttgtggttcacatatagactctgcatattattctttaatttttgtttttggttccatatttttgtttgtttatatgtttcttacaaaccttttaaaatacaaaaaatattctatcttacttgtctctcaaaacataggccatttaacccaggaactgtatttggtcaatctgtgcttcactgtaaatgttctttgttattttaaaagcaatacggacatatttcaagtaaattattgttttcactaccactcattttcagatgtaagtccacaggttaacataaataagaaagtagcagccaaaaacaaaaaaaagagagaacagtaagaaaaacattttaagtcaaaggaaaattgccagcttttatcttctcctaaatcccaatccttcactcctaaaggaacacattaagtgcaaagggggtcatacttttattccattgcaaaaagggtcatacttttattccattccccatgtatacatttgttatccatttggcaaattgtggttgaatttctcttgggatgacctcgccagcagtaggtgaatggatcatttgattcaacactagttcgtaagtgattgttcttttcaatcaggcacacactcactgctgataactgcatattttgactatttgtagaagtgttaaaggaactaagaattttatcgtaaataagccatgttggaacaaatatcaaggccttgagaataatatactttatacctttgctcaacatataatgtaggaaaatatccaattaagagtctagaaatggagtgaggaagggccagctgagtattttgtttaatttttaattgttaactcttatagtaccttcataaagtttccaaatcttttcctttttcttgcttttgctgtaaatacaaaagtccaagcctgcattatattatactcagtttgaataaggaatatcagctccttaagaataaaatgaaacagttttattcttcccaagatcttttcaggcttttatattgatcatcttcatttctgctgtgtagctggcttcatcaatgatgtctcaatttatgtctataattgttattttgcaaaactgtctcattttaattaatatgatgccttactcattatttttaaattattttcttcattattttaaaactaattttatttctaaggactgggaacagggtgggtggatgtgataatctcacacatgttcttgtcttttttccttttattttccctctggtgctgggatagagaggatgaagaaagaaaaatgtattcgttagatgaattatctgtattgaggttgttctaggattactgtgctagaggaaggacccccaataaattccaccattaagaggctcaatatcaagcaacaatcctgtgatctagtggcactgtatggaattctaacgtatcttttagctaatgtccaggtggtagtctgtgttacatcttgatatgcatacctctcttcttcacatgcttcagtatcctttattttatttataattagaagcacaaactctgagatttacggatccaggcaggactgatctcacctacaatactgggcaagatcttcaaggggacagttgatgctttcttgccaactgcccactccaccaccacatttctctccaatgttctctcccttgttttagttgtactgactcaaatctaagcagctatttgattagagtattgaatggtgatcttccctgttttgtgtgaatttctttgggattttcttctctcaatccttgccagactttttttgtaataacactggactagcaacaatttcaacctcacctatttataaaataatgttatctagtactatttgagacctctcttacttggattttttggagtattgtactcagaatcaggaactttttgagataaaatctgagaaatgaataacttttgctcaattgtgctttattcaggttcttatctgtattctattctataatctccaagtgaggaaaatagtcaattcatatttctctaaagtgtttcttcataagagccttaaaataaattgtatatattttaaacattagtacatttaccccaatataacatcacaaaattaacctttggaaaatacagaactaatgtaatacaaaacattcccatccctccaaaaacagataaaataaaatataatagttctctacagcctaatctaaaagaatgtgatgtaatggatagagcactgatttattaatcaaagggagaaaaactaatgtggctcataaacctttccatttctgagtctcattcttttcattttcccgataataatgataataagatcgacctgtttgttagggtcaggttaatgaccaagtgaaatgatgcgttatacatatgtcaaagaaatatagcctcttaaaagaaagttaacgcagctgacattcagtaacatatctcggtttgtaagtaaaaaattagaaataaactcaaataaacgatcaatacatattatagtaaaaagtaataatttgaattaagataacttgttgaacactgatttatcaaactctattgaactaacccattttttaaatttatacttttgtttgtttgttattagaaaaacatttccctagatagaagctgctccactattctgaagggaagtagaaacgatgaaaagcagaactggagatgatccatgatggacatatagtgtgagtaagaaatatatattatttgttttaaatcactgagattttgagtttgtgtatgtgtccataatatgagctaactatccttaatgataccataagtaaagaatttaaagtaaataagatgtgcctgaccgcatattaagtgccacactaagtgttaattatagctccctggcggtaaacaggggactggttccagacttctgagtatataaaaaatccacacatactgaagtcccacagtgggtcttatggaaccctttgtatacaaaaggttggctctccaaataggcaggatttatattatatctctcaaaaaatctgcatataaatggatctgtgcatttcaaacttgggttgtgcaagggtcaactgtgttactattttatgggatgagacggcagagatgatacatggaaattttgtgtttaaaaaaggagaaatatgcaaatggtggtggggtgggccaaatggaatgtgagttacatgaaagggtaatttggaaggaaacaacgcttttgtgaagaaaagaaatacttgaatatttgagtataaaacatagttttatttagtacccttgcctcatctttagtatgataaaaatagataaaaaattcagacagacaaagagggaggaagctgcttgagtgaacatactctgttgatgtaaatactcgaggaaattagctctatattgggtggtgtgctgatgaatgcttaacaaaaaaactttgaagtgaaaggcactgatttgttgtatttgatgatttctgtggcataaatatgcccaccatagcaatgtttagctggtaacatgacatagctgcacagagtcaggaagagatgcacatgactggctctcacgatttcggcgcggtctggctccagcatttgactgtgacaagtttcactggccggtgagaacgctggaggaaaaaaatctacctataactgacccttattagcataacaggtttgagaaagcagagccctattttcctcaagtgaatgccatcaatacagccgtcaggcaaaactgcattcatgcactgaggaaaatcactgcttctcaaacaacttttggataccataaaaggcccgttcttaaaaggggaagtgggaggaggggaaacaagaattgttgcctgaaaagaaacgactttgatctccatcaaaacagattagtttgaagccaatttgctgctatcttcaaaactatatttcccctcaaattctgtcttccaaattgagcagtgcgtcagctgtaggtagtgctagagtgtgaaaaggatgaggatggaggcagccagggtacctccaatgcatcttgttattagaagacttttgaagagtaatttgacgggagcttttcaacttttaggtcactagtttaaatgtagtctcagttgatcatgaacaaaagtgggtggttagtggcctatgaaaagtaccttcatggtattacccttgttctttctaatagagactgccactacagttggcatcctttcttttccttctaccagaagcacaaagggtgaatagaaatgtcatttcaagtattttttcagcctttgtaccagagaaatttgaaatatgaaaaaggccaacttcttttcatctttaactcacaggtagaattattgaactataatatgtttcctagatcttcctggattttattaaaatgaaacctgagccactttacaagtaaaattatgtcttacttcatagaaagttaaattacataaaggcacatacttgacaaatatttaaatataaaatgtataatttcttgacctgaatcttacacatgtaaaatttattttgttttccttttctttctcttatttttttcttgcttcaataaatgagttcccatgaatgtaaagacaaagatcttattactccattaaatgaactatcttaatatttgattttttctattctttatcattacaatactttgacttttttttcctcctaaagagactgtaggttttattccctttcttttaattatttcatgaaaatcctccaaatttccatattactaatatctctaccttcatataattttgtttcaatattaaatgatcaattaaagcaaactttctctaagtacctggagaaaagcaacagaataaatattagagtagagacacaaagtagtacttggtaatgccaagaaaatttcagcagctatcagtaatcagtaggatataacagaaatagccctgttttagaagtgatgaaaactcaatcaactgattttaagcagcagttactttctatggggttagctttccacatctcaaaaataagattgatgtgttatttttgcatcattttcaatacaaacattctatgaaatcttcacttttatatcatccgaatttaagtgacagggtgttaatattcgaatgggatttaagcgagatgtagctgtgccttatgtcacgtcagctgatggtaaagattgatgctgggattttcctgggttagtcatgttaaaatctcccctaggctttaaggccagcttcatgaattctcatatcagcaacttctgcaattaccacataacaccagaagataaactctgttctctgaacattcatatagaaaatagtacgtcatcttatgattcttatgattggcatagcaaagtgaaaatatatcaacaccgtatttagcccaacttgaagctgcatattcagtcaaagatagagcttttcctggccaaagatactttggtcagaaatatataaacagtgaacaccaagctatcatcttgcaagtaacacatatgctcatgaatctctagctacaaataaaaatatcagctaaaactacccccttcttctaaaggaataaaaaccacagcaattacaagatttgcctatggccataaaatgaagtggggtttgtctcagaattagaatgcctaccatcagcctttgagtacaaagttaattcccctacacaagactgcatcaaaaataaatccagctggacaaaaggcatacaagacagaaaataatagtcagctgcagactctttggatccaaagtataaaatattcaagtatgtgtttccaatcccttcattctctcctgtaatgattgcagctaatccctgcctgccaaacgttagttcttcaattgtggcgatcaatagaatagattagctgtggaaaccctccatccatattacccttgctttcctttccagatggaattttcattcactagagtggaggcaagcatgtgaggtttctccctccatacacaaatataaactcattaaatgccaagcttgtcactttagaatttatacacacacacacacacacacaccaaggaacatacctgtagatttaataaaacagcaccaaccctcatggcttcactaatttcaaggctatacatcagctgtgggaagcgaggagggctttgattatttggtggaagcacttcaatatacacagtgcagatggagttcctgcagagaaagagaggaaaagaagatggttacgaatctgcatcacatttaatgttagactgcattgtttattcagttgttgggtttacaggagaaaaaatttccaaattttatgaaaaataatacaatcaaaatgaaaggatagaaaaaactaccaccaaagtataatggttttatgaaattatcttagtaaaagtaattgactccagtatctgtttttcctacttagattaatagtatgaattaaaatggaatagctatacaaataaagctaataaattaacttgccttgacttctgactttgtttttaatgcttctctaatagcaaaatcattctataaacatctggtaataaaagctgtccttggggcttttttgctgttaaaccagcagagggagtattgattacaataactcacaaaacaaattatgggctgcgttttatcagttctgttgctgacatcaatggcttaatgtaagtgcatgtgaggagtcaggatcataaagaatcctacgtaaaatagttgcaaacaaaactaaatacgttttaaaatcttctctaaaaagcaatatatgataagctaggaattagatttaataaagcccttataatgacaggagcttttcttgaaggacaagataccttatcattacaaggaaaaaaaattagcattgacatagtcaacttctttgatatctctgaactttgaatttgttttataaaacaaaaactgaagaagcatgttagtcaaggtttgtaaggtggaaacattagctgaaatatatcaatgagatctgaaaatacataaggttagccctctatcgtgaaaaaacatatatatgtatacatacacacacacacacacacatatatacacatatatacacacacatatacacacacacatacatataacattttgtacaaacataccaccactgcctaagatgtatgctttgaatttaacaaagtcatgatttagttcaaaacacatttgttataatttctatttggggatgagaatctttatttatttatttatttatttatttgagacggagagttgctctccagcccaggctggagtgcagtggcatgatctttgctcattgcaacccccacctcccgggttcaagtgattctcctgcctcagcctcccaagtagctgggattacaggcctgtgtcaaaatatctggctaatttttgtattttcagtggagatgggttgtgccatgttggccaggctggtctcgaactcctgacctcaggtgatccaccctcctcaacctcccaaagtgctgggataacaggtatgagcaccacacctggcctagaatctccttaaagtagtcccaaactctttataagatgcttcaattaaaagacatggtcaccaaaaatatttgtctgagtttattaactacaacattctacttttcaaaaccttttgaaagaaattcaggctgggcacggtggctcacacctgtaatcccagcactttgggaggccgaggcaggtggatcatgcggtcaggagatcgagaccatcctggctaacatggtgaaagccggtctctactaaaaatacaaaaaattagcttggcgtggttgcgggcgcctggggtcccagctacttgggaggctgaggcaggagaatggtgtgaacccaggaggccgagcttgcagtgagccaagattgcgccactgcactccagcctgggcaacagagcaagactccgtctcaaaaaaagaaaaaaaaaaaaaagaaattcagatcataggcactaaaatttcgttttatagcttgtcactttataatatacctaaattcaagttgtttctgagcatatcatcagtagatagataccaatagaatagtaagcataaaagctacagtgacttttaaaaatttcatggttgggtgcggtggctcatgcctgtaatcttagcacttttggaggccaaggtgagcgatcacaaggtcaggagttcaagaccagcatgaccaacatggagaaaccccatctcgactaaaaaacacaaaaattagccaggcatggtggcctgtaatcccagctactcaggagtctgaggcagaagggagaattgcttgaacccgggagacggaggttgtagtgacccgagatcgtgccattgcactccagcctgggtgacagggcgagactctgtctcaaaaaaaaaaaaaaatttcatgcttacatttatcatgatattgttctaaagtaatctcactttaaattaaaatattttaaactttcatagttaaaatatctgtattcatttctgcctctgattttatctatttagtatcaaaatttgccaatacagttaatcagattatatttcttaaatgggttcaaactgatgatgaaatgttgcttatatacttataattattaatgtaaacatgaaacaatgggaagttacaaaatgtattgtatactgcaaagattcccacttccgtgttgtgagaacaaaagaatcgtcattctgaggtagacctaacatccttccaggtggtgatctgactccagaagcagccccaagatgtaaaacattttccctgatattacccttgaagatcttggcttcttttagggtctgttgttgatcaagtttttaaaacattttatgaatctccttcttttctctgatagcacattctctatgcataacaagtcctacaacgttattggtaataaaagtaggtgagtgatgttgaacacagaatttgtaaccagatattcctgagttagaattttgacgctgccctcaatgatctagagcaaattatttctttcagcttcattatttccacataataagtgggaataataataacatctaaggtcagcataaagatgaaataagtttatatatttgtatatgtaagtacatgtatacatatatatgaaacatacttttataacttattttaataaattactcaaaataaggcttaaggtttcttattccactctatgaatagtgcaaacgatcttgcattttccttagctacatcctttataatactgtagatattttaattgaatcctttcacttggctaaattcctacaaaggcttgatactccttcacccctcctgagcatggggtatgttggtgttagaatttgagcatgttgtatcataatctttagggtaggatacaagaatctacaattttcacaaatttccaaagttctacttatagaaactagactttgaagaccactgcttcagaatctcatgaaaagtacaatatgtagactcacctgttttttttaaattacctcaggagaaaaactctacaaagtcacttaacgtcttcaataaccctggatccaagagacttcctcactgtttaacatttttttttttttgacctggaacatatctgtactgcagattcgaagctttctttcaaaagctaggccctttctgcttcgatattctttagatcttcagtttactggtcaagaatactttataaaggttttacaagaatatcagtgtcttaaagcttgtgaaagtatagttaaactacacttattatactttttgtatttctttattcctttccctttcattatcttcccattgtagagggttaaagtgagacaatgctacaataaggaccttaaactcgtatgagttacttggatacttgtcacagagtcgaaaactttaaaatgctgaaacaaagaggactctagtctcagacaaaacacagagacaaattttagcccaacatgaccgtctccttgatccgtccttactcctttgcttcctctgttcctttccacaataattcaaaagctagaattgctaattgtgttcccccacccccttggtcttgaatgttagttatttggaggagatcatatattaaggtcttgtatttttcatcttcaacatcctggcatgtccctataatgtgtttaaataaccaccaggcttcttgagggttactgccttttaaaatgctatctcctttttatccctgatgtcagcacagtgtcagagttagcttttctaaaattaaatacccatagtattaacaataaaataatagtatttatgctgtaataaatagtagtatttcaacagcatcatttaagcacttaataaaatagggcagtcactatataaataacactttacgcaagcattttgtattcatattttatcgctaaatgcataaaactgagcatctatataagaaaaattttatttttgtaatatagccagtatgatgcagataaatctccatttctaaaaacgaatctcataaagctttattatatttcacctggtaataaaggtcaaagtagcacaaaagaggtaatatatttcttatatactcttgaaacctacccaatagttccataaatataaatacatatatacttttttttgataaacatagaaattgacccttctggtcttaaagcttgaaacttaacatttgttttatctgagctccttcctcaggaaacaaccttcaggcctcccaaaaaaggtatcaaagaactgaaactcaccagatcaccacatccgatgagatgccagacccgtcattcattatgattgcttcctagcccctccctagttcctgttttcttacatattgttacatttcttccctgctatgtaaacactaactgtagtcagtcagtgagttggatttgagattgtcaccaatttccttagctgcagcaccagattaaaatcttcttctttgacaattgttgttcagtgattggctttttgtatgaccagctgcagaatctaaactgaacccctggtgttcctgtgacagattttcgttacctgaccaagaacacattgcttgtgtcttggctgccttgagccaagagtcttagaaggcctcctaagcagttgctcacccaattttcactggaggtgttttggtttttttctggccccacagcagctacccccaactacattcctgattgtctagtcagaacagcatttgaaatttgacatctgcacccggataggtgagtgtcaggttctttgtgggcctggacagcatgatcccctcctctcagtttgagaattttttaaagaaatttttatttgtcagttgaacaagcccaaatgactgaaagtgggaagcatcctgtgttagtatggacactttttgggggtttcagtatgaacactcttgggggcttgtttgtaattgtgaggtgtgtgtgtgtgtgagcaagtgtgtatcttttgtgggactagacagtgggattggctcctctcaatttgagaaattcctaaggaatttttctttgtgggttggtcaagcccaaccagtagaaagaagaagcaccccgactgtttcagtttggatgctcttagggctcgtttattgtttcagcagtaggattgtgttggcgattgtgtgtgtttgatatagtcatagcaaagtagaattcagtaagctaatattttctgaaacactgtttggctccaatattctttggaatctggagtttgctattgaatgggaaagcatgacagagttccatgtatccagacttttgtgctactgctctaaccatggtcaggcctggtcagtatgtgatgttctcttgtgatgctgtttggttccagtgttctttggagtctggggaggtttagcctttaaaaagcaaattgccatgaaaactattctacccaaaattttgattcacagccttcaatggattacctactgaggtcaagaaagtgtggctatgtaaaccagtgagtttctattgctatatcatggctataattttgaggtaaaatagattggatctttatgtgtgtttatatgcgtcttaatggtttatgtatgttcatgtattacgtttttttttgtctaccaaattggtttataaataaaagaatacacataagtaagcccaaagtatttttcaagttcaaatgagttaagtcaaccacaataagcaagctggctttaacatttttgataaaataaaaataaaaatgcctttagaattgtcagcatacatttttgctgagttttatatatgtctctgctagatatgattgaggtgtcatggtttggcatagaaggttatagaactataaacccagctaacataaaatgatcttggtttgtgtaccttctttgacaaatgagactaatgtaatgttgttagttgattcttgtgagttaatggcaaaaatacccatatctttaattttaagatttagttgaggacctgacattcatcagctattaaaaaaaaaagtaatgaacaaggaaaaagctaactttaaatgatggtgtctaatatttcagttttcagaagaaatctggataaactattaaaatgaaataatcaagtacttgtaaattgaataaatgttgtaggtacactttttgtgtaatataaaatttttaaattgtttttggtgctcattgggtgtctgggtcatttccaattaagaaaaagttatggggaaacatatttctaaaaattgtggaatggttctcatctgtaaaatgctaatatctgatagtcagctcagaatttcttgcttctcagatgttcactaaagttttgttcactaaaatttaaggctactaagaattctaaagaagatgtgtttttattgagaaaacgaatctgtttgtctagttcagaagttatctaaaggctaattaaaattatgggcttgaaatggttagttatgaaacaaggcagaagaaaaccaataagtagaagaaagagatgtgtaaaaagttatagatacgaaaatatattttaggaaggtgataatgaaaaaaataacaatttttataagaaaagattttgtatggtgaatgtttgtccaaaattaaaataactggttattaaaaaaagaacagaaagaaaatctaagacaaaacaaaagtccaagcatgtcatggatggtctgtgtaagtcatatgccatttttcctgtttctctgtgtgtctatcttcatgcctgtacaaagaaaatacaaagttgaaaaagcttagataataaaatatcctttaaaacttgataaaataggaatgctttggctaattagcattgttcatagttaaagctcatatcttaatgaatgtaaaatataaattattgtaaagaaatacattagcagtttggcaattttttaaatatagttaagcccaaagctggatgtaacatggagccaaatttcatagtatatttgctattctgcatcacatacctaaagtgaatttcttagttacagaaaatgtatagtggtactgctggacttaaagacagtaaatatcaaaaaactgaatcaggaataaaatatccatcaggttaattttttttggctctgggtaacactgtaaagccaaagttaattgagtagaagataaattgagggttggactactgtttatttctgcttttttttttttcttgagacagggtcttgctctgttgccaggatggagtgcagtggagtgatctcagctcactgcaacccctgcctcccgggttcaagtgattccccttcctcagcctcagtcctcagctgggactacaggtgctgccacctcacctggctaattttttgtattttagtagagatggggcttcaccatgttggtcatgatggtctcaatctcctgacctcgtgatccactctccgttgtcaccaggctggagtacagtggcacaatcttggctcactgcaacctccacctcccaggttcaagcaattcccctgcctcagcctcagtcctcagctgggactacaggcatgtgccacaacacctggctaattttttgtattttagtagagattgagtttcaccatgttggccatgatagtctcaatctcctgaactcgtgatcccctctcctctgcctccccaactgttgggattacaggcatgagccaccatgcctgacctatttttgcttctaattttcatttatttgctatttgttctacttaaatatacaaatatatacacatacacatatttatatgtatacatatacacataggtatacatatatgtatatatatttgtatacatatatataatatataaaactattgatgctttttagtttctaatggaaagcttttatttggttctatgaatagtcattttgttttctatgtatttccaacaattcaccatttgttctgtttattgaaagttcctaaactacctttgtcaagcttcaaaacattgatgaaggacagcagccatttaaatttgattggtttttcttacctctgagtatattgatagctatgataattttaaggttcttggcaaaaatcttataaaagacttatttttatgagttctaaacacaaatagtacattatatattttgtaatttggaaaagtagatgagaatagaagtgtttaaatgatgtttatttccaatgtaattcaattcaatcaataatttcagttggttcagatcctttcctttagtgaagaaaaactgtgatatgggttaaaagttttaatgttcaggaaagactgggctgtttttttaagaaaaattttattgattgggatttctctgaaactactttcattgtgtttaccactattaacattaagtgacactcaattgaattaggtagtaattgctttaaaaattgtgacactttgttgtaatttttgatccaaatccatttatctctgatgggcattcatgtggtacttgaaaacaaaatatgcacaagtgttgcactggtttgaagagtttggtgtgaaagttacttaatcagttgtaagtactgtatctagaagtaaatcttagaaatgtgtgatgatgctcttttaagtagctgaagagagattattatgtggttttcactttgtccttgctttgttgtatagtatttaagtgaaatgagattgcttatccttattctgaatttccaaagctgatatttgcatttgccatttttcaataatggaaaaaaaaacaacattagttgtcttgctttcaaaagtttgtcaaaggacctatcaaaactttgatgcttttggtcacagttctgtcactaaaatgctagcaattagacatatggaatgagtaacctaactactttaacaccgtggtcagaagtgctataagtagtatctgctaagctccaagccactgtgttttaatttgtgacattttagaataataggctttctgtagtataaatatcctattaactaatccttgtgctgttaagttacaggtctttgaatcctcagtctgaagaaagcactgacttctgttaaattttgagcattgataccagtcaaagcctcatcttcagacacaggagaaggtgacaatcaaaatgaactgctttcatgagacacagggccagaaattaaaactattcaatccctctagacccaggaactattgtggaaactgtaggtgtgtgagatggtgagggacaattttgagggacaaactcagttcagagtttctgtaaattaaacgttaatgtcaaaagcacaatgatgcaaggtcagtgtctgggcctatgtgtcagaataacagggttttcttggtgcattgatctgctctttaatagataatcgtaaaaggctataagaactttgtcaaactgattaaaattagatagatttgtttataaggttttattaaaattagatttaacattaataatataccatacaaagatacaattttgttttctcttttgaacaaaaatttcatgtaagaggaaactgcagggaaaaaaaggagaggggagagacagaataagttggcctcatgctatcttaagtattaggtcttattgcttaagaaacagagtctcctctctatcaaaaggtaaatgtttttgttttattattttggctaaataaatgaatattttatagtgacctgtgatcctattttgtgatatcgagtgtcttaaacctttgatactcgacagaatttccaacagcaaaatttcaagttctaaattcagtctttgtgaactcaaaccaacctttttggatattagttgccctgaagttcaagagagacatgtaaggcttattaggcttagttgttatgttagaattatgcaggagatattgtcaaatctgaggtggtgctaagtttcctttgggtgatatttatatggatgggttgttaaaatgtgtttgaggattatatgagattcctgtaattctgatatgtcttaatataagttgtcagtaataattatgattattatgttacattgttgtatgccacagaaataaccaaatttctttatctactgtgcctttaactatgactctcttaagacttttgtcatctacaattattgttttgctttgatccttctcaaaaagtgacttataatcagctacagtctagggattgcttctttggtgttcgtgaaaagaacttttcaatgcaggttactgataactttggagattgtgccattaggttagagaggaaaattccagggcactaattgaaaggctgatgtgttcataaagattgttaacccaacatgaagcagagcaataattgattgcatggactaaactaatgaaggactgaaataatttttgtggcttttatctttggaatattgctgatttttttgttttgtttttcagagtctggataattttttagatctacttataagctttaagttatgctttaagtatattaagtagagtatacttttgtaaacagaacttgaggcatattttttctctgcctattttctccggaattatattcttaattcatgtgtgttagtttgcatacatttaatgacaacttgttttcttgtataatgggacacaattggaggaagtggttattttcttagggctttgaactgaaatgggcttgggaaaggttccagaaaagccagtgtaggtcctatataaacaatgaaccttgttgcactttgggtggttaatcaggctaagtatatgggcctgaagcttcttttgcaagtagatttgtcctgctatgacttgcctttgttggaagttggggggctgaagagaaaatgctgtgtttcagaagaaaatgatactattagattagcctttgatttctgggtggccgtgaaatcacctgtagtatgacgctgcccacgatgcccctcctcagtattaagcagccagaaagactgacaaccagtttccccatgattgaaaattgataaatagaaaggggggactgaaaccgaccaaacagtcccatagatcactttttcgataaacatagaaattgacccttctggtcttaaagcttgaaacttttgtgaattgttttctgttttatgtgagttccttcctcagaaaaccacttgcagcctctcaaaaaagtattaaagaaatgaaacgcaccagatcaccatattcagataatgagatgctagacccctcattcatcatgattgctttcttgcccctccctagttcttgtttttttacacattgttacatttttttccctgctatatattcccataattttagttggtcgggaggatggacttgagactgatctcccatcgcctcagcggcagcacccaattaaagccttcttccttgcctataattgctgtgtcagtgattggctttctgcatggttagcagcaggacctagaccgaaaccttggtgttttcgtaataatcttataattgaaaaagatccttaaaacaatgtaatttaagtctcattttacaaaagaggattttaaaaatggaaaagatttgctgactgaatcaagattataacattaattagcaacagcagataaactaaaatacaaggcttctgaattcaaaatctgctttccatttctccctacgtcctacaagaacaaatatgtaaaataaactggagaatttttacttatctatgtgtgaatataaaacatttttggtttgtaataaaggatgttaccttacaggaagccataaattatttcaagtctgaggttcagactatgaagtcacaattttaaattattaatactgtgaatcaaacttcatctataacacttattgtaagaataacataaaatatgaataaagaagagggttggaaaatagacttaagatactttaagtttgggaatgatataattataaaaagacaactttttcatatgacaatagtaattagtagtaatgagataatgttgctagcttatagaggattgtattatcttattattattttctattatatatgtcaatatgtgctacaaggagtctatttgtaattctgcatttctagcttatttctaagatgaaggttacagatatttatattgctttttctggtagatttcagacagattaattactgtttttgttttcctttgtcttctaccaatattgtgctagaaaagctatgtttacagtttgatgttcacagattgtattctattatttttgaaatacatatagaaatctacaagagcaaaaacttcacattgaaaaccaatataggaggacagagaaaacttttctggagaagttacagggcagagttttaagatagaagatgtatttatatataaataccacagaacattaatagacagaggaaaactcacatgtcaatttacagaagattaaagaaaagaaatgtatgttttgtggaactaaagagaagggtgtaagtaaagcagtagtaagagttaaggtacagaggtgggactcatgggctatatctgttgatataaacttcatcttgacaatgaggctcagctggtaaagtttaagcagattagtgattataaccaaaagtgccaagtcattcacagttctttaacacactactttgttttgtttcttttgatcttcttgtttcctctgctgggatattccattatcattcttgcccaggtaaaactgcacttgtatttatctactgctatctgtctagatttacctgtgcctgcatctgaatcccatgtgggcagagatctcattttacttgttttatatttctagtacctccccaagagactaatatttgtgggaacttagacaatttttataaaaataaatgaataaataaatagcctcatcattttttactaatgataaacttagcatgtacatttgtcactagtaaaatgatcttttaaagagaaaattgtattttaaaaagaatgtataatcacaatgggaaaataattgtatttcaaagtaaattatttcatctcatattaattaaacatagccttgcattttatgaaaagaatgggaatttaaaacgtatgttagcccatgcatcagtcatttttatcgtaattttattagaagctatttggggagagagagtgtctcttattatctaattatcaaacagtagtgctttattcatgttaggatgaagtaaatatttacttaatttaattggataacgtaagtataagttaaccaatatacacgactaaagaatatcccaaaataacttaagtgttttttaaaagcttttggtttttatttcttctgtatgcttatcaaagtctcaaaaaaaagtaaaacaaaacactaaactatgtactattccttctctcactctctgaatctttagctggtttactaaattagaataacacagacatacgtatttcattcatattggacttattttcagtcaatattactacatttatggatgaaagctgtcaattttaaaataataatatagaaaactgtctaaattctgaagcctgctgtcattttttgatgttattatttagttagcttacatgccatggttgctggctgggtcgatctgtaaaaaaaatcactatatatatagtgtgtgtatacatatatatatagtgtatatatatagtgtatatatatataatgtatatatatagtgtatatatatataatgtatatatatagtgtatatatatataatgtatatatatagtgtatatataatgtgtatatatacaaatatataatatatatatttgttcataatctttaaatataatcttccttataaaagaagtctgaaagcaaagcctcataacttttcagttcattcatcaattcaatttgaaggattaactcctctccagaaaatagcaaatatgattatcctacagtgaacatgacattatctcagcaggtagaatggaagtatatggattttattctctgcaggtcccacttgatatttcaccaaacattctaaggtgagtttttagtatccaagacattatttaatgaaaataaatgtgaagctaggtcaactaaatttctgatgtcacagaaaagacgtgtatactcagaatctgaagatggcactttgttttctggcgtggaatacaattttacttaagtaaaaaacatttattgtattgataattatagacaatatattatccaggaaaatcaatgatatgtcttacaaatagaaactgagcaaaaagaggaatataagatctcattcattaaataatcaataaagtgatttaaaacacttcaaatgtaatatattggccacatatagatcagaccagatttatttagcacaacacaatcttcaatgaaaaatatgtatatataataccaacttgtggttggttttattttaatattcaagactaataaattaaaagtcttgaatattaaaagactttaataaaatcaaaataaaaaaacaaaaggtgactttgttcttataaatagcattattatcattgctactaaacaattatagttttcctccacaacagtaactacaaagattatagatatgaaacagtggaggaaaaagctttaaatctaacaactctgagttcaagttatggtcctactacttgtttactaggggagtggaagtgggaaaggggactgctgagccaagtcaattatcctatttcagcctcagatttctggtgtgcaaaactaaattatgcaaaagtcatgatgctattgttaatattagaaattatatatataaaggagctagcaaggtatctggtcctagtgtatgctcaataagtattatcaatcatctttaattcctcttcagaataacctagcacagatgaagctattatttaaaacgcactcaaaccttacttggctcttattgtagattctgtaactactcaatgtataaaagtattctatatatttcttctaagaaggagcccttagctgtttatcaggttcaggcatacagagtcctccctcagcatccatgtgggattggttccagagcccataaggatactaaaatctgcagataatcaaggccctgatagaaaatgagacagtatttgtatataatctatgcatattgtctcatacactttaaatcatctcgagattacttgtaatacatataaaatattaatgctaatagttgttatactgtagtttagagaataatgacaaaaaaagtctgcgcatgttcagtacagatgtaatgttctccccaaatattttcaattgttgcacttagttgaatctactgatgtggaagccgtggatatggagggccaagtgtatatttgctttttggatatattaagtttggccacatccaactaaatgtgtccaaaattaaattgatgtcctcacccaagccatgtgcacccctattgacatcaacatgacgtcaccttaagcaaaaccctgggaaatattttatcttatttttgacaaatctatttctctattcttcctaacatacccagttcaaaacattagcagtatttcctgtagactcttgtgcctctgctcccctaaaatctgcctcccacagagacaatcagatggattttacaaaaacatgttttctcacttgactttctaatttaaaagtctttccaagaattcctcctattgactagataagtctaagtttcttataaaagaaaattaaattttctgtggcatggccttttaattttccagccccaccttgaatcagtttatgccccagtaacactgactaataattatctataaacaagaagctatttcagacctttgaggctgtgcaaatagggtcacatacttctttttcatttggtcaacctcatcctcttattgtgggatgacttcttggtactccttcattatcgtaagttccccatcaataaccccagaaagcccagaatttaccttaatctcaaaattgctatgctaaactcaatttaatttatattctttatatactttactgtattttgggggctttcaaatgatggtactgtagttatctttgttttccagaatgtagtaaatggtagtatgtaataaatggtttgttgggctgaaaggaaacttttcctatcacagacacctgaaggaaatgaggccattgagaaatctgagaaaagatccatccaggctgagagaagatgaaaatcaagctcaaaagcatataggtagctatgatcctcagagatagagaggagactggtgccacaactggaatggactaagaaaagcagagttgagtaggagatgaaatgtataaactgttgacatgagggagtgtcctacctgtagtgatagctgacaaatttcactgagcccttttgaatttattttaatgatttgccttttactcagagtgaggtgtgaaagcactggaaagcttgagtaatggattgagatgttttccatgttaccaggatcacccaggctattgtgttgagaagagattgaagagagcacaggaagacttgtaattggaagaagttttcaacactctagactagagattgcagtggcttggactggaatgctaataaccaaagtggcagcagttgttgctttctgaatacatttttagagtagaacacagaggagttgctccaggttatgtgtggagttggggaggaagaggggcattgaggatgactctaagggtgtttggtcagagtgactgcaagatgggagacgccttaaacctcttattggatataaagtcaccaataagtttgacaggagtactgttgaaatgaatgtcaggcatgtaggaagtaaactcttccaagtgtgacttccagtatgtagatgacaataggatatgaggttagaaagaagaaaatttattgggaagagacctatcatctgtcgatgacagcaaggaggggtaatgggcgttataattattttttgacacgagattcaaaggaaaacaaactattgaggaggaggaaatctagtttaaaaatgtaaatgagaatctaatactccaccaaccgtatctctgtgattaatgatgatcacacaccctgcaaagtttagttacagtccatcaagtttcctacacctggtgtagtattgagttatctgacaagtttgatctcgtaagattcttgagacttccttttttttttgaactaatattagtaaactgtatcttttagaagaatcatccatttctgttttcaaattttgcatacatttaagcaaagttgtctctgaatcctactttttttctatttatatgtagtttcttcattagattttattgtatacagttttacttgttctttttttcttgattaggttagatagtattttatccaattaattatgtctttatttttgttgtttctttccagagaaccaaattcagtctcatttatttgttttatatatgtttataatacattcatgtctgatattatagttattaattattttgggggatttcttgtgtttttatttgtttcttttatgaagtattatgacaactatacataatcttgataggatttctcaaaaagaaaagtacagactaattttattaaataaaataacagcaagcatataatatcagcttatttcaagagaaaaaaattatgtcctaatagaatctacaccatggatgcaaaatagatccatctaagccatggatgcaaaataggagctatagtaagatcagtcattatatcatcaactcaagaagaaaagtcattactgtcctcatatatggtagctatttatttgatctgagaaaagcaccattactattttaaaaagtcaataaaatagaaatagatgagtatttttttaacatattaatagtttttaaaaccatagaccaatctaatggggaaacactgaggcagtctcattcaagtcacaaacgagacaagcatttttattggaagtataataggaaatgaaagtaaagaaagaaaatggaggccaggcgtcgtggctgatgccagtaatcccagcactttgggaggctgaagtgggaggatcagtagaggccaagagcttgagacgagcctgggcaacatagcaaaattctgattctacaaatttgtttttaattagctaggattggtggcctgaacctgtagtccccactactagtgaggctgaggtgggcagattgcatgagcccagagtttgaggcttccattagccgggattgtgccgctacactctagactgggagacagagttagacctgggctagggggaaaaaatgtaaaagaaaaaaagcctatttacaataaaaacaaaagatgtagaaatagatcaagtaagaaatgtacagaacttacataaaaagaaaaacaaaaagcctgctaaaaaacacaaaaaaatgcatggacaaatgcaaatgcaaaatgttcttggatagaaagattcaacatcaaacatatataatatattcctaagtaattaatatataaatctcttgtgttcctaataaaaacacagttaacaacaaaaacactgaactagcttatttaaagtcaaagagaaaacttaacagaaggagagggaacattttggagggaaaacagcattgaggtaagttagtagcaccagaggatagagcatactatgtaagcttaatcattaaaattgtgtggtaataggttataaaatataaataatagaattgaatagaacatttagatcaaaatcaaaacacataagaaaatatatgatataataaatgcaacatctcaaatttgttcatcattggatgaatatcacaatgtattgtgtggggaccacagagtatttgactggaaagaactatggctgcattaatacctcctactgtgtactaagatacatctcaaatacaataaagatttaaatatacaatatgaatccacataaacactagtagaaaacgtagaataactgtaatctgggcttaacataccaatataaaaaactgatatacttgcacatattcaaactgatgcatgttgagtgttaaatatttctccattgtcaataaaagaggataaatcgaaaagtttatcaataatagacttcttctacagttttatacttattaaggaatatgtttatcaataatagacttcttccatagttttatacttattaaggaatattacataactgtgaaaaaaataatctgaaggatttatctagtatctacatggagaggactccaggatacattcattgtgaatggaaaaaaaccccagcaaagtgaaggaatatattaatatttattcatattttcttggaatgatactgaaaatctggaaataaacaataaattaacaaaagggatttctcaggtgggagactagaaagatgcaattgtaatagcaggaaatcttttagcttgctgtgtgtgtgtgtgtgtgtgtctgtgtgcgagtctgtgtgtgtatacacatatttaaatacatgtattattttacataactattttaattacctatacactcagaagtgactttgaaaccctgagacattacatgccactgacacatctgttaatttctttgaagaaaagagcctttctctgtctgcagccttacttttccataataaatttgaaatatgcctctgatattgtcctcttcccaaaatttaaccaaatcagaatatgcatgcagttcctgagaatctggtctctctgattttctgatctaatttagatgtttataggataaaagaatacttgccgcgcttcttaaatttaattacagggttaaacgggcccgatgaaaagactgcattggttctaatataaattaccttcgctctgcaggaggagcattatccgctgcttggaccgtgagtgcgtaagtccgcccgactatcatttccacccctggagcgatggtgataagccctgttgttttattgatgatgaagtctccctgagccccaacaaggatttcatatgtgatctccccatttgacccttcgtctgcgtcgactgcagtgagctggaattgaaaatcacaacataaatcctcttgggtctcaacttttcaccaccatgtcgttttttcccccaacaaaagaagcttgctttcaaagaaaaaaacacaggaaagtttccttgacatatatactgttttttgttttttgtttttttaactgaggctactgtgtcctgttacaatactaaagcaatcacaaaaataagagtgattttgttttttgtgagagtgattaagaaataaactttggatcttgaaggcttatctttattttaatttaataaagggaaaaagaggaaagccctaacagaaaatctaatatccctataggaaatttatttttcctgtcttgccttgcattcttgacacataaactcatattaaaacagactgaacctggaaaaaatgaaataggcatagtcggcctttgttactcccaaccttccttttactctcatttttccttccataatgttctcctccctgtctcccagacactctcatctttgtgtcctttttgtttacaattgctctaggaaaggttattaacttgcacaccctgatttataaaggactgataagtcgtagagtattaatgtgtcaacaatcaaacaaatgcatctcccattgtagaatatcaagggtaacatagcccaagaaatgtttctttggggaaagaaaatctattcggagcccttgaaattaagcatgtaaacatctgtatagccaatttacatatatctataatcattttgaaggaactggtatctaaaagactttatttgggatattatatgaaaagataacaatgattaacttcatcaagcaacattaaagcaacagtgatttattatattaaaagtggctccttgacttgctgataaatataaattaaaggggaaaaagaatataaagggattctagcagaaatcttatagtaagcattttacatacatcaatagtattttctgtattcatcatacaaaaagtgaagaatgaaagaaagtggtctcaatttacacatgagggaatataattaaaagttttctgtggaataaagaaaacacatgtaattgtagtaaattaacctacctgtagaaatgttttatttacttatatttatattttcaatacattacttctaaaaatagtagtttttatagtttgcagactcctttgaaaatacagtaaagatgctggtataccttccttgatcaaatgtaaacatacacatttaccttgaaacttgaattcaatttcagaaacatcatattaactaatttcccattcaaaagttcatgtttaatatcctcaataaatgtaaacaaagtactttatacactgtactgtgctgaaggggttatattatgcatattctattttttattatatgtcatgcttagagtgataatgtccatagacatagcagcaaaaaataattgagaatgaaaaaggaaatgacattaatgcaactaagtcctgagactggctatttgggggtggacagatgtggttgctggaaggaaaggcattttatgacatgattctgcgacttgtataagcctgacagacatattcctaaaggcaaaggagaaacatttgcagaaacagtcaaaatgaatggcatatatttatagagagctattcaagccagacaaactaattctgttttgtgtatggataaaattagaaaattagaggatggggataacagaggagatatcaattttgattatacttaaatcacttaaaatgtctcaggaaatcttaattaaaatttagcacaaattggattcaatattaacattcttcctgggacttaaattggctaaaggaatgtaatgataaatggcaatgcatcaagttaagaaaaggtgttaaggagtgtgcttcagggatgtcagcattatagctggtcttatttaacattttcataaatgatgttggaagggaggataagctggatgataattacattgaagaaggtacccacctgggagatgctagaaataccaaatagtactgcaaaacacaggagacagaaacacccactaaattgcagagatagtcaaccacagttgagctaaggtattcagggaacacaattagctctgcagaaattattaggaggtagaaagcttaacaagtacacaaaataaggattctatgtttaagttacctagataacactatttttcagtcttttactactaaataataaaataatgggttatgagtcaatataatttgtttgcatgtatgctaacaaagatattttaaggaaattaatcgtagtccaccgtcagaaaaataagctgagacactgattctgaatacccaaatcataatagtgtcttccatgtaagatcccgaaaactcaagacctttttttttttaaacctcaacattagcaggagaattgcttgaacctgagaggcagaggttgcagtgacctgagatcatgccactgcactccagcctggcaacagagtgagactcttaaaaaaaaaaaaaaaaaaaatccaaaacctcaacgacattacacagtagatgtccccttctgaagtctattagatgatgttgaatggagttgtagttgctaattttggagctaacctatggcaagaatttaattcaattatagttcaatgactctgtgaccagtagatagtgtctatgagatggaaatatatgaagctcatttctaatttagcagggaaatctgcttcctaaatgaaaagggcatttatttacatggggaggccaatattttgcttacaagtttcagatgaaagtaaaaacaatactataactttaaagtgtttattgaaacattgtgatatctaaaaggtaagaaattgtgagctatttgttttttttatttcttttcgatgatgttttatagttctattcaggaactttagccctaccctttcataattccttcctctcagtgtttcaacatgtgcatattccaaatgtccccatctgtattagtctgttttcatgctgcttataaagacatacctgagactgggtaatttacaaagggaaggtttattggaatgccacgtggaattccacgtgggtagggaagcctcataatcatggcagaaggtgaaaggtgcatcttatgtggcggcagacaagagaagagagcttgtgcagggaagctcccctttttaaaaccatcagatctcatgagacttgctcactatcacaagaacagcacaggaaagacttgccccaatgattcaattacctcccactgggtcctcccacaacacgtgggaattcaagatgagatctgagtgggaatacatccaaaccatatcattccaaccctggcccctcccaaatctaatgttctcacatttcaaaaccaatcatgctttctcaacagtcttccaaagtcttaactcatttcagcattaactcaaaagtccacagtcaaaagtcccttccacctacgagcctgtcaaatcaaaagcaagttagttacttcctacatacaatggagatacaggcattgggtaaatacagcctttccaaatgggaggaactggccaaaacaaaggggctacaggccccaagcaagtccgaaatccagtggggcagtcaaatattaaagctccaaaatgatctcttttgacttcatgtctcacatccaggtcatgctgatgtaagaggtgggtttccatgctcataggcagctctgtccctttggctttgcaggggacagcctcccccccaactttgtttatgggctggcattgagtgtctgtagcttttgcaggtgcatagtacaagctgtaggtggatctaccattctgggctctggaggacagtggcactcttctcacagctccactggtcagtgccccagtagggactctgtgtgagggctctgactctgcatttcccttctgcactgccctagcagaggttctccaggagggccctgcccctcagcaaacttttgtctgggcaaccaggtgtttccatacatcctctgaaatctaggcagaggttcccaaacctcaattcttgacttctgtgcacctgcaggctcaacaccatgtggaaactgctgaggcttggagcttgaaacctctgaagccacagcctgagctctatgttggaccctttcagccatggctggagtggctgggacacaggacaccaagtccctaggctgcacacagaacagggaccctgggcctgcccatgaaacaattttttcctcataggcctctgggcctgtgatgagagaggctgctgtgaagacctctgacatgccctggagatattttccccattgtcttggggattaacattcagcttcttgttacttatgcaaatttttgcaggtggctttaacttctccttagaaaatgggattttcttttatattgtgttgtcaggctgcaaattttccaaacttttatgttctgtttccattataaaactgaatgcacttaacagcacccaagacacctcatgaatgttttgctgctaagaaatttattccgccaggtatcccaaatcatctctctcaagttcaaagttccacaaatctctagagcaggggcaaaatgccaccagtgtctttgctaaaacataacaagattcacctttgctccagttcccaagaagttcctcatctccctctgagaccacctcaggctggactttattgtccacatcactatcagcattttggacaaagccatttgacaagtctctaggaagttccaaattttcccacatcttcctgtctttttctaacactccagactgctccaacctctgcctgttactcagttctaaaattgcttccacattttcaggtatgttttcagcatcaccccactctactggtatcaatttactgtattagttaattttcacattgctgatatagacatacccgagactgggcaatttacaaaagaaaacaggtattgaaattacagttctatatggcggggaggtctcacaatcatggcagaaggtggtagcagataagagaggagagcttgcgcagggaaacttccatttttaaagctatcagattgtgggagacttattcactatcatgagaacagcaagggaaaatcttgcccccatgattcaattacctcccaccagatccctcccacaatacttgggaattcaaaatgagatttgggtggggacatagccaaaccatatcaccatcaatcacccatgtgaccacaaaataatctaagttgctcctaatgtttccttttaaattttggctgcagtttactactctctttaattgctctttcctggttctgataaaaaaaatacagcttgatataaaaggacaaatataaagatgattgaattgtgcataagctgaacaaaaacattcaaattggagtctcaaaaatgacacagaaagccacagttgatataaaccatatgcaagaatataaattgtaatgcaagagtgtaaacacggtattttatatgaataaatatattttttattagaagtgaattatgggccggaagctgtggctcacgcttgtaattccagcactttgggaggctgaggtgggcagatcacgaggtcaggagtttgaaatcatcctggctaacacggtgaaaccccatctctactaaaaatacaaaaatattagccaggcgtggtggcgagcacatgtagtcccagtgtttttgggaggctgaggcaggagaatggcatgaacccaggatgtgaagcttgcagtgagccgagattgtgccactgcactccagcctgggtgacagagtgagagtctgtctcaaaaaaaaaaaaaaagtgaattatggcttaattgataatgcatgaatgtgttgatcatttgatgtttttgcctcttgggcatccttggctcttgcttccagtaaaagtcccttattttcctttggggagcaattggcaaaaaaacatgtcaagttattcaagttggtatagtcaaggtgactcctagaactactgtaaaagagtgtttttttcttcctctagggctaaactggtaaatttatatctggtgtttctgctggctttccagtcttcattggatgtacctaagactgagacccatacagaagaagacatgtcaagaaataagcagaaaatatcgctcatgacatggtttctgcttatgcctgaaaccaaattcaccactttctgatagattaaaaattacatattttaaatgctaatttattttgaaattatgtctttcaaccgtaagaaccctaaatatataaaatagttttgatgcttaactactcttcttggtttgctttttgattatttttctaggattattgtgcttcgagattttggtttgagataccatgtaatcattaatacaataatgtaatatataattattcattacaataggcaaagatattgcttgaaagtggtagaattgtccctgtatagaaataatattgaattactcaataagtaaaaaaatacagataaattagctggtaaatatttccatcaagagaggacagactcgatttcagggaaatatttaaatgagtattgctttgttttttcttcttcataatttcatggatagaggattcattcttacatagatatgagcaacctcagcatacaatttttttcattattaagatgagaactttcacattttaacttaaaggaagcactttcatagcttctctttgatatatatgaattgccagaatcactactcctgtgctttgggaccattgttatgtaaaataagggtaccaccacaggtaatctaataacagagatagcttctaagtgactcatgggcagggagcatagatgtcctggagatgctggacaaaaggatgattcatgccccccccaacaagctggggacagagtaggacacctcaagatttcatcacactactgaaaatggcacaaaatttaaaactttggaattgttgatttctagaattttccatttaatgttctcagaatatagttgaccaaaagtaatagaaaccatggaaagcaaaactgaggacaagggaagaatactgtaaaaataaacatgaactgagagatttacctcacagcatatgtaaaattaactcaaaatgcatcacagacctaaaggtgaaagctacactatgaatactaggagaagataatataggagaaaatctttgtgaatttggttggcaaattttcttaaatatgacagtaaaagtatgatacaataaaaaataaacttcctaaaaattaaaagctttttctctaccaaaaacataagaacatgatacataaaatacagattatgtatttgcaaaatatttgcagatcatatatctgataaaggacttgtatttataatttatagagaatacttaccagtcagtactaagaaaacaaacacaaattttttaaatgagtgaaagatttgaatagatatttcaccaaagaagatcaataaatggctaataagcacatggaagtatctcaaattaatttgtcattaagggaacacaaaatcacaatgagatactaataagcatctgtataatggctttaacaaatgaactgacaatactatcagagaggatgtagtgggtggtaaaatggtacaagccactgttattaaaaagcagtttgacagtttatttaaaaagtatatatttaccatgtaatctagcacttttcgtaagatatctatatataacaaacagaaaaataaacatatatgtgtatatatatgtgtgtgtatatatatttacatttccaaaaagtgacttatatagaatattcacagtcacattaaactggaaacaactgaaatgcccatcaactggtaaacagataagcagaatgtgttttcacaagatggattctattaagtaactcaaagaaacagatatatagcattgattcatgccacagcatagatgagctacataaacattatgctatttaaaaagccaggtaaaataaaagtaaaagatacatactatgggactccatattttttaattcctagacaaggaaaacttttagaggcagaaaccaaaacagggggtgtctacagctgaaaatgggagtgagcattgactacaagtggtcatgagtaaagttttggggtgatggaaattttgggggtgaaagaaatgtatagaactagattgtggtcattgttgcacaactgtctaaatttactaaaaccagcccaactctttcatggaactgatgtttactggtctttgaataaacacagaaattgaccccccacccccaccccaccataccctgtcttgaagcttgaaacttacatttgtctcatgggagtttcttcctcaggacactaaccctcaaccctcctagaaaccaaggaactgaaactcaccagataactgtatccagaaaatgagatgccagacctctcatccatggattatgattccagtttaccaattcctcttccttaccctaccctaatatttgtttttgcacaagtattttttccctgctatataaacccctaattttaatcatttggggagatggatttgagactttatctcccattctcctcagctgcagcacctgattaaagttttcttctctggcaatatttgttgtctcactgattggcattttgtgaagcaagcagcaggacctagatgaaacccttgatgttttggtaatatacatacatgaggacatgtaaattataccttaataaagttatcgaaaataacaaagataattccacccacacatctgacctttttaatgatatttatccatttttttctgctacattatagaatgcccttcaggctacttgttcatgtattgtttcatcatttgagtaactttcttccttcttcctgccttcttatgcacctcacaaagtttagatcttgattatttgtttctttctttctcttttaaaccactgtatgttcctctgccttcagagactttactatcaactccatgaactccatgctacctttgtaaaactacttcttcctcctatgaatggacaggtatgaaagctctggcaagcaaagaaaagccagacccatggaagaaaagcagaatgtaatcagctaatccaactatgaaaggctgtctgtgttgagaaaagtaatcagtagaagagaaggtgaaattgtggaatatagaatggagagcacacaaacaaagatttcaagataagataccttcatattttcctctgagagaacattttatagcaagagtataatcttcttagcagctcccttcagatgtggtaatgattaatggccaatgctggagaattgcacagatttggcagaaatcaaggtacaagatatacttgagaactctactgggatcatttggggttaatgtctccttatgacatgccagaatatgagataggattgtatcacttgggcctttttcgttggttatatttatcctaattttacatttgaagccttgagttaaattctaactttgaccttatctgatatgcagtggctggcagccatagcttatacatgtatagatatgtataaaaatgacatcacttaaggcattcttcggtggtttcctagtatgacagagtcgatttttcttttttgcctcaccagatgtgtttaagtgtgggatgaaatataaacaaacgtttatggaatcagtattgtaaacaagaaggtgaacagtaaagttatatggtgaccccatatcctgatgatttgttcctagaaattctcaagggcaattataaggatccttttgcacactcaggttgaacttcacctagaagtagaatatgcctaatctacaagcttctgggagaaacaatacttctgtatgcacacaatatacttgaatcgtattcatatcatatatacttagaggaaatgtatcagtctattttcacactgctataaggaactaactcagactgggtaatttatgaagaaacgagttttaattgactcacagttccacaggcttaacaggaagcatgactgggaggcctcaggaaacttacaatcattacagaaggcaaaggagaaggaagcaccttgttcacatggcagcaggagagagagagagagcgagaggagaagtgccatatacttttaaaccatcagctctcatgagaagtcactcactatcatgagaatagcatgggagaaatttgcctccataatccaattaccttccactaggcccctactccaatactaaggttcacaactcaaggtgagatttgggtggggacacagagccaaaccaaaccgaggaacaatccttgagtcaccttaatcaacactggacataaagaactaagagggatttgaagttcaataaattagtttactgaatcaagtagagatggcttttaggcaaacatattaacctaaataagcagagtagggaacattctttttcaataacttggcattactcaggaatgattacagagtaatcaatgattactgaaataacaattataataaattctgatgtatttaaatggttctagttggctatactagaagatcaagtcaggagggacatatctctgggaactacggacaatctaaactataccaagatgtcatttgtaagtatgggcattatcaatcttctattacagtcatatttctatgaactaggaaacaaacatcttcttcatggtacctttggcgaagtttggacagactaagaatcaatgcattgctttattaaagaaaagtgactggtgtgctgcattcatatgcagaagctttcgctagtgaaagtttattcctaggggatggtttatagttatgctatcagaccagatgcagaattgtcggagaaagagtatctaatgactactctggtaatgtaaaatgtatgatatgtaggaaaagtctattttttgctaggaaagttgagaaaataatttggaaatattaaagtgtattgtgttaaatatttcatctctctgcctcagctctatcgtgtgataagggatttttaaattcatttatgtagttagataaaaataaaatctgagtgcatactgatctctaggacagaaagattatttggatgggcaacataaaacttacaactaggtaatccttatgtagaaggatttgccagagaaagaattgaatttacgtgtgtaaactaatatacccagttgaatgtatcaacacttataaaaaggcagaagtaatagaggataagggggaaaaattgtctttcaaatgttaaagaaatatcagaacagttaagtgaatctatctatggttgttaatttgctttgtagagggaattccaacttcttagtgtatgaaatatgctctggtgatagccagtgttttaacatctatttttaatgcactagatattatagaagttagtgtaacaaaaattttaagaagattcctcagaaatgtgtagcaagtgggtaacacataatgagtgcagatgacttagaagtcataagatattatatctaaagttacaagacttctactatgctattgccatagaagctatattgttgcctgcctggtatccttaattaaagctaaatcaacttggagctgtgtaaggtctactgggtctctccaggttggcattcagtctgaacctaaggctgctgctcattaaactatcactggaaattcactattcagtgtgatttctgatggaaaaatgatataatgggtttgcttttatgtttgttgatttcttcatgtgtcaataacattcaggaagttcttcaataactcctgctggccaagcaaattggggattgcaaatgtatttattttcagatttattctctgtggccttaatgtgaacaagtgatgctttaaagccaaaaagcataacaggctcccagttttcccccttctcttacgcatatcctagaataatccaagatgatgggcacctcagtagggtaggtggctggcaaatttatcactttggttgtataatttggaaaaagatattgataacattaataataacatgatcattaaatacttatatgaataattgtcaccgaagatgaatctcccatctatgcatttttcttcccaaaaaaaggcaagaaataaaacaacaagaagatgactttaaagcatttcttttcacagcctgactatttaaagggcttgtttcttttctgcagcaacttcatgatccttttgtaaaggttcattggttctaattactcaaactctgagactggaaactggaaccttaagtgctctaatgctatcaaattctctcatgcccaacttacactctcaaaaaaagatttcctcaaagttggcttccattaatttccatctcattagctttaacccatcgatttaaggacccagtctttcatacttcttcaagaaatctcacgttgtatacaatgccaaatctaaactactctacatgcaaggtagccatcttaaattaatttataaataattggatccatttattcagaccttaatttgtaccaaatgtctgactccgaaaaatgaagagtggaaaagaaacagaaacaataacttctgtcaaacagaaggtgctctaggaaaggagatgagagagaaacctatctttaaatgaaatgctgttacagaaacataaaaatactttacaaaagtacagaaaagcctgtcatgacaaaggggctgggagaataaaccaacatatatttgacttagtaaaagaaaagcaaatctttgagcattcagttcctcttctctccaatgccagttaaatttgtatctttaatgcctcatgaaattactatgcctttggccgtatcatttcatcttcaacatcatattatcttcacttgcctatctgagtactctaacagatcatcatccccactcacttttgatgaattctcgttagtgctcttagtctttctcatcaaatttaacaactcaataattgtgatgttttctgattatttcactgtgaagaaggattatttcttgcaaaatatagtcaactccttgaggattagggctgtgccttactcgttctacgtatttttcagagcacttagtttagtacgaatcacctaaaaatctgtgtagattaaattataatctagccaagaaagtaatacaacatgtagcatacatatattaggacttgcacaatagtgcttttgtttgtttgtttgtttcctttgccaaactggatgagcaagtttactagggttttaagaaatccctactgctctatttaaatgtttgttttttcccctaagatctcctgtatttgaaatatctcaatacccaactatttttattttactcagatgactatgcttggacattataactgtcaggcctctgagcccaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctcgctcatcctggctcaaaaagcacctccactgagcaccttgcgaaccccactcctgcccgccagagaacaaaccccctttgactgtaattttcctttacctatccaaatcctataaaacggcctcacccttatctcccttcgctgactctcttttcggactcagcccgcctgcacctgggtgaaataaacagccatgttgctcacacaaagcctgtttgatggtctcttcacatggacgcgcatgaaatttggtgccgtgactcggatcgggggacctcccttgggagatcaatcccctgtcctcctgttctttgctccctgagaaagatccacctatgacctcaggtcctcagaccgaccagcccaaggaacatctcaccaatttcaaatcaggtaagcggcctcttcttactctcttctccaacctctctcactgtccctcaaccactttctcctttccactcttcaatctctcccttctcttaatttcaattcctttcattttctgggagagacaaaggagacacattttatccgtggacccaaaactccggcgccggtcacggacagggaaggcagccttcccttggtgtttaatcattgcagggacgcctgattatacacccacgtttcaagggtgtcagaccacacagggacgcctgccttggtccttcacccttagcggcaagtcctgcttttctggggaaggggcaagtacctcaaccccttctctccttgtctctaacccttctctgcttttctgggagaggggcaagtacccctcaacccctcctctttcacccttagcagcaagtcccgcttttctacagggcaagaacccccaatctcttatttccgcaccccaacctcttatctctgcgccccaatcccttatttccgcaccccaacctcgtatctctgtgccccaatcccttatttccatgccccaaccccttatttccgtgccccgaccccttatttctgtgccccatcccttatttctgtgccccgacctcttatctctgtgccccaaccccttttcccacttttctggaaggtaagaacccccgaaccccttccctctgtttccctactctctcttttctctaggcttgcttccttgactataggcaaccttccaccctccattcctccttctactcccttggcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaagatctaaataattcttgtcgtaaaataggcaaacggtctgaggtgcctgacgtccaggcattcttttacacatcagtcccttcctagtctctgtgcccaatgcaactcgtcccaaatcttccttctttccctcccgcctgtcccctcagtaccaaccccaagcatcgctgagtctttctaatcttccttttctacagacccatctgacctctcccttcctccccaggctgctcctcgccaggccgagctaggtcccaattcttcctcagcctctgctcctccaccctataatctttttatcgcctcccctcctcacacctggtcgggcttacagtttcgttccgtgactagccctcccccacctgcccagcaatttactcttaaaaaggtggctggagccaaaggcatagtcaaggttaatgctcctttttctttatcccaaatcagatagcgtttaggctctttttcatcaaatataaaaatccagcccagttcatgacgtgtttggcagcaaccctgagacactttacagccctagaccctaaaaggtcaaaaggccgtcttattctcaaaatacattttattacccaatctgctcctgacattaaataaaactccaaaaattaaattccggccctcaaaccccacaacaggatttaattaacctcgccttcaaggtgtacaataatagaaaaatgttgcaattccttgcctccactgtgagacaaaccccagccacatctccagcacaaaagaacttccaaatgcctgaaccgcagcggccaggcgttcctccagaacctcctcccacaggagcttgctacacatgcaggaaatctggccactgggccaaggaatgcctgcagcccgggattcctcctaagccgcgtcccatctgtgtgggaccccactgaaaatcggactgttcaactcacctggcagccactcccagagcccctggaactctggcccaaggctgactgactccttcccagatcttctcggcttagcggctgaagactgacactgcttgatcgcctcggaagccccctagacaatcacggacgccgagcttcgggtaactctcacagtggaaggtaagcccgtccccttcttaatcaatacggaggctacccactccacattaccttcttttcaagggcctgtttcccttgcctccataactgttgtgggtattgacggccaggcttctaaacctctgaaaactccccaactctgttgccaacttagaccatactcttttaagcactcctttttagttatccccacctgcccagttcccttattaggctgtgacactttaactaaattatctgcttccctgactattcctggactacagctatatctcattgccgcccttcttcccaatccaaagcctcctttgcatactcctcttgtatccccccaccttaacctacaagtataagatacctctactccctccttggcgaccaatcatgcaccccttaccatctcattaaaacctaatcacccttaccccactcaacgccgacatcccatcccgcagcacgctttaaaaagattaaagcctgttatcacttgcctgctacagcatggccttttaaagcctataaactctccttacaattcccccatttcacctgtcctaaaaccagataagccttacaagttagttcagaatctgcgccttatcaaccaaattgttttgcctatccaccccgtgctgccaaacccatatactctcctatcctcagtacctgcctctataacccattattctgttctagatctcaaacatgctttctttactattcctttgcacccttaatcccagcctctcttcgctttcacttggactgaccctgacacccatcaagctcagcaaattacctaggctgtactgccacaaagcttcacaggcagcccccattacttcaatcaagcccaaatttcttcctcatctgttacctatctcagcataattctcataaaaacacacgtgctctccctgccaatcgtgtccgactgatctctcaaaccacagcaacttctacaaaacaacaactcctttctttcctaggcatggttagtgtggtcagaattcttacacaagagccaggaccacaccctgtagcctttctgcccaaacaacttgaccttactgttttagtctagccctcatgtctgcgtgcagtggctgccactgcattaatacttttagaggccctcaaaatcacaaactatgctcaactcactctctacagttctcataacttccaaaacctattttcttcctcatacctgatgcatatactttctgcttcccagctccttcagctatactcactctttgttgagtctcccacaattaccgtcgttcttgacccagacttcaatccggcctcccacattattcctgataccacacctgacccccatgactgtatccctctgatccacctgacattcaccccatttccccaaatttccttctttcctgttcctcaccctgatcacgcttgatttattgatggcggttccaccaggcctaatccccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagttcgaggatttgccccacccaggactggcaaattagctttactcaacatgccctgagtcagataactaaaatacctcttagtctaggtagatactttcactggataggtagaggcctttcctacagggtctgagaaggccaccgcaggcatttcttcccttctgtcagacataattcctcagtttagccttcccacctcaatacagtctgataacggacgagcctttattagtcaaatcagccaagcagtttttcaggctcttaatattcagtgaaacctttatatcccttacggtcctccgtcttcaagaaaagtagaatggactaaaggtcttttaaaaatacacctcaccaagctcagccaccaacttaaaaaggactggacaatacttttaccactttcccttctcagaattcaggcctgtcctcagaatgctacaggggtacagcccatttgagcggtatagatgctcctttttattaagccccagtctcattccagacaccagagcaacttaagactgtgccccccaaaaaacttgtcatccctactatcttctgtctagtcatactcctattcaccgttctcaactactcgtacatgccctgctcttgtttacactgccggtttacactgtttttccaagccatcacagctgatatctcctggtgctatccccaaactgccactcttaactcttgaagtaaataaataatctttgctggcaggactatgctgaatctccttaggcactctctaatcagatatcctgagttgtcccaattcttagaccttttatacctgtttttctccttctgttattccatttagtttctcaattcatccaaaaccgtatccaggccatcaccaatcattctatatgacaaatgtttcttctaacatccccacaatatcaccccttaccacaaggcctcccttcagcttaatctctcccagtctaggttcccacgccgcccctaatcctgcttgaagcagccctgagaaacatcgcccattctctctccataccaccccccaaaaattttcgccgccccaacacttcaacactattttgttttatttttcttattaatataagaagccaggaatgtcaggcctctgagctcaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgactttaccttgtgaaagtccttttcctggctcatcctggctcagaaacacccccactgagcaccttgcgacccccgactcctgcccgccagagaacaaaccccctttgaatgtaattttcctttacctacccaaatcctataaaacggccccacccttatctcccttagctgactctcttttcggactcagcccgcctgcacccgggtgaaataaacagccatgttgctcacacaaagcctgtttggtggtctcttcacgcgcatgaaaataacaaaatttactaccagtgaaagctgaaaagaaaatgagctcttttttggaaacaataggtgaataaaagctaaaattgatcaaagaaatgtttcatttattggacatatactaaagaaaatagtataaaatatattgtacattttgtttcttctagagcaatatcatatttcaagtcaaatatctagtaaaccagcaatatatagaaccataagtatgagcgtgaatatagtcaaaattaaaaatacacaatttacatgattgtaaaaacaatcacatacaaataagcagaagcttcataaaaaatgcaagcacctaagcattaattattgaaaccggaccatgaaattggacaactttcactatgacaaccaaaaaacatgatacagaaatataaaagtaaataattgtgtttacaaatgagttttctttaaaaagctacactgttaagtatatcaaggaaaggggataacgtctgaaaaataatataaaatctaaatattctgttttcagttacacaaattcaaaatgcaaggaattgtgattactataatgctagcattagtatttcttcaaatttatcaaatgggaaacctcagcctaaactacataagccctaaggttttaagagatactgaaatatgtgctaaacacttaataatgtttaatttgatgatctaagtcatatttgtcatgtattataaaaccaaaatataatttgcctttcttcattagtagtctagtaattacttaaggtcataaactatatgttgatagtttctttatttcttatgatttggcatcgtgcgcaatactttaaatgctctacacaataaatcattttcaaataaatgtgttaattattcaactttgcctctttaacagcatatatgattgacttatgttttcagtcagtttagcatctcaagagtctttttgaagtgattcttctgaataatcaagtttggaagtactacgttatagggatactaatataactgtagtttaaaatattttactttgtaaaaaatttaaaaatgaattaacctgaaatataagttatttcccatgactcataaataaattcctaatacatattttacctacatctattagttctttttatccatttattcatttaacaaataatatttattaaaggtcaatgtgctgggactgtgtaaggtgttaggcatacagtagtgatagaaaaagaagaaaagtatgcaaaaaaattgacaataattttattccatttgagcctataattaagtgagagaaacagatagtttaaccatataattataaatttttaaatgtgctgtgaaggagaaatcaggatgctccaagataataaaggggtaacattgagaagaggaaatcatggaagtcttctttgaggaagcggcatttaaattaagacctaaaagacggaaagcatatgaatgaaagttatctcatcactgtgggagcatcataacaaataagagaaagataaaatgctaagtgaagaaattgaacgctaatccagtaatacaggatatcgattatgggcttcatttttatagcagtagaaaaccattgaaggggtcaagcatgctaattatttgagtgatttcaaatgtaatatagcccactggctaatgaatgaagaagagggaaagaggagacataaataatactcatagaaggacatttcacaggtttaggtgaaagttgatggtggcagtgaaagaaaaattaaggccgggcgtggtggctcacacctgtaatcccagcactttgggaggccgaggcaggcagatcacgaggtcaggagaaccagaccatcctggctaacacggtgaaaccccgtctctaataaaaatacaaaaaaaaaattgccgggcatggtggtgggctcctgtagtcccagctactcaggaggctgagacaggagaatggcgtgaactcgggaggcggagcttgcagtgagctgagatcgcaccactgcactccaacctgggcgacagagcaaaaaaaagaaaaaaagaaaaacaggtagatgcattaaataagtatatgagaaaaaattggtaggaggtggtaatagattggagatgggagtaaatgagtatgtttcaagaataactttttccaatcaaatggaaggtgttgctattttcttttccttctttcttttttctttttcttttctttttttttttttttttttttgagacagagtctcgttccgtcacccagccgggagtgcaatggcgcgatcttggctcactgcaacctccaagagattctcccgcttcagcctcctgaggtgttgctagtttcttagattggggaatatcatccatttgaaaaaatgctgatagtgtaatcaaacttggaattcaattaaagtcctaagcatgagtgaataacctgtataagttcagaattacatgttggtgtatatatttcaattctaatacaaataggtttagccaagaaatggagtggtctttagaaaaaaataaaatgcttcaaatatcaaaaataaattaaaattgtgtactaatgtaaaaataggtccacatttttgtaagctttgctcatgaagactttatccggtatttgctgaaatactgaaccccctcaagaccttaagtaaatataaccctcaaactttaatcatgacattatacacacaaaccaaagaaaacaaaatcattatttgaaagaaattgtcgtctatggccataccactctgaaccctcccaatcttgtgtgaaataaattgtcaagagacattaaaatacgatgtagttttatcttaaacttgaatatttgaaattacaaaaacagaatttaatatgtaattttatatgttatgtacgtgtcctccacagagcactaaataacacaggacactcagaagtatatacagataaggtagcaacaaatattaataatcataagtgctttacataatttatgagaatggtacagtaataatagcaagttaccacatgcagcatttgctaagcatgcatgtgatagtagtttatatagttagtttaataatcacaacactcttttgaggttggtactattattatcaccattttaaagattggaaaactgaggtacaaaaggttatgtcatgtaatggtacaaagtggcagaaagaaatgcaactagctagcctgcctcccaattctattgtctttaaattggattctacttcatctctgtcacttaaaaccctcgttaatttggaacaatcatctgtcattatattaactcacatttttctataaaattaggctataaaaataattatgttcaaagttttttcctatgatatattacctatgatatagaataactacctatgatataggtatgataattacctatgatataggtatacctatgatatagaataactacctatgaataattacctatgatatagaataactaagaaattaaaatatttccaatttaagagcaggaaggggtagcttggctaaagctgtgaagttagagatcatctcgggaaaggactatgtgaggtgatacttagtgtgtgatagaattcttacgccaaatagaacatatatctaaaattaggtgttttctaaactcattgagggtacattagtcgagggaattaaattctatggacattaactgaattcctactgtgtgtaagtcattatactgaccactcgtggttagatcattaaaagtttttgtcttaaaggaacttacagatcagtaggggagacagacacgtaaaagttagccttaacgcaagccacaataaaacatgtgggagatacagttgatagctggtacgtggaagcaattaattttgacttgctaggaaaatatagcctttattaaagaggtaacaattgtactgtgtgttaaagattttcttttttaaagatacaacttggatcaaaccttcaacctgagagagctctcaatagttacagaataagaagaatattccatgctaaaaacaagtaaaacaaaaccctatatattattctcggattcataacatgaagggatgtagcaggagatgaaacaaatatatttaagagtattacatagatgtccttgactgtatgtgtggagctttcttccttccattggtaggttttccaggagggtgaggatctgttctgactcagtttcagaataatcatctgaaacagtgtggtaggaaatccattgaaatagccagattgcccaacatagtttactgtagtagcctaaattatggcagcacataggcatggaaaaggaattggtggtggaaatgggaatgcaaattggtacagtcaccttagaagacagcttctcagtttctaacaaagatatccatattcattctatatgatccagcaatcccactccttggtatttaccaaaaggatttgaaaatttatgtccatgtaaaaaaaaaaacttagcatggatgattatagcagctttattaataatggccaaaacttgaaagcaaccaaaatattatttcatggaagaatgaataaataaactgtgttacatctagataatggaatattatacagccctgaaaagatatgggctattatgtcatgaaaagacatggaggaattttaaatacgtattactaagtgaaataagccagtctgacaaggctacatactatatgattctaaacacatgctattctggaaaaggcaaaatcatggagactgtagaaagatcaatgattgtcaggggaaggaagcaagcaagggggagggaagcataggcagagcacaggatttttagagcagtgaaactcttctgtgtggttctataatggtggatatatgtcattagtacaaaaccataaaatgaagcaccgagagtgaatcctaatgcaaactacagactttggatgataacaatgtgcgaatgtaagttcattaattgtggcaaatgtatcactttggtatggggtgttaatattggggcaggtatgcatctgtggggacagtgagtatatgggaaatcactgtatcttcctctcaattttggtgtgtacctaaaactgctcaaaaaaaatctttaacaaaaaagatgaaatgatgatctacaaatacattctaaaatagaaattgcctaaactgaacaataatttggatgtatgcaggtaaagcagagggaaaacaaacaagactgcaaggtgcctatcctgctgcctgtggaacctaaagattaatggtgtgcatcatgatatagctgcctccaacacgactagatgcatgtttttgagtgtctgtgtttgtttattaaaataaagataattgattagttaatgtatttttggatatgtgcaatttgaagtgcttgtaaaagatctactttgtcatgtccagctgatatctggaatgtcagcttgctgcttgggaaagaggtcattacagggcatttaactttgggagacaagtatatatagaggtgatgattgaaaacttgagaacagatgaaaaagagaagaagtatatatacgtatttgaagaacgttaatttttaaagggtgataattgaacaaggggccagtaacatctctcagccaacagagaagtaggatgggaaccagggaagtttttcataaaagggtatagttgagagtttcaaaaagattaaggacttttgactttgacatgtagaaatagactgatgggatatctaattttatatgattttagtggtgtgatgtgagtgaaacccagagtatattctatacaagatagataaatacagatagaaatatagagatagatatagatcaatatatgtatgcaggcacttagattgatacatttttgtcgataaggaaaataatcagagtgggatagaagcatgaagaattatatctgggagtagggattagaccagaacctggggatgttaataatgttaattgggcaaagggaagggattagtcactggagagagattattgcatcaaaaaaatagaataattggtggagcacagaaattggaaggagtgcagtctaagacaggaaagaagagtaagaagcatcacagaagaagggaaggagaactaaaaaacaaaagaacaatgaaaagaagtggggtgaggatcagaggactcaactttatgtgggattccatcttaatgacttaagaagtaccagaatctacaatgaactcaaacaaatttacaagaaaaaaacaaccccatcaaaaagtgggcaaagaacatgaacagacacttctcaaaagaagacatttatgcagccaaaaaacatgtgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggattgtaaactagttcaaccattgtggaagtcagtgtggtgattcctcagggatctagaactagaaataccatttgacccagccatcccattactggatatatacccaaaggactataaatcaggctgctataaagacacatacacacgtatgtttattgcggcactattcaccatagcaaagacttggaaccaacccaaatgtccaacaacgatagactggattaagaaaatgtggcacatatacaccatggaatactatgcagccataaaaaaaggataagttcatgtcctttgtagggacatagatgaaattgggaatcatcattctcagtaaactatcacaaggacaaaaaaccaaacaccgcatgttctcactcataggtgggaattgaacaatgagaacacatggacacaggaaggggaacatcacactctggggactgttgtggggtggggggagggggcagggatagcattaggagatatacctaatgctaaatgacgagttattgggtgcagcacaccagcatggcacatgtatacatatgtaactaacctgcacattgtgcacatgtaccctaaaacttaaagtataataataataaaataaaatttaaaaaaaaagaagtacaattattcagtggtacttttaaaatattgttgtttaaaactgtaactctcaaaattggctgcatattagaactgtttcaatttcttaaataaaatctgtctaagtgagtccgttatgggtggccaaatcatttaaatacaaacatcttagaatgaagtgctggcatcaatactttaaaagttcctcaggcagaatgctaatagtcaattatcattgagaatcacagtttaagagaattgcagatgtttgcgaatagtgtttatggagcattaattggatagctagctactagtatttaaattgacatcttcaaaatattaaaatctgtatcctgtatagggagtaattgtcttttcaagaaaactagcaatgtgtggattggtattagtggagcatagtatttattagtttcaacctatacgattgcattgacatctgataaaacggtctgcatggaatgaaaaatgaaattatctcatgcagtaattttcccttaaacaaaatatgtgctaataatgtgattatacttcagctccggttacggaagatgatgttggtgctttaaggcatcactcctctaagtgttgttcatgacccatgtgcatgagaatcactccaggctttttgaaaaaatcaagtgtaagagacatatataaagtcagaagctcaatttataactgagaacttataacaaggatctggttaaaactttataaccaactcatttgctccttgcagacagggtagatacttaataagaaaaatatactgtacttaaaaaattgagtatgcactcacatcaggctaaaagagtctcatggctacattgaaaatgacaataattaaaacctgttgcccaagtgtctctttcctttaaagtgctcattgtcacttttgtttctgacactttcagtctttgacatcagtttactaaccacaaagtaaactgatgtatcctgtgtcaggtcaatggggaaaggcagggttgtgatgaggtgtagcatagggacctatgtcatgactcttaaagggtatatgtagatcagagttctgtatcaagtttctttgttttaaaaatattctctcaatgagaactagtttatgtctaggttcttggaggatgttttatagcgagaccattcttctaccacataccagaaataacattaaaatactaattataaagcttaatttgttgacttaaataatttttaaaattgtgggcatgctgacacaaacaacagtctatcttcataatctgcatagttcaggaaaatatataaaagtcttgaaaggcaaggaaatatctgttttacaaagagatacataagggaaattaacttttgtagacttcaaatgaggaaataagcctttgatcccctaaggcaaacatttttgagatacagtttctccatataattgctatgattttcttacttacactttgtagttccctgctggctgtttttctgtgtaaacttactttcatttccaattatgtcattatagagatgaaaatcagctctaattaaataagaacatgacaataattgtcattcatttatttatgtaaactatgatttttctacctgtgaaaaggtgatttagcaaagaaaaatgtagctctcatggtccatcaattgactggaactaatagtcatgtatctacagcttcccattctctcatatctttattcattcaatattacttgtctaagggtcttcctttctttcatcttcaaataagcatttattaagtagctacactatatttattttattttataattttaacttttatttcagattcagggggtacatacgcaagtttattacctgggtatattgcatgatgttgaggtttggggtatgattgattctgtcacccagatactgagtatagtacacaatagttaatttttcaattgtctcttctccctctctccctccatagtagtccccagtgtcttttgttgccatcagcagctaccgtattaaacatctactatatgccatgaactatagatacagatgccacagatacagaaataaactagttacagttttgccctgaaatcaaatgctttaaaacacattcattttattaatgtgacaagtaccataccaatatattaaaaaatttaccatagcagtttgaaacgttttttctctctttaccaaatacacagcagaagctatttacacatagaataaacattccggtgaattcccagtccccaggctatcatgtcaccccttctatagaactcaagaaagcatatcttaattcataaataaaaaataatagcattgaatgatttcttttttctttcacattttgcttgtttgtttgttttttgtgtttttctttttaagacggagtctctctctgtccccaggctggagtgcagtggcgccatcttggttcactgcaatctccacctcctgggttcaagcaattctcctgcctcagcctcccgagtagctgggactacaggcgcatgccgccacgtccggctaatttttttaaaaatttttattttagtagaggtggggtttcaccatattgcccaggctggtctcgagctccttagctcaggcaatccgctcgcctcggcctcccaaagtgctaggattacaggtgtgagccgccatgcccagctgcattgaatgatttctaattttaattaacaattaatgcaaagttggtgatgatttatccttggaataaatatttactgcatggctaatatgtctgccatgtgctggcattacagtggcaaacaagacagccaaagttgctaacctcctgagttttccatttggagtaagggaaagaagaaaataggttaatttcagatatgggctatgaccttgatgagagaggaaaagagagaaaaaaagtgtgtgtgtgtgtgtgtgtgtgtgtgtgtgtttgaaataacttatttaagtgtaataagcacagataatggtaaaaataagataaatcaggaataaagatgttgcctgacttacatgttttcaaagttaccatttactatctaacttaaattttctctgctgtaatgattatattttatctaggtaaccaatatctagtgggattatgcatcaatttactaaggcagttttttgtatttatctccaagtgaaatttaatcaatttctacagtagtgaaaagtaatttgaagatttaatatattcagtattttaataaaatataaactggtcaaatagctatgcttttttttttaaagtaacaaccaagcatttattcacttactacaaatagctatgtttacctctaataaccagttaagtctcctttagagtccatatagatatgcttttatttgtttttggttttttgtttttgtttttgtttttttttgagatggagttttgctcttgttgcccaggctggagtgtgatggcatgatctcagctcaccgcaaccttggcctcccaggttcaagcgattctcctgcctcagcctcctgagtagctgggattacaggcatgcgccaccatacccggctaattttgtatttttagtagagacagcgttggtcaggctggtctcgaactcccgacctcaggtgatccacttgccttggcttcccaaagtgctgggattacaggcgtgagccaccatgcctggcggatatgcttttatttgaaaagtaacagaaatttaaagctatttaaactaattatgctatacaataagtgtgaaatcaatttctgtttcttaagtaatttcttcatgagcatatcgtataatgcacatgtaaataacagctttgagtgtacacttatattatgtgagtagttacctgtatgacactgtccccaggtctcatgtctgtataaacatacacatcataggatatttcagggaaggttggcgtgttatcatttgcatccatcacttgaatattgacgatgactggctcactttcttgtacaccatcaaatgctgttatctttgggaggagaaaaatacacttagtagagatgttctgcaaatataagtagtacagagtttgctcttacagtttaacaagtttcttacaggtaatcttacaatttgaaagggtgcaaaaatattttgttgataaaaggacgtaatagagacgtaatattacatatattaaaagtgttctaatatggtaagaagcaagtattgaagattttgttttaaggtattcaactccaggcatattttaaataatcagatatgcaaaatatcatttaaagtgggccaataacattgctgactcttagggttaactacaatttaatccttaaaaacttaattggaaaatattatttgcatttacatattttgtatacaatagttccttgtacagtcaatgtgtttataccatcaggaaggtagacttcctagatgtactttgtatcacagtaattcacccaatggcaattttcaaaggactaagtggtatcatttaattgtgatattttatactttatcaatgttgataatgtatgttatactttatcaatgttgataatgtacattatcaagattttaacaattcctgccaaatcagtgctacagcaccaccatctttgtctaaatccactttgtatctaacttttaacaatcacataaactttcctggaagttctgatctttttctatgtaggcttctccagaaataatttctacatatcttgtttaacttgtgctttctcttagctcatctttctcctgtgactgattcaaaaattgggatataattagaagttacattttttctttatccaactgtcaaccctactatacttgttatttacgtgtttgtgtgcatgtgtgtgtatgtttatgtgtgtgtgtgtatttccctatctcatgataaatatttacaatcacaactttaataacctttactttttttcccccttgattagcctaacccatgatttatctacctcagtgctattgacaccttgggacagataactctttattgtgaggggctgttctctgtattacaattagcagcatcctttatgtctacctactagatgcctatagtaactaccccttcacaattgtgacaaacaaaaatgcctccagatgttgctaaatgttcactggagggaaaatttattccctcttgagaatcactggctcaaccttatgactaaataaaaaatgcaagaacaacaacaaaaaaggttaggaaataattctttatacctcaatttaagacaattatgactgtttagtaaagactgaaattctcactttcttttttttttgaaaagttttttcttctgtgaggaagaatgttaatatagctacacaaattacaaaaaaagagcaatacatgtaaataatttttcattgatcttctctctggtattgaaaataatgtatttttcccccaagtcattgattttttcagttttaaccagacatctctttcagttccatacaaacatacatacatacattcatacatacatatgtatatttacacaaaagctctttaccgaaaaggtgtaagtttgctgttcttccctgtccactggttgaagtaaggtgaggtagcgagtaataccagtctgtgtgacggtgaagactgaggtgtagtcattcagaaaaaggtgaagctctgggtcttttgtctttgaaaaaaaatgacatcgtttcaaacgttgaataaataatgtagctattagttcattacctagaagttaatgtttgaaatttatagcaaaaatccacgtgaaagtattaagaatttctaacgataaaagatatttaactagatatttactcaaatgatctaaactattcaaaagatggtgacctatatcgtggaatacaaaatactgaaatacaaacaggtataatcaatgtgggaaaaaaggaaaaataatagaaaaacagaaagaatataaaaactcccaattaaatatattcttactgattatttgttatcaatattttccaaaatagcattggactggagaaataagaaataaaagcaagaaaagaaaattgcatttcaaaattttagcaataagactttataattacttcatttatagtaataaactgcatatatacatattactatcttgttcttacttataatgcaaaatagaaataaaattggttatgtattattcattacctataaatatcatgcttactctttcttattttaatgctgtaaaattttccaaatggaaacatgtttactttaattaaaatatttcagataatttgatttaaaatatgcataaatttagcaaatgtgtctgatagaaaagtctagaaaaaatgatatatacttaaaaaggaagggatttcaaaattcaagtctgagagacaatcaacttagcattgaagaccctttgcaatttcattgccacccctgaaacagaagacaacatactctaatttagagaaagaacagcaatataaagtaagaaggctagcactgatgtctgcatagtaggaaagaaaggcaggtggagcgaagaaaaaaggaatattcagagagtggactattatgaaggctttgaaaaagagagaaaggagtgatacagggaggtaaggtgttgttctagattatactatcttttaaagtatgcatagcatgatatgaaatggatttaatatcataaaacacttctttaagtctgatgtcaaggactgaggcaagagcaaagaatagaaaattgttaaatgtgtttaatttgaaaataatagaactcataatttcaaaatttctatgtaaaatacaaaagttgtaatgcacactactataataaaatgtgaacatgatttgatccacaatatacttgaatctgcccatcttttaaacattgtgatatgtgtagatttcaaataaccttgaaataaatggtttcatttgaacctaaaacaagttatgtattcataatatctcattctgtagtagcttctatgttcaggattttgacttaaggtcactgtgctacatttatcctggaacaataagaaagtaatactacacataataattccaactggcgtatttattataaaatgatcaaaaatattgagaaaaagttcaagaggcttcacactctgatattttcaaacaggcacttcagttgtttccatttcagtgtcatgaacccaattactcagataactagaaagcgggatattctaaaaaatctaacatgttagttttaaaaataaattatgtatttttaaaagtcaattagaaaatgcatatgtctattctgaatgatattttaagcattcttattttacactttagagtgaattgtgattaaattcaattattagagttgataaaaaagttttagttaacatgcagtttcagtcaaagaaactctaagtatgaatgtctgccatttgttttgtgttcatcctggatttacctaatcactgggcttttaagcacatatacacttctctaaatgcaccaacaatggtgccatctggcatgccttaatttattcggacctttaaaccctaaatgcaagctgaggaagttttgctatgtaccttgtttaccaaatatttactttgttccttttgttcaaatctcatcattctctacttcctttataccttaattctctcaatttattttcttcctttcaaccgtaacctctgttaataaatttgttaggtatattcactcatatcttcacatttttaagcatttttgtgtgtcaagtatttcgataatgcaatatttcaataagtattgagttgtcaactagtgtgtccaaatgtgactgtagtataatatgtttgtgtcacaaagagcacttactttttaccactttcaagaaaacctctaggttttgtttgtcaaatgcttttcgtttgaagataatgcacacatcaatactccataaatagacttccttatattggataaacagaaacattaaagatcttttgttaatttaactgtctcagtttcttgagtgcttttataataactagctggagaaagataacatttcccagaactacagtgtatttgctttttgtgaagaagataatctatcacagaaagctagcactatacatggcatattatagctcattctgttttgtttagttaatctctgatcaaaatataacatttacatttatgtatatttaaaataataatcttgtacataaatgctactggtaaatatcctcgtattaatttaagtaaaaaaatttaggaagccagatttggaaatgttcaacaaattgtcactcaatgtttaataatttatattcatttttaaagatagtgcaagtttcaaatgttgtgtatatatttatgttccaaatattacagcatatcattttatgagttttatgaaaattttaagtaatatcaacataaaatgttaatagatacatatcagtaccaactaacctattgttttgattgacaatatttacagttcaaggttttgctacccttcacaagaaaggtgtatcaaaggtttggtaagaaacaatgtgcatttgaagtcaaatatccttctctaaatctctttataaacttaaattccttcttgtcaagctgcattccgatacagtttgaatttcacaaatatatttgaattttgcaattcctaaagagtaacttgagtcaacacttgtatatttgcaactcttttaatcatgttagagttaatagcttataagtttcatagactaggatgtacatggacaaataatgctctggcttaatattccaataggggtagcagactttaggtagctgttgtgtctataagtttatttaaaatgaatttaagtgttaaatcaataggtacacagagagttgattaaaaaccgttaattttcctctgacattaggtaatatttattttaccctaaaatatccagtcagtatataccaaaagtatgatatattaattcacttatctgcatattatattttgagatggtaaaataagctctgacatgcacacataaaaacagaaaaaaatgcaaaagtaaatgcatatgaaaacacacaggtaaacaaacatatgaatataaaataaacaagcattctatcatataaaactatgttcaaagatgagagtctactgtttaaacaccaacttggggtttctaatgggaataaatataggatatcacaaacacacaagaccatatgcatgcacatatataggcacatacaacacagacatgtatagacatatgtgcacatatatatgtatgcatatacaagagcatacatataaatgacaaagcataagagaaaaatgacaaaaaaatgttatctcctcagccagttttaattacttggtagtagttgcctgagtatttagttcaaaaaaattcaatttcaaacttacaatgttttagaaaaaatgccatgataaattaccaatgtttgttgtggactgagaaaacattaataattaagcagtctttgcctcagttgacaattaaatttggattttacaaaatttcatagtactataaacaatagattatgtaaatatttttaccttttttaactttaaaatatttttaaattttaaaccaatgaagtaagtatatttaaatttatataaagtatttgtagatatccttataagggataatgaagtaatacctacgtgttttagtgaagaaaaaaaagaacaaggaaataaaccacagcaattaacaaaagaacaatcacaagcttaacacctagtacctacaggaactccactgggtggaacctatacgcaaattaaacatgaaataaatattgtaaatgtaaatgatcacaaccgcacatatgaagaaaaagcaaaccacttccagcacactagactgacaatttttttcagagtatacaatttttttattagcattgtgacccacatataatggaataacgatatttatgaagcatataaatacttaactgctttatgagtatattgaattaaatatcaaagatacctcttcatagtaaaataacgttaagcagagaaacaaatttacatgaagttataaataagtatctttttacaagccaaatgagtaatctttattgattattattctttgtcattttttatgatcagcattcaataatcaatttttagcatctctgacactgaaaacctggtggtctcagacatgcctcttaacaccttgtgccttacctattctacttatattatgggttattttgaaattatgatgtggtacaagtactctaaaaggcataatgtataaactgatatggttcatatatgtatacatgcatgtgtatgtgtgtgtgtgtgtgtgtgtgtgtgtgtgtgtgtgtatgggtatatgtctacatctatatagcaataaaaagaacactggtgcaaatatttcttttcctttcttttcagtattactgtggcccttggaattctttctgacttaaaatctacactgtgaatactatcacaactcacattcctggctattgtttcttaaaatgtggcttcactttccactaaattaaagggagaaacacaacttaaattttacgcaaatggatccaaacttgtccccttcttggcatttaccatctggaatagctatgcttgaagcaactcttgagagccaagccctgcaatgacaacttccacttttatgcttgaggcttaatctctaatactatgctgatattgtatgaggtggcacactgtctctctcaaagagtttatccctataatgatgattgtcactaattctgacactcaaaagcaacaggattttgtttcattttgttgaattagggtcccaatttgtcatctagcctgcagtgcagtggtgcaatcatggctcactgcagcctcgaaccagtgggctcaagggatccttctgcctcagcctttcaattagtgagactacaagcatgaaccaccatgcctggctaagttttttgtttatttttgtagagactgcatctccatatgtagccaaggctggtctggaactcctggcctcaagccatcctccagcctcactctcccaaaatgctgagattatgagtgagccaccacacccagccaagagtggcatgatttaccttgaagtaaaattcatgcccataaactaaaatggctttaaagttttcttttcataatacagatcttttgaaaatcccagaaatgaactaatttactttataaaaataaatggtgctcggtctataaaaaacagatgtatcagaaggacataaatccatcttctaatatatgaatgactatttcatagatttattttgtgtgctggcaaatggaagatttaaggaataatagatgaattaaaagaaaactggtttcaactcagtatgaaaaacagctttctaagaattagagttgttcaaacatgggataggccatcttgtgaaatacttaatgcaacatcattagcatctttgaagcatctgttagataacctaattcattcaatagtgactgaatttatgagtttattgaagagttcccaaaccctattaagtgctggaaactgtgttagttcttcagcatacaaaagttgctaagatataggacctattctcaacagatgtaaactcatgagggagaaagacattattttcaagttggaagtatagaattagagaaatgcactgagggaggcatgcaactaaaattggataatgaataccgtggaaagattctcgaatgaaggaatgcctgaggtgagctctaaacactgagtataagttatccaagccagcctgtgcaacagatgaaagatttcaaagcctagaacatgtaatgagcaaacattagacaagatgtagcttggcacatgaaagaaacgacaagcagttgccaaatgttataggtgaattaggaagtttccaaaactcaggccacaaaaatgttcaggtatcaagatacagaaaattgtgtgagcttaaattttcttctctagaggaataggtgtcataaaagtatatcaaatagaaatgtgggccagacgcagtggctcatgcctgtaaacccgagcaaggtgggtgtatcacttgaggtcaggagttccagaccaacctggccaacatggtgaaacactgtctctacaaaaaatgcaaaaaaaaaaaaaaaaaaaattagctaggcatggtggtacaagcctgtaatcccagctacttaggaggctgttgtgggagaatcacttgagccagggaggcagaggttgcagtgagcctggattgtgacgctgcactccagcctgggtgacagagagaaactctctcaaaagaaagaaaagcaagggaaagaaaaaaaagaaaagaaagaaggagaaggaggggaaggaagggacggggggaaggaaaggaagggagagagaaagaaaaaaataatgaacggagagaaggaaggaaggcaggaaggcaggcaggcagaaggaaagaagaaagaaacaaaggaaggaaggaagaaagaaaaaaaaaaaagaaagaaagaaagagaaagagaaagaaagaaagaaaaagaaagaaagaaagaaaaagaaagagaaagaaagaaaggaaagaaggaaggaaggaaaaagagaaagaaaggagagggagagagggagagaggaaggaaggatgtagttagatgttagatttgagcttttgaataaatcactctaatggccctgcagaagatagacttgagtaagaaatcaagagaccaagaacatcaggaagtaattctaataacagaccaatagggtggtggttataaggatagagagaagaaaagagattaaataaataattaggggacaaaataggaagatctggaagatttcttagttgtggcgaataaagaaaacataaaaatcaagcaagacttctaggattctaggttgcatagcacaataaaacatctatcaatttctgggaaatgggttttaggagaggatttcatacagtactggaagtttaaactatttctaatattctatgagcttatttatattttatatatagaaactacatatgatatttttaaaaattttattactagaagactaggcatacttgttcactctctggacacctaatgacagtcactcaccatagattattttagaaagggggtgagtctaagtaataaacaaatgatcagttttgctgattaattacttgacacttttataaaagttatgaagcatgccaccctccatgtacatggcatcatctcagggaaattttctctccatgccctttcctaccagtcccaactaaagacacataccaaggcagcaatgattgctaccatatagatgactggacaagagggggcacctgatgagtatgaaactcacaatgttatacagctattacatgacagaaccaggagtcaagccaagatctgtctaaatccaaagcccaaactgccaaaaacacttcagagcatttcatagactaactggtactgtacatctccaagagttgaattataagtagtgtttctcaaaggttttagacccctgagctctctccactttatttcatcaatgccctgtgagtactactgtcttttacaaagttccttggaacacaattttaacatttgtaatttaaaagtgaacagacaatccagacaagtacggggtcacataggcaagcatagggcttagtgtgtaaccaatagataatatgaacacactgagaaggtataaatacataaattttgctattgtgtaaacttaaaactacctaactttagatttagatttttctaaccaccagttctattaaggtatgacctaagctatcatacactttcaaattgattagtcactacttaaaatatgagtatgtattcaattgaaaagcaaaatccgcactaaaatttgtgggacattagtagatctacaaaatacatttgctcagcctggattgaagttattaaggtgactctaggtgttttctagtggggattcagtagagacttttttcctgtgactcatgaaacccactatacatcagagaatccctaaattctcttgactggcatatgaaactgtgtatagattaatgtgttcacttttctaggaaaagaacctagagcattcttcagctatcattatagtcagactatgatcaaagtatataaaatatagagtgcttaaaattgagaactttgttttccataaaccttggcttaaggtccatttctactgtttactaacactgtgatcatggtaaggcatttaaactagctttaatatccctttctgaaatagggataattgcatctatcatgtttgttgtgagatttaagggaattaatgcaagaagaatttactgtattgtttgacatgtactgagaactcaatgacagatattgttaaaacttgtggtttaagaagacactaaatgtgagagaccaggaaagattgaaaaaaaaaaaaaagctagaatggaaaaagaaaacaaagcaaagagaaacaaaagaataaaataaagcatctggtgggaagaggtggagtgccaacaagaattgtcatagcctctgtggagtgttacaaaatttatttagaaagagaaaaaaaatctgaaagtgccttcctaatttcctgaagtgattataaagctatgtgtaatgagatattagggaacattctagagctctgctgccttatgagtgacatgtatttatatttaatttcattaatattaagcaaaatttaaaagttatgtttttagtccagttaaattttaagtactcaatagctgtataagactagtggctactatgttggacagtacagttacacagtaattccatcatcacaaaaaaatccatctatctgagagcaagcactgttaagggagaaatgaatgaatcaagaattatataacagcaagtaagaaatccaactatcttttacatatagttatgcttataatccaaacacagttgtatttacttgctgttttatatatatgtgtgtgtgtgtgtgtgtatgtatacctgtgtatatatctctatctatctatctatctatctatctatctatctatctatatctgtatgtgtatgtatacctgtgtatatgtctatctatctatctatctatatatatacacaaaacatatgtatacatatttatgcagtgaggatactgtggtagttcacaaactcaaaggaaaatctttgggaattagaatacctctggggaacttaaaacttaaaagacaggcactcaatgggactctcttttctgtgtgtatctctcaggcttcattctctcccactgataattggctttctcatgatgtcagcaaatgtggctacaaaggtttcagattcatttccacttctctaatacatgataccaaagtctttcagcccttctgttctccattgtaaattcctgggaggattctggctagcctggtatagattttctgtccctttataacattcactctggctaaggaggtaaagtgttctgatttgctcagcctggaccatttcccactcatgtagatagtgtgagtacaagaaaaacaaaagacaatgatttgtggagtgaagcgtaagcatccacatagtcactggcagaagtatgaatgggtcagctgcctcaaatatattttaataacgatgccctcagacttgaagaaaagtctctgagaatcacaatctaggggtgctttcatgattttttactcatgtagtaacaccattatttttgctttatcaataattatataaaacagttctcaacatatgttaataaaaatattgccctcgtcattaaataaacatcaagtaaaacattcattttcttacatatactgaatatctgcaagctgaaaaggaatagttattgaattcaaagatactttttaaaatatccttgttttggaattaaattataacactaaaactcacttacagtgacttaattctctcttctctagcttatgtagccatatctttgtcatatttcccattaatggaaatatgagatttgttacacaaacaagagcaaaatatgtatttaacttacatcttctatgtccttgtccagagctactattcttaaaggtgaagtcaaattgagactgtccgaaatggttgctcccactggggcagattccaggatatagccttgataactgggcattgtaaaatatggactttgattgttttcatccagtatttcaatgtgtagaccggcaaaggcaggaagaggatgaccattgtcttgttcagcctaaaattgaaaagaaaagaaaatatttagaaagtatatgtcgtgctatctttttggagtttcacttttcatgcaatatatagggttctctttttaactaatatcatcacataaggaaaaaatacgttaaagggccatttgaaaatataaatgaggaaatgaaaatccagtgaggcttaattgcttcagtcttctgttttaaaactcagtgtatattttaaaaattcactgtaataaattattattattttattttatgtttttattttttgagacagagtcttgctctgtcgcccaggctggagtgcagtggagtgaactcggctcactgccagctcttcctcctgagttcacgccattctcctgcctcagcctcccaagtagctgggactacaggcgcccaccaccacgcatggctaatgttttgtatttttagtagagacagggtttcaccgtgttagccaggatgctctcgatctcctgacctcgtgatccgcccgcctcagcctcccaaagtgctgggattacaggcgtgagccaccgcgcccagccaaattattgtaatttttattgaatgcagtaggagaggtaattgtgtttaaatacatttagtcagaaaattcaaatggagatacttgagtgtaccgctgataaaatatttaaataaaagaaaaaaagtaacacaaataaagaactatcgtatcgactttgtctcttctgtgtcttctcattttacactaatgtttaaatctctgctatggtctctgctgttgtaccccccaaattcgtaagttgaaattttaaccccaaaggtgatggtattaagaggtgtggcatttggaaggtgataaggtggtgagggcagagccctcattaatggggtgaatgcccttatagaaaagggtctagagggctccttttccccgcctcccaccacgtgagaacaagtaagaaggtggaaccaccctctgtgaggaagtgggccctcactagaaaccaaatttacaagagtcgaatgtccagcctccacgactgtgagaaataaatgttccttgtttataagccatccagtttatggtgttttgttattgcagctcaaagaaacgtagacaattcccaaataattcgtaattctatataaaattaataaagttatatttattgcccactgaccgtccccaaaagcttcttaaaaaggacagaaataataaatttcattgtaatgttgtagaaactgtgaattgcaatattatttaactagaaatgtttttcaagtaaaattaatattcttatgtataaattttcttttttttctcccattaagtttaagaagttgataaaaatttctgtttctaacacattttcatacaaaatctctacatggtcatgctgcacataggaaaatactaaccatagattttctgttttttaaaaaatatatattttattatatgtgtattggaaggtttaatttaaaggaagatttcatcacaattgacttctggaaaatctcctccaacttttatgagaaaacatggatataatttaatagcatatacatttattaaaatgaattcaaattctatctttaatttttgttatgttttccccattgggagaaaagttgtatttttaaatcaattaaaatgaaaataaaatatttgatattaaactctggtgtgattttctagatagatagtgacagtactttgtaagtagctcagctagagatctctaactgttaaaacgtgaggaaagaaatttggtctccagaagacaatttttcacttccttctaatagtaatttaacattttcatctgttaaaaaggtaggtaacaaactacagtgatattggtagggattgctgacttttcaccaagaaatattacaatatattttccttcatattatttatattgaagatttgttgaaatattatttatgtcaattactaatgtgaaattatgctaattaataaacccatagggaggtaatgtcatataatgcattgattaaaaaacttatatttgatttttaatatattgatatctctatttagataatatgctagattttcttagtaatattacatagtttaccttatgcatttaacttttcatttggcagcagaatgtcaaattagcccatggcacaaaacgctttaagatcctgctcagcactaagaagaacagtactggaataatgtttggtcctgtctgggattatgtatccatctcacataaccaggcatgctgctaataccatcagtatggatgaggtctttctgcatccagcagttgtgattaatttgtgccgagcgatggatgttcttttaggagttacccctgtgacacacatcaggctttctggagacagctgaccagggcaagaggtagagtctacgcctggaaaacattgttttttcactgtttaaaactaattggtccatatgggcttccaacccaatgaccttgaaatgatttaagcaggaatcctctgcttcactcttacaggctcagagcagttcatacatgcaaggcattttgaacagatttttttctctctttcttgtatctctccatctttctttaatatctaattattcttttttttttttttttttttttttgagacaaagtctcgctctgtcgcccaggctggagtgcagtggcgggatctcggctcactgcaagctccgcctcccgggttcacgccattctcctgcctcagcctcccaagtagttgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaataaccagcatgtcatatccaggacataaaaatgctatgaaaagtcataaattctacaacttttcctctttccccgatgaacacacccaaacacacacaatatataggtggtgaggaggatgaaaaaagcaaaattgtataataatgaaataagcttacattttacattcagatcatatatcattagtttttaccagcagctgtgaagccagtaaaaatatgtattatttgcatgatgaaaacaaagtgattcaatgaaaagagaaataaaattcaaatcagatctatgaagataatctaattcttaacttcctcatatctataaaaattacatataaaggctctgcccatttttactctaatattaatttagagttaataatgattaatatttttggattgctactatgtattttgttctatttgaggtgtttcaatttgctgaccagatatctgtctccaaagcccactttctttatgccatttatctgtccagatgtgaaaatgtgtatttttgaactgatggaaaaaaagaaaggttagttttatattcaaggccacataggctgtaagttacatacagaacatgggcccagactcaggtctcctgatttttaagaggctacacaggaagattcatcatatgtttctcaaatttacagaatgcaaatgaatatcgaaaagcaagagagatgggacaaattaacagtaggaaaaaatattgagataaatacttctgttaagtaagagttaaaatgttgaatttaaacaacaacaacaacaataataataataataataataataatatactttgctcgttagtgggcccatgcatcaaaactctgatacaattatcttttcttccatacaatataaataagggttctcaaaaatctgaattattctgttcccctgaaatccgtggtggatgaaatgagaaatattttaaaaacacctcagttggaataaggtggtattttaaaaatcatttactttcataaggtaaccttatttatatttacagagtctatagttacgagttaaacattatatttaagtgctaggttttgtttgaaaagcgtctgggcatgagtctcactttcagtaacgagaccaaagtaaaactgaagccaaaaaaaatgaagtataaaaagcacaccattttgttactttggaaggcaaaacattgaaaaagacaaaccactccatcttcaatattgaaaaaaggaaatactgataatttctgagcaccttgtaacggaggactgagactacagaataactttgttcttcctaactggtggcaaacaatttaacaatttcataatctctaatatgaaacctttcaagtagattcaacaatttaaaaaagacaatggtaaagcttatcaaattatttatcatttaaataaattctaggatagaagaaagaaatcatgttttccaggaattatttattgtgcatctacagagcccactttttttttttttttttttttgtattttaaattctgggatacatgtgcagaatgtgcaggtttgttacgtacgcatacacgtcccatggtggtttgctgtgcccatcaaccagtcatctacattaggtatttctcctaatgctatccctccctaggcccccaccctcgacaggccccggtgtgtgatgttcccctccctgtgtccatatgttcttattgctcaactcccacttcttagatcgcaagtgctcaccttcatctgtattcaccctcccaagttttcttaaacccacttcaatcatacttttgcctcagccactcaaagccagctgcttttgtcaaaatcaccggtgccttttacattgctaaaagcaatatttattttcagtccttatcttacttgacctatcttcagcattattcactatcctttcacggcaacagcttctcggttctcttcctattttactacccattttttctcattctcgtttggtggtttccccttttctcccctacttaattttggagtggcccagaagtgaggagttattcatcttttctttatactcactcccttgctcaatctagtctaatctcacaccttaaaaatgtcagtactattatgactcctaatttcaatctccaacctggatttctcctttgaattccacagtccatatccaactgtgtacttcgtaacactgcgtaagtatctaacagacgtttcagatataaatacctgcaacaatgaaattctgattaccctgcacgaacctcctccactcatggtcttttccacttctttaatggcagctacatagttacaggtaccgaaaacaagaaacttggaggcacctcttgcttcagtggatagatatggaaaaagtgaaaaccacttttttgaaaattgaatttgaagttccatcttctcatttcacaatacagtattagcagattatatatgccaagaaatattctatgttagtaaacttgagatgaaaaaatactcttatgtcaatgtagtgaattatggtcttatcctactgaagcattaaaggtaaatattgcaattttcaaagttaaggtaataccacattttaatttggataatattataaatttatgaaatatttttctatatttataatatgtaaaaatagaaatataatcatattgcttgtatagtaaattccactgttctatgctattgtaaacctaaacctttcttgtaattagtctgaatctcatttttcattagatttttaaattccatgagcataaacactgtaaatgtatcagtttcattcactgctaaaatttcggacaatccctggtatatggaagaaggtcaaatatatatttatttttacttttctgtatctttaattttaataggctttaaatatttttttaaaaattaagtgattgtgacatcattctaattcccattcgatagatatttatggatgtttttccagtgtgtgtgtgtgaacgtacacgaagtggaaattaattaatgtgaatgtacaacatgaacaccttagattatagaatgtctttattcacacattttaaaggtttgtgatatctgcaagtttacctatgggtaattaatactgatgcacattcttgccagtcttatgaatgggcctcacccagccccctcaatcatcaattatgattctatatctatagggatggtgctgtgaacagaataacgtataatcttctagaaggtttatgcatttacatgtaatatttatgcaaaaaggcctatttatatgcatttttgaatggacagtggcttaaagaatgagatgttagttgtgactttgctcttaacacatggcttagatacattttattgtcagaatggtgcaaattgaggactttagcatgattttgactgtgtgtactcttccagtccactcaacacattttaatttattaatttaatttacttgctttacttactgaactatagcttttaatacctagttcttagaacctgcttggccaattttcgcaaacattagatatcttaggaagagaaaaaaaaaagagggagggaggaagaaaaagagggaataaaggatggatagagggagtgggtaaggaaaacaaatggcattctcctttcaccagaggtaagggacagataaatgttaaaaatcatggcaaccacacaaggcaatcattctcaaactctgatgtacctaagaatagaatggaaggcctaataaaaagcagattccctgggccaggcgcagtgtctcacgcctgtaatcctaacactttgggaggctgaggcaggtggatcaccagaggtcgggagttcgagaccagcctgaccaatgtagagaaaccctgtgtctactaaaaatacacaattagccgggcatggcgctgcatgcctgtaatgccagctactcgggaggctgaggcagaagaatcgcttgaacccgggaggcagaggttgcagtgagccaagattgcgccactacattccagcctgagcaacaagagcgaaaccccacctcaaaaaaaaaaaaaaaaaaagtagtttcccacaccctatccacaaagattctcgttcatatgttgatgttagaggcaaggaatctccatttttatcaaactgtctgtggtggttataatgtgagcagaatgtactttcacagacattattctgggtgtggctactcaaactccaatttttagagaatctttctttttagccctattggttagggctattggttagccctattggttagtggaccagtctttactaatggatagtccttataatctggagcaaaaactccagataatacagtgcatccaagagccaatgttgtcacgccagaagatttggagtctagtaactgaaactgcatgcaattatacaattatcaactgtgtaggttcaacaccactaaaattgtcatgtgactctagcattaccaaagattgctcgtgtgtcagtgggaatactctacaagtaataagctcagtcttagctagtattcataggtcatggtcaaatcctcttgacattccattattcataattaattagaatttaggtatgttggtgtatgtgtgcacgtatgcctgtgtatacacagtatcaatatagttttgggtgtaagccaccacttttactttatcatttttaaataaaggaacctcagattgagaaaaaaagcagagagaaggtaatttgacatacagaaagtttttggtttctagtcagagtcagagaaagacaaacgcatatagaatgtacccggaaggcagataatgacaacattctgagtaatagtatattcctgttgctagtgactaaacataggatataaggctactatgtaattcaaaattttcttcttcctgtgttcccttcctggacaccacacctcttgctaaacagctcttcagtaaagccttcaatatacaagggtgtaatttttccaagtttcttcacccagcaaggtgcaggctgcatattgatctttatatgaggatgattctgaaaaacgggcaaattgaccgaactaccaatgattcacgcatatccctttattcctttattttcaattttaaattcaactctcaagtagacaaagaagattgtttgctttggttaattttgctggagggctaaattatatatcctgtctttctttatggatagaaattgcatttgcttaacattttaaaaatcactttagacagttaaaatatgtttacttaagctttcaaccaatttattttttggcaataacaatattattagtgtataaccttcaaatagcctgacatttggacatgtttgtcttgggattcaaacgtgaattacttgtacttttattttgaaatcaaaatgttaataaaagtctcagatttttctttagcagacaattcattgccattgaattttttcacaggtggaaagtatatggttgtggaacatatacatcctgagttggttacagtacagaaaaatagaaggaatcataaaactcttaagaatctgattaaaaacatcaacatttaatccaattataaagtgttgcaaaaaaaaaaagagaaaagtaatctatgctgttagaatcctatagtggaagtttgtggttgtgtcaggtggaggtaaggtgattagtgactaggaggaggtgtaggaggcgtatgggatgtttgtagcatctttttttaacaaaaatctggttgttagttacatgattaacttcactctgtgaaaattcatcaagatatacactttcctgtatgtcagcagcatgtcagcatttcaataaaaatgttactaaaaaaataagctatgaacttgctccccaaaaaagtgtacatagactatcccttcctctcctatcacagtaaactaggatacgggcgctcaagtccaagtggtaatttaatagcagctgccctaggaagtgacatggaaaaccaacattatgaagatacgtgaaaattaaagatgctcccctcttcaaccatctgtgttcattaaagatggaccccaaaagtaaacttggccttttgcactttcccactaagtgtttcccaaatactgtggtttccaaagccctgcttcttatctgctgccttaaaataatctaaggtaattgttaaagcaaattcccaggggctcaaccaaaatatctgacatgtatctgctgtattgcttatttgttttctttattagtttaattttatcatatcttcctaagttttcaagtaattttaatatatgacttgctctcaaaatttagcatccgaaaatcacatgtaaatcttgattctgtagggagagccctgaagtctgcctttccaaaacagccacatcccctggtcctggatatgtagaatcagtagtcgtttgggatcagttggatcaggcattttagcttctctcacacaggcttataggtagctgttacactaaaaaagcctagggtgagcagctgaggccaactctgttctagccttttatgtaagtcattatcactcttcttcactttcagcaaagtctcttaatttggacttagttggaaactgaatggaaggaattcatttatgtaagggaattctctgtaggatcctgcagctcactgaagctctacaaaagctataggtccaaagcaacagtaattggtaacaggttatcaggttatatttcctttgtgtgtgtgtgtgtgtgtgtgtgtgtgtgtgtgtaaaatgtcttagggagggatgactgtgaataacctgtgctccatgaatcaatgaacatattatcaactgactaaaaattattaggtttttgccattaaaagtaatggcaaacaccacaattatgtttgcatcatcctaataaaaataagaatatcccattgattcttgaccctacttataaaattaactgccttaaaacctacaggagcctccttttattcaaaatttaatactctaaaaattaaaggatgcatatacagtttgactttaagccaatttattactattactaaacatactcaaaaacttataaataaattcaaaaacctataaaattcatgagataaaatacaaataactgttgtatgctgtaaagtttgtttgcaaggctatacagcaaaagagtatattcttggttggaaacaaatacctttttttgtatgacaaaaaggaaaagaaacttcactagatagaatataggcagcacatattttataaagccttgtaatataacgacgaaataatactgacacatttcacacctagggaatatttttaataaaacgaaatactttctatcttcacttcaagtaagaatatgcccattctgtttataacttgttacaacgaacacatgaatcctcaaagctcttgtatacctttcaatgataaaaatctttctttttgcttagagcatgagatacaaatcgacactggaatgactaaaaggattttgaatgatttaaagaaaaaataaccttgccactctggggaagaccacagattctgaaaactctcacttatcaccgacatgttgaactatttagctggtgtttggaacgtgagaatcatcttgggtataaacagcaaggtcagccagatataaaattctgatagtgataaaggggtaactttttttctgtgaatcttccaacttatgttttatttttattattttatcctgccttttgccttccaaccagcaaagccatcttatcctacactgaggtctgatcccattcccagttttttgtcaaccaagagaaaaccacactaaagtaccttctatgaattagccaaccagaataatgtattttgtaataagcaaattttaaaaaatcattaacataaaaattatatctaaatcgtttatttttcagagcctagaaggtattgagggtgagaggtcaatatttctcctccacctactggaccgttcttgagacaaaaaataacaaagagttttagcctacaagtttttcaatatgctctttcattgttatatttctatggaaccaagaaacctatgaagaacgattactcgggaacatatgtgatagagtgctaaggatgtttatgtgtgtggggattgcagagtggggagacgtgacaagggttcagaaagtgcctttcctttgaacattttacaatgtttggtcttgctcttgtactcttacaatgacctttgcagacaagaaggccttggcaaaaagcaaggtactctgatgagaatggataaattgcctttcttcttcccaagcagttacaggtcaccttgtgaggaagaaaaaaggccaaataaaatgtcacctctgtgtgtcttttgtcagtttgtgctttttgacagccactatattcaactgctacattctatttctgttctaacactgctgcatgaataacgatatgagacaagaggacatcatacttcctttccttttattagcttccataattggcataatagttaattaatttaggccagtacttagaattgttagagacaaaccagtggaaaataaaaacacacggtgttctttctgaagaaacacaaatactgttttgttttgtgtgtgtgtgtatgtgtgtgtgtgtgtgtgtgtgtgtgtgtgttttggtattatttattatttcctagtaatggtagtgttgctcttcggcaatatttttgctttgattaaacttaactcattaaaacaaaagttgtaaaaggtaaagtttttagactgacttctttttgagcttctacatcctctgtgatgtatctcagtatgttatctgagtcaaattgttgctgttctcatgatgtgttgttggatatggtatcaggcaccctgtggaggaactctctggtgggaggtggtgtacaacgtcacactgtagcagaaaacctgaaggatactcttagctgccttctctggcatttgatcccttagttctatccaagtgtatcactttatccttaggcagattaaatttcatattatacctctgagctcatttacttactctgttacacttaaggtaaaacagatatagtcatttgtcttaaccattccctcttatttagtgatatgttcaaatttcctaacataaaggcttttcttcatcattaattagaagcattagtgatcttatatagagagtctcgtggaatatagttttctcccaaattcttcttggccctccatttttaagccagttgataacatccccttttgttagttggatgctatgacatatcatgacaaaaattatgctttgtgtggcaatctgctaagtttaaaaaaaaggagaacacaaaattaaaatacgaacacttagtgtatcaaaggtcaattgatttcagaaattgtaatatttgttggaaattcatggaaagattgctatttcattactaataacaagtaatgcctgaaatttctgtggggtgattttctctaaaatgtgtaagagatatttactttgccttaccttagagacctggctattggggtagaaaagataaacttattatattatttagtaacctactgaactgaggtgtggtgtgcaatggacttaatatttgtatctctccaaattcatatgttgaaatcctaatccacaatgtaatgcaattaggagaggtaattaagtcatgagaatagaggtctcataaaagtagttagtgtccttacaaaaggtaccccagaaagctctctcaccctctcaccctctcatcctctcatcctctttccaccaagtgaagatacaaacagaatttggcaatctgcaacccagaaaaggaacctaactagaacccgaccatattgagtatgaaattccagcctccggaagagtgagaaatatatttctgttgtttataatccacccagtcttttgtactttgttagagtggcctgaactgactagtacgtgtctgtgtgtgtgtgcgtgtgcgtgtgcatgtgtgtttgtgtgtgtttcattcttgccataagaataagagtaggaatatattgctagaatatttccagatatagaagatatgtcatttgtagcatttgtcttccttcttgtagcttggcaatagcagccctgatgttttttctcttgtcctaactctgggtcactatggaccctgttcaacctcaccttaaaggagtgccaatcgtttccatctcttgtctttttttttcctctctctctctcttttgtttgaaaactgatgatatacacattagagtagaaagaatataacttatatttcacatctccataacagatttaattaattttattagctttttcattttcacggtaggttccatctttttcattttgagaagtgatgactgatgatctttgacttgctactctgcctgacttagacacctgtgatctttcaacttgacaacatctctgtgggaaattcaggtagggggcaaattgtaaattggcttgaaggcaacatgcagcagcatgatctattttttgttgttttagcgatactctgttggcagtgtgaaaagatggacaagatgcacagaaatgaagcatgattttagagactgcttgtgtaagatcatgggccaagagaatgcgaaataaagaattgcagtagatgagcagagttgagatattcaagaggatttcaaaggtatcaggaagggattctatgagtgactgagtgggaacatacgagagaagagacctttgaggaagtggaagtgtctagcttgagtgggtgaccaactaaaatatgattaactgaaaaagggaatagaaaatagaaggtttggaatttttaaaggatgtatatagtttgctatatttttaatttgtcacaattaaataatactaggagtagttatccaaccaataattgaaaagatgtccgtaggcatcagaagtaaaatatgtctcctcagaccaagaaaaatgccaggcacctgagaagcattcaacaaggattagggaaattgaaaactagcaaatgtcatatgctttaaaatcattgaatcagggtgttctcttaaatttctatgaagtaaaatatgatttttatcattactcaaatagtgactaaacattttctagagttatgacattagtgattcatgtagggacaggggttgtagtagctgtcctcctcttagccctcaatcatttctcaaatgctgttttcctgtaactctcaaattactgaaggatgacaccttgccagggcatcaggcacatcagcactaagaatcaagctcactagttttaattccctggctaattttctatggcaaatatgtaatttttctttagaagaaacacattttttgacgcagtcataagtagctttagttgtgccataacaaaggtgtgacattttttctaggcattgaatttatgtggaaatctatttgctacatttgcatcttttttttttctggacagagatgcaagatcaaattgtatcaaatgcacacacattcacatgtaagtatttagatagagtgaagacgtaggtacacagattcagcagtctgaaaagatttactgtgccagggagaaaataattacaacaaatgtttattaagcagcttctatgtgctgtatataggtaggtgtaggggcatgggatgcagtgtaaataaatgttttgcaatctgccctcctgtaaaagttgggagaaaataaacaggtacattcaatagagtaattggggccactttaggggccaaaaggctgcaaaaaagcagcttcctaacagtggctatgcctttcgagggcaaatgtcttcttagttaaaaactgaaacatcagtttgaattagactgttgacaagaagagggaggaatgattcaggaagagggagagtatctctaaatgcttagatgtcagaaagagcatggtcagttgagggcactggaagcggtttagtatgtttggaacagagggtgtgcaagttaactagtgagagctcagggttagtgagctcatgagttggaaggaaaagaagttaaaaggcagcatgctagatagaataagtaggtcagtgagtaacaacatgaaaatcagaggaaacatgaaacaattatgcttctaatttcattgtgatctttgctcttcgttgttaattaaagggatttagattaaaacatgcaattgttatttgaagaactgagagacagtaaattattcaaaatttatccatttaattggccttaataattaatgactagtagctttgtattagatgcctgaagtataaatatatcaactaataatacttgaaaatatttcacttacaatactgaaagtgattttatggactttgtaatagatggtccacacgtgaactaattcactcttaccagagttcttaaatgtgctttcatatttttacatcacaggtggtttttattttatgagtgtagtgatcaaataacttatccaaactgggacatttaaaagagcaacagaggtattatgaataattacacaaagacaatggacataaacatgtactgccctgggtaaaccaaatctatgattcttgttcacagtgtatatcacattttaaagtatgcttaaatgattacaattatataaaatttaggatagtgttttggaatggaacaaactttttcaactgcatgttttaatcttttcatagtctaaagtttgtgaactattccattttgtcttccaagttacacctttacatttttatttgtcagcatgctgaataaatcactgggagaaaaagagaaaaaaatgaacatgagaaatctctaatttgtggcactcaccagctgttaaatacacacatagctttttaaagcagaattcttcttcaaaatgtaggagaagagacttcattttattttttctccgcttttgaaacataaattgggatctagtccaacaaaaacttttagggccaatgaaaaaatgaagtattattaaagtaaaaagagagagagagagaagaaattgaaagatttactatagaggagaactgccagattgtagcatttcaatggtcccctgaacaatgccacaatactcagttattattcaagcaggtggcacattattattacagttagatacctttgcttattatgcccttgacttcacacaaaacatagtaatttgaatctaatattgtctgttaaaacttccattaataaaagaaagtgctattaaaacaaaaaaaaaatctgtggcctattgtaattgattttttttctgtaattgatggactgagttacactgtacccaggtacaccaggacagctgaattcgataataaaggaaaataattgatttttggtttcacatgtgacagtttggaaacagtgctttgtcaaatttcttaattcccatagaaagcagcaccacaagagtcaggtagatccacaatagaaaatcagtacacattgtggagttttatatactctcataataattaacataaaatagtcaatgtaagaaggtgaatctcatgcatggccatttaatacaactggttaaagtggtgttttttgttgaataactcccaaacccttaataaatgaaatcccaggaaactgtagtcatccttcaggctctctccgtggtctgacgctatacctcatttccctgttaactgcttgtagcctgtgcattatgtctccaagcgtttacttctgtgcctccttatgttcaaacatcatttcccacttttattcattgaccatactctttcaatccagcaacatttagcttggggtgatctccagaaaatcttccctgagtttccagattaatttaaatgtccctattctgtgtgtcgttaccgctttttacacgtcttcctcttagcatttgatgcattttatctgatttatttgattatatgactgtttccctttctagactataagttttttcaaggacaaagatcgctgaataaacacaggttctgtgctaaggacatatctattaattgttaaactagacaaccatttctaagtatctgcatatttgtgaagtgaaaagagcatggctttagcgtatataaaactaaatttgaatctcaactctgccccttattagtaatgtaactctaaggtaatcacttaccttatccgaactttagtttccccattttgtgcaaatgagaatattactaaaattgcggcaacagttcaatgaaaaatgcacacaaagcagcttaaacaatgttcattctcagtaagcttccctaccttacttccttttcctttagtatgtttacatttttcaaaaggtaagaaaaataccatcgggatgcatttctagaggttttttttgcatgcttaaatatgagagagttatgtactatatacaaaacttatgctgaatctttgcttttgtcttttcttgtacttacaatgcccttttcccagtcccatctctgcctggcaaattcctgtttttccttcactgcttagattaaatctcaccatctcaatgaagtccatcgaaattaattagaagaatatctgcattttttcagtatctatttaatgattatattaaaatatagatatactattaaaccaaaagtgaaatgccaaatagattagcttagctttgaattatttcaagtctaagatcatctttcaatataaagaaaataatgagacatatattgaaagcatctttggataggcaagacctcttatttttatgttggaaaaatcattaaaaatacattagaatacaattaagtaataaaaatgaaaacaaaattaaaacaacatataaatcaagcacattttagatgtcttaattggtcatgtttttgtggtaaaacgctaattccttttagtagaaaaataatgttagaagacataatgaattgtgtagaattgtatacgcttgaccaaggcatttgttacatataagaatatttagtattttaccccatagtactataaaacgttattttagagaaaagcaatgccatgtattaaaagtgggcttcgcttattttctttttaacaaaaaattgactgactgctgtccacattaattttaattttataacataaaactgcctacagtagcgtctacagatttatctgattagcagttcataaacacaaggaaataagatattagcttaatttaccttaataaccaaatcaaatttctggtgaaagtctctgtttactggctccaggagactaagttctgctgtcctaggatgcatatggaaaaatcgtgggtaatcctcaggagtccctggaagacattgagatttcagtacataattgagaacaataagtaatatgtgtatctgctttttctatttcccttcatcagctgaggaacaaagctacaatttcattagtaaattaagtttcacaattatgcagttcagggaaagcagacacaaatgtggtatatagttattaataattagcatatcagtaagaaaatggaaaatgtttggatgatttttgaaattttttttattaagagggctctaattaatttgaatcttcatcacatgaaaatagacattaagtggagggagagtaaattttttattatgaaattttattttaatggtgcataaatcttaattataactgtttggtctttcaacatatattgtaataaatgattagtaatttgtaccaaatagtgagatgcttggaaattaatgtgaacatattttgttgcatatattatttcttaagattaatatcaagctaataatgttaatcatagtaaattaaatataggttctgatgatactcttaatgtctacacagggtatttatttatgtatttatttttgagatagagccctgctgtgtcacccaggctggagtgcagtggcttgatctctgctgactgaatcctctgccttcccggttcaagtggttcccctgcctcagcccccaaatagctgggattataggcgtgtgccaccatgcctggctattttttgtatttttagtaaagaaagggatttgccatgttggccaggctggtcttgaactcccgacatctggtgatacacccacctcagcttcccaaagtgctagaattacaggtgtgagccaccacgcctagccaagatggtatttcttaatgtattttaataatcaatatacatttcttcatgaagaaatgtcttctaattgtataatcttcctttgtgtactgcaacattcttttcccaaaatgaagaagtcaaatcataaaattgtatagtatatacatttgtaaaattaataaccataagagaaaaataatatagcttcctattatggaaacctactctgtgctaaatgctttatataactaatcatcaataactaaatcatttacattttacagatcatgacttgggagactggggagattaaatgacttatttaagttaaagggacaatctgaaacagagcttttattaaaaatccaggctgccagatgttaaaacacatccaaaaaggggcttattgttactacttattttcctcaactctgagacaagaagggaaattctactgggcagtaaatgagggggaaaaaaaacagaaacatatttcacaccattaaaaccgactgtaaaatctacaaatagtcaaaattatagatgaaatgcaatatatgataaagaagttatccctcctaataggagagtcatacagaaaatcatagagtttcatacattcttcatggaatatacatgagcaaaccccaaatgaagaagatattcataataataaaaaaatgagcactagtcatagatgaaaatgtggataaattttactctaatgtgagagtgagcaaacctttcctaactatggctcaaagtcaagaagtcaggaagaaaaagagataagtttaactatattgcaaaattgcatggtgagacacaatgaacaaagtaaaaccacaagtgacaaactgagaaaacatttgaaatttatgtcgagacggccgggcgcggtggctcacgcctgtaatcccggcactttgggaggccgagacgggcggatcacgaggtcaggagatccagaccatcttgcctgacacagtgaaagcccgcctctactaaaaaaaatacaaaaaattagccagcctggtggcgggcgcctgtagtcccagctacttgggaggctgaggcaggaaaatggcgtgaacccgggaggcggagcttgcagtgagctgagatcgtaccactgcactacagcctgggctacagagtgagactccgtctcagaaaaaaaaaaaaaaaaaaaaaaaagagaaatttatgtccagacaaaatgttcatatcccgaatatatatatataggtttataaattagctaaaaatagggccagtgagggatttaaaaagtgtggggctggctcggcgcagtggctcacgtctgtaatcctagcactttgggaggctgaggtgggcagatcatctgaggttaggagttcgagaccagcctggccaacatggtgaaaacctgtccctactaaaaatacaaaaattagctgggcgtgatggcgcacgcctgtaatcccagctactcgggaggctgagaaaggagaatcacttgaacccgggagacatggaggttgcgtgagctgagattgtgccactgcactccagcctgtgcgacagagccaaactccgtcacaaaacaaaacaaaatgttcggggctagagaaaaaactgttcacagaaagagaaaggcaaatgactctagatcataagcaaagataagcaaagatgcttatctcgatacataagaagaaaactacaaattattcctacattaagatttcattagtcacttagattagcagttgtcccagttggagactgtactctgttggcgagcctgcaggaaaacagacactttggacactggtggtgttaatacaagtgttgtaaaatttatgaaggagagtatgacataagctaccaaaataatattaatgtttactttttgacccatacatcccacatctggacattttcccatttataataacggaagataaatgaccacctaaatatacatcaatagtggtctgggtaaataaatggtgatacatcctaaagcagatgataattcaaatgtaatgataaatgatagatatctttagctattactatggagttattttcagctatattaagtaaaaaaaagcaatttggaaacaagggcctataatatgctaacctttaagaagaatacacatgcatatttacaaaggaatacatacacacatttaaaaatcgaagatagactgtaacataaaaaattgttacttatgagaaagagagggaacacgtggagaggataaacactgaaactaaatttcattacccatatcaagttttttacattttagagctacatatgttatatattattataaaactaattaaattcaaggacttctctaaaaataaaataaaataattcaatctaaatgtatatttagttgttggcacaagcacaaacaaaaagaactaccccaggtgaattttaaaagtagtactgacatcacacccacagtgtaatataggtgaagtaccagagaaattacaaaactcaaaaagttaagctatctacagtaatcatattggtggtatgttgtgattccaagatagttataggagtattttacaataaataagcacattattatgtgtcattctgattctattcttttcagtattgaaagctggattcttggcaggggatgataaagagatagaaattaaaaattaaagaggtaaaatagaacacctatggttttgattttgaattggcagtggaagtttaaactcaggttgtagtttatcttaagaaacaaaatgcatacaacacagctctgaatgctgaaacacagaactatatataatggccaatatagaagcgatgaatatttctaatgttcagactatggttttgaaatactatttaccaataaaagcacttaagatttctgagagagagagctgatttcaggtccagggcagaaaatcaacaaatagctgtgaaacatctgctcacactaagtagcaagaaagaattccgagactactaaactgatttgaaaagttttcaagagccaaaaggcttttttttgtttttttgttttttaagctaaagataagacaatttgagcatcaataaggatcatatcagtaatgatttgaaacagatcaaatatgtttaaattcataagtttacgagtgttgcaaaataacgtattgatcacttttggagcatgctagagaaatattttgtaaattagaaaataagaaaacagagcatgctttttccatatgagcttaacatggggtaaacaaataattgattaaaaagtgtctcattaagaaactatttcagctaataatttaagaagagtaatagtatcagagtgccatcattttacaacccctcataaatgaatggatcatggcattgagcactaaatgctgctaatatcacaaaaaaagagataaagccacatacataccactcaatagaagaattaattcaacatcatctgctatggcctgagttgtccccctcaccattaacaattttatgttgaagcccttactcccaatgtgaccattatagagagatagacccttttaagaaggtaatcagattaaatgagtctatatgggtgggctcttaaatctgatgggactggtgttctctttgtctctctttctttctatctcttccctctctctctgtccaagggcacacagaggaaaggccatgtgaagacacaagaaagcagctggagaagcttcatcaaataccaaccatgaaagcaccttgatctcaggcctccagaactgtgagaaaacacctttctgttgcttaagctactcagtctagggtgtttcttaatggtagtgcaagcagactattataccacctatgaaacagttttgagaaaacccaacaaagaaacaaacaaaatatgttatttgattaagtgtcaaaatttataggaaacatgggacagagtaacatgtaaaattaaaccaaggaaagtacaatcaagatgacgagaaactctataatataaacaacttgacttctcaataaatgaatcacaagaaaacaatttaaaaataaatggaaagagaaccactgtagattaaaagagacttagggctgggcgcagtggctcacgcctgtaatcccagcactttgggaggccgaggcgggaggatcacaaggtcaggagatcgagaccatcctggctaacatggtgaaaccctgtctctactaaaaaaaaaaaaaaaaaacaaaaaaaaaacaaaaaattagccgggcgtggtggtgggcacctgtagtcccagctactggggaggttgaggcaggagaatggcgtgaaccaaggaggctgagcttgcagtgagctgagattgtgccactgcactccagcctgggtgacagagcgagactttgtctcaaaaaaaaaaaaaaaaaaaaggagacttaggagaggctgggcgtggtggctcatgcctgtaatctcagcactctgggaggccgagacgggcagatcaccaggtcaggagatcgagaccatcctggctaacacggtgacaccccatctctactaaaaatacaaaaaaaaattagccaggcttggtggcgggtgactgtagtcccagctactcgggaggctgaggcaggagaatggtgcgaacctgggaggtggagcttgcagtgagccaagatcccgccactgcactccagcttgggtaacagaacaagactccatctcaaaaaaaaaaaaaaaaaaaaaaaagagacttaggagaattatcaatcccaacgtgtgaacttacatgaattctggtccccttgcatctctccctttccgagaaaaacaaaaacaaaaaaacagaaaagaaactaaaaaacaaaaataatatttgtgagaaagtgaaaataaacactgactgatatttaatattaaataaggattgttatactttttatttgtgctatgatattgtcagaatgctctaaaaatagttattttataagcataaattcaaatatttgtggattaaaattatatattttttcaaaataatgaggaaaaaaattgatagacatatatattttaataagtttggccaagtcttcataattcttgaaactaagtgatgccaaatggtgattttatttactatctcttattttatatatttttaaataagagttttcaaaaatgcaatataatttatcatttgctttggtttgcttttaccctagctttcatcagcatagaatggagcagggctcctggaagaatgaacccaaaatggtgaagataattgaataatagccgctgagctgggaaagattttcatttcccagagagtaatacttactagctgttaactagttactacggtgaaaatgttataatctctttatttgtaaatgatctatctcatctaagtttcaaaacaatcttatgggaaagatatttattgcttgatctgtgaagaaaccaacactcacagaagttaagtaaaatattctgaactctcacggctagtaaatgactaggtcagaagtcaaggtatctaaattcagagtgtaaactctttcctgttatgctatatagcctgagttcagtgaattagacactttggcttcatcggccatctgtttctggaaggttggtttttagacatccttacagaatatcaactcaacaagagtataactagcaattaaaaaatacatctccttagcactttgggaggccgagacgggcggatcacgaggtcaggagatcgagaccatcctggctaacacggtgaaaccccgtctctactaaaaatacaaaaaattagccgggcgtggtggcgggcgcctgtagtcctagctactccggaggctgacgcaggagaatggagtgaacccaggaggcggagcttgcagtgagccgagatcgcgccactgcactccagcctgggcgacagagcgagactccgtctcaaaataaataaataaataaataaataaataaataaataaataaataagtaaaataaatacatctccttggacaaagagtaaaaccaagtgaaatttatttccctgcatttcttaaaagtgtaatgcttttccagcgaggactaagaacacttaatgtttgtgctttcattatacacaatgtttacagtcaacctaaagctgttctttagaaacaaaaaattagccgggcgaggttgtgggcacctgtagtcccacctactggggaggttctttagaaacagctttgattgcctaaatttagatgtaaaattgataactatgtttattatcacaattataaataatacggtgaatttcagcattataattattagagccaacataattagtggttgccaaaacatttattttaatttttatatatgctaagaaaattctacgtttttcactttttcagtattatagaggaaatggcaacctaaattaatcccttggtgaaaagtttacaattttgaagattacgggttttctgtaggataaagaaaaaatgctacacaattatcttcatatatttaaaatgtagaattttaattacacgtgttgatcaagatagtatcaccatgactaagatagtaagcctatccataattgccagaaatttccttatgacaatgtctcctttctctccccattcatatttctcaccctatgcaaacactgatcactttctgtctgtcagcataataggaatgggatcatttatatagtatgtattcttttttttttttttaattttgagaaagagttttgctcttttttctagtctggagtgcaatggtgctgtcttggctcactccaacttctgcctcctgagttgaagcaattctcccgcctcaacccccagagtagctgggattacaggtgcccaccaccacgcccagctaatttttgtatttgtagtagagacggggtttcaccatgttggccaggctggtttcgaactcctgccctcaggtgatccactggcctcggcctcccaatgtgctgggattacaggcatgagccaccctgcctggccttacagtatatattcttttcgtaggtgtgtctggcttctttcaattagcataatgattttgaagtccatgttgtttcatttatcaatagtttatttatttctattgcctaggtgttattctattgtatggatatgctacaactcatttatctattcatacattgatgaacacttgagttgcctccagccacaaataaagatgctatgaactttcctgtatacctctctgaatgaatctatgctttcatttatcttgagcaaatatctaggagtggaatggctaggccatatgatatgtctatgtctaaatgttttattaagaatttttgggcagggaacaagtctgttaattttcagttacgtataggtttgtgtagtcaataccacaatcgggatatagaatggttttatgatcaaataactactttgtgttttccttccccaaagttaaatctttagcaatgactgatttgttcatcaccaccgtactttcatctttttgagaatgacatttagatggaattgtgtagtataaagatttggagactggcttctttcaactcagtataaagcattagagattcctccaagttgctgtgtatcaataatattatattttcattgttgagtaatgtttaacttttaaagaaattgccaaattatttttccaatgtgtctgtaccattttacattcttaccagcaatgtatgagcatttcagatcttccacattttcaccaacacttgatattgtcagtcatttaaattttggccattctggtgtgtatgtagtgatattcattgaggtattaatttgcatttcccaattagctaatgacattgagcaacttttcatattcttattttgtttataaatctgtaataatttgttaaaactttctgccattttataattgtctcatttttattaaattgtgttttcatatattccccaaacaagtcacttgttggatacatttcgcaaatacattctccttttctgtcagttctttttcagtctattgtcagtgccttttgaaaagcaaatgcgtttttactttgatgaagtcaaattttaaattttttcttttatagatttgcatttgttacatttaagaaattgttgccagccgggcacagtggctcacgcctgttatcccagcactttcgaaggctgaggtggggggatcacctgaggtcgggagtttgaaaccagcctgaccaacatggagaaaccccgtctctactaaaaatagagaatcagccaggcatggtggcacttgcctgtaatctaggtactcgagaggctgagggaggagaattgcttgaatctgggaggtggaggttgtggtgagccgagattgtgccgttgcactccagcctgggcaacaaaactacgtctcaaaaaaaaaaaaaaaaaaaagagaaattgttgccaaccctaaggtcataaaaatctttaccaatattatcttttagatgctttatagttttagctcttacattatgtatagaaagtctttcaagttggtttctatagatagtgtgaggtacggattgaagtttatttgtttacatatggctgtccaattgttctgcaatgttggttgtaaagattaacttttccttcttttaattgtcttttgcttcatattatttttgaagtgtttataccttaacagttttttctcatagctgtatttgcctatcatttattagcataatacttctgattccctacatatagtaaattgaaggaaatgtggatgcctgacctaaactatataattaccacttaatctttcaataatttttatttagagcaaagaatcagaagatggatgtacaatctgtaccacaaaaataatgggcatctagaggaaaggccctctaatccctcatcttgaaattcctgtttctgcttcttaaaatgttattgtttttgacagttccttgaattctggaagaaaacaaagtcctttcaataaatttccttaaacgccaagatgaacttaagttcacctctgtattttttacccaaagaggcccattcaggaaaacatttgtttttaatgcttcatacatttgaaaatgcacatctaatatacttcaaaggagcactacctcaaaaaatacagtatcaaatttttcccttcaccactgaaaatgtttatctttacatataaaattagtaagctgattaacacagaaataaaagagaacactgtcttctgggtgccatgaagatgtgtggtaattcctcagattttgacattgtagatatatagaaattatagtcagtttcaataaaacactgctaatgaaaacacccacaatttcctttggtagaacaaaaacaattataacatgtaacttatctctccaggtaatttttttgtgaaaaccttttaatgaaccatgaatgctggataccctgcagaagccaaggtattgaaatgtaaaaacattgtacgagaatagaaacacatgtctaagttcaaggtccctacagaatcccttatttatcccacttagaaaatgtaatataaactctatttagcaaagcttaattcatctaaaaatatagctgcttctgaaccatctctgaagctctgggttttatttctttttagtcattcccttatttgatcttgggattaattatattaatattccattcctctgacattaaattcacctgctaccccttttacataactaaaattttgttgataattttaaccattattttcatctatgccctaacaacacatttgtttttgtatcaagttatccctaggttcaaacatatattagaaaaattacctctaatttctcattattttcttccattaattttaactttagcactttttcttttcagctaatatgttctcttagtgcattctttgataattctaaatgcaaaaagtaaactacctttgtcctgcttttacagcttccaaaaatcattagttctaaatctgtctcctttgcaaaacttctttttcagctacttgttataaataacgaacttcattttcttatcgaaaatgtttttaataactgtgtaatagccaccaaaataatttaaatccatttttacatattattagggaaaactaaaattcttatcttagtagccaatatctcaacttcaaaaaatctttaccaaagattttattgggttgcttttcctatgcatatttatgacaatgcttctgattgtatagttcaggtatacctacactagaaagaccgagttcttgtcccagatcttctgaatcagaagctctgaaaagggaggtcaagagaatgcactttgaacaatctcactgaattcttgtatcctttaaagtttgaaaaccacctcttcatggtacatgatacgttcatatctgttatttaaacataaaaataattacaaaattcagaaactatgttattactaatagaaccaacattttttctgactacgtagattcaaatccccaagttactttcactagccagttctctacacattttccaagtgattcttccttaccttagaacgtctctctgatgtgttcctttttcatagtcctaatctcttaccttacttagacccttgtcatttcatacttgtaccacggtgatagcctcctaatatcttctgacattccattcccttataatcactgaaggaaactttctaaaacgctacttttattgcccaattatctagacaaaattttatctattgtgtactggggtaacccctaaaatagaattgagaataaaaggtataaatttatttttctttatgattgattcaatttacatatagtgaaatgcacagatcttaagctttaacgttttaggggcatagacccatgctattaccactcctattcaaactttatatttatttttaaataaaataatacaaaagtaaacttagctaatgctttatatactgactgacactgtgtctctgtatgttttagggacaagcaaggaatcttgagggagatgtgacaagtgtacagtgtgaagggataagcagcagtgtattattcagagttctttagagaaacaaaacaaataggctataaggacatattagtactgacagtgagaaagaaagagagagagagagggattgattctgtcaatcaattggctgattgattatgcaaatttgttgttttagtccattttcacactggtgaaaagacatacccaagactgggcaatttacaaaggaaaaaggtttaattggacttacagttccacgtggctggagcctcacactcatggtggaaggcaaggaaaagcacgtcacttcttacatggatggcagcaggcaaagagagagagagcttctgcaggggaactctgctttttaaaaccatcatatctcgtgagattattcactgtcatgagaacagcaacggaaagacttgccaccattattcagttatctcccacatggtccctcccacaacatgtgggaatttaagatgagatctatggccaggcatggtggctcatgcctataatcccagcactttgggaggctgaggcaggcagatcacctgtgtcaggagttcgagaccagcatgcatagcatagtgagatcccatctctaggtgagatttgggtgagacacagccaaaccatatcattctgcacttgacctctcccaaatctcacatcctcacatttcaaaacaattcatgccttctcaatagtcctccaaagtgttaacccatttcagcattaactcaaaagtccacagtccaaagtctcaccagagacaaggcaagttccttccacctatgcatctgtaaaatcaaaagcaggctagttactttctagatagagtggggatacgggcattggataaatacagccattccaaatgggagaaattggccaaaacgaagggtctacaggcccccaagtccaaaatccagcaggaaagtcaaatcttaaagctctgaaatgatctcctttgactccatgtctcacatccaggtcacactgatgtaagtggtgggcttccacagccttggacaactccacccctgttgctttgcagagtgtagccccctcctggctgctttcatgggctggggtcgggtgtctgtagtttttccagaggtactgtgtaagctgttggtggatctaccattctggggtctgtaaaatggtggccctcttctcacagctccactaggtggtgccccagtagggactcagtgtgggggctctgaccccaagtttccctcctgcactgcactagtggaggttcttcatgagatccctgcccctgaagcaaacttctgccttaacatacaaggcatttccacacatcttctgaaatctaggtggagcttcccaaacctcaattcttgacttctgagcactcacaggctcaatactttgtggaagctgctgaagcttggggcttacaccctctgaagcagggcctgagctctatgttggcccctttcagccacagctggagcagctaggacacagggcaacaagtcccaaggctgcacaagcatggggatcctgggcccagcccacagaaccatcttttctccccaggcctccaggctggtggtgggaggggctgtcatgaagacctctgaaatgtcctggagacgtttttcccattatctacaggattaacatacagctcctcgttacttatgcaaatttctgcagccagcttgaatttctcctcaaaaaatgagattttcttttctatcaaattatcaggctgtaaatattctgaacttttatgctctgtttccctaataaaactgaatgcctttaacagcacccaagtcacctcttgaatgcttttgctacttagaaatttcttccaccagataacctcaatcatctctcaagttcaaagttccacaaatatctaaggcaggggcaaaatgctgccagtctttttgctaaaacataacaagagtcacctttgctccagttaccaacaagttcctcatctctatctgagaccacctcagcctggttttcatcattaatatcattatcagcattttggtcaaagccattcggtaagtctctagagagttccaaactttctcgcatcttcctatcttctacagagccctgcaaactgttccaatctctgcctgttacccagttccaaagtcgtttctgcatttttgggtctcttttcagcaacaccccactcctgttaccaatttactgtattagttcattttcacacagctgataaagacataccagagactgggcaattttcaaaagaaaaaggtttaattggacttacagttccacgtggctgaggaagctttacaatcatggtggaaggcaaggaggagcaacccacatcttacatggatggcagcaggcaaagagagaacacttgtgcaggggaactcctctttttaaaaaaaaatcatcagatcttgtgagacttattcactatcacaataacaacacaggaaagacttggccccattattcaattacctcccaccttgtccctcccacaacacataggaattcaaaatgagatttgggtggtgacacagccaagcgatatcatttgttatgaatgctaagagcatctactctctgcaaattagagaaccagaaaaactggtggtgcattttttatcaggtccagaggcctaagaaccaggggagtcattggtataagtctcagaatctgaaagcctgagaactaagcactgtaatgtttgatggcaggagaagatggacgttccagttcaagaagagagaactcatccttcctctgcctttttgttctattcaggccctcaatggactggatgatacctgcccatattggtaagagcagatcttcttcactcagtcttctgattcaaatattagtctctttttgaaacactctcttagacagacccagaaataatgttttaccagctctttctacatgccttaaatcagtcaagctgtcaaataaaattaagcatcacaagcagccttctctcttgtctgtttgctttcaacacattgcagtgacttttagtttacatttggccagttaaagggatctgtattttataatattaattttacaccaaactaatgctcaaaaaaatgaataaatagctgagaaatatctctgcaaataaacctgagattaaaggtaacactaatgatatgtgtagaagtgaacaccaacagagatggaaaaatcccttcccattcctctgctaaaacagcttaatcagtcatgttattaggtcaaaaccgtggagatccaggcagaccggaaataaagtcagactgacaattttgatgtaattaatacaattatttataatgttgacttatatataatacaattaatcattttctatgtgatatatgaacattgaaaatttaatgactgataaaatacatgtataattcttaaatattagagtgtgtactcaaaaatattttttaattcatgggatgaaggatcataaaagttatgtattcattataaaatgtagctatcattaactaaatgatatggttttggctgtgtccccacccaaatctcatcttgaattgtaactcccacagtttctgaatctcatgggaggaagcttgtgggaggtaattgaatcatgaaggcgggtctttcctgtactcttctcgtgaaagtgaataagtctcacaagatctgatggtattaaaagtgggagtttccttcacaagctctcttttcttatattttgccatgtgagacatgccgttcaccttccgccatgattgtgaggccttcctgaacatgtggaactgtaaatccattaaacctctttcttttgtaaattatgtagtctcaggtatgtctttatcagcagcatgaaaacggaataatatactaacatacacacacaatcttgcctaaagttatttatgtcttaaagttcagagctccactttatgaaccctctcatctccttgaattacttgaattagatcaaagatggaaaacattttttgtttcctaacaagtaaaataatctttttttcccctcaccttaaatctgggcaggaattgtccttgctttgaccagtatatgatagtagattatttctactgattcagttctgggatcaggccttcagaagtttgatagctttcacttttgccttcttaaaaggcaggcatacatgcaattaaatggactattttaaataaattctataaagaacattttctttaaaaaataatttccaaaatgtagaagtacattaaaattagaagaagcattctagagaatggtaaggcatgaggaaaaatacaccttgggggatatatttaaggttatataatgtttgaaaaaaccacatgtgctcagctataagtgttcagttataagaacccagttgtgtagcacaaggatcatgaaacaaaagaaaatataaacaaaaaataagaaaacaaaaaaggaaacagaaaaatatggactctctgataactgtgaaatatgaaatacaaaatgaaatatggtaactgtgaaatatgaaatacacaatagaagaaatgttgggcccatgaacattttcatcccttctcaatgtgatatatgcattgaggaagggacaaaaaatgtgtttttctcttcacatttccaatatgagtatactgtatacttggccatgaaagtgctaatacttgataatacctaccacagttaatgaaggttgataaaaaaatttaaaccaaggtttctggctctagtatctccattcttaatcaatgggtgacaccaacattttagttgccagaatattcataatattattataatcatactttgaaaaattagaaaaaatactgttagcaatattatatttatgttttagtatgtaacatatatctcatctatatgatatttaatacatattacttttcacacattagctgctcatataagagtacttaatactacaagctactgttacaagctaaagtcagcagactttcttatattattagaaataaatacacattgtatgatatcattattaatgacagtgctgcaacagagcttgatagctgttaacatttacattaaaaatggtcagacttgataacacaattagaagcagaaatttcagctacatatatgattaaggggtctacagattatgcttttctttcagagaccttcatggcaggtttctccaccataggccttgagacttaggaggaaagaatggttttgtgggccaggaccacggctccactgccctgtgcaacctcaggacactgcttcctgcatccagccattccagctctagccatggctacatggcccccagatatgcctcaggcctctgcttcagagcatgcaagccatagccttggcagcttccatgtgatgttaaacctgtggacacacagagggcaatggttgaggcttggaagcctccacttacatttcaaaggatgtatggaaatgtctggatgtccaggcagaaatctgctgcaggggtggagccctcatggaacacctctaccagggcagtgtggaagggaaatgtgaggtgggagcccccacacagagttcccactggggcactgcctattggagctgtgagaagaaggcaactattctccagaccccagaatggtagatccactgacagcttgcaatgtgcacctggaaaaggcacaagcaccaaacaccagcccatgaaatcagccaatggggctgtactgtgcaaagccacagaggcagaaatacccaaggccttgggagcccaccccctgcatcagtgtggcctggatatgagacatgaagtcaaaggagattattttggagatttaagatttaatgactgccctcctgggttttggacttccatggggactgtagaccctttgctttggctgatttctccttttttggaatgggtgtattcacccaaagcctgtacccccattgtatcttgtaagttttttcaggctcataggcggaagggacttgccttgtctcagatgagattttggactgtggacttctcagttaattctgaaatcagttaagacttggggaactgttgagaaaggatgattgtattttgcaatgtgagaatgacatgagatttcagaggaaccaggggtttcatgatatggtttggatttgtttccccacccaaatctcatgttaaattgtaatctccaatgtaggaggagggacctggtaggaggtcattgaataatggggggaaatttcccccttgctgttctggtgacagtggtgtcagtgagtgagttctcatgagatctggttgtttaaaagtgtgtagtaccaccccttctctctcctgctctggccacgtaagatgcgccaacttccccttcagccatgattgaaagtttcctgaggcttctccagccatgcttcttgtacagcctgtagaactgtgagccacttaaacctatttttatttataaatcacccagtaacaggtagttatttatagcagtgcaagaacagactaacacagaagaggtattaaatattctctaatggtagaatttaccagtaaagcatctgatccagaattcttctttgtgggaagatctttttgattactaagtcagtctattaacttgttaaaagtctaccccaattttttattttttctgaagtcagtttgaatagtttgattccaggaatttgtccattgcatccatttgtctagttggcataaattgtatataatattccctcataacatttttttatttctctaagctaaatagaaggtcctctctttcattccaagttagtaaattgcatcttatctcttttattcctggtcagtctagctagaggtttgttaattttgttgatgatttcaaagaattgattttggcttcatttattatctctactgatttcctaatccctcttttattactttccactgtagtctctattatttctattgtgttgtttagctttctttctttttttttttttttttttttaaagagagtcacctccaatctcctccatcactcaggctggagtaaaatgatgtgatcgtagctcactgcagccctgcagccttgacttcccagacccaggtgattctcccaccttagcctcctgagtagctgaggccacaggtgcacaccactatgcccagctaattcttgtattttttgtagagacagggtttcgccatattgcccaggctggtctcaaactccaggtctcaagcaatccaactgtctcggcctcccaaaatgttggaattacatgtgtgagtcaccacagatggcctcccttctgctctttttctttagtttgcttaacatttccagtgtctttgtgacaaatattacattattgattagagattaaaatacatgttacaaagtattgttatttttatttgtctcaaagtatttttctgattttatttcttccatgagtcattgattaaagaatgtttaacttccatacacttgtgaatttccaaaatttccttcattataatttctaattgcattccatttttgtcagagaatagagtttgtattatttcaatcatcttcaatttaacgatattggttttatggcctaacatgatctatactgaagaacattctaggtgcacttgagaagaatgtgtattctgctgttagggggtagagtgttttgtagatatcttttaggtctagctgctttatggagttgttccatcttgaccttaagttactgcatttgcagagtttcaaggttagtcagagatgagagcttagggccttcccaagtgcttcctgagtatatatacagcttgcttttatctttttagaatcccagaaatatgttaaactttttaaaactccctatgaacatcattatctagcttttcctttaaagacttttggctagtcaataattctgccattgatgttcatgacagtagaaccattgaagaggttgacaacagcccttggatgacctcgtcatagacatcagcatccgtatcctcacatatagtaaacagagactgtctataacaaatggaagcaggagaggagtcgtccatgtggtaatttactgttagcttggagaaacacatatattcagaagtatttgtatggatttagggaaaattaagagttttgacaaagtacgtgaagtcagagtcatggatatccccttctgtgtgtgtgtgtgtgtgtgtgtgtgtgtgtgtgtgtgtgtgtgctgtgtctggtttttgtttttgtgtttccatttgtaccagactgatgtgacttaggtaacatgccttattttccttcctaatgctaataacaatgtcaactaaaatgtattgagcattaactttttttccaggcagcattatgtacatttacaatgtattggatcaaattctcacaacccttttgtacaaagatctatttttgttaatcctatattaaagaagaataatctggtcaggtagtggctcacgcctgtaatcccagaacttagggaggctaaggtgggaggatcgcttgaacccaggaagtcgaagcttcaatgagctatgattgtgccgctgcactccagtgcgggtgacagagcaagacactgtctcaaaagaagaaaataagaaggactaatttcaggtaaaggggggctaaataacttaaataaaattatgtctagtgtgagttaaagtcaggatttttaacatggacagtacaatttccagaggctacactctcaacccctacaattctcttccttctaaaaatgtaaatagtgtaaaaggatattattcatttaccttagctgtgacagcaaataattgtaagagtttatatctattgtttgggacaatccactatcctacggttgtaggctgatgaaactttccatcactgtgtcacttttctgttaaaattttttaattggctcctcatttcactcagagaaaaatacaaagtagataaataacatacaaggctctctagtttctgctctgttcttatctgtcacctttctacttttacctcactcacttctttccagtacttccggcccccttgttgtttctgaaacccacctggcaagcttcagttttgatctctgcctagaactcttcccggagatatcaacgagaataacttcctcagcttctgtaagcctttgctaacagcttaccttttgatgacacaagtgctgatgatactgcttaacactgcaacttctactacaatcctcctctgcttttccaatcccattcatatgatcgatttttcccatagcattcacaactttctaactttgataataaacacttacttattatagtaaatgtttattgcctatctcttctgccagaaaactggctccacaaagtcagtgataggggttgcttcacagggtaggtgatcgtttgttgagaaaaagaatgcacataacttttaaaagtgaaataaacttgaacaccaatgcatccaactggctctgagtatcataattatccaagtctgttattaaatttcatcctttggcttttgcacatgctgcattatctatatagataattgtctctctttttccacctggaaactcctgtctttctgctaaaatgacacttcctaagcaattctcataaaatgcttaatgctctcctctcatgagcctacatgtggttcaaactttatttagagtgccttaaatattgtattttaatttatcttttacgttgttttaatgttttttagccacagactccacgactccctaacctagaacattcatctctcatatttgtgtttttagcatctaataagagtgattgacatacagtcaagccttcagttaatgaaataaatgatgctttattatctacaccaagatctctatagacttaaaatagtttctgtttatgaaagttttttacaaatataaaagtctgagctctgcttatgatatttgtgtctttataaagaccaaaggcttgaaacagaattgcttgaattttctttacagacagcatttctaagaaggatacagtatgatatttgcaaatctaatatctgttggttgttgtgtatttgtatatgcacataggcttcaagtaagaggacagaaaggggttgagggctaatgctgaactccattaaagttatttttcaagcacacttcaaaagaagccctttctcccttaaaagatatatagcctgtctcacatgcatctgtctgtctagaggctatgcaaatcagcaacatccatatttcagcaaaagcaatctaagaagagcagcataatcaatttctcatcatttttgcttttgacacaattagtagtatatgcatagggatggattaggatggtttctgtggaatttttcaagaaaaatatttaccaaaggttaatatttcgtgttcccttgggctaatcgtgctctctcaccttttttttttaaatggctccaaaatagctctttttaaattcagtcatatattatcacaattatgtatagtaaccaaccaaaggtaaaacacgtgtaaaatgtttttcattttatattaaagctgaaagttggtgctagaggaagttttatatgataagttgatatgtagaaaaatactaatatgtaggttaatttcctaatattttgaattgctttgcttcttccataaaagttattcatttatcattctacacatttcagtccaacaaattgaggaagcaaatatcttgaattattatttttaaaatgtgtttatacacaaaagtaacaatcatgtcaaataataaactttgttatttaaaatatttccttggaattgagagaatttgttactgtaagattctagaataactgatagtgtaaaatgttatcagatacaaaccaacaaggatggaatagaggattcctggcctatctgatggcggttgaatattccggtcctgatcaatggcttggattggtggcgtaacaataatggggttcagttcttcctgaaaaaaaaattaagagagtttcattcagccgcattactaatacttcatgaaggattgagacagatgctttagtttggaaatctatataacgtctgagacagtaaactcaagtttcaacatttatgatctaataccttttactagttaattttgaatgttaagggggagcaaagtattctcaaagtcaaaatggtaagacatagtgattatgcacatagacatttatatcagtaactactcctaaaaggaaatcaaggaagaatgataatgcacttttaatcttctctagaggatttcacaaaagaaatagcagcctatcaaatagtttatgaagtaatgttttctctttgctttagacaagatttgtaagaatacttgtattctttccttgctaaatcattttttagtttcatacacatcaattatattaaaatataaataaagtaaataatttcataaaaataaaagtcacattattgcaaatttcatataattaaaattgattttaaatattgcaggtatttacatgtattttacaatggtctataagaaataatgtttaaaattataatatacttctttaatttggtgtttcccaatttaatgtccagtactattttgttgtgctatcaggactggcaaacatttttctgtaaagaaccagataataactatctttaggctttgccaaccatatggtctatgttgcagctaccctcaactctgtcattacagcaccaaagcccaagtgggcatggctctgttgcaataaaacattacaaaaacaggtggtaagttatatgaggttactgactactgtgatcataatagatatgctaaaaatacaacaataggtatgttgaaaaataataaaaagcttatctacacagatatgcttgggaaatatgatattaaatacagttttgaaagccaattaactgtactgcaaatcttttcagacttaattatgctaatctgcatactgactttctaagaaaagggtactatttgctcactttcaagaaacacccattaacctgtttttgaaatgatgcctttagaacacagtttgggaaacactactctaagttatgtagccctcatcccaaatatgtaagtggtaattctaaatgaaatacttctaaagggtaattctaaagggaaattccattacatatttgggctgagggctgtgaaacttaaactactgtttcccaaacatttagtatgtctcaatatctacaaccttacattctaaaaaattactgcaatgttctcatattatttcttctcaaatgacagaacattgaaatatgtaatgtacttttatacaaaaccagtagtttcagttctcagcaaaaatgtatagtgatggcatgctaaaaaaagagcaatgatattaaaacattatgtataatacttgattttatattgaagttataataaggataattattgaccaataatttaaacaccatagacattgtatggggtttctctcgagttcattatcactaataggtcctaagtagtctaaatgttatcagtattttcctgaaaataaagagttgttggtagtagcaacttactaatactctattctctcctttaaacgtggaatcagaaccacgaaaataccaaataaatatcaaaattactccattaaatccagaagattattgttcttaaaacgcaactctcactgaacttttcctcccatgctgcctctctctctctctctctcacacacacacacacacacacacacacacacacacactttcccaataatcaatttgcttggtatgcaatacctgtatttctccctaaactgaaaaaaaaatctgaagttctttgaaatatgtatgtttgagcacaggacttaagagttgacaagctctttctagtaatttcactgaggaatctgattgccatcagccaaagtcagcttatacttaagctgtatcactcctggttcatataattaaatctgcagtaatttttccaaaaccgaggctctatttggatcctgtaaaggcatttcaaatctgaggattttctgcagttccattctgcatctcatagtcagaaaaatattttcctaaacaatttttgctattataaaataagtaatttcttatctagaaattaaaataaaattgaatcttagcttttcgtttggaatgtaaaatgtaagcaaatcacaatatttgaggatatgttggctgatcaccttcatctatttatttctatagatttgctaagttacctacacataagcagttttagctttaattagtaatgtagtataaaatattctttctataatatatagaattgttgaaatgagcaacataatttatttacattgaattgttgtataagcaatgtaaaaactaaaagtaacacatcaaacaaaaccaagaggaagggagaaatgaaaattaaattcctcatcttacacatttgcctgtgattaaatatatatatatatatatagagtaagaactgaagaactaaaaagaaacaagtgtagtatttagaattatattaataattagaagatgaaaaactgtgagtatctcaggatactgagcatggaagtgagggtagatgggatagaaaatattttacataaagccatttggtactgtgtgactatgtcattaccatagcccgtactatttgttttaacattattaataaataaattatagtattgagaataaaagaaaataaactctcttgataaaggctttcacaagtttctgcaaatttaaaagaaatggtgtggtttaaataacttatcagaattgacattttatcttgtcctatagagactagcaacttattttacaatatttatttttccttctgctaccataaatgaaattgtcagataatctaggattaaaggtgaaaagaatgatttcttaactattatgtgtatgattacctctcaagtaaactgtgctccatgaagcttgaaatgtttaaatattattaatacatgacattaaagaatactaaaaattatgatttttaggatgaccttgttaaatatttaacatattttataaagatatgtagcattgaagtcagaggcagacaatttatatacattaattagaagaaacaacataaataacatgcattatgtttgaacttctgtctgccaacacaacctccacagtagatgaaaccaggcctggaaagggtattcatataagcaagaacaacccagattgaaatggttccttagaataagtgagaattttacagagagaacagaagtaaaataataataataatatgtacgtattcagttcaagtatttttttttaacaacagggtaaatccaaagaaaactgagtaaaaataaaatgaaaaaggaaaaaaaaaagtagtatatagtagtaaagtatccaatgctgatgaacaaaggaaacagataaaagaaatagtctttgattaccaagtgccagcatattactgtccttgaatttattgaaaaatagtatccttataatgaacctctttttccctaagttagtttcaggtcagttctctgactttaaacctagagtaccaatctaataaagggctaaagataagagaataacagatggtgtgttggctctcttagagacatttacttaaacttctaaattctgttatttattttcttttgctttttttttttttttttttttttgagacagagtatcgctctgttgcccaggctggagtgcagtggcgcgatcccggctcactgcaagctccgcctcccgggttcacgccattctcctgcctcagcctcccgagtagctgggactacaggcgcccgccaccacgcccggctaatattttgtatttttaggagagacggggtttcaccgtgttggccaggatggtctggatctcttgacctcgtgattcacccgccttggcctcccaaagtgctgggattacaggagtgagccaccgcgcctggccaattctgttattttcattgaacacagttacagctctatgaagagaacagaattattcttgcccatgaattgaaataatgtaatcatttacaggatttagcaaatagcagatatttaacataattttgccaacttattctgttgagttatccaaagagatcactactctctggtcaactttgtaatatccactagcagaaaatagtccatctgtggctactgccaggtcttccacagttccaaaaaggagattgattcagtgacttgtttcttctgaagaacagagtctcttcacatagacaataattgctgttgcttattctctgtcgtcctcatttctcctagtttttgactttactgcctatattacagaggaagtacggtatgtgttgaagaaattagaagtccacccatagctcaaatatgcttgggtatcctttatggaaagtatcaaaatgttcctctattttattacaattgctatatttatctttttgccaaaagctttattggtctgtgggcagaaattatcttatttgtacttacaaccctcagcctagtgcctcacagatttcaacaaatttttgttatcaagtcaagaaacacagaaagagctccccaaaccctggatggttcttttatactttgcctctgaagcaaagctgctttctttgctgtctcatttgtcttcaagaagaggtcatgtctcctgaattctgttccagttgataagcatatattagaagcacacaggatagcagatttgcatttcattgctgtttgaactgtcagagctacattccctgtcttagtcatggggacacataagtaaagtgaattaggtccatataaagagattcataatgagaaggtaatcatagaaacgattaaacaataacaaaaaaagtcttctgtgaaaatactgtgtaattatatggtttaagaaccttaaaattattattttaattttaagaaccttaaaattattctattttgaatacatgcttcctattcattagcttttctggagacacaccttctcttttgagcaatgttaagacaatgttttcatgcagaactgttgtattattctgagaggataacagtagccaattaacatttgatgtgagtgagggttaattatgcctcatgaaacctcactaccagattgaaaatgaacttttggtctgaattctatttttatatatatatatatatatatatatatatatatatatatatatatatatatatatatacacacacacacatacatacatacacataatcattaataaaaatatattagcaagcaatcccaaaagattaagaagcctttttgtagatttaataaaatctcagctttctggtcatttaggtgttcatatggttatcttgaacaaaaggtatattcaagagaaacactcagatttcagagattggatacattcactgtttagcttatatcaggttaacagaagtcatgatccatagaacaataagatttaacctattatatcatccctaatgttaaatgcatacatgatgcctatgattttcactgtttcatgcatgggtaggttgtctttaaaataatatgaaaccagttcttacttttaaaatacttctcacttcaccaatgaaaaataatatctatcatttacacaagttgatgggtcagtaaacttaaaaaaatgacatttcgcagactgattattaaagcttccagccttggttgagatagacataatagaagcattgttaaaatactaaatattctcaacttggcatttgaatgatgtcttcatctgagtaacgtatacatagtagtatactgaatgtgcccaagtatttcaaattaactgaaggcattataattatcttcaagaaagaatatgttctgatacatccctggaaaggtaatctgagctcatataagtacacagtttgctgttataaaagccaaactttgatgtattatataatattccacttatcattgcttagatctttacactgtattttaatcaagtaataacatcatagtatttggagaaaggttatgctaaaatagtaaaaatatgctgtaagtattccaagaccaataattaagtgatttgaaatcttagtaactatataatttaatacctaagttattgaatttattatttagtacttaattactttcactaattttgtgtgttctttacatttaagtaggtgctttttcaatatctattaaagtcattaatatttaatttgtacacttcctttaacaacagaaaatttctactacatttaaggaaagtcagtgtcacgcctgtaatcccagcactttgggaggccaaggcgggcagatcacgaggtcagggatcgagatcatcctggctaacacggtgaaaccccttctgtactaaaaatacaaaaattagtggggcatggtggcgggcgcctgtagtcacagctactagggaggcataggcaggagaatggcgtgaacctgggaggcggagcttgcagtgagcagagtttgtgccactgcactccagtctgggcgacagagcaagactcagcgtcaaaaaaaaaagttagtgaacattattagtctcatttcatattacattgcaaatgtactattttcctcaaagctcttgattattttcagccagattcttgcttgtttccatgtgttactaacatagagaattagaacaaatcaaaaattttctcaaacacattcatatagacataaatacaattatatgttacctttagaggccaaacaaccatttctgttttcactttgcttagttttgcttttttcaagggtcagaaatatcagattgtttgaaaaagtatcagacatatcgaaatgtttttcctggtgagattattttaaaaaatagtaacgaattggggtgagtagtatgggccaagccaattactttgaactttttgtattgttatggaagaaacacaggttgaacattcacaaacctctttgaaactgattcactgcatatatcaaagttcctcaaatggttttgacaattattatccttagaacagaagagtgaagagcacatttgagataggtatataattatgattcatgaaaatcataacaattcatgcctgatcactggaatttcgtatcacatattaaaacaaaaactcacttagctaacagaaaatacccttgttttattatttccatgagcaaattttatgacccctccaatatcatactctttattctaccaagtatgtgtaaatttaccttgtataatgtgactgaatttgtttccaaaatgtgcatttcagtatcctctcaattgcatatttgaatacttttactgatacttcccttattttcaaaatacttccttgaatgtctttgtctttaaagtttgtttacctgggattatatgcctccttttctatggatcatcaaatgatttctagacaggcaataaaaaccttggctggtggtaacccggtaattattttccatgaataaataataaaagcctgtaacaaaatcttgttggtaacaaaaggttggtgacttgttccacgctgtccaagtgacaaagtctgaagcattactgcaatcaagttggctttgactatcaaaaatcgttttccacataactcaaacctgagaatatgcatttcacagatgttgtaaggaggatacatagatcacagaaatatttcttacaaccctttctcacattcttatccatttctataacaactattctggttcctacttctcacactgccacagggctaactcaaaatcttctggttattcacctccccttcattcccatcgtgcacatcaaaaatcctccaaacgattttgacaagcatgacccactctggaagtcagaggaaaggaagaaattgagcagacagagtttgctttaccatgaagataaggagacaatcttgggagaatttatttgttcataattttagtctcattaaatttggatgaatatttcaatgataataatgatatggttcccattgtgtgctctcatcaggtcaggagacgactgtttttgtgatgacttcaattcattgtcaaatcacaattctatctaggacctccttgttagcagggactgtgtgagcactccctaggtttttcaccctcaatctctccatataaggcctccacactcaataggaaggcaataaaacaaggacaacaaatatgaaacatatataacaaagtaggccttttttattgatttgattttggagaaataaaatctgattttgcattatcagatgcagtagtttggtaaaagaacatacatttttaatttagataaatgaagcaaagtaatgtacagttttcccaagtggttttatcattttatatttctaccgagtatatgtgtaataaatgtgaaagttcaaatcaatgggagaaaatggatttttaataaagaatgattaaatattggttatcaataaatagagaaaaaaattatgatagatattgactttaccaaataaagctttggaagattgccagataagtctttaccagatacatctttggtcgattgcttatgccaaataaatttttgtagaacaaaagtgaatgtatgagaaaaacacatgtattagaagtcaacatagtagaaaataaggtaaatgattacttaaaaatattgcaaatgcttgcttagcaatgatttaaaacaatcccaaaaattggaactgttgaaggcatgaggagatgtgggcttttatatctgtgatggaaataaaaagcaggttaagttcaaggaaaaaaaaaatgaaatctatcactaggtttgacaatatgtatagtatagattaaagcatttcaatttgagctttatcttacataaatattgagagatatgctcggagatgtgttgagaaggatattcattgtacaatatacaatttgctttttaaaagaataaatttcttattcaagtacaacctatgagataccttcataaatcaatagttcacagtctgatgaattatcacaatgttataattataaattccaggaaaaaaattgatattttcacaaggtctgacaatatatgtagcttaaacttcaggattgcactttgagcttcatcttacataaatattgagagggacatacgctcagagatgtgttgacaagaatattcactgcacaatatataatgtacttttaaaaataaatttcttattcaaatataagttatgagataccttcctaaatcattagatcacagtctgacaaattattacaaagttataattcattcatgtaatcacactgtgatcaagaaatagaatattgtcagtatctcagaaaaccacttattaaattatctactcataactacccctacttccatcctagagatggcctgatttgtaatatgaaagatttgttttacctgttttaaattttctataaattgaattacatagtataaaaccttttatatatggctttttaatcaattattatgtcttatatgatatgtatgagtgtaagattcttgcatataattaagtgcagtactagtatactcatattaatggttatactatcatccattagatgaatacatcatattttatatgttagttttttttcaactggcgatgaactttgtacttcttctagggtatgctgtgaggataatgctcttacgaacactcttgagtatgtcttcttactgatatgattgcatttgtgttaaatagaagaataaagttgcagagtatgtatacattctgataggctagattactgtcagttttctaacgtggttgtatggtttacattctatcacagagtaggagaattctaactctttcacatctttaccaatttcagtctcttaagattttagcaaagccagtgaatatgtattattatcttatagttgctttaacttgaattttgatgatgattaatggggttgaacaactgtttgatgatcttggacatttgtaaagtgctgttccatatctcttgcctattttagttgaattgtctgttttccttaatgattcacaagagttcttcatatattataattaagtcatttatcagcttaatgttttataaatattacaattcttatggcttatatttagaccctattagtgttatcttgtcaaagaaaagtttctaattttaatatagttttatttatccctttctctttccatatatacctggctatttcctctacctgtacacatatcctgaatgtatgaagtatagacaataattttccttatctatttccatagataaaatattgcactcatccacatcagaatttatgtaaactgagttggcttccctacaactttcttgagagcaaagtgaaggtctattttcttttatatctgtaggaccagacagtacatatggcacacggagactcaaaaactttgaataaagtgtttctttgttgtagattatttagagtatttttaggctcatacacacttgccttgctctctgaatttctgtaggacatctaaatacaaataatgatgttttttgagaatctatttataatttcaatatctttgagcttcctaaattgctgcatttaactacaggccaaaataatctggtcataagagtgaatcatatacacatataggggctcacagcgcttcattgagatggccttttggggtagtacaataaacaatgtcataaacattccaatagaatgaacggtgaactcctatgtcctacaacaaaatatgccaagcttgccaataagtagcaataaagcttttcgataaactagtctcttagagcttgaattatgattttcaaggtgagattaataatatctacattacttgcaccactgcactccagcctgggtgacagagcaagactctttctcaaaaaaaaaaagaaatatgtatatatatatatctacattgcatgattgatgtgaggatgcatgaaagaatatatatatatatatatatatatacacatacagtaaatgacattcttaatatgtggaaattattatagttagttttttaaattgataattttaatgcttttaaattgtgtaatctgggtgttaaaattgactccaagttataagctagggagaaaaaaattttcatttgaaactagaagcttaattgataccatgtcttacacatctgtctgaaaataggacagtgatatgaattttgaaagtttatttagaattccatagttgatcaaataattgaggaagtaaaaagggattatctatctctgctatttaacttgaagccaagcttcaaatgagaaacttatgaattaaattatttaaaaatcgtacttaaaaataagatagtctgccagagagttgaatattcacttaaaatagttatcttattttgatttatttaaaggtaacttcagtgaaattattttctatagactaagacatatcatacttttatatccaataataaattcattccctacatttttattgtaaagagttgaagtgaaatttcttaatttgttaacattcagatgaattatataaatgcattaagcagttggcaggtaccaagaactctactaactgctcaagcagtagaaaataaattagacacaaattctggagatatgaaaaagctcacagtatcagggatggggattcaaagtgcaggtaccacaagttaatttagaaaatgttttgttagggcatttctcaatacatggtaagagaaagctctgataaaaaaattcatgctgtcaagtattaaaggtgaattataaaaaataacaacaaacagacattcaagcatgtgtactttgatccaagtatcaaatgtgatactgctagtgaaaaatgatgttcttgtctctgataggagtgggaaaaaagagtaacaaaatatagtagaaaatcatctagagacattttgaggagagtttctaaatcgccttaaaaatggaggagtttaattttcataaactgagttgccaatgaaaaacttctataggtaaatagcaaaaatatttattgtcttggtgattaaaaaatgatcctagagtatctttaaaagtatagttcagagaagcaaaaatatttataaccctaccacccaatgattatcatttttaatatttaaggtattttgtatcagtatttgttatctatgtatatatattgcttgtctaattgtccgtatataaacacatgtaatattttaccatgttccatatttaattttgttgacattttcatctcatatcataacattggtcttcatcaataaatatgcatcaaaaacctatttttgcaatagctttccaaacccactaatgtcataatttataaaatgatatatttcctcttcagtagtgtgtaaaaaagtctaactgcagatgcttgtcaatagtgagggagatatacatctagagtgttgctagttaagcataaagtataattttaaatttctttggtcactagcataatttacttgatatatttgtgtcttgcctgttcatttactttgcctattttgctttgttttaatttgggcattttaaaattttatttccatggcatatgtgaatagcatagaaatcaacactttgtcaccagccttaaacatattttcagtttgttgtttgccttttagtgttgtttttgacatttaggaggttggtgtttttatttactcaaatatttccctttccttttggatttcaggctagatactttaaaccatctgaaaattatgtgaatatcaaattatctattttttttcaagtactatggcttttttatatgtaatgtttcaatccatcaagaaattgaatagtaaagacttaatactcaccaaattataggtggaattttaatctttatcatttataacagaaataaaactagattgaaaaactatattttcccattgtatcttaaatggatatcttatttatttatttatttgagacagagtctggctcagttacccaggcttgagtatgatggtgcagtctcacaacctccacctcatgggctcggaccatcctcccacttcagcaccagagtagtagctgggactacaggtgcatgccaccacatccggctttttttttttttgtattattggtttcaccattttgcccaggctggtctcgaacttctgagctcaagcaaaaggcccacctcagcctcccaaagtgctgggattacaggcatgagtgactgcacctggcctataaaatgtaatctcattgcaaaactcaatgatgccatgcttctataatatgctattacttttttttttttttttttttttttggagacagagtctcgctctgtcaaccagttgcccaggctagagggcagtggcgcaatctcggctcactgcaagctctgcctcccgggttcacgccattctcctgcttcagcctgtggagtagctgggactacaggcacccgccaccacgcccggctaattttttcgtatttttagtagagacagggtttcatcactttagccaggatggtctcgatctcctgacctcatgatccacttgcctcggcctctcaaagtgctgggattacaggcctgagccaccgcgcccggcttattacattttttaacacaggttttctctagtagaagagagccatgatatttaggattatggatatgtgtgaaagctagacatttaaaaagcacacaatgacttgaaatatggaattgggtatcaaataatctggatttacggaaaactagtcacaaaattcatggagataaacaagatggaatgccaaacaagaaaagaccatgtaattgcatttgttaaatgtctctaatgtgttccacatccacttcccaatctctctctcacacacacacaacccaacaaaactgctttccttgtaaataaaatttgagggttgaaaaccaacatgtatactttttgcattacacatgtactttaattatcattttaaattcctatattaagttaaaaatacatatttagattaattttattggtttaattctttttcttcaacagtcaattgacagacgtctttgagtacttttattctgaagataatatgaatccttgtatatatgagaatgatgtttcattcttaaataaaaatttgattgaattttaggttctctatttacaaactttttctttcaatgcactgcaagttctacctaatctttgctttctttatgctttcttctttaaccatctggtagaaatttgcttttatcctagaaataaatatagtttaccagggattttccaagtatttgtctgtgctttaactgtgattcataattaacacttttgatctgcaaacacaggttctttatataacccttgagtgtttttgtctttgtttttgtttttccttacagtatctttgttattgtacttgcttacttctcctggtttattaataaacacaaactaattacatttttatctggctctctgatcttcgttgctttattctcctagtcagttcgtctgtagtctggaagatttttcaaacatgtaagagcatactataaaatcgtagagagtgctttttttaaccaggctgatgcagacaaagtcttgcctctcaaattagtttctgtgaactccaccttttgctggtctataaaataaagagtaatcttaccttctttaccaagaggtttgtttattaactgtggaaatgcttgtaaaacacctactaccattgtcctatcaagttctaaaaaaatatttgttattattgtttagagtcgcagctttgctttctgcatcttaaatcctatctttctgtcttaaatctcttcagtttaattatttcatttttcttctgtatcaatatctttatttaactttcaatatcatcctatatattccattcttaattaaattttatttcttatccaaacttttaaaaataatttaatagtgtttcttttagtcaatcttattaaatatatgctcccccctgcctttttatcttcagtgtaaaatgctgctctaatgttgtggaatctttcaagggattcaagtgtgtttgaaactgtgtattaagcgatgatcactaccttgctgactgcaaagtttccatatttctgtggtggagaggtagaaatctctcctttatccctgtctacatctcttttccctctactgctgctttcttacactagtcttggcaaaaatcgtacttagaccccttgtttctagtgttgatgcaacttgtcatccctttttgctgtctccacaagtacatcaatagggccatgagtaaaactaatgcagatactagtagctgcctgacatttcaattcagacctactctatgtatttcaatccaaacctactttaggttaagagatggaaaatgacatcacagaagaggtgttagttaaaactatgttttcaaagattgatacttcgaggcaaagccttctcctctaacttttccagatagaataatattgattatcctcactattcccattaaaatatgctttcctctgcattagattattaatcagaactctcacattcttagttcatcatcatatattttatagcagtccagtccagaggaaagcatgctgccatcagagccagaacgaccaaggtcttcaaaactcttctccacaacttattcattatgtaaatatatctttctaaatatcaacgttgtaagtgtataatagtaacattaatttacaacgattcatatatcagattagaccaattaatcctatgtcattttaattatagaacttttctcaggatttttttttttaaagtaacattagacggccttgcagtgactgtcccagggaacattcaataaatattagttttataatttcttattattctatttatgtataaatttctttctgatctgtactatagttatattgaagagaatgtctatttctttcatgttagtgccttacttggtgcctgacacattgtagatactcgattgccacttattgaatcaaagaaccaaggtattgattgaattatgggagtaaaataattacaacatgttataaagctgggagataggaaaatccaaaagaagagatacattttggggaaaacaattacctagtaaattcgattgaggattgggtttactagagaaatatcattttaaattcacaattcagaactggagaaaatttaaaagagtaagaaacagaaaaaatgaataaaaataactttgttttgatattaattttcatatgttgattgaaccttcaatataggcgagaatattaaagttactgcattttcctacagtttttttgggtatattctatatggaatgaacacagtggtttttattgtcagaatattcaaatattactactaatagcactatctgtcactgatcacattcactagcacactgtagaccctacatgtacatcgagaatattgagaaatctgtgacaacagtgagttatatattttattgacttcctctagttctgtatcatccagcatagaggacacataatactttacaaaatatacccttgctgtatgaagtaccaacatttttagtttcatttacagaacaaattctgaactttgtctctgatataaattatgttatacagcagcatttaaaagagatattagtgattagtgatttctttttataaatgcaatgtgaactttagtaatattaaaataattttgtcaccttactatatttatattaaaatatgcatatggtaatgcttgctataaattaaatcatataaataactgttccttttacagctggtttgaaaacattcttttgctgtcttttaacgtagattttagatctcaaatactgtatttttaatttaatagaacacatggccatttaatactaggaagaaaaagagatgttaatgtcattttccaatagtatttaatctaatatgttaaaaattttaaacatatacagcatttgtgcattagctttaggaaaaatacactagcagtaattatattctttgcagaaacatttctgaaattaacaaaatgaggaatataagtaaaccatttttaggcattgaaaaggataaatttatcctaaaagatgttgatttcagactcaaaataccataaactctatctgtttcttggtatttaaaattgaataaagaataataacatcctcttattaccaagaggacctactgtctcaccccgtggttagtgtatgtgacttaagaagcaatgattagaatttgtagagatgatgcaagtctcacattgacaaaaagaaaatttagaaaacagcaatgctaaaaatagaaatgcacaccaggatatactagcaacataaagttttaatgctttacagagctcatataacctgaattttctgagaatacaagaggagcgaaaataaaggttcatttttttgatagatagtcttggtgggattatgtctgcctcactgaacagtataaaacatttggcagagcatgtataataaccaccaatagcatggttcccaattcactcttactcaactcccacagctagcatctgaatcacaaacagaatagaagcttcccagaactcaaccactggcaacatttaaatccctcagcatactgaaggaccttgggagattagggtctttttgtggaagggcaaactgaaacacttggttttaatgtttgaaattatcatgacctaaatttgttttcacacttctgttttgtccttgtagtagaggtgactactttaaccacagcagggtactgttgataactctggatgctgatgcctgtaaggcactgatagatgcttcataaatctttttcaaatgacattcttgatatttgcccaccgggtctctggaagcatctgctaaacttctcaatttgtcttcagaatttcaacgtaattttttttctttctcctttctgcattggcaacaatttatgtcttccacataggatgtacttctttcacactatgtggatatttttaaaagtgtaggtaccatcacactcgcatcagaagcatctgttaaagtaatcacactggtgggggtgaccccagaaagcacatattctcataacaccttacaagagctgtaggtaatttgtattttggacaaacatgtcagactttttttatgtacaaaaaagatgtatacaaactataaccttttaaccctttctgataagccttcctatatcctgacatcgatttccttcttttacttgtttctctctcagtactcttcaaaaagagaggtggtgaccagtgttggaagagatgaagcagatgcacatcacttcctttgggaacttgctgaaataattctttgcattgcattttcatttacattatgctgaccagttctcttcacttagaactttcttagttgttcttttgattcttactgttgaaaaccaagattatgctcttgtgatgaagtgttttcaaatatcaaaatctgaataattgggcagcccactttcagaatcttatcatgaagtttatgctgcaaaatgtcagtttaaattgaaatattcaaactagtagcaaggtaccaatgataagacatccacagacccaaaagttaactgaattcatatgctattttttgctgaacttatctaactggtagccatacacagcaataaataggctggcaattatgcatgggggaaaatggagtttcaagtgtgtagtatcatgtctataagaataatattaatgatagcctgaaagcccactcagatatctcacagagcctatactctgtaacttagctatcatatataatctgtcctggggatttacaaccctggcccaagaattaccaggcatctatgaaaatgcgacctagaacaccagttgccctagagaaaaagacgcctcagcataggtgcaaatttcatagatgttaaaacaaagctaacccttacaagaataacttaaactccttatatgaaataaacatctgataattgaccaggactgaatacagatgtaagaaaggggaagacctccccaaattccgagaatagtctccggaaggataccctcccagctatttggtggccatgccaccagcctgctcccactgtcttgtaagagcactgccacaataaaccacttgggaatcaggtgatgtctaagactcatctttgaagcgtatcctactgaagagaagaagttgcctctggagaagatggtcagctaggctcacctaagaccctggagtgcaatggcagaaaagataaaaaaaagcatttaatgatgatctgatgactaacaaagcaactaataaataagttaacttttaaaggtaaagatgaatcagatggtcagctttacttagaaatatttgagataggttgtcctaattaattaaccaacaaacacttattgagagaaagtgagtagattggaagtagactaacatttattgatactctacttgcatctggttctgtaggtttaattttcacaattctactgttatagaacctatcaaaagcttcaagtaataagtaatatagattgaatcagaatctgactttgaatactctgttttttggatcaatttgactttccaccattatatgtgtaaggctgctgtttcctcacattacctacctgtcctggctgattgtacctcctactattgtgtttcccattccttagtatctctggtttatttttcttattaaaataagccaaaactttccttttccaggtttttcattggttatttctttagccttccatttatatctcacatttcaactcaaattctccttccttagagaagcttcactgaccactctagttaccaaagaatgctgtcttcttaatagtatgtatcagtgcctgaaattttttgttgaaattttaatttcctgtcttcttacactgaaatgtaagctccctgaagcagtaaaataacaatgtctatatccctagtacataaaacattgtcctgcactaaaagtctttcttgttcatgccttcattcactttctcattctctctctctcgatagattagatagatagatagatagatagatagatagatagatagatactgagatagagatatagtgtgtatgtatctataactgatggactgatttttttaggtaatgttccttgtcaaggagttgaaaatataattgtaaagaaagtttaactaatatatgatacaactaacaattaaaacaatgtatagtatgtggaactcacctactgaattactgagaggacagagggttgcgttatgagggaatctgaggaatacagatatcacttcacatttcgtcagaatttcacagtttaacatatattttatttcatttgtgcctcataggagctgtgtgaaataaagagaattgtcttctttttttttttttttttgtcaaagaagtcaaatgacatctcaatccacaaatccagtggtaaggcaaggttccctaaagaagataaacttgctaaaaatactaccctcctttgtttatttttcagaaatttaaattgctactcttcattgagaaaattagagcaaatgatgagattttttaaatctgctactgtgagtacgtgtatgatatttgatgaagttagcttgctgaaggcatcatagatcaaatccctaaaacaagaaacattttgtggccttacatgtgtaggattggagggtgtatgcatacactttcagtatattctagaaatcagtgagctacagtgtgatgtcatacagatatatttggccactgaccaaaaataaaagcatgctatagaagcattcgtcttgaaacaatatacttgccaaactgtctttacattggaataagccaatatttttatattttatatgtgcaggcaatcaataaaaaattgctaaggaacagagtctctattcacagtcctctgcatggggcacggcccagtacacattaagttgacctactgcatgatgtccagtcagtattaaaagggcttaacgattaaaaaaaaatcagatgtttaacatgtaaaagataattaattggtacattcaaagtctctcattcttttttgggatcatcctctgtgcttgatttttacccaatatttcagagccatttctgccagtgatgaaaaactggagatgaggttgcttagacacagcaaatcctgtatagccaaagggaagctgaaggtcaaagagtgaattagattgatgtcttgttcttgttgaaaacagaatttatttgttttgctgacagagaaggaaaatataaacagtcaagaacgggaagacatattattttgctataaaatgaattcaagaggaaataacagatataaggaaaaacacagtgaatattattataggaataattcattagaatagagagacaatgaacttaaacacttgctaattctcctgctgaaatggatcaagtgattgcttcgactggagaaaaatcctaaactaacctaaatataaatgagtgctagaggacaggcagaatcacatcatgacacagacttaaaggcagagccagaagtacaataaagttaagacctgagctctccatataaaacaaaccttgtgtaacaagtgaaccacccaggtatgtctttaaatttatttttgaaacattagtttctgtccttaattattttctaataaaaataaaatcatttgataaaagaaatacaataataatatccaacgtgaataaagtctgaagactcagagggaaaatatttttttcaataactgtaatcatcgtatttctccaaaaatctcatttgcaaataatattgtgaaaaaaacaattttcgtgatataactcacaaggcagaagtctgatataaaacataaaatgtccttttgtttttcgttttgcatttatttcttatttcatcctgataaaaatgaatgcatgcagttttcaatatgagcaaataagtttttttccatatatcctttaaaactgtcttattcacttcgaatcttataaaatatattcatttaaattatatttatagaaaatcttcttgagaaattatgaaacttctaaatttgaggagatagtgacctaaattactttaaaggtaatcttgatcataatagaatgctgcagaagggctcaaagtttcacttttagaaagtaataaattgcatggcatttaacaggcctactctaaataagccacagccttgaaaagaaaattgctttagacactggtcctcttgccaatgtactgatttctattattagccaacatcttctaccggcccctgtctggggtcaccttaggtctagctgaagctgtatcctcagggccctgaatggattcagaatcagcatgcaacatgcttgtggtggcagtataaaacagtctacgtgagagaatggtccatgagagcaaaatcaatgtaaggataaatgaatgtagatgggatcaccaatcccaaatatgttacaagaagagagtgaacaaagtgacacggagactaagagaagataagaaaagaagtagaaagcaaacatagggtgagtattatggaatagttcttgagtaaaattcagtaactataaaattataattactatggctctatctgttaatgtagtgggctatttaataagccaaagcagcaaaaactagggcattactatggattagttctctgtgtgtttcctgaaacctagagaagattgtaggatataaactcaattgtgtcctagaaactcattttctatgttccagtcttgtaaattctacaaggttctagaaatctgtagtctaagaggcaataaacctaattatgaatatactaagacttagtcccttccaggaaaaagataaagaaaatactagtgaagattatttccttatgaaatgtaaacatggccttaatctagactaaaatacattttttcctaagaattttagggattaagatagattttctgtggtagtaacaggagcacagccgctaaatttatgccactagaagcaaggaagatcataggaaagatataacctgtcaactttgattcattttgagaaatcagtactcatgtaatgacggtaatggtatttatcgtatgtaaaataaaaccataataagcttttaaaatagtttaaggtacaaaagagtattttaaaaacaatgaatttgatctcttaaaatttattatagttttgtcacgagttttattagaagattttccatgtgttctttctgggagaaactatttaaaaagtccattaactttttctaaatgtttaattttttttttgagaaggaatctctctctgtcgcccccaatttttatttaacatgagttaccaaattagggtcactgcattcttattaactatgctagtttaaaaaaatttatagaaactttttaatgcttaaatatgccatcatatcactgccaacatttgtctctttttaatcaatatttaaagtaactatttccagtttttcattttaatgatttatatagtctttaaaaacattcataatggtttcagtggaagccatctctgtgttgatttttatgcttttatgtttctttctttttttgagacagagtcttgctctgtcacccaggcaagagtgcagtggcgcgatctcggctcactgcaacctccacctccccggttcaagcgattctccggcctcagcctcccaagtagctggaactactactactactacaggcatgcactagtagtagtactacgactactactactacaggcatgcaccatcacctctggctaatttttgtatttttagtagagacggggtttgggcattttggccaggctggtcttgaacacctgacctcaggtgatatgcccacgttggcctcccaaagtgtggggattacaggtgtgagccaccatgcccggcctgatttttatgcttttaaatggcttttggtctcattctttacagtaatgaccgctgttggtttgataatcaaccttcataatgttcaaacagtttatatttctgcacatattttctatttaaatactgacaagtattgtggtcttagtctcttagagacaaaataatcataaaatatttgttaggataaaaaactgttaggataaagacataaaaatgaagttttagaaggaaatgtagataactgtttgaaaatgtaaaatcagtgagaccttatttattgtaggataataaatagctattaaaaatatacagatttaacactacatgaaaatttaaacatttttataaaaaagctatcattaatatgatcaatggataaatgacagattttggaaaaatagcatttaccagaatgatttgtaatacctataataatactaatgaaaattaataataataatacttcaaatagataagaaaaagcatattgctaattgaaaaagacaaagttgttaataggcaaattacagatgagaaatacaaatgacctgtaagcatttggaaaaaaaaatgtttaggttcattagaatttttgggtgtagtggatgcaagtattaaaaataatgtattagatttgtacctgataacctgtaggaatttcctacaagtggtttttaaagtaaagcaagatacattaaaatgtgtatacaagtattctattcttaacacacatatgcatattacatctattttttataatataaagaattgaatgtcagagtacatatcagtgttggaggaagagaataaggaggaagcacagaaagtaaaaaggaaaaataggcaccaaaaaagatttggagaatggcagatggccaaggagatgcagctgggaagtgcctcttccatggagaggaacccaaatatccagtaaaccgtcacattttaaacagatcttttgagagaaaacactgaaagttgatacagaggtgacacagacaccatggttgaagagggaagaaatggggcagtctgctcagagtcactagacaccaggactggcccatataccttgaacaaacccaaggaaggggtgagtgaaggaaccctgggacactacatacccacaatgtacttctgagatcctagctacaggagtttctacgacccccatagatctttggactggtaggagagctgcctcgagcacatgcagaggcacagtttgaacccacaccgagcccagaaggctttgttgtgcggtgcagctgcagcaaaatgcaaccctaggtgcccatcccacaagtctccatttcatactgagtggctaagttcctgctatctgccaggctgggagtgaaccgtgcctggcctgctcacatgcccaagataggccccatcacccatgctgcgtgattaaggtacatctggtccacatgcccccttgcctgtcaacgccttcccagacctcatgcctgaccactcctgcaagagggtgtccacagcacaacatccactgcccagcttaagtgttttgttaacagcctgggagaagttcaccaccctgtccccaaatcatagccagtgcttaaagcttagaggccagaggacaaatcagtgagcccaggcccgtgagctcagtcccgtgagcccagtcccaactccccaagactccagtacaccacgcagggacattgagctgagatttgtgacctaatctcaagtgaaggaggaggatcctccacagtcagaatgcagagaagaatgtggtatgggttctcatggggcatgggagctggacacccctccctttgcaagaccagacaacgaaaggtatggcctgatggtcgtagctttttttccagggagtatcctggcacagaatgcctggagtagctcaacaatgtgggagcagatggcttggggaaagcctagttggttgggcttgccgccagggcgagtgtctgtgggagatctgctgggttaggggagtgtgagctaggcagacaccatggttgccagctgggctgaaaatcacgggctgcaagctccatactggtgttgcacccattgtggcactgccctgcctggagatcctctacccttgaaatactgcattttctttgtctctacacttgaaatactgtattttctttgtctcatgttgtgttttgagacagtacaactcatacctaagttgtgtatcacagcaactgcggacataccctaaaacctgctctgactttggtaagcacagtagactggtgggtctctggagagttgtgtccctagagatgtaatcctcagtgtggaccactcctgagggaaggggagtgcagcctgccaaagcacaccatgagataaagaaaatgtggccatggcatcagccactaaaagggtcaccaccaaggcccagaaccagacttggagaaggaatcatgtcttgcctccatctccacttcccagtgcactgttgcggatgcagcagtagctcttcccataaggtcctagaaagtgtgcactgaaagaagttgtttctcatgatgctccagtgaggacaagcatgcaccaagaccccacctgccagctcttactcttaaatctgtctaccagattgaagtttgaattatagcatcacataaaaatacattgctaaaacaagcaacatctatgaaagccactgcaggaacctatctctaaccaaggaacatatatagaaacttcacccctgcaactacccagaaatgaagccaatgaatcacatacaccacagtcatactttcaaggagaataaaaaatataaaagccctgtgatggttaatattgagtgtcaacttgattgtattaaaggatgcaaaatattgttcctgggtgtgttttgagagtgttgccaaaggagattaacatttgagtctggactaggagaggcagaaccactctcaatctgggtgggcaccatctaatcagctgccagcacagctaggataaagcaggcaggagaagacagaagagcagacttactgagtctcctggctttcatctttatcccatgctggatgcttccagttcttcagattttggacttttgtacttacaccagtggtttgccaggggctctcaggccttcagtcacagactgaaggctgcacatcagcttccctacttttgaggctttgggactcggactgccttccctgctcctcagcttgcagatggcctattgtgggactttaacttgtgattgtgtgagtcagtgatccttaataaactccccttcaaatgtacatctatcctactacttcagtacctatagagaactctgactaatacaaaccccatctaaatgaagcaaattcaaaaacaaagtatcaactcccgcagatggaaaggaataagcacaagaactctggcaatacaaaaagccagagtgttttgtggtctccaaagcctctcactagctccctagaaaaggatcctaaccagatgtaaatgtctgaaatgagagacatagaactcagaagatggatggcaaggaaagtcaatgagacataagataaaattgaaatccaatacaaagaagccagaaaaacagtccgaatttgaaagacaacatagctatattaagaaagagccaaactgaacttctggaactgaaaaattcactaaataaatttcgaaatacggttgggagtcttaaaaacagactaggccaagtagaaggaaaaaattcatagcttgaagactgattcttcaaattaacccagtcttgcaaaaataaagaaaaaatattttttaaaaagacaaagccttcaagaaatatgggattatgtaaagaaaccaattctacaacttattgatattcctgagagaaaagaaaaaataaccaacttggaaaacatacctgaggaaaaatttcaagaaaatattctcaattttgttagagatgttgacatgcatacatcagaaatccagagaaccccttttatatactataaagacagccatccccaagacacatagtcattagactatccaaggttaacacaaaagaaaaaacaaatctcagacacagctagagaaaagagcaacactacccacaaagggaaccccatcagactaactggtcttctcagaagaaaccttacaatccagcagagattagaggtctatttttagtactctaaaagaaaagacattccagaaaaaaacattcatattcttcaaaactaagcttcataaacgaaagagaaatggagtctttctgagtcaagcaatcggtaagggaatttatcaccaccagactagccctgcagaaatgcttaagggagttctaaatgtggatgtgaaagaacaatacacacaaaagcagagttaagtacatagtccacagactctataccacagactctataaagcaactacacaattgagactgcaaagaaactagctaacaaaactatggcaggaacaaaatctcacatataaaagttaaccttggacataaatggcctaaatccttcacttaaaagacatagagtggtgaattggaattaaaaaaaaaaaaaagaatcatccatctgctgtcttcaagagacccatctcataagtaatgacactcatgggttcaaagtaaagggatagagaaagattaatcatgcaaatggaaaacaaaaaagagcaggagtttctattctatcagaaaaaacagatcttaagcctaaaacagaaataaggacaaaaaatgttattgcttaatgacaaagggctcaattcaacaagaataattaactatcttaaataaatatgcacccaacattaattggagcaccaagattcataaagaaatcactactagacctaagaaaagatgtagacagcccctcagtaataactggggacttctacacccaactgacagtggtagatagatttatcgaggcagaaatctaaacaaataaattctggacttaaatttgacacttgaccaattaaacctaatacacatctacagaacactctacccaacaaaccacaaaatatatatttttctcatcttcacatggaacatactctaagagtgatcacatatgcagtcataaagcaagtgtcaagaaattaaaaaaaatattaaataataccaagcatcctcttggaccacagtagaataaaaataaaaatcaatagcaagaggaactctaaaacgcagacacaaacacacacacacacacatacacacacacacagaaactaaacaaattactcttgaatgactttcatttgggtaaacaagaaaattaaggcagaaatcaaagaactttttaaacaaatgaaaacagagacacaatgaacaaaaacctctgggatgcaacgatagcagtttaaagaggaaaaattatagtgctaaatacatcaaaaagacagaaatatatcaaattaacaacgtaacattgcacctaaagaaattaataaaacaagaaaaaaactatatccaaatatagcataagaaaataaataacaaaaataagaacaggactgaacaaaatcgagattcaaaaatccatacaaaggatcaacaaaatgaaaagttggttctttgaaagtttaaacaaaattgatagactgctagcaagattaacaaaaaagagaagatccaaataagcacaatcagcaataacaaaggcaacattagatccagtcccatagagattcaaaagattctcagagactactatgaacatttctatgtgcacaactagataacctaggagaaatggataccttcctggaaacacacaacctctcaagattgaaccaggaagaacttgaaacactgaacacaccaacaatgagttacagaattgaataagtaatagaagtccgggactagatgaattcatagctgaattctaccagacatacaaagaggagctcatgccaatcctactgaaactattccaaaaaatcgaggatgagagattcttctctaacttactgtacaaaacctatatcatcctgataccaaaatatggcaaatacacacacacaaaagaaaaccctaggccaatatatctgatgaacatagatgaaaaaatcctcaacaaagtacttgcaaaccacatccagcagcacatcaaaaagataatacaatatcaagtgaactttattcctgggatgcaagggttgttcaatatatgcaaatcaattaatgtgatttatcacataaagagaattaaaaatgaaaaaaataagattatctcaacagatacgttaaagtatttgataaaatccaacatgccttcataattaaaaccctcagtagactaggcatttaaagaacatactaaaataataagaaccatctattgacaaacccagtctacattatactaaataggcaaaagttggaggaattctcataagaacaagaacaaaacaagaatatccacttttaccactcttattcaacttaatacttgaagccctagccagaatgatcgaccaacagcaagaaataatagacatccaaataggaaaagaggaagttaaattttatttcttcactgatgataggattctatacctagaaaaccctaatgattctgaccaaagacgcctaaagttgattaaaaatttcagtaaagttttaagataggcaatcaacatacaaaaagcagtagtatttctatacaatgcaatgttcaaactgagaaccaaatcaagaacacaatcccatttatgagagccacaagagaaaaaaatgaaatacttaggaatacctctaaccaaggaggtgaaagatctctttaagtcgaactacaaaacactgctgaatgaaatcatagatgacacaaacaaatggaaaaatattacatgcttatagattggaagattcaacatcattaaaatgtctttactgcccgaagcaatctacaaattcaatgcagttcctatgaaactgccaaaatcattttttacacagaattagaaaattgattctaaaatttatatttaactaaaaaagagcctgaatagccaacacaatcttaagctaaaagaacacagacaggggcaacacattacctgacttcaacctatactacaaggctacaataaccaaaatagcatggtatgggtacaaaaatagacacatagaccaatggaacagaatagagaatccagaaatgaggcctcattcctacaaccaactgatctttaacataattgataaaaatgcaatagggaaaggataccctattcaattaatagtgctgggaaaactggctaaccatattcagaagaatgaaattaggctcctgtctctgaccatataaaaaaattaactcaagattgataaaagacttaaatgtaaaactttaaactataagaagcctagaattagacctaagaaactcttttggacattgacgtaggcaaagaatttatgactaagtactaaaacacaaaagcaacaaaaaacaaaaattgacaagtgagaccaaattaaactaaagagcttctgcacagcacttgcatgttctattgcaaatatgaaatagcaaaggcatggaatcaacattggtttccaacaatggtggattgtataaagaaactgtgatgcatatataccatggaatactatgcatccagaagaaagaatgaaatcctttcctttgcagtaacatggatgtgcctggatgccattatgctaagcagatgctgggacacaagaaaaatctttaagatatgtcactgcttcttatcaataataatgttctagtgagtaacaagagttaagaacaccactaattatagtactgtaaatataattacagttctaataagacatacacacacagagaacaattttgtctggtggttgaggaaatcttcattgatttaagatattttttgatgaacaggatttttcaataactatcagacgaagaatgtctatgacttatttttaaaaactattttcttctctgccttgcatatctgacattttcatctcctatcttccttgaatacaatatagaacctgacatttctttcctttcaaagatccttaaaacatttcctacatttaatctgaatgtctttctcagtaatttttcttatacaagcaattatggctacattttcttaatataatcatgaaaaagtgagcaactgaaaatttaatctggagaatatatatgaaacatattcaattaattcaagttgttgttaggctgcatatgttcagctttcagtgaaggtgattgataaatgagaaactgaaagaaaacaaaccaataggtgtttttcagaaacagtattattaaaatgcatgtgctttctactgaatgaaagcaatatagactttttcctcgcattggtagttagtaaggtgtataaaaacgactttgtaaagaacaattaatataggttaatgaatcactgtgaagaggggataacactttattctagcaatgatctgcaaggtgttaaaagttaaaaaagatgaaaaacaattgaatagttatttcatcatagtgtttattaaattgattttcctgtatctgtcaagctttacagaaatgtcttcaacagaataacagtgttggaagccaaatgaaatgcattatgaaatatgattcttcacttggtatgcaggtatactctcaggtgttaactcaggcaaagagacaaattcaattttaaagttccatttgttaaaatttgatgattgtgattaaagacccataacaattctatctttgacattttagttttttcttcacagaagcattctactgcaattttcttagttttctttcctcttaactgtggtattacccataaatgctggatttctctgttttaagtgtaacaaacctacaatcaactatttctggaacaccacttcatcttaacaacaaggacccataaatattctaaaaattcaaagtgttttatataaaatgttaaatgatacacataataaatttctaagtagtaattatgattatgcccataattatacccataatttaaaaatatgttacctgaagtaaattattacatattttatgttggaagtattcatttatctttgatctcttttaacacactgtactaggtggtaataaaataaactgccttattgggtagtcatttatcttttgtttcatattttttactggactaatattccaacgctatagatagtgaaatataacattcaaacaatttgatagtagtcaatgaatccagtttttaaaaatgggatccattttctaaaattgagtatatagatacttcatgaaatgtcttatcatacatcctaaaccaaaccaacctcttcccttgactgtcttacagtgcgttattattttatccactgcagcaactagcacatttttcagaacctagtagatattcagtcattgtctatggaatacatgaacacattctaaatttggacagtcatcattcttggtgttttaaaacaaacacttcctgaattgcacaaactattttctaaatagccctgggaattcattgaaggaaggtatgggtaagttgggggtcaaactataaagatgtaggttctcctctcaaaacttcttcagcgtatcctcattgttgtttgtttgcttgcttgcttgttttgaaagatctagatatagtctaatgagagttgtataaatgtgatgttccacaatgattctaacttacatggtgcaaaataataaaatattacattctagctgtttgtggaaaatcagggataatataaaggatctagattttctctctcctctcctcctaagatttattcactcagcaaagttacctggtgactacttactgctagacactgttttagatacttgggctataacgttgataagaacagggcttgaattagtgaaaagtttattttaattagctgtatggcaaaataggaaactaacaaaaataaacatataacatgtcagatggcaatggctgcactgagaaaaatgaaggagaataagaagttctaaattattatatatgaccaatattaccaacatattatagaaagaaatgagttcataatgtttatcagagaatttcatgaaaatcactaaatttttccagaaagccaggcactgataagggaataaacaaacagataaccgattttaatttgatcttctcttacaagtgcagctatgatctgccattgtatataatttaaattttaaaattgtttatatttctttcacataattatgttcttacattttgtttgtttgtttgttttgagacagagtgtcgctctgtcacctaggctgaagtacaatggtgcgatctcggctcactgcaacctccacctcccgggttcaagcgattctcctgctccagcctcctgagtagctgggactataagcaggagcccccacgcccggctaatttttgtactttattagagacagggtgtcaccaaattggcgaggctggtttcgaactcctgatctcagattatcagcctgtgcctcagcctccaatagatgctgggattacaggcgtgagccactgtgcctggccaatattcttacatttaaagatcagacatctatcagattcccttctccctgctacaaacattgtatacttttccataggcacaagattttgttttcattcaggttggactcaacaagtattatttagcagttcattgcatttatccatttacccaatagaggaagtataaaagatacagatgaataaagtgtaataattcttatactcactatttgcccttacatcatgtaagtgctcaactgtacaacatgtttgtgttcccaaaacctaactggaagggataactcagaaaaatagaataaaagtattgtatatctcatacatcttcattttagaatattgtaggggtacagatcagtataaataaaatactttggtaagtgcccaccacatcatctgtttgtcatccttagagccagattataccattctcattaagaaagaaaacttactactgtacctcctacccagtaacatatatatgatatatatatatcatatatatatattttatatataatatattatatatatatataaaacatttgctactggttaggagtaacactcagaaaatcatacttaataatgtagtacaattgggtataaattcacctagtatttttaaattttatgtatattcatatttatatgaatcatcatttaaaatcatgtctactgatcctgatggcattaaaggcataagaggtaccgaggatattaatttaattttgtttacagctatgcacagatatttttagttcactcagatttaatccagtagtctattatttgattaattgtacagctatcaaatcattcaggactcccactgtttcaacaagagtggaaaaatattttttcatttatgtttatatgcagctatttgtagtctaaattaatattctggcaattgatggtgaaattaaaattatttctgtcagatatggtaatttgatgacagtggataagcatgggagtaagagaaagttttgaggaagaggggtactttttgtttacttaatgattattcaaaagatgttaagtaaacattctatagaatgctacagatagtggaatacaacattgaaacaatttaataatgcagtcaatgaatccagtttttaaaaatgggatccgttttctaaaactgagcatacagacacttcatgagatgctttatcacgcatcctaaaccaaaccaactccttcccttgactgtcttacagtgcatagggtatctctacattctaggaaaggaattatctgtttatatgccacttataaaatcatacttaataatatagtacacttaggcataatttcacttagcatttttaaatgtaaaatgttaacgaaaagtgttcttgaaaaatatttctgagaatattttctaaaaaatgaacaaatcgtaacacctaagggatgatatctttctagtgaattgattatcagagtataatgtggtatgttctgattatgttacataatattctgattagcagaacattttaaataagtgaatttagcaaaatatttagaggttaaggaaactgttttacactgactatgttttctgacccaaatgtgagaaagaacccaataaaaagaggcagccagataatgctgttgtttgtgaacttaaacagaagcttgcatgtaatttattgttcaaagaaaaataaaaatagaagttatactttatttagaacttaatgacagtgaaaattacataaaaaggaagactactgaatacagcaaaagctgaaattatataggaaatataaatataaacacacaaaataagtgtaaattataatgaagtaaaaatatatcaaagagaaaaaaggaagtagtacagtaaaaaaaaaaaggtgatgctttaaaaactgtaattaaatagacaaatttccagccagattgatgaccaagtaaagagaaaaggaaggagacagatcaaaagacacaagatgatgaatgaaaagggggtcagcacttataaatgtagtagcaatgtaagccataatgagcacaagaaaacattatcaacttaattttgaatatataaaatagagacacttaaaaaaactgaacaaaaacaacttactagttttaaaagaaaaaaaagtcatcaaacatatatccttccaaaagtatagacttcaaaagtatagccccagatgggtgaacaacttcaaaagtacagtcccggatgggtgaacataaaccacactttaagcaagaactctcagttataactgcttgcaattttagaggataacagccacactcctgaaccagagcttggcaccggctattccctctggaacacccttttatttccttctctaagcaaagacatggaatcaatctaaatgcccaccagtggtctgcgggataaagaaaatatggtatataaacatcatggcatactatgcagctataaaaaagaacaagatcttgttctttgcagggatgtggatgtagttggaggccattatccttagcaaactaccacaggaaaagaagaccaaacactgcatgctctaactcataagtaggagctaaattatgagaacacatggacacatagagtgggggacagcacacactggggctttttggagggtggagagttggaggagggagaagacaaaaaaaataactaatggttactaggcttaataccggggtgatgaaataatctgtacaacaaaccaccatgatacgagtttacgtatgtaatgaacctgcacttgtacccctaaacttaaaagttaaaaatgaatgaagcctgtcagaaccacccactttgtagtcttacattttccctagtattcccaaacccctttgcctagtcaacattttacaaagcgcttttcatcttctactgtgttataatttatatatttttagtgtatattttacacactttattagaatatgagttccttcaaggtaaggactgttgtttgttttgtgctccctgatgtattttcagagcctagaacagggcctggaataaaataagcagccaacactatgcgatgaaaattttttggtgggtataaatgcctttgattcgaaacaaaactcagtttaattgtgtgtgtgtgtgtgtgtgtgtgtgtgtgtgtgtgtgtgtctaaagtcaccctaagcacactgttaataaccctagaatgactgacgtgttcgtattatgcaattttttatttttttcatcatattgacagataaaggattctaattcctataccttttcaataatgcagaagccttcataacatttaaattccattcatggtaaagattcttagcaaataaagaataaattgaaccttgatcaattactttaaagtagttataaaagacctatagtgaatatcatacttcagtattagaagctttctctttaaaataaggaacaagacaaataattggcaacatgacttcttttcaaattgcacagcattagggatccaagccataaaagaaaataaaagacatgtggatcataaagaaaatataaaacgttacttacagacaataaagttgtctgcataaagattataagagaaagctaaaaactattacagtcaaaaagagacatcagcaagcttggtggaaacaaaacaaacaagtacaagttgtcagtgacctttcaacaaccaattaggaaaaaaatatatatatacgttaaatcttaacactgaaaagcaacaaaaatatggaaacagtgcttcttatatgccagattctgattgaaatattttacaagtttaactcatttaattttcccagtgattcttgaggtagaggccatatttttcttaactttaatagatgcagaaactgaagcacagagagcacttgacttgcctaaggtaaaagttaaaaggcggcagatgtagaattcattcacaacaatctagatccagagtatttcttgtgcccctgatgatatgccaattctctggactctatcactaactctattaaatgatcaagaacttgaaagaaaaaaatatttaaattagtccatgaacaggaaatgtccaagtcataaacctagtaatatttcccaaagataatgcttaatagtggtgtcattacaaccaaaatactaaaaaaatgtgcaagccaatctcaaatatgtgggagagaaaacccaatactaatttgaagaggataaaagagcaaggcatctcccttgctgacagaaaggcttcttataactacaacattcatactgaaatgctattatactagatctagcactgaaacaatccaggccactacaaatgaatgaaaaatgagtccagaaaaacacagatccatatatgaaaatttgttttataacagaaattgcattaacaaatcagaggttaaattttaaaaaccataaaatatttcagacaattaattatttatgtggaaaaaagtaaagttgactcattatcctgcccagtacacaaaaatcaattccaggtggacttaaaaacataatgcaaaagcaaaactttaacataattaccaaaaatgtaagtcatcatctttatggtatttaaataaaaaaaagacttctttaaaaagacacaaagaaagcaaaacccataaagagaaaaactgatactcttgaagatgttcaagtttaaaactcatgcaaaatagcaccaaaaacaaggtgaaaaggaagcttcacagaggtactagataattctgctatgtttaactagcaaataattagtatccagaataaataagaaagcaatacatcactaagaaagtgacacacaaccctatagaaaaatgggaaaaaatatgaattggtaattcacaaaagagaaaatccaactgaatactaaatattataagagaatgttgaacaagtcaaactattaaagcaatacaaattaaattgccaataacattattttattcccatcctattgaaaacaattaaaaattctgaataccatgtggtggtgaaaatgtgatttcatgagtatatagcaatttggacagcaaactgacagcatgtgagatagttgatgatattcatatgacccagaaattccactattctagaaaataatcttgtacatatatataataaaatctatataagaatgtatactgcaacattttaaaattcaattaaagattagaaaagctctaaatgtatcaaaacaaagaacttgaaaaacagattataaataaatttatacagtggaagtcagtaaactgataaatcacaaaaacataagtttgagtaacaacatcaagttgcagtagacatgttcagtatatcatttccacaaattaacaaaataaatagtgctatatttttatggctataacacataaaggaaatatacatatgactttctagataggtattatttcttgtatctacaagtagaaaatggggttgcgcagagagggtgatagctacaattgcttctgtaattattctctttaaaatgatctgactcacaaacttaagagctggtggaaattcagcacgttttttttcctctttttctctccctgaaaagcatggaggtgttgtcactctcttcctgagtccctcagtgagcagacgtagagaaaaataccctaactgatctggaagtggaagatttaagttaaataaccttcaggaaaaaaggccttaaactgttttaaggcactaatattaaggtggtttcattgttacaggataacctagcatacgctgactgctattagaattcctgccatgaatcctaaaatatatgatatagtcttagtgatcattgggtgagtggcaaagcaactataactaaagctgaaagcatggtaatacatcttccgcagtgacaggatatttgataagactttcaccagcaaaaatatggaaggtacatgacattcctaataaaattgtagttccaagagaaggatggccagatttagcaaataaaattgcaaggcattcagttaaatttgatttccagatataaaacagatattattgtttagtaaaatttccatgtgatattatactaaatgattatacatatttgtactaaagaaaaacagtgttgtttacccgaaattcaaatttaactggttttctgtgttttacctggcaatcccatcaagagggagacgttgtgaaatagaaaagtagcaatatttcttggttactataaaagttatttaacaagactttataagggaacatgaagtcagagaagggggcaaaacactagtcattttaaaaactaggtggggaaatttggaagtagaggtgaccagatttcacagaagattgtagggtgagaggagtatagaggaagccaatataatacatcaaggtttatggtttgaaaaatggaaagatggaatatcaattacctgaaatgaagaaaatagcacacatttgtaatttgagttgcttattagcacccaactagagatatcaaatagatagttgaatatctacatctttgaattcaggagagagattcaaactgaagacataaatatggacattgacagcatatagatgacagtatactaagtttataaagataaaatagtaataaaagctaatattaacctcttttgtgtcagtccttgatgtaaatttttttatgtgttaactcactgagtccccacaataggtcgatgtaattggttctactataactacactctttaaaaatggatattttagtaaaaagaaggactcaatttatactcaccctcaatttgtagccattggtgtcatctctaagacaatttttagtaattgcctagtcagtgaaccttgccatagtccttagttatgtaaatttattgtattttttggaattccttttcattagccataacgctttaataacatatttttaaaattttgactttaacatctatattgtagtgaatatttaaagaacttcctccaagtttaggatacagaaatgggtaaattatgtctactccctcatatttcactattaagatgatggtaaattagcagtccaagagatcatggtcctgaaagtacagagaaaaaaatagaacccagtgacccaacataactaaggagcatatttgagacattgtcattcttggtatttctgaagaagcactgggatggaagggagttgagatcattttgtcagctacagcactaaattttggtcatgaatatcaaagtgattccatctttatgaggagcctgtggagaatggcaacatgctatatgtatacattttagaatggattaattgccatctgcgtaccttttatcaggttattctatttgttcagcatgccccaagatctcttttgtactttacaaatctgcacttcaattcttcttagttcgagactcacttcaacctaccgcatccttagttttctgcacttacttgttgtttctaaaaaagtatacatgatattatacaataaacatctagaattatacatttatgtactatattcacagaaattggacttgcctttaagccctcctttttacatatattcctgttattgtctcactgctaagtaatattactggatggcaaaataaaccaaaaaacacaaattgattttaatgaaaaatatcaatattaaatattagcttaaataacacaaataagtaaatattgaaatagatgggcatgttaggctgggcagctttttgtgggcacaatcatacaatttcaacttcaaattccatcatataacaggatgttctattggtacaatatctccttgttcacatgaggaaattaagtatattgatattcaccgaacaccaatttttaaatgtatttgaaattaattattttaagtgtctctcaactctcccaatagtgcacaaatatgtagttatgctatatactaataattaaataactttggaaactcacaacttcaaaaaaatgttcgctgttgtggaaagtttccgcagtagagaagggaatgtgaatggtatcagtcttagataacaagaaaactactttactttgtttcaactctactcatttgccatccaaatatgatagaagatgctgctcattcctaacaaatatttccagatatcatgcattccttaaaggagatgatactgattgccctctctattttcactcactttcccattacaattagcagcagattcttttaattatccctgcccttcttaaagcagtctcagatatataaaaattaattgcctggaactcacatctttataattttaaccttttcatgcttcacttatttacggtgacatttatctaaaacacttatcaggtgactgcgcatggtagacatctggtttatcagaaaaggcaggagaaaaaataaatgtaggacattaagcttgctatggtgctttgagactttcctagaaatcgttagctcatcaaaacttgttttggcatggcagaaagacatgtcccattaaaaggatattaatgcaagatcaccattgtcattaaaccatcataccatatattacacatttatgctgaaaatgggttcaaactttttattcccttatcctttaattattagaagaaactttgcagattatagccagataatttaaaataataaaatcaatgtcacttacaaggtcacaggatttagtaaaaccctgctacccatttccttttaagtaacttcgcattttagaaatgaagactgcctattcatgtggcttctgtgattttgttaaacattaattaacaaaatttctagtttttttttttttttcttctagagcagttcagtggaatgaaagaccttttttatcctatgcctctaaccacaaccgggtgtctctatcttaaaagatatttatcaagtctctgcttcatatttccttctctacaccattacagtcctcagcaagccctgctatctcatgatcgcaaatcttggccctttattgttggtcttctttctttcattgctacatgttagaataaatggtgtaagagaatgcttttatctattcaatttctttctctttggctcctgacccactgtctttgtttcagaataattatcagtgcctatatattaccttcacatatgaggcctttgttcgtttcattctttccatctcaattttctgtacattcgtattctctaaagtcttcatctctgtcaattgttcccttatctccctcaagtggacactgtcggcttttcgtagatgttcctactcaaaagagatcttgcaagccagtattttacattaagtaattgttctatttctcgacttttgctggcctataaatataacacatataaaggtagccattgcaggcacagtaaattatttgtctatgaaatcacaatgtttgccccagtatcttaatacaactctcaaatttatataattttttaatttaaaaatttaaaaataactttgcttaaacaaaggcagtttgttttctaacttatctatgtgtgtatgtatatatacacagaaatgtatatgtatacacacatatatattcataaattattgaaagtttcatgcaaattttttactttgccaatatgccccaaaacttgatatgaaattaattatacgaaggagtacagccttgtctttaattagctagaaaaattctcagcccacttaaataaactgttcccaacttggggagataaatttaaatatcttatcttggcaacgaacttataacccttaaaaacatttgctatggcatctatatattatatttcccttgatgtgaaaaataagaaacatttcagaaaaacccacaattaaagaatatcacctggcatcatgtctaaaaatgtataacagtaaaatagaaaagatttgtggatatgacaacaattctgcttgctttcaaaattattttttgctttgttttttgcaaagcctaattaaattaatatatgaatattgagtctattaatcttctctcttaaaaattcaaagcactattttaaagtaaattatcttaggaatattatctaagaatgaacttcatgtggtaaataccagcataagtcattactaaatgtgtttagggtatacaatggaagcagagtctgctgctaggaaaaattgaccttttgttttacaatttataatttatttagtgcagtatttgaaaatcatatttagatataacaggtgacaagagagctctatactaggaaagataattttagtactaccatctataaaagagactaataaatatgaaatgaagatgctataattaaactgtaactcttgcccatgccagcccaacataactattataaaattgtacataactatcaggctgttaatttgaggtaatattgcaggcactacaaaaaaaattcagtaactcatcaaaactattttcttatgaaggtaataaaagctacaatacctgcccatgtcaattatttaaaggtgttcgaagcaaatttcttaaataatttaatttctggagccagacataacagttgactttgtgctctttgacatttactactacagactgttgctaagtccaggcttcaagaactctcctgcatttattctttttaaatcaatggtacaaattatctaactagctatatgtgacgacagcagtggttctcagtttggttttaacaccacctggaaacctgcaaagtctcaggtttcaccccaggtctaccgaatcagaaacactagggataagccccaacaatcactgttttagtaggatcttcaagtgatttcaatgcaggttaagtctgaaaacactggaaaagaggagagaaaaagagagagagagaggagagatggagacaaattcccagaccatacactgcactagaaatagagtgttaggactttacaacaggttcaaaattttagagatgaattatagctgacatttgaacacaaaggaaaggagcccattagtccagggaacatctctgattataaacaacttcatttcctgcttaggtattattcaaatgtatatttaacagtataatgcttctctacaatcaagtaaagctcaaacaaatttaagatgtctttttttttaatgttgtatgttgatgagatttaaactaatagaggcttagctcaattggtgattaaggtgatgagtctgccctggaggtggaaataaatatttcattagacttgtgatgaattctagataattttgacactactagaatgattttgaaagtctggatgatttttgaccaaatatagacccaaatacaaatattgtgaataaaagtattgctaggatttagaaactttaacaagttacataatgtttaaattcatgatttctgtgggtaatttgtggtcagtgctttggggggcagaatgttaaagagatttctatatgagattatgagtaaaactttgtgacaaacaatttgaaaaaatagttgaaaagaagaattcagtaggtaaagttaaaaaagtagaccttactatgaaaaaaagagtagggatatatagaaaatttagatattacgagttgaatgtgtgcagacttcccaagatctatgaatgctataaggaccactacagttgatagcgtagagaaactaaggcaatatttatgcagtgttttagaaggccacagctccattccattactatctgatgatattttagcaaagctggactctgcagtatccttttttgtttgaagaggaatagtagaaggagcatttgtcactcttatttcaccttcaacttctcattatttcccatacacgctcctgttacaattcttgggaaataattaaaataaacttacagccttttatatgggtaatttaaccatatttactagtgtttaaatgattcaaccactgctaggctgtgtagaaaatacaagtactggtagttgtgtgaaagttagctgagtttagataagaggtggcctgaaaagtcaagtctcactagagcactgagattttaaaactattctctgggaactagctagctagctagctagatagatatagatgtttctcaataacaacaataaagaaaattatttcttcatgtatttattacaataagcaaaatattgactaataaaaacacaagaaaggaaaaatactaacaaaaaacatcctgaatactctatatactaaagtgtaataccaaaataaaaattagacacttagcattttctgtgagataaaatagaccaagcaatgagcctcgcttgatgcttcatacaccaggagagctggaaggatgcacaggttcagtaaaaacatgccaaaattaacatgagaagacatgattttatttacttatttatttattttttagagacagggtctcactctttcacctgggctgggatgcattggcacaatcagagttcactggagcctcaagttcttgggctcaagcctcctgagtaactaagactacaggtgcatgccactatgcccaaataattttaaaaaaatttttaacagaaacggagtctcactaagttgctcaggctggtcttgaactcctggcctcaacccatcctttcatctcggcctccctaagtgctggaattacagtcatgagccatggtgcccggcctaataaatgattttcaataaattatatttaacaaaatggattagaattaaccaaaaaataaaactagtaattcaaagctttaaggagtggatgtaggtatgtatctacgcatggatgtctgttaattttgtttctttttaaatcagagaaaacaaatttgaaaagatgctttgaaagtagctgccttcttattgtaattgttttaccaaatagcaaagtctagttcttcaaaattgtcagaacctgttatttatactccatttattcttatgattgggcaatgtgtggcacatttaaggattattttccagtatatcataaatatattaacaatgtgacactttaaggatctaaggaggactgaaaattttatctgaggaattcgttagtctatcacagaggtagctctttgatacctaagtcatcaccttttatagaacgtaacataaaggttgaagttttcacagaataagtaatactgtgaattttcagatagagtgtaaactcctctgggttggctggcttttctgtccttacagagctgcccattgtggtcaaattgaccacatgagaagttgatgatgcagttatgccatgcatagcaaccgcagcaggccttcctcattccaatgtaaatattcattatatgaagcattatctaagacccttttgccttgaaagagagagtaaaaaattaatcaggagtagagtctctaaaatattcatttccctggttcatggagtcatacaagcttctttatcatctcagcattttagtctagtccaaaagcccaaagactaaataaagtaattgatacatggcatccatgaaaataatacaagtaaaatatggctttatgttgactatgcaaatttcatatgaaagaaattgtttccaagaaacttaactcaataaaatttaaaccataaatatttttcaccaattttattcaataaatacttactgagaacctactgtttcctggccttgttatacttgtttggaattcatttgagaagtcaaccatataatacttcatgacattggtctaggcacaggtttttttggataaaaacttaaaagcacaaacagtgaaagaaaatttaaaggcatcttaacagaaaaaaaaaacaatcagcagagtaaagagacaacctaagaacaggaaaaaatatttccaaaccatgtatcagataagatattaatatccaaaatatataaggaactcaaacaactcaatagcaagaaaacaaataacctgattaaacaatgggcaaaaaaatctgaatagatatttctcaaaagaagacatcaaaatagccaacagatatatgaaaaatatatttaacattactaatcttctgggaaatgcacataaaaaccacaatatcatctcatcccaattcgaatattatcaaatagacaaaaaataacaaataatggcggggatgtaggaaaagggaaactctattacactgtttgtgggaatgtaaattagtacagtgtttatgaaaaacaatatggaggttcctctaaaaattaacaatagaactaccatatgatccagtcattctactactgggtacacatccaaaggaaatgaaatcagtatgtcttagagatatccacttccatgtttattgcagcactattcacaatagccaagatatgaaccaacctaattgttcatcaactgataaatgaataaagaaaatgtggtatatatacacaatggaataccattcagccataaaaaaataaatcctgttattcaaggcaacataaaagaacctgaaatgaaataagccaggcacagaaagacaaataccacttgatctcactcacatggaatttaaaagagctgatttcatagtagagagtaaaacagcagttgctagagactgagaagtagagtgagaaggaaagatggagagagactggtcaaaaaattcaaagttacatttgcacaggatgaataagttctggtgctttattgcacattagagtgattatggtaaaaagtattgtattgtatgtttcaaaatacttagaagaaagaattttgaatgtttttaccacaaacaaaatgataactgtgtgagatgatggatatgctgtataccctgaaaagattattacataatgtatagatgtaggaaacatcacactataccccataaatatgcataattattatgtgtcaaaaacaaaatttttaaaagttaatcactctctaatgaaagtatcttttggctcctagacacctgattttttttttccattttgccaaaagtcaaattctacatactaaaacaaagaatttattgtatcctttcaaaacaatatattttaatagcatctatagattcatcaagcaatgatgtaatgaacacaataaaagcttgagtaatctaactactttacaatagaaattgtaatgtttttgtttttgttttgtacgttcaatcctctgaaaaacatgactcttcctgatttttttttcttttttgaaaggagtcttgctctattgctcagtctggagtgcggtagcacgatctcagctcactgcaacctccgcctcctgagttcaagcaattcttcctgcctcagcctccagagtagcttggattacaagcaccaccaccttgccaggctaatttttgtatttttttagtagagacggggttttgccatgttggccaggctggtgttgaactcctgacctctggtgatccacccacctcccaaagtgctgggattataggcgtgagccactgtgactggccaatattttaaatgttaatgtctatcattatattttctcattctcttttgctgtacttattaaatggtctattatcctagaaaataggtaagaagatgaaaaacaaaccagtagcataagatctgaaactgattgataagttatacattaaatatatgatttgatttgcttaagacctctagtatttctattccttttttaatttttagagtttcaaaatttcattataattttggttaaatttactgacttctcaaaacttctaaagtttaatgaactatatacccatcagtgtattaagcagaaaaatagtttagaaaattgtcaccaaagtatgcactttgtatctgaaaacaataatgaggcttctctctgaccattaatcttgggcttttatgacacacaacaattttactattttgtttatttgcttggtttatagtacatgaagacagaaatattatagtttctgtttcatgtagcacatttctttaaaaatgtgttttaaaatgcctttttttctgcaaaactgaattccagtacctaatttctctgttactttggtgggccaggagtcctgccgagaagaatattgatgtctctctcatcagaggtttttgataatgtcaggtttccaatatatcctaggggtatatttttacctttttaaaacaaaatttatttttgcctatttttttcgttctaaggctctttatgacaggactatttaaagcactgaggacaagacaagatgtttatatatacttcctgctgtttaatattcatgcaattctgacaagattaatatactaatttctctgtcattagtttcattaacagatattaattatatctgaatctaaatgccaaatgaatagacagttgggattcaattctatttaagataatcgaagttctctttacaatcatgattggggtggcatacataccatctattctggttagagatggactctggacgctagataaaacacttgggattaaaacacttatcctagaacttatcattataggcacttcacataatgggggaaactgaatatttacaataaccttttggaatagttgatgatgatgatgatgggaaagagagagagaaaggccaggtgtggtggctcatgcctgtaatctcagcactttgggaggctgaggcaggtggatcatgaggtcaggagttcaacaccaacctggccaacatagtgaaaccccatctctaccaaaaacacaaaaattagccaggcatggtggagtgtctgtagtctcagctacttgggaggctgaggcaggagaatcatttgaacccaggagggagaggttgtggtaagccgagattgtgccactgcactccagcttgggcatcagagtgagactccatctctaaataaatacataaataagagagagagagaggagagagaaacatccttttttctggtaaaatttagagactagattgtccaatgaagatggctgaataggaacagctccggtctgcagctcccagtgtgactgacgcagaagatgggtgatttctgcatttccaactgaggtactggttcatctcactggttgaatagtgggtgcagcccacggagggcgagccacagcagggtggggtgtcacctcacccaggaagcacaaggggtcaagggatttccctttcctagccaagggaagatgtgacatactgtacctggaaaaatgggacactcccgcccaaatactgtgcttttcccaaggtcttcgcaactggcagacaaagagattctctcctgtgcctggctcgtcaggtcccacacccacagagccttgcacactgctagtgcagcagtctgagattgaactgcggggcagcagcctggctgggggaggtgcgtctgccattgctgaggcttgagtaggtaaacaaagcagccagggagctcgaactgggcagagcccaccacagctcagcaaggcctactgcctctatagactccacatatttgggcagggcatagctgaacaaaaagcagcaggcaacttctgcagacttaaaaatccctgtctgacgctctgaagagagcagttgttctcccagcatggcatttgggatctgagaactaatagactgcctcctcaagtgggtccctgacccccgtttagcctaactgggagacacctcccagtacgggctgacagacacctcatataggcaggtgcccctctgggatgaagcttccagaggaaggatcaggcagcaatatttgctgttctgcagcctccactggtgatacctaggcaaacagggtctggagtggaactccagcaaactccaacagacctgcagctgagggacctgaatgttagaaataaaactaacaaaggaatagcatcaacatcaacaaagcagaaaggaatagcatcaacatcaacaaaaaggacatttataccaaaaccccatctgtgggtcaccaacatcaaagaccaaaggtagataaaaccacgaagatggggagaaaacagagcagaaaagctgaaaattctaaaaaccagagtgcctcttctcctccaaaggaatgcagctcctcaccagcaacagagcaaagctggatggagaatgactttgatgagttgacagaagtaggcttcagaaggtcagtaataacaaacgtctccaagctaaaggagcaagtttgaacccattgcaaggaagctaaaatccttgaaaaatggttagacgaatgcctaaccagaataaacagtgaagggagaccttaaatgaactgatggagctgaaaaccatggcacaagaactttgtgatgcatacacaagcttcaatggccaattcgatcaagtgaaagaaagggtatcagtgattggagatcaaattaatgaaataaagtgagaagagaaggttagagaaaaaggagtaaaaagaaacaaacaaagcctccaagaaatataggactatgtgaaaagaccaaatctacatttgattggtgtacctgaaagtgatggggagaatggaaccaagttggaaaacactattcaggatattatccaggagaacctccccaaactagcaatgcaggccaacattcaaattcaggaaatacagagaacaccacagacactccttgagaagagcatccccaaggcacaaaattgtcagattcaccaaggttgtaatgaaggaaaaagtgttaagggcagccagagagaaaggtcgagttacccacaaagggaagccaatcagactaacagtgggtctctcagcagaaaccctgcaagccagaacagattgggggccaatattcaacgttcttaaagaaaagaattttcaacccagaatttcatatctagtcaaactaagcttcctaagtgaaggggaaataaaatcctttatggacaagcaaatgctgagatattttgtcaccaccaggcctgccttacaagagcttctgaaggaagcagtaaagatggaaagaaacaaccaataccagccacctcaaaaacatgccaaattgtaaagaccatggatgctatgaagaaactgcatcagttaactggcaaaataaccagcgaacatcataatgacaggatcaaattcacacataaaaatattaacctaaaatgtaaatgggctaaatgtcctaattaaaagatacagactggcaaatcggataaagggtcaagatcaatcagtgtgctgtattcaagagacacatctcacatacaaagacgaatataggctcaaaataaagggatggaggaagatctaccaaacaaatggaaagctaaaaaaagcaggggttgcaatcttagtctctgataaaacagattttaaaccaacaaagatcagaagagacaaagaaggccattacataatggttaaagggatcaattcaacaagaagagctaactatcctaaatatatatgcacctaatacaggaacacccagattcataaagcaagtccttagagacctacaaagagacttagactcccacacaataataatgggagactttaacgcctcactgtcaatattagacagatcaacaagacagaaggttaacaaggatatccaggacttgaactcattcatttgaactcgcacttataaaattgaccacataattggaagtaaagcactcctcagtaaatgtgaaagaacagaaatcacaacaaattgtctctcagaccacagtgcaatcaaactagaactcaggattaagaaactcactcaaaaatgcacaactacaaggaaactgaaaaacctgctcctgaatgactactgggtaaataacaaaatgaaagcagaaataaagatgttctttgaaaccagtgagagaaaagacacaacattccagaatctctgggacacatttaaagcaatgtgtagagggaaatttatagcactaaatgcccacaagagaaagcaggaaagatctaaaatcaataccctaatatcacagctgaaagaactagagaagcaagagcaaacaaattcaaaagctagcagaaggcaagaaataagtaatatcagagcagaactgaaggagatagggacacaaaaaaccctccaaaaatcagtgaatccaggagctggttttttgaaaggaccaacaaaattgatagacctttagaagactaataaagaggaaaagagagaagaatcaaacagacacaataaaaaatgacaaagtggatatcaccacagatcccacagaaacacaaactaccaccagagaatagtataaatacctctatgcaaataaaccggaaaatctagaagaaatgtataaattcctggacacatatgccctcccaagactaaaccaggaagaagttgaatctctgaatagaccaataacaggatctgaaattgaggcaataattaatagcctatcaaccaaaaaaggtccagggccagacggattcacagcctaattataccagaggtacgaagaggacttggaaccattccttctgaaactattccaattaatagaaaaagagggaatcctccctaactcattttacgaggccagcatcatcctgataccaaagcctggcagagacacaacaaaaacagagaattttaaaccaatatccctgatgaacattgatgcaaaaatcctcaataaaatactggcaaaccaaatccagcagcacaagaaaaagcttatccaccacaatcaagctggcttcattcctgggatgcaaggctggttcaacatacacaaataaataaatgtaatccatcacataaacagaaccaatgacaaaaaccacatgattatctcaatagatgcagaaaagaccttcaacaaaattcaatggcccttcatgctaaaaactctcaataaatcaggtattgatgggatgtatctcaaaataataagaggtatttatgacaaacccacagccaatatcatactggatgggcaaaaaatggaagcattccttttgaaaactggaacaagacagggatgtcctctctcaccactccttttcaacatagtgttggaagttctggtcaggcaaatcaggcaagagaaagaaataaaggacattcaattaggaaaagaagaagttaaattgtccctgtttgcagatgacatgattgcatatttagaaagccccattgtctcagcccaaaaattccttaatctgataggcaaattcagcaaagtctcagatacaaaatcaatgtgcaaaaatcacaagcattcctatatgtcaataacagacagagagccaaatcatgagtgaactcccattcacaattgctacaaggagaataaaatacctaggaatccaacatacaagggatgtgagggaccttttcaaggagaactacaaaccactgctcaatgatataaaagacacaaaaatatggaagaaaattccatgctcatagataggaagaatcaatattgtgaaaacggccatactgcccaaggtaatttatagattcaatgccatccccatcaagctaccaatgactttcttcacagaattggaaaaaaactactttaaagttcaagtggaaataaaaaagagcccgcattgccaagacaatcctaagcaaaaaagaacaaagctggaggcatcatgtaacctgacttcaaactataccacaaagctacagtaaccaaaactgcatggtactggtacaaaaacagatatatagaccaatggaacaggaaactgggctcagaaataacaccacacatctgcaaccatctgatctttgacaaacctgacaaaaacaagcaatggggaaacgattccctatttaataaatggtgctaggaaaactggctagccacatgtagaaggctgaaactggatcccttccttacaccttatacaaaaattaattcaagatggattaaagacttaaatgttagacctaaaatcataaaaacctgagaggaaaacctaggcaataccattcaggacataggcataggcaaacacttcatgactaagacaccaaaagcaatggcactaaaagccaaaatagacaaatgggattgaattaaactaaagagcttctgcacagcaaaagaaactaccatcagagtgaacaggcaacctacagaatgggagacaatttttgcaatctacccatctgacaaagggctaatatccagaatctacaaagaactcaaacaaatttacaagacaaaaacaaaaaaacccattaaaaagtggtcaaaggctatgaacagattcttctcaaaagaagacatttatgcagccaacagacacatgaaaaaatgctcatcatcactggtcaccagagaaatgcaaatcaaaaccacaatgagataccatctcacaccagttagaatgacaatcattaaaaagtcgggaaacaacagatgctggagaggatatgaagaaataggcacacttttacactgttggtgggagtttaaattatttcaaccagtgtggaagacattgtggcgatttcttaaggatctaggactagaaataccatttgacccagcaatcccattactggatatatacccaaaggattataaatcatgctactataaagacacatgcacacgtatgtttattgcagcactattcacagtagcaaagacttggaaccaacccaaatgtccaacaatgatagactggataaagaaaatatggcacatatacaccatggaatactgtgcagccataaaaaaggatgagttaatgttctttgcagggacatggatgaagctggaaaccattattctcagcaaattatcacaaggacagaaatccaaacaccacatgttctcatagttgggaatcgaacaatgagaacacttggacacatggcagggaacatcacacactggggcctgtcagagggtggggggctggggaagggatagcattgggagaattacctaatgtaaatgacgagttaatgggtgcagcaaacaaacatgccacgtgtatacctatgtattcaatctgcacgttgtacacatgtaccctagaacttaaagtataaaaacagaaattagagacattttctgcctcaaatagatataacgcatgttactaatttattaagcagaactcatcaagatgccaaaagataaaaatctactaaatcaatgatatagttaccaaaagtcaccctgtataattcatggatttaggacatgattaagtacatacttagcataattgaaaggtgtccacctgaaagcaacagtaatcacacacacacagacacacacatgagtcaatctgtcaaaattacacaccaagcttttaattaattcatcaattatacatcagtgtttctggattattagaattattttgacacattaaaaagtaaacactcctaatttaactcatattatttttgataaaggcattgtggtatgccatcatttcataatatacactgaaacatattcaaataaaatgaaactatatctgagacatgcttcaagtaatttgggaagaaaggatgggagaagatatagttggtgcaagtatgcctatgaattggtaattgttgaaactgggtgataaattcatagtgtggtcatgatggtcttctgtttttttgtatatatttgaaaattgctatataaacatttttgaaatacaaattcttaggccacattccagtcatattgaattagaataccctggagttgaagcttcaagtgagaggtgaagccagctgagcttctgggccggatggggatttggagaacttttgtgtctagctaaaggattgtaaatgcaccaatcagcactctgtaaaatcacaccaatcagcatgctgcaaaatggaccaataagtgctctgtaaaatggaccaatcaattctctgtaaaatggaccaatcagcactctgtaaaatgggccaatcagcaggatgtgggcggggccaaataagggaataaaagctggccaccagagccagcagcgtcaacctgctcggatccccttccatgctgtggaagttttgttctttggctctttgcaataaatcttgctggtgctcactcttagggtccacaccacctttaagagctgtaacactcactgagaaggttcatggcttcactcctgaagtcagtgagactacaaacccactggaaagaagaaactctggacgtatctgaacatccaaatgaagaaactccggacataccatctttaagacctgtaacattcactgtgaagctccgcgcttcattcttgaagtcagcaagaccaagaacccagtggaaggaacaaattccagacacatttggcaaccacgaagggataatcaccaagtagtgagtaccatcggacccctttcacttgcaattctgttctatttttccttagaattcaggatctaattatcgggcacctgtcggtcagttaaaagtggttggtggccgggcgcggtggctcacgcctgtaatcccagcactttgggaggccgaggcgggcggatcacgaggtcaggagatcgagaccatcccggctaaaatggtgaaaccccgtctctactaaaaaatacaaaaaattagccgggcgtagtggcgggcgcctgtggtcccagctacttgggaggctgaggcaggagaatggcgtgaacccgggaggcggagcttgcagggagccgagatcccgccactgcactccagcctgggcgacagagcgagactccgtctcaaaaaaaaaaaaaaaaaaaaaaaaagtggttggcacggccactggaataaaaacacgggtgtcaggcattctaggaaagggctctcttacaacccctgactcttcggggttggaagcattgatttgcctggaaccagcttccacttttcttgtacttctgggctgagccgagggtagacagagtggaaagccattcagctccagggtcccaacaacaagttggttgaccctgaggctgagcggaactctcaaagacatgtcgcctaagggagactcgcccatctctcctatctatcctgacccttgcctcctgggtcctcatgcctgtcagacaaacttcctcttgcctctcttctctgaggctagtctcgcttctaaaaaccactccctgtctctggtgcttttctagtttctcgtataagaatgatttctagcataaactttaggactctattcccttctttaggcacccaggctcaccaatcagaaagacataatttttgcccaaagccccatcggaggagccagactatcttatctggaattttaggacccctcctcaggctagcaggcctaacaaaggctattcctgaagctaggatatggggagcctcagaaattgtatccttgctattcatataagtgaggacaaaaggcatcactcttccaaccctggagatctcttccctctctcagggtatggccctccacttcatttttggggcataacatctttatagggcatggataaagtcccaatattaacaggagaatgcttaggactctaacaggttttctagaatgcattggtaagggccaataatccgaccttcctcattcctccttgtggtctaggaggaaaactagtgtttctgctgctgtgttggtgagcgcaactattcccatcagcagggtccagggactgttgtgggtgcttgggcaagaggggtttctgctgccacgtcagtgagtgtaactattctgatcagcagggtccaggggccactgtgggttcttgggcagggggagaaacaaacaaaacaaaaccgcaggtggttttgtctttcagatgggaaacactcaggcatcaatgggctcacccttgaaatgcatcctaagccattgggaccaatttgacccgcaaaccctgaaagaaaggcagctcatttttttctgcactatggctcggccacaatattatctctctgttggggaaaaatggccacccgagggaagtataagttacaatactatcctgcagcttgactttttctgtaagagggaaggcaaatggagtgaaataccttatgtccaagctttcttttcattgaaggagaatccacaactatgcaaagcttgcaatttacatcccacaggaggacctctcagcttacctccatatcctagcctccctatagctccccttcctgttagtgataaacctcctctaatctcccttgcccagagggaaataagaaaagaaatatccaaaggaccacaaaatcccccaggctattggttctgtcccctttaagtagggggaggggaatttggcccaacgtgggtacatgtccccttctccctctccgatttaaagcagatcaaggcagacctggggaacttttcagatgatcctgataggtatataggtgtcctacagggtctagggcaagcctttgatcttattggaaagatgtcatgctattgttagatcaaaccctggcctttaatgaaaagaatgtggctttagctgcagcctgagagtttggagatacctgatagcttaatcaagtaaatgatagaatgacagctgaagaaagggacaaattccctactggtcagcaagccgtgcccagtatggatccccactgggacttcaactcagatcctggggactggagttgtaaacatctgttgacctgtgttctagaaggactaaggagaattaggaaaaagcccatgaattattcaatgatgtccaccataactcatggaaaggaagaaaatcctgccttcctcgagcagctatgggaggccttaaggaaatacactccactgtcaactgactcactagagggtctattgatcctaaaagataagtttattacccgatcagccacagatatcaaaagaaagctccaaaagtgagccctaggccctgaataaaatctggaggcattattaaacctggcaaccttggtgttctataatagggaccaagaggaaccggcccaaaaggaaaagcgagatcagagaaagactgcagccttagtcatggccctcagacaaacctaccttgctggttcagagaggacagaaaatggagcaggccaatcacccagtggggcttgttaccagtgtggcttgcaaggacaccttaaaaaaggttgtccaatgagaaacaagctgccccctcatccatgtccactgtgcagaggcaatcactggaaggcacactgccccagagggcaaaggttctctgggccagaagcccccaaccagatgatccaacaacaggactgagggtgcctggggcaagtgccagctcatgtcatcaccctcactgaaccccaggtacgtttaactattgatgaccaggaaattgacttcctcctggacactggcatagccttctcagtgttaatctcctgtcccagatgactgtcctcaaggtccgttaccatccaaggaatcctgggagagcctgtaaccaggtatttctcccacctcctctgttgtaattggaagactttgctacagatagtaagtatgcttatctaatcctacatgcccatgctgcaatatggaaagaaagggagttcctaacctctgggggaacccccattaaataccacaaggaaatcatgcagttattgcatgcagtgcaaaaacccaaggaagtggcagtcttatactgccgaagccatcaaaaaggggaaggagaggggagaacagcagcataagctgctgacagaggcagggaaagaccagcagaaaggaaagagagaaagagacagaaagtcagagaaagaggaagaaacagagagacaaagaggaggagacagagagaggaagagacagagacaaagaagaagtcaaagagtgagagagaggaagagacagagagacagagagtcaaagaagtaaagagaggaagagacaaagagggagtcagaaagagaaagacagacaaagaagagagagacagacaagaagtcaaagagagagaaagagggagatagaagtagtaaagaaaaaacagtgtaccctattcctttaaaagccagggtaaatttaaaatgtataattgataattaagggtcttctctgtaaccctataacactccaataccaccttgttgtcagtgtaaacaagggtgtagcccaaaagcactgaggctactgacaacccatagccttcctatcaaaaatccttaacccagcaggtttccaaacagggatctaaatcttaatgaattaccatacaaaggtctgaccagatctaggaggaactcccttcaggacaggaggatagatggttcctcccaggcagttaagggaaaaagacacaatgggtgttcagcaagtgataaggaaactcttgtagaagcagagttaggaaaatttcccagtgattggtctgctcaaacgtgcgagttgtttgcactcagccaaatcttaaagtacttacagaatcaggaaggagctatctataccaattctaagttaatatggactgaacgaggttttcattaatagtaaagaaaaattataatcccaaacttacaaggctttcaactaaagtttgctaaaagttaacagtgtaatatgtattatcctgctaccacacactcttaaaggaattctcagacagtttgcaagaaataacgaaatctatccttactctacaatccgaagtagactctttggcagcagagactctcctaaactgctgaggcctagacctcctcactactgagaaaggaggactctgcaccttcttaggggaagagtgttgtttttaccctaaccagtcagggatagtaagagatgctgccaggcatttacaggaaaaggcttctgaaatcaaacaatgcctttcaaactcttataccaacctctggagttgggtgacatggcttctccactttctaggtccggtagcagccattttgcaattactcacctttgggccctgtatttttaacctccttgtcaaatttgtttcctctaggatcaaggccatcaagctatagatagtcttacaaatggaaccccaaatgaactcaactaacaacttctaccgaggatccctggactgacccactggccctttcactggccgaaagagttcccctctggaggacactacagctgcagggccccttcttcgcccctatccggcaggaagtagctagagtggtcatcgcccaattcctaacagaagttggggtgtcctgtttagaggagggattgagaggtgaagccagctgagcttctgggtcggatgggggcttggagaacttttgtgtctagctaaaggattgtaaattcaccaatcagcgctctgtgtctagctaaaggattgtaaacacaccaatcagcacttggtaaaatcgcaccaatcagcactctgtgtctagctaaaggattgtaaatgcactaatcagcgctctgtaaaatggaccaatcagcaggatgtggatggggccaaataagggaataaaagctggccacctgagctggcagcggcaacctgtttgggtccccttgcacactgtggaagctctgttttttcactcctcacaataaatcttgctgctgctcactctttgggtctgtaccacctttaagagctgtaacactcactgagaaggtatgtggcttcactcctgaagtcagcgagaccacgaacccaccggaaggaagaaactgcagacacatctgaacatccaaaggaagaaactccagacagaccatctttaagagctgtaacactcactgtgaaggtctgtggcttcattcttgaagtcagtgaaaccaagaacccactggaaggaacaaattctggacacacaagttcctaggcttcatccaaaacattaaatcagactctttgaggtagagtaagacacatatttacaagctagttatgcaagttatgatccaggtaaaacactaatcgattgtatccaaaatataagtcttctatcattctgttgtacaaaatgaatgaaatctctaaaatatttctttaggaaccaacacaaagatattccattgtactaagtttgttttctggaaaacaaactctcaggtaaatttgcatgtatgatgtttataagggaattaacttttaattaattatgagaggggagttgaaaagaagtacaatccaggcagagacaacaagcccacagaatatcttaaaaggaatggcttcctgagttctcatgcactgaggctagatgactgggccttgatataactctctccagccccactgaccagccatttgatactatgcttccaggtgatgaatttgtgtgaaatggttgtctttaaatgaagggcaattcctcaggagagactcaagtaattttcactagccagcaacattcctagcatgtggggatgaaggtaattgagaggggagaattcattgcctcaatggttacacatgtaacacttcatagcacccaccacatctataagagctaatatattttttctgggaatttctttactgtcttttctcatttatctttatatatcccttacaagtcaacaaagaaatactgcagtggtggttatagtgactacactgtggttgctggctgtttttttagtgtttaaattaaataatattacccttaggaataaaatgtaaaaccatttttttaaaattcccatcaaaatcaacataacatactgtttgtgttagtaacagaaatatatttaactgcatagataataatgaatagcagtctggattttcaaataaattatttcaagatgatatttactaggttagatacatgtaccctaactcccacccattcacttcctagaaatgtgttttaggtgatgttatttaggtggtaaaatcaggtcaataactcctactgaatccttagatattatgtgttgtacagggaaaaggtagtataggtaaaacttgtgtgagacacactttgttgttttagactagactgtaagttccagctgtgtctgaatgtttgtgtttccccaaaatacatatgctgaaatcctaaccctcaagatggcggtattagaaggttgggaggtgattaggtcatgaggggtgttaacaatagttcccttaataaatgaaaggcctaagagagacccgtcgcacattccactatttgaggacaccactaactgtgagccaaaagcaggacctcctcagacatcgaatctactggtgcctttatcttagaatgccaacctccagaactgtcagaaataaatttttagttttataaatgcctagtttgtggtattttttatggcagtcgatcagactaaaacaaatgtttactctgttgtgatcagatagtttatataacttacctaacacataataggtactctagtaggtcgctcctcctttgacctcagacctttccatttgagaaattttacaactttatttcaaaatgcattccatctactttacaaagtaaaaatacaaaggcctcttatcatgatgtgactattaggctttacaagcctatatcaaagtgtttcatgtaccccataaatatatacacccacacatattaaaaatttaaaaagtgaatgttatacacctccccacttcctttacaaaacttagctcaattccatctggataataagaaaaataggaaactttattgaataatgagtcacttctatgtgtaatttccactgctagtatgagccttcagaagggactggctttaagaattggtacagttcttgactgagaggaacttccaccacctagcagatggggcaatagattacaagggcaattatcactcagagaattgctgataaggtcaaattactgctgtcactttattcttaatctctgtatgcatttttttttctaaaagaaaactgcatatacaattctacagaccaaaaatattgcaaaaaatatgagtttatatgtcctaagagggttccccaattatcacaattgtttcaaatggaaacaatttcatatcccatatgtacatatatataaaaatatatttatgtatgtgtatatatatgcatatatatgcacacacatacacatttctctgcagatgttagtatgtggaaatgtattgctatataatagggacaataattagaactcaaaatctagagtaatgcaactgaaagtcatatcatgcatgtattacaagtaagatactctgcaatgtatacaagagaatgtaatttttaaggaccaaatgtgtgttattaatcaggtatacactctgtaaacactacgtggtataaaattgcttctcaacacaggaaatatttataacctaagtatacagtccaagaagtactttatttctgacacttcataccaaagcaaccagactgacaaataagcattctgagtaaaagcagtgttttaaataacttttgaacccaatgcatgcatgcaaggctgataaatgcaaacccttttacataatactcaaatcatattaaagagatgcttcttgacagagatacacttaaaccattctacatttctcctttttgttctcctgtgtgaaaatgtcaccttaaaagcaattttttaagaaacaagtgctgtttcatttcatgtcttcagatacattgtctgcccatgttttagcgattaggaatttagaggtttttggatgtttattacaactctttgacttatcagtataaatatttatcataccaatcatatttattctttgattatcttgacatggcaaggttttttcaattttatttaaaagagccagctgttttgtatcttatttactcacccatatcattgtttcccgttaaattaacactggcataagccagctgcaagttgcaaggaaatcgcactgaaaacagagctactataaattgtattcgcctctatataccaacaaaaacaaataaaacttttttattaatctctatgactttgttgttgtttaaagcaaatctacattaggaagagttgtcaggaaatttgggaagttatattgtttcctgaaacctgatattgattgatgagagtataccaatgattgcaagttctgagaaaagagttttacacaaaatgaacagcaaaagcttgggcatgagaacaaacttagaatgtccaagggataggaaaaaacgtcctggcagcagagcagcagataggcaggaattgaatcatgtgtactttggtaagccatacacgggcattgagaattttattcttaccacagttggaagtcactggaatattttaagcaagagagtaacttgaactgatttatgcttttaaaagattaccctgattggctgtgtgaaaaataagcgatagggagcaaaagtagaaacagggacaggagatgacagtggcttatgtataagatttcttctaaggatcttgaaagcatcatgaactaacatcacttgggaagtagataaattcattgctgtgtccatagtctgtttatttccctttttttttgtatgtatttgcagaatatgttagtaaacaaagtgaaattcaaggaaatcactattagggctgcctacaaatcaagtcggtttagagctattatagttgagtagtaatattctttcagaaaaaatcttaatcataaagcccaacacttatactatggcttcttaaaagtgaagctgcaaaactgcttgtgaacaatcttacagctatttttataactttttaaagtgttatgtacataatttcttttctgatgacctcattgaattctaaaccatcttttagccacacataagccccaacagttaaaactattaaaatgcattagcatgtccttcattatttgttttaatcaagaagaactgaaataaggaatatgtaacataaatttagttttgctaacgaatacatcagagagaaatatatctccttagagaggaatatattttatctaggtattttttttgaacagtgaagcactttttaaaaaagtaatactgtacacagaattccaaaatataaaacagacaaataaattaaggtacctttatacaaagtcattctatgcagctattataaaaagtaaaatatatatgcattgatagggaagttttaatttattccatataagtaaatattaattgagcattttatatttgagccatcatcctaacagtttgtgataagatagcaaatgatatagggaaagtctctgttttcagatgtttttatattttgaaggaagtagacaaatattaatcaattaagtgaatatgcaagaaatttccacatagtaaactaatctgcagaaaacaaagtcatgaattatctaattcttgagggaacctattacagactgtgttattagggaagccttttttaaggaggcatatatgagggaaaatctaaataactaaaggagccagccataggaaaatagcagaagagaatattctggaaaaaaaaaatggcacacaaagacatttcacctcagccaaagaatatgggatgataaaggacagaaaaaagaccaggaagcaggaggaagagaggtagtagaagcagatgggatgaggcaaatgagacaagatagtgtaggaccttacaggtcatggtagaggaagacacttagatatgattacttaataagaagctatcatagcactgaagcatggaagagatgtgatctaatgtctatttttcaatgccattctgaccagatttcgggcaaacctggtagacacccatagtaagactccaggaaaaaaaaaatttgatggtttgattatatatttgctttaaacatttggcttttcagctgccttgcatccatttccctttaacaatttatctgtttttaaattaatgaccttttctattagacacactttcatcaggggccctgtattgattggtatcttccagagaaacagaaccaataaaatgtgtgcgtatgtatgtatatgtgtatgtttctcagagagagagagcgagagaaagataatttaaggaactggctcatgtgattgtggagttgggcaagttcaaaatctgtaggacaggccagcaggctggagacatagggaggaattgtcatagtttgtgtccaaaaatagtttgccagaatcctcagttttttgagggaggtcagtctttttacttaaagccttcaactgactggatgcagccaaccgatatcatagatccaaagtccagtgatttaatgttaatatcatctgaaagcataccttcacatcaatatctagatatatttgacagatatctgggtaccatgtcttagccaagttaatgcataaaattaactatcccaggctccattccctctggtcaaagggcaagcatgtgattcaagctaggtcaatcagttgctctctccctcaaatttgcactgggttaaaaagacaaagaattacatcctgtctatacagtcatgccaaatcacatgatccatctccaacccctaaaacacataggtatggcttttgttctcaaccttcagctcctaattcctttaaaaagttaccagtatattctgtgaggccacagtgaatcttctaatagtttacttttatgtaggccagagtcatttggcttgtttgaaattaaatatatatatatatacatatatatatatatgtgtgtgtgtgtatatatatatatatatatatatatatatatatatatatacatatatatatatgtgtgtgtgtgtatatatatatatatatatatatatatatatatatatatatatataaaattgcttcagtcaggctccaggtacttggaaagacattcatcaaattaataatggttatcctggggactgggctttgaggattgaggatttctgatttttaatatgtgtctaatctttttaaatgtttcagtataatttataattagcagccaattattttataattaaagtaaatcctgaaaaactttctacattagtgtgtggaaaaacagcacaattgccaaatttatagggcgaagaagtcctatgtttacctagaggggaaactctgaaccaccacagcccaacaggaggctctgtgggacaatttggaaaacattaccataatctattgtttttatatttatttagaaaagaaacaaagggagcaagatacctccccgtctgacatttaaaatttgattcactgatatattttggctcacagtatcaccttgtggcatttggcatctgctgctccccctccccaaagtcataatatactgcataattaattcagcacaagtagtgacaatgccaactctgtttatttaaaaagatacctcgactgttcttttgaataaatagattgcattcctttaaaaatccaaaataatactgaattaattagaagtagtgcaatcagaataaattaggtcctatctacatacaactcagttttaaagctagaaattcaaattaataactaatttgaattagctacttcttcccatgtgtctctgagtaaacaccaagcagacgaaaaatttccattgccaataataatagtaacaatagcaaatattgttaaactcttactatttgctggtaactagttaagcatgcttcataaatcttcttttatagtagtcatgaaaaccacatatctgagctattaccttcattttgtggatgacaagttcaaactgagttttagagacagtaagcaacatacccaacatcacacaagatttaaattcagactctgagtgcttacaaactatcttacgctgtgatggtaaacatctttgcaaattttccctcataattgagtaagccatcagagtttcagaataaatgtgtaggaaaacttataaacatcagggacaagcttaaggacttgacatcttttacttttgtgtgtgtttcatagaaaaaaatagctcaaaggttaatttaaagtaatactttgaacaaactccttaacaagaagagttagacttcatacttgttattcagcagaatagtgactttgttcatacaactaaactaacgaactcaattcctcctttcgactgtttcttttttttgcctccttaatagttattttatacctgtttcttattatttatttattccactaaaaatttcaatgtcttcacattatctataattggtgctatggtatattacagttgaatatagttgaacctgttcaaatacattttgaccaatgataaggagaaccaaggattcctttgctttcatattacttcacacatgactttttaaaaaatttactttaatttctgggttacatgtgcagaacgtgcaggtttgtaacataggtatacacatgccatggtggtttgctgcacccatcaacccataatctacattaggtatttctcctaatgctatccctcccctattccccgacccccagacaggcccccatgtcacacaccacttttagaatcacaatacaatttcacattcaggacaatacttgctgaattttagtttgtgtttgtgtgcgattgttgatgggaagaacaaaatggcagtcacatcatatgttgactctagatgtgttatttatcatttgtttcttcaaaatattttgacaaacgatcttcgcattaaaaggctgtgggcagtttgggagctaccacctgtttccctcttcattgatcactttgctggccccaaaacatatccacagaaaaaattttgaaagtgattggccaagggactcagtgaggatatactttaatatttagaacactattaaaaacaaaaggagacattattaacaatatgctgggacaagaattataacctgggactttctatggcaaatgggatatatgattacttgatctagactgtataaaataaataatatatttggataatctacaattacaataagtatttatacacacaaacatatatatacgtacatacacacacacacacacacacacacacacacacacacttcacatatgtacctttacaaccaatatactttaattgagactgagaggacaagagccatgattattcatatttatattcaatgacttattacataataaacatattttgaaaatttgatgagttaattcaattcaaaatatgcaaaaaatatcaggctgggcacggtggctcatgcctataatcccagaactttgggaggccaaggcaggtagatcatctgaggtcaggagttcgagatcagcctgaccaacatggtgaaaccctgtctcaactgaaaaaatacaaaaattagccgggtgtggtggcacatgctggtagtctcagctacttgggaggctgagagaggagaatcacttgaacacaggaggcataggttgcagtgagccaagattgtgtcactgcactgccttggtgacaaagtaagactccatctcaaaaaaagaaaaaaaaaatactgtatatctgctatgtgaagccaatgggtttcaagttaggatataatgacaaagaagtttaaagaattcatagcgtagtgaaagaaaaacattcatagtaaatgaacacactgtaatgaagagtttaatatttatagtaggaataaatgggatcacaaagagaaactattagttttgaggatctatcattttaggttaactgatatgaaccttcaataacaaatatgtgcttaacatatgaaacagagagaaagtagggtaattctcagagttgttcagggtcatatgtgatgttctgtgtgcctagacaagttgtactatgtgtgttagaagagatgagactggaaagtggtcagatataagttactttgaatgataagataaaagccgtggaattcatttggtgtatgatggaaaacactgaacctttttaaacaccaaaaaatcagatcagcattgtattgaaaaacaaaaacaaaaacaactttggctttattgtgatggtggttagaggagtgagagactggaggccggatgccgagtttagagtatgtctttaaatagatgttctgacagtgtaaatagacaggtgtcaaacagatttgagtaagagtatataggtaatgcagaaaatggctttggagattgattgagtttggaacggaggtcattgaagtctaggttcaaatcaataatgaccacaggagtaacaatacatagtaagtatggatacattagaattggatagaaagaataatgaggcatctgccagaaacacagttaaaaatatccagaaaaagacgagaaattcaaacttggaactcaagacagatttcaagttagaagacttatctacaacaaatacataatccctatttgaggaaaaatagaactctatataggtttgctcaactcaatcttagtaaaacaataagggagaaaaaaagaattacaaaagagagaagccttggaactctttaaaatttaatcataattttaaaataaatttcaaaataaataaaagtgatcaaagatttaagaggcaaaatccaaggccaccaagggaatgagaaaaaacggtacttccataaaaaagcaagagaggagagatttcccagactgtaatatatttaatgtgaggctatgccaagaagaaatgataagtgttgtagatcactgaaaatcatcattacttttctgataactgagaaagcttccccggagggagagggtttcatagataaaccagagaagctgtttttgacatgaaagctagattttttaagacaaagattgaagttgagatgtttgtcactagaaattattgggatccaatccaatggttttaaacagggggagagaaaaagatgaccatgttcagtgagcaactgatgttgaaatactgaaaaccacatggtgcaataattaaaggaaggtatacacagtaaacgcatagaaaatacgttaatatatcattcatttttctgtccagggataaataacactgcaaaagaaaaaacagccaaccaatcaagcaaacacataaatgtatgctactgttcaattgaaaaaaatgcataaggatttatcatggttttatctgtgcttcattagaaaataaagccaaggattttatactccaaattctacagacttttttcataataccagaaaaccttaactttacagacataataactttaaaagagttggaaattaagaataaacatacataataatatatctgggcaataatttatttcatcctacttgcctagcatcctcaacgtagtttggcatacattaaggtcctatagaaatttatcaaattaatactaaattagcagagtactatgaattgctttctacctttgtaacaccagatgtatatatttatgtgttcaatataatattaatcttagtgtttgtgaaaacattaatttgccaaagagagttgtttatattagaaaaccgtgtaatctacatttataaaatcagtgtatttctaaacaagtgactttaaattttgatataaagcgatttttatttttattatatcatagttcatgagataaatttattaatagactatatttttaaaagtttttctgaactgacaaattctgcatgtattataatggggttaggaatggtttctcaagtcaagaataccaccaaagtaaggaaaatttcacatcaacataggtgaacaggtggcaagtcttccaaaatttgaagaattctttcaagaaaggatcagcaagtatgtaattagagtcaacatgttctgtttagctgacattaatggttagctttcactctggagagcaagatcttattgaaatttcatgaaattttagcagaatatataaaggaaaatagaaaaagagacaatcaaaaagaataaaagtacagacataaacacagtaatttgaatgtgaagctcaaaaactaactccagtttttatacctagtgttctagaatggattcaaaataacaatatacataacaatgtacataaaaacctgatgccagtactaaggatgattttattttctaaagattgccacaataacattttcttttccatatgctcttcttataatgtgacttggacacccctcatatagggaggtggagtatgtttctaccccttgaaactggcagagatttgactacaacagaactgacccttcaaattccatagctaatttatgaaaatttctgcctaattctcttgggaagcttgttgtgacaacccactgtcttgctgtgaggaagccccaacagcctataagaggcttcagtggggtgaaaatgaagcctcagtcttcaatcctggatgagcaccagccaacagccaaaatcaacttggtagccatctaagttaatcattatgaaagtggcacccagccctcagttaaagtgccacagctgatgctgcatggagcaaagataagatgttttctcaagtcttgctaaaattgcagcttagtgagcaaattaaatgattgtagtttgagcccactaagttttggtggcctgttatacggtgactgataatctgaccaagtgcctaggcttacaagtaaatatatctatatttttgtacatgaaataaaaaaataaatatttgccataattacttaaatgtataaatcttaaattctcattttttcaaagtatgttaaggaatggctcaatctgttaaaaatgataaaaggatcaagattgatcattccagaatttcttccataatatttaattcaaaaagcaaggttttaaaagaaaataaaagagtaattgttcaaaaaaatatttattgatcttcagttaaagacctcctttttttactggcaagaatccactatccttaggatctttcatgctctttgcccaaacactactttacaaaggattcagagcataaaaaatttcctgacttatttcttcaccattagttcattattctccttatgttaggatatgcaatatttaatattggactgggtttgtcatctgaagactgaataagttttatccttggactagttctactttgagtactgatactcaaaatatgaatattatagtacaacaagggagatagtgaggcattctgaccaaaaatttgcccatactctctgaaaatacttttggatataaatatttttcaacaactatgtccacctacagagtgaatctccaacttaacccaggctgccagagccagaaaaaacctgctatcaatttttgcatgtagagctaggactcaaatgtatcttaattttatttactcttcctaaattgtatctatatacttaaactgtctaccagaaacgtttttgtgtatattcaacacatgcaaccagttaatatttgtgcagagcttagcatagttcattacgaacagaacattctatacaacctctagacattatgatcacttacgttattaccccaaattgaaagtataatctggtctctagcattaaactgcataggaatgagagagatgctcagtctgtaatctggagaggaaaggaaggtcaatgattctttgtaaaattaagtttgtacactctgcttttcaagcagcagtctctatcttcctttactttcctcaatgaactaactactagtaaacagtcatcagactgactcattgaattggattattgcggtttcaatgtataccttctcttggggtcccactggtacactagctgaatctattaactcggaaacataaattaatactaaaaatatatttttctttttccttttttatatttaaaaggattttaattggaagtacacacacacacacacacacacacacacacacacgcaatacagagtgccaaatttgtatggggatgattgaaaaagattattatcaagtattaaatatttgtttcagcatatttgttttttcactgttgtctttccgaatagaaattttcgaatgaaacaaaaatgcacattttaataccagcccaatatacttgatccttacatgtttaaatttcatgtgcaaaaaatgattagtcatagagcaaacccaccctcttgtagaaattttaaaagattttaatgccagcgtaatatacttgaaccttacatgcttaaatttcatgcacaaacaatgattagtcatggagcaaacccaccctcttgtagatattttaaaagataaataaaaatgaaacttttttaaaaaaagagttatattttaggttcaggggtccatatgcaggtttgttacataggtgaagtcgtgtcatgggaggttgttgtatagattattgcgtcacccagttagtaagcccagtacccaatagtcatcttttctgctcctctgtctcctcctaccttccaacctcaaatagacttcagggtctgttgttctcttccttctgttcatgagttctcatcatttacctcccacttatatgtgagaatatgcggtatttggttttctgttcctgtgttagtttgctaaggaaattagcctcccactccatctatgttcccgcaaaagacaagacctcattattttttatagctgtatagtattccatgtggtatatgtacatcattttctttatccaatctgtcattcatgggcatttagattgactccatgtctttgctattgtgaatagtgctgccatgaacattcatgtgcatgtgtctttatggcagaatgatttatattcctctgggtatattcccagtaataggactgctggatcaaatgggagttcttcttttagctctttgagaaattgccacatggctttccacatggttgaactaatttatactcccaccaacagtgtataagtgttcccttttctctgcaaccttgccagcatctgttattttttgactttttaataatagtcattttgactgactgtgcaatggtttctcattgtggttttgatttgcatttctctaacgattagtgacatttaactgtttttcatttttttattggccacatgtatgtattcttttgaaaagtgttcatgtccaaaagaaaacactttttgatgtttttatttaattcttgtaattttaaattcctcatagatgctggatattagacctctgtcagatgcatagtttgcaaatattttctcccgttctgtaggtggtctgttcactctgttgatagtttattaagctgtgcagaagctcttaagtttaattagatcccatttgtcaatgtttgcttttgttgcaattgctgttggttctttgttacaaaatctttgcctgtgcctttgtcctgaatagtattgcctaggtggtcctccagggtttttctagtttggagttttacatttaagtctttaatccatcttgagttgatttttggttatggtataaggaggggggggtccagcttcaatcttcatatggctagccagttctcccagcaccatttactgaataggaagtctttttgccactacttttgtcagctttgtcgaagggcagatggcagtaggtgtgcagccttataaaaattatgtttgtcatcattacttttaccagtcctttcaagtaaaatttttatgttcaccatctttaatagtttgtgtgttttttttgtttgtttgtttgtttttgtttttgttttttgggttttgtttttttttttggctgggattcaacaaaataacataatggcatataactttaggtattctacatctattttgtccagtcaagttctgattagcttttttgcctgcaaaaatacttcatttggctgaaaacatatttttatccaatgcacataactatttatttttctctccagctgttttttttattcatgcaagttaactggaccagtgatcattgctgtgagtagactcaaaagtgattctcagctattttagatctgctgtgagaaaaaccaatagatgtattaatattataacattggataagcactctggctttacatttaggaggcattcctgttctattcctcaaaatctcaaatagaggaccctcagaacttcagttctcatgtattttgaggaaaaaaagtcaagtagcttccaacaaattctaacactttgagccattttgggaacccagagagctgattgctttccagggaaatagcaaaaatactggttaaatggttaaatcctagaccacggaatttttaaaaacagaatatgtgtatacacacacacacacacacacacacacacacacacacacacacacacaaatacaccttttaggggagaaattgatatttttgcctcagcaggatatccatttgccttaaaattcttattcttaggtatgtacatcaatcatctggggaggtccaagctgtgaaatccaaactgacagaaatttatagctccattagcatttatcaaaaatacaggattaagtgtagaaaatatgtattcatgcttcacctttctatatctttactttaagaggtaagtatttgtattcagtatttgttagctcctaccttcaaacggccaaacataatctccaataacatttcagaattctactgggccaaaaatgtatcctattgacctgtgtgtcctctgacttacgactgcatgtttaaatatgaatttaagaaaatgctgcactgattatttggagtttttcagaatggctagtgaattccttggtgatttattggtaaaaaaataaaataaaataaccatgttggactgttgtttcataacatactttctatttggaaattatataattactctttgtgttaaaaatgtattcatactccctgaaaatagtttcggacataaatatttttcaatgtgcatatactgagttttgctattataaattatatgtctacaaaatacttgaacatgatcccattgggttttaaaacatgcaaataaatggagaaagataagagtatatttaccggagttctcaactcaggtatggcagcttgataagtgagtggacggcaatcacgagtgtttggcacaaggacacaaggaagaaacattggacccaagtcatctccatccagaacatccactgtgagagtggtggtggtggttcgcctctcattcagattttgggcacggtcctgttagggagaaaaacaaacaacaggtagtttatagaaattaggcacaatagccaggagcagtggcccatacctgtaatcccagaactttgggaggccaaggtgggtggatcacttgaggtcaggggtttgataccagcctggcaaacatggtgaaaccccgtctccactaaaaatacaaaaatctgggtgtggtggcaggagcctgtagtcccagctacttgagaggctgaggcaggaggatcgcttgaacttgggaagcagaagttgcagtgagccaagatcacgccactgcactccagcctgggcgacagagtgagactcagtctcaaaaaacaacaacaaaaaagaaattaggcacaatgtagacttagttttcattgaaaaaaaaaagattggtaaattaacttgcttaaaccaacagttttaagtggttgagtcaggatgtaaactgagatccaattgtcttcaaagcaactttcttgaaagtatgttacagtagttaagcttttgtatgttaggcctttacctaacagttcacattactagacagcctaaccataaaggtcactctcatctcattagagcatttactttagaaaccttgtaattgtaaattccttctctgcgcctctgaggtgttaatcttttataagctgcttgtcagttctacaaaccaggcccatctttttcatgccctggggggccatctctttgaaatgtaatagtcaaggaagaagcccgtatttcccagtttctgtgggaggttaggagcctgacttcctttggaggcttgctccaatttctaaaactactttctgtcatgaaaattcaaggaaatttattttcctttgggaatgccaattagtaaacacatctggtctgtgattcccccacacccaagtccactggagtgtttaacagctctccagccattttttctattagagatcagttcagatctagtctgtattctggtctctcttctctattgcaatagctgtgaatacagtcttccttatcatttaactttgtctagtgcaattttgctgtaggaatacattgttactaactaaaatccaaagtttctttagatttccttagtttttacttaatgtcagttttctgtttcaggatcccaatcaggataccagtttgcatttagtcataatggttccttaggctcattttggctgtgacaagttctcagacttttgtttttgatgacattgacaattttgagcactggatattttgcagaatgtcccttaatgggtgtttatctggtgttttcctcaagattcaactgcggttatgtgatgtatgtaggaaaaccacaagtcaactgctattttgacatatttatcaaaagtatatgattaatatgacttatcactgttgttaacttcatcacctggctgaggctgtatctagtcagttttctcaactataaatttcctctttcttgtttccctttcatttctttggaaggaaatcatgatggacagcacacacttaaagaatgggtagtaattttattagaaatgtaaattgtttatatttatctgaagaatgtttgtcataggacagaagaaaataatattggacctaagtcatttccatgaagaacatccattgtcaagggtggtggtggtagcatcattcattatgacagaatctggaaatgtttttactttcacagcatttagttattattttgaagaactattatgcttttctgcctttttgaattctattttgtacaacattgacaagtatacttgcatgcatgttcatgtagcactattcacaacagacaaaacttggcaaaagcccacatatttatcaatgaataaatggataaacagattgtggtatgtacacacaatagcatatgattcaagcataaaaagaaatgaagtactgatatatacaacaacatgaatgagccttgaaaacatcatgttttcaaataaagaagccagacaaaaaataaggtcacatattatacgatccatttatatgcaatatctggcagcagtaaacatattggtggctacaaggagctggggaggggatatggaaagcaactgcatgagtggtgccagctctttttggagtgattaaaatgtttgggaactggatagaggcggtggttgcacaatactgtgagtgtaccaaatgccattgaattgttcactttaaaatggctaatcttattttgctaatttatgttaaataatttttaaaagtaattatactaacagacctgtatttttttttttttgttcataaaatgtcttcctttgtgacagttcccagacattaatatttgccttccaattaaaaaaaaagtccctcttgttaaacatggttaatagtacattttggttaagctcattcccagtctggttgctcataaaaacttgtaaagcaatgcttgagggtaaagttttaggaaacacgaatttctgttggtggaattttgtcagtacaaccttgtctagaatgtaataactctgtggttccaggattctttgatatttttatacagtataagacagactgcgataaaattatagcttaaaaaaacacaaaatgtttaaattttcaaagtttcggaactcactcagatccctagaggcactataaagattattcaaacctaaagacatttgagattcaacaaacagaaagaagtcttttctgaacttcttttatgtcactaaaagcagatacttatgagagtgaggctgccatgaattccctctgccaagaaagtttatgaaaatgaagaaaaaacaaggaaatctattcttacctacataaacatgatcacaagctattttaatctcccctttgactcctagaaacctagtttttcttcccttagaagcctcctccctctcattgtgttaaatatatacaccttcttctttagctgtttaaggagctgtgtatatgcactcccatatgtatatcaacctctaggccagttgaaaagtagagtaggagcaacatgtggcatgtgagataattttggtggttcacaaattaactttataaattattcttaagatgtatgaattttgaacatgtagaaaaatattaatttaaaataagcgtatgtgtatattttaaattttaaaaaaaaatagctcatcaaacttgccacttttttaatactgatcttttatttaattgggttatagctatgtctataatatatgaattaatagacaaatgatgtaatgatttgttcagtcagcatatcctgagtagcttccaaggggcagattccaatacactgcttctgacggtcttaaaaaaatgatgaggacatgtttcctcatcccattattaagagagtcatttagtactgaaaattactaatgttaagataatgtgacctcataaagattagtaggttatattttcacatatatttccctttgtgttgcatcatccagtgttttaaatcattaagtaatctcatcttccatatttctaaagttatattaaagtttaagaactaaaacaaatctttaaatttctaaatatatatatataaactggaagcttctttaataggggtggtaaacttttgttacatttattaatgattttacatttgacatttttctcaataacaaataagttaataaaatgacatatttaatatgtatttgtaaatttacttgtggcactggagttaatatttgaaaatttttttatttataaaatatttatttatttatttatttattttagaaatgagaatctcactacattgcctatactgacttcaaaatcctgggctcaagtaatcctcgcacctcagccttctgagtagctaggactataggtatgtgcctggctttaacccaccatttaaaataatgattgcttatgaagttttaaaagattgaattaatctaaatttaatttataaaaatagtaaatagataataaatattaaatatttataatattttatgtgatacatgaatgtagcatgcagatataaacacacatatatatgcatatatacacatacatgcatataaatgccagaggcaatatttctacccttccatgtcactcagccttctttatatgtaatcatcaaatcactataataaacaaatttgaattttttaatgttatgttttctttcagtctgtcagcatcaaatctctcactattatctgcttctttgggtcattgtcactactccatagaatagatactggtgtgttaaagatagtgtatttacaggaagtgtataccaaaatacataataggagttttttctcatattggggaaagatattgcttacaaagtgttgagctctaaaatttgtatttttaagtgggaaataaaaataatcctggcaaaatgattgtgagcagagatgtagcaacaaaatctactaacagtttccacacgtgggaattctcccacattttatcaccaacacatatcacataggaaaatatataaaaatatgtctcatgcacactcataacttgtgagcccataatggtaatgctaattcatgatgttctcccaatttggaatcagatttgatcttaaaatatccatttaaaaaataatccttcagcaattgagataaaaatcaaaacaaaaacaacaaaaacagaaaaaacaaaacaacctacacttttgatctttatagtaatatactactgctcaaggctcttctgagtaaatgaaataacattctaaattgtgagtggtaaaaaataaaaaataactatttctataaacattccatataatttaattatgttttcatttacgttatgtgataatctaatatatattaaaatccacaaagaagatctcctttcttccctttcccattttcatctgcatttctcttcttttttaaaaaataagaatatatatttaacttcaattatttaaaaataacaggatattacattaagttaggaaactgtgattctagttggcaagcaagaatatcttttaaaaagttaaacaagttcaaccagtactctgaacagaattgtgtctcctcaacctcaagctagaaaatctagagtaaagtgatatgtttctggaaacacataatgttccaagatcgaatcaggaaactattgaaaccctgaacagatgaatattaagctgtgatattaaattagtaataagaaacttaccaaccaaaaaaagcactggaccagatagacacacagctgaattctaccagacatacaaaaattgactcaagatgaattaaagatttaaatgtaatacctcaagctataaaaatcctagaggaaaacctattaaaactcttcttgacattggctttagcaaggatttcgtaatgatgatatcctgaaaagcaattgcaacaaaaacaaaaactgacaagtagcacctaaactaaagagcttcggcacactaaaataaactgtcaatacagtaaacagaaaatggaaagaatgggagaaaagctatgcaaactatgcatctgacaaaggtctaatattcagaatctataaggaacttaaacaatttaagaagcaaaagacaaacaatcccattaaaataggggcaagggacatgaacagacacttctcaaaataagacatacatgcagccaacaaatatatgaaaacatgctcatcagcatttatcatcagggaaatgcaaatcaaaaccataatgagatatcatctcataccagttagaatggctattattaaaaagtcaaaaaattacatatactggtgaggctgcagagaaaaggaaatggttatatgctgttggtgggtatgtaaattatttcagacactgtggaaagcagtttgaagatttctcaaagaatttaaaaccaagctaccattcaacctaccaaccccattactgggtatatacacaaagaaaaatagtgcattctaccaaaaagacacatgcatgtctacattaattgccatgctattcacaatagcaaaaaacatggaatcaacctaggtgcccatcaatagtggattgcataaagaaaatgtggtgcatatacaccacggaatactacaaagccatagaaaagaatgaaatcatgtcctttgaagcaacatggatgaagctggaggccataatcctaagtgaattaatgcagcaacagaaaactaaatactacataatatcagtttttcaatgggagctaaacaccaagtgcccagggaaataaacctgggaacagtagactgtgaactgctggggcaaggagagagaatggatcaaaaaactacccattgagtactatgctgaccacctgagtgcaatacacccatgcaacaaacctacatatgtactccctgtgcttaaaataaaagttgaggaaaaaaataatgcttctatgaacattaaccagaggaagttgggtattctattgtcttgtaaacattttttgtttgagatatttgcctaatatttcttattttttatgcaaaccagtagacagaattatattatcatttatagccccaaatgctcatgtatctttagtagccaaacactcagtaaatattaggtcccataaaccatcacctgctatcctcccatttcactctcactcctcagaaaatgcccaagaaacttgcagagttaaaacaatggggttacaattaacactaattccacacatcagtaggaagcagaagtgagggaaggtcagggtagaggttatttctgaaaagttgtttacaaggttgaaatataaaatatagaaaattaattttacctatacaaacacatatgtttgcaatgcttacacattttatttgaatatttctgtccataaagataaaaaattgagctaataaagaaatagtaatattataattttaggaattatatcttgttaggaaagatagctagcatcccttctctagattttgctatttgagaaatatacaacacccttgctattcataaaataatttagaaattataaattattcttgccatgattctaaattaaatttaggccgggcacagtggttcatgcctgtaatcccagaacattggaaggccaaggtgggctgatcacttgaagttgttaatggtttcagaccagcctgtccagcacagtgaaactccgtttctactaaaaatacaaaaaattagctgggagtggtggcacatgcctgtaataccaactactcgggaggctgagttaggagaatcatgaacacgagaggcgaaggctgcagtgaaccgagatcacccccctgcactacagcctgggtgacagagcaaaaccccatctcaaaataaataaataaattataaaataagtaaatataaacttttttctttctggtaattaagaaatcttgattacaaaagtgttcttatatatttcactcaggataacaataatataaaagagagtttgctttgaagaaaaatgatatgtaaagagattactttgattctatgtgaattagggtaacatatcaaagttgaggttataataatatgtagtaaatttcaacaaaaagaaaacccatttgatctttctagatctacccccaaaatttttgtctggaattaatcattccttcattatgtatttatatttgaagtcaatagcatgggtgacaatattgcaaatattctcaaaaaaatatgtgacagggttttctaatatgggtcagtcaaaactcaattaccttaattacggatcataacatgtaaacacggataaaaagaaacctccaaactacatgtaatttgaaggattctcttcgaaaatcaaatatttttaacataagcaaaaccaggtcaaagctgggtaatgttcaataatttgtcatgatacctgtaattattcttttagaggccatatactttaaagtcaaaattgattgctcatatcttaattctccttatgacttcaagataatatattggtgcttaatgtacatgacttacattgtgcataccaccaacacaatataaaaaaccactgccaggtgcagtggctcatgcgtgtaatcccaacactttgggaggctgaggtgagtgaattgcttgaggccatgagtttgagaccagcctgaccaacatgctgaaacctcgtttctactacacatccaaaaattagctgggtatggttgcacgcatctgtaatcccagctactcaggaggctgaggcacgagaatagcttgaacatgggaggctgaggttgcagtaagctgagatcatgccactgcactctagcctgggcaacatagcaatactctcctcccctcccaaaaagaaaatccaggtgtggtggtacgtttgtggtcccagctagttgggaggctgaggcatgagaatcacttaaaccccgtaggcggaggttgcagtgagctgagatcgcaccactgtacttcagcctgggtgacagagcaagactgtctcaaaataaataaataaataagcaaacaaacaaacaagataaatgtaaaaaaaatggaggtacattttagatatatggatatcattatcatatacaaacaaagatatgttagacttatgttactattggtatatacaaaacagttaatgattaacaaccagctatcagataagtagccctgatttgtagcactggcactttccatactgtaaatgctcccagcatggctgcaaatgtgagatcactgaactcagagtttgaaagagaaacccacaattggccctcaagcaagtctcagctgactttccacctccaacaacccacagttttaagttacagatttaaaatgttgtgaaaatgagcatccttctttatcatttgtggaagtgtgatatgtcacaacactttgaaaaataatatagcattatctactaagattaaaaagtatgtgaatatatatgtacaaatacacatacacatatacacatatatatgcatacatataattttctcaaagcaattccatttttaattactgatttttaaacagtaaagtaccagtattttagtgatttatataatactgtaataatgtctcaatatatttcaagcattagtctaagtacttttttgtttgctaactagctaattgtaaccagaacaatgtggtatgttttattaatatacccattttactggttaggaaattaacatacaaagcatgccccaaatcacacagccagtaaatggctgaactgagatttgaactcaggtgacataattcactacactcactgcctctcttgaacatcatgagggtagatatcaatttggtgccaaaaacaaatgatcaaataaacaaaaacggagtattgttgaatcaatggtgatccattattattatcttacattatgtagctattaaaattatttgttcttaaaacttttaaaaatgcttaaaatgttataactttctatatttaacatttcattgtgtactgtatgacttaagtttataacaaaaactgttattgcatttaaattcaaatgttcattcgacttcttcctaatgctattccttccttttgatgattcacatatgtacttctgttttataactttatccctgaaatgctaaaaacttgtcactacctcagtgatgagtagtccatcatgttggatagaagttgttccagatgtctttataaatattttaaaactagacaccaattcagaatcttttaccttgcatttctattaaaaaattatatctttttaattgcatgataaaaaaactagcttacaaataccttccacagcaatctgacttcataaaaaagacattctaccttttcttcacatcttcagttaaatagaaaaaagaattttctgtgtttttgaaaaactctgagtggccctccctaatacattttacttttccccatatctacagttttcactctgctctatgttacatgacattaaaatatatacacacatacagacacacacataatacatataacatcttataatatataattataatatataaaataataaatcatttttaaaatctgaagaaatataaataaaagcttccaaacttagcttcaaaaattagatctatatgtctatctacatatttctatctacatatccctaattatatatctatctaggtatctatctatacacatacacattctgtgtcaggtgatatatctctaagaaaggcaagaaaatgacaagtttgtggcacattttttcatgttaacttcttcagaacagctaattgaggttattttccttttagcatcccctgctatctatctgttctgctgtatgagcaagattacaacgcttaggagtcattaaaggcacaggatggcttcagagtatagctgctttaaaaaagaaaaggctattaatttagagcagttttaggtttatagaaaaattgagaggaaggtatatacaccatgtctccacacgtgcacatcctccccacttacaacatccctaatcaaagttgtacattggttacaattgatgaatctacattgaacaatgataatcaccaaagttcatcctttacattaaagatcaccgttggtgttgtacattctatgggaatggacaaatgtataatgatatctatccaacttcatggtatcatccagagtattttcactgacctaaaaatatttcatgatccttctattaatccctttctacctgcctttaccaccatatccctgacatccactgatctttatactatttccccagctttgcctttaccagaatgttatatattggaatcatccagtatgtagccttttcttaatggtttattttgcttataagtatgcattcaagatttctccatactttttatatctttatgcctcatttcttaacggttatttcaaaaacgtaagcttgtcacttaatatgggactttttatgtgacctccccttctagcttttttctcaaggggtactcccattcatcttgctaagaaaagaaaaatgttttcaggtcatcagtgtgcccagtctcaggatatgaactatacatagtataattcagaagtgaataccgcatatccctttgacacatatggacttcctcaaccttcgttcctattatgctgacacaggtgatacaagtctagaaggagatgttggatgggagaaaactctgaagagagtatcttcccagataaaagaaggaagaatcaataaacgtaaaagaaatcctagttttgctaccctttctgcctgttgcattcagacttgaaatgcagttgtgatgcttatggccatggtacacaaatacctcccagctgataaggcattgggaaaataaccacattccagagaagagggaagtataaggatggaaggaacctaagtccctggtgatataattgaactgtcaaaccaaacattgagctgcataattccagaaattttattaaacttccactaataataactataataaatgtctatgttttataagcatataagcatgtctatgttatataagcatgtaaggatatctatgttttataagtatataaaccatgtctgtgttttacaagcatatgtttggatgtcctgttattgttatctacatacattagcataaacttcagttatgggaatattagctgatatctagtgaacaattactcaataaatgatagccatgaggaagaacacgaccaattaggcaatgattctttgcctttagtgtaccttagaattccctgaagagctaattaaaaatgcagatattccacttccatcatctgagatttttattcagaacatctgaggtagggtccagaaatatgtatatttaatacacacccaaggtgattctgctgctgttaatttgcaggatcctactttgaaaaatatttcagtatagtctaaaaaggttggataatggataatacatatgaataatttagaggtcaaagaatacagtgaataaaaacaacctattctatccctttctccatctataagagtattatatataaacaccaagggcaggagtgccctgatgaagaagtgagtggcacagagctctccaagagtatctgatacattttggatgagttttttacttcataaattcacagaagaaatttaaaagaaattgaatactcacattagcttggattatgacaaagtagcgagtcttatcttcatagttgagcctcttccttaacactatatttccagtcaacattaggggaatttcaaaggtgtcattggatgtctgcaaatattaaagatacagacttcagattatttgaatgtaagatgaattaataactcaatattttggattaatcctcttggaagttagagatgacatgcttatcatctgaaaatagaatgactataagcttcagagtcaatattgttatcatacttccaaacatttaattttgatcaatgggtttccccagagtcctttggtaataataaccagaaaatttgtttcttgtcatagtttttaatatattactagtattattcatcaacagtcttggaatagttctaaatcaaagtccaggtatctgaaaaacttccctgttaccacattatcttttcactgtgttctttaacaccaaagcattcaaacactgaaatctgttatttctacatagtatcaattgtcaacattgatatccattctgtattttaagtatttttaagtattatctggcattaaatacaaaaaaaaaaatacagttacgagtcacttagtgatgaggtacattccgagaaatgtgttgttaggtgatttttgtcattgtgtgactattatagagtgtagattcacaaacctaaaatggtacagcctactacatactaggacaagtgatatagcctatggctcctaggctacaaacctgtacagcatgtcactgtactgaatgctataggcaattgtaacacaatggtcagtattttctctataaatgtaatctaaacatagaaaaggtatagtagaaatacaacattataattttatgagaccaccatttgctatgtgatatatcattgaccaaaatgtcattatgcagagcatgactgcgtgaacttgaatcagttcattattgtggaaaaaaaaatccaggttatatatcatttttttcttttaggttccacaacttctgctcattagttaagttctctgccctgtctaggactgagttttttcctggtaacatggaagtcataagggcaacactagtgctctggtataagcagccctcagtgtaactgtattcacaccttaagggagtataatttataagataaatctcttattcttaagaagaccttatgtcacttttgtattttagtgccattttaaagaatgataaaattgtttctagtaggctcaataactcagtgttattttgttcactgaaattgtcttgtggttgttcagttgccttgtgtatttgtgcttgtgatttttttgtgaaatatttagtttgaatctgcattagattgctgcaaaaggaaggaaagagagggaaagaaaaatgagaggaaaaggcaaggggaaggagaagagaaagggaaggggaagtgtggaagaagaaaaaaactgtgtatgtgagagagaaacagagagagagaggaagagagagagagtgttcacaccctcaacttagtgtaagtgtattcctaagagtcacataagaagttaaactcaatgaaaaaaaaaaagctgattcaaatctctcagctcaggctcaatcaatgaaatgtgtgtagtttagccttccatgtctagagctgtgatctgtctcctttctttctttctttgtctctctatctctctttctctcggggatgcataaagacacacacactgtacattttgcagaattaatatatatttttaaatgattcattctgtgctcctcatgtaatgggccttgcaaatcgttcttggatgcagtcatttaaaagtaacaatttaaaatataaatacagaaaatgaaaatgaacaacacaattaaaaacagacatttgacattttccctaattttttgcctattcaactttgcttatacctatgagtggggctggcattatgacacaggagtgtgaaaatgattgaatctaaacatgtaagttgaatatgggcaaaaccttagttaataattgctgtttacactgttaaacttatcctaatgtgttgttatgaggttattacattttagtgactcaataatatagaaatatatattggtttctagcataaatatggaagatactgtggtcttaccacaaaactaccacatctctggactcagaaccccaaattagctcacatatctggtgacattgtgcctcagaggaggctatgtctctaaatgagatgagtcttgaatagtctagcttaaaaacagtaattccattctcttttaccaggaagtattttgcaaatgtacatgtgattccattttgagtaatgaaaaaatttctcttaattgcaaagatagagagaagctaaaaatcccttttcaggttatagaagtttctgtcaggatataaaatttagaacttcagcagccatttggggactattgataaaattaattacggagaaatagctaacatgctagtgatagcagagtataaaataaaaagagcccggatctgtgttgtctttgagttgctgagcaaatcttgatattaccccatctctgaaaaacttattatgatagataataaattacctttttggttaaatcatctttaatttagttttttacatatatataatatatatataatctatattatatattattatatataatataatataatctatattacatattattatatataatataatataatctatattatatattattatatataatataatataatctatattatatatataatatatatatagtaaattttctgcagctgaaagcactttgatacatgattattcctgtctctatgtgtttacactgtaggcctctctcttctccaaacaggccatggctcttcacacctgatatttgctcttatttttctcttgcttaaatatcccatcacttatttctctgtgtactaatctttgcaaactttactcagtgaaacctcttaaatgtaatttagacttaagtctttgatgtgatctcacattattttttccaaaaaacacttatttgggatcttctgttttgcttgacagattcctcaagggtctcagtctgtgatgcagaaataacctatccttaaatgtctagctaagcaacttaatgaatctttgcaatactttttttgttgttgacagttttcattggacgtttgtagaattattaaaaataatagttattagtgactttattgatcttcagagcactttcaattgcactgaattcttatcatcttaaatctatcctttagagattttatagattcttagattttaattttactttttatatgtatgtatttatttatttatttattgagatggatgcagtcttgctctgtcatccaggcttgagtgcagtggtgcaatctcagctcactgcaacctctgcctcctgggttcaagcgattctcctgcctcagcctctgagtagataggactacaggcatgtgccaccacatctggctaatttttattttttacttttagtagagatggggttttaacatgttggccagtctggtctcgaactcctgacctcaagggtatgcccaccttgcctcccaaagttctgggattaaagatgtgagccaccatccctggcctagattttcattttgttagcacttgtattctataaaatataagaataggatatactttatcatcaatggtgcttctgaaatgttgcatattgaaagccactgtattaaatttaatttattaattaagcaattattgagtattcattctgtctctaaaatgtagaataataatcaagaaaattagaagcaaaatatagatatctttggtatctttatgatagtcttctttttcctctagtaaaaagaatactggattagatcaaccctaagtaaaagtcttgctttaatgatatttctgaagtgtttacctaaaaagtttaaaaaaaaaaaagctaaattaagcaagggaaaaaagtagattttttaataaataaatacatgataaagccatgaaaaaaacaaaacaatacttagaacattcttaaagtttagaatgcacaagaatcataggcatgtatcattaagactgtagattcctagcatctattacccaaaattcccgaaattcttgggaatcggcatttttaacaaacctaccaggtgatcctgatgcagatgattcaggttttacttttgagaaaccactgtactacgtaagtctaagagtgactgcactctctgtccttgctatttatttttctcttctttcattcttagagatttgttccaccaatgaggcagaaaagtttgggaacagagcaatgcccatttacttaagcaaccttacatttctaaagccaggacattgccccctttctgatagtcgtggatattctctttaaaatacaaactaacattggcttttttgggtgataagaatttaagtgctgactacctgcactgtattaatgagaaaaatccaattatggttaaatgatttaatacccacacgccccaaacacctggcctccattaagaaaggtccactcactactttctgacagttcagtgacaacaactgtcaaataagggacaattctccatttagtaaaataagggcataaggcagtttaagcaatttatcactatcacagatatgggaagcagggtaggagacagctgtaacatccacgccacacacattcacattcaataatggagagagaaggaatgttgaggctctagcaactctgtgtttcccaagatgattccatccccccagaatcccctttactaatatgggtttgcaccagtttagataaaacggcagctctctgaaaggaggtgttgaatcctacagttaaagatgctctagaaatggaatatggggttattagcactatttcttctcagctgatagatttggtcattcatcatttttaggaaagagggaaagactccagcctttcacacctatgttgtaagcattgtttgtaatattctcttttcagctgtgatgactagaaattcagttcaaaagaagataatttctaaagaacacacacacacacacacacacacacacacacgtgtatatatattttctggtgacctaaagacagagacttagtacaaaagtgcctcaatgggcctgtaattgagaagtggcggaaatgtagataattacgattttctctttatctctgtaaattctcttgttctttgacacttttttttgaagtatcttcccttatctttgtgtctttttctgtacctctctcttctctctttgggtttcccccatttgttcacattgaatataactgtgagtctgtgttttagttccaataagcagcatcaactttgcccttatcaatctttagacagccttaagcttgtctctgattaagctcaggctactgtgccatcagctgctgaaaattctatgttattgtcattgtttgtgtgtctcctctaatctaatttcctaaagtaaaaagtggaggactaagtaaggctatgcaatttttgtccacccaagagggactgggatttgagcaggcaacattaactttgctcctaagagaaagtcccaacactctaatcattttttctgtttcatactgttaaaacatgtccctggctgacagacaaaatggactccctatgactaactgaagtaagttaaaacaaaaccaacaaaaccaggtggccatgcctgagtgacaaagtggtcgcatactctgtgttctcagaaagatgtcaaagcatcacaggatcttcctttctacaattgatatggtttgggtgtgtcctcatgcaaatttcatcttgaattgtagcttccataattcccacgtgttgtgggagggagctggtgtgagataattgaatcatggcatttccccatactgtttttgtggtagtgaataagtctcatgagatctgatgcttttataaagggaaatcactttcacttgattaaattctctcttagtctgcttccatgtaagacatgccttttgcctcccaccaagattgtgaggcctcccaggcacatggaactgagtccattaaacctctttttctttatacattacccagtctcacgtatgtctttatcagaagtgtgaaaacagactaacacagtaaattggcactggtagagtggggtcctgctgtaaagatatcaaaaaatgtggaggcaactttggaactgggtggcaggcagaggttggaacagtttggagggctcagaaggacaggaaaaggtgggaatgtttggaacttcctagagactttttcattggctttgaccaaaatgctgataatgatacggacaatgaaatccagggtaaagtgatctcagatggagatgaggatactggagtaaaggtaacccttgctatgttttatcaaagagactggtggcattttgtccctgacgtagagatttgtggaaccttgaatttgagggagatgatttaggttatttggtgacataagtttctaagtagcaaaacattcaagatgtgacttcagtgccattaaaagcattcagttttaaaagtgagacagagcataaaaattcagaaaatttgcagcctgataatgcagtagaaaagaaacacccattttctgaggagaaattcaagccagttgcagaaatttgcataagtaatgaggaaccaaatgttaatcaccaaggcatggggaaaatgtctccagggtgtgtcagagacatttgtggcagcccctcccatcataggccaggagccctaggagaaaaaagcggtttcatgggccaggtcctggacccccctttccgtgtgcagcctaggaactcggtgccccgtgtcccagctgctccagccatggctataaggagtgaagacatagctcaggctgcggcttcagaaggtgcaagccccaagccttggtagctttcacatggtgtggagcctatgggtccgcagaagtcaagaactgaggtttgggaacctccacctagatttcagaggatgtatggaaatgcctggatgtccagacaaaagtttgctgaaggggcagggccctcatggagaacctctgctagggcagcatggaaaggaagtgtggggttgaagtccccacaaagagttgccactggcgcactgcctagtgaagctgtgagtagagggccactgtcctccagaacccagaaagtagatttactgatagtttgcactgcatgcctggaaagcagcagacactcaaggccaaactgtgaaagcagccaggagggaggctgtaccctgcaaagcaacaggggtggagctgcccaagaccatgggaacccacttcttgcatcagcatgacctggatgtgagacatggtgtcaaagaagatcattttggagctttaagatttgactgccccactggatttcagacttgtatagggcctttagaccctttgtttttgccaatttctctcatttggaatgtatatatatatatattcatacccaatgcctgtacccccattttatctaggaagtaactaacttacttttgattttacaggctcatgggtgtaaggaacttgctttgtctcagatgagactttggactgtgagcttttgagttaatgatgaaatgagttaaaactttgagggactgttggtaaggcatgattggttttaaaatgtgaggacatgagatttgggaggtgccaggtgtagagtaatatgatttggctgaatccccacccaaatctcaccttgaactgtagctcccataatccccaagtgttgagggagggacccggtgagagataattaaatcatgggggtggcctccccagccacgtggaactgtgggtccattaaacccctttttctttataaattacccagtctcaggtatgtctttatcaacagcgtgaaaacggactaacacaacaataaagcaaaaacagatcctgttcttggtgccaagataaactacagctggaactacttccttttgccccctatgccatccctacactggccctttagcactagccctttgaaagaaacatctgacagaaacttctggtttggggcttggaaatcaaccaatcagagctcacctgaatcaaccaatcagtgtatagaacagtcatgactcatctgttttgaccaatcagaattaagcaaggatctatccttcatttggatgaagacagcttattgggaacctgggtgggaactatagctataaaaccctaaccctctctttgttctctgaaatgtgtcttagcttgaaaccacaggctgtatatccatggtttgaaaactgttcactgaaataaagtctctttcgtccaaattcctttccagagaacatttgcttacaatataaatttaccactctccctcacacaaatacaaacagattcattcacatttaatgatgcattatgattacaatgcagttcaacttatcttattccatccaacttccaaggaaactgtatttgtgtttggttgggttttgaaacttaaaagtcacagccttggtgtgaaaagactgaggttcgaagttttacacaaagaaggcctttacaccagtcttaattatacatgagtttccagtaaaatgagaatattatgaatttatggaggcatggaaatctcatgatataatgtaccctgaaaagtattattaaactacagtaaattttttagtaacctacctaggaataagtaatcactgttttagcttaaccttaaatattttattgacatctgaaatttggactttgacatatatacacacacacagaactacttcaggatggtgatttttttaaaaatcgtttgtccttaaaatgtggttttaacttcctgactcaggaaattcaaatgcttacacattacaaatgaaaattatggcttacattttctgaattatctcaaagctacggggagtcaaacatattacaaaagaaggacaatttactcaggaggacttgataaaagatgttaccacccactgaaacaccactgtaatacctcaaagaaagaagctgcttatgcatattgcttaagtgtcttcattttttttttctgagtagtaacagtagtgaataacaatgttatgctgcttcctcagtaaactggagactgctacaagggacatgtcatcagtctcctccttatcactttaggtcaaacttaaaatgctgaataaacatgcctccagtctggcattaaaataaaaaaaaagatcaaaaagacatgataattattgtctaaatagtcttatcaatcttgctaacaatgagatttaatatatcagaatacctatatttagatttttccatataagacaaattctcaaaaatgaaagttactgcagatcatgtgatgacaaattcttatcaatttcagagttcttcttttattttttcaaaacaaactaattcaagcttgtctaacccatagcccacaggctacatggggcccaggttggctctgaatgtggcccaacacaaacatgtaaatgtccttaaaacattataagatttatttgtgattttttattatcagctcatcagctgtcattcacgttagtgtaatttgtgtgtggcccaagacaattctttttcttccagtgtggctcagggaagccaaaagattagacagacacctctgaattagttcagtgcattatgaacactcttactttgtattaccatgaaggcattaaacaaaaaaaaaaatcagcagtattttacaataactgtgatgagtacactagaaattgcatagaaattaaatgcccctaattaaaggcctgacaacatatattgtccagtacatatttttacatattgtctactaccaagttccaacagataattcaagtggtacttaataaacaaaaggtgaccaaatgagaaaatgaacttatacaaaagaaagaagaatgcttcttcttctgaacaatagtgcagactgacaaagattctttgcctggccaaacttgatcaggcttctgaatcttctcctaggctcatctgtatacttcctcataaaatcactttttaacaaagaaccatactatatcactttaccaagaactcctctacctttgatgaatgatctatcttgaaaactcatcaggtttctcatcctgcaccaccccttaggtgatgtctgatcaccctgacttgtcttcagcaacaatcgtattagcgtgttttagccagaattcccctaatctctgatgtttcctcctagtaattttccatccagtgaccctgaccctgctccttggttataaagtcccacttgcccatgctttatttttagttgagtccaatatctctctccaactgcaagacctcattgcaatgatttctatacctattgcagtggtcctgaataaggtctttcttaccatgttttaatgtatcattaaataatatttttatttaacaattgtctagaggacttttagaagaagatatttactaaattatttttttctaaatacatcagccatgaaaggatagggaatgctgcaggaacaaacccttaaactttcatttttttctttacttttcatatctacatatctaatatgcatcagcaagtggtctctttttattgttgtcattggctaatgaatgtttctcctcaacatgtttttctctgatcacaacagcaggggcagagaatatgattacttgtatattggttctttgagtttacatttcattagtcaaagcaaatacttttctccaggcaagaaaagtacacctctagtatgaatcaaaagagaggaagaaccaaacatttttggtaaacagctcaagtgcttttgttaacagcagtgaatccatatgggtctgcagcaactcggtcctaacctcagaggaaagaatgtgatttaggggaagaagtaagtttaaggcagagggagagattgaggtgagttttagagtaagagtgagagcttattaaaaagttttagagcaggaatgaaagcaagcaaaatactcttggaagacggctaagtgggtgacttgaaagatccaagtgccttgttcatcccttcacttgggggttttctacattggcatggtttgggggtttgccattctcctcccttgatttttcttttggggcaggctgtccacatgcacagtgcctgctggtgcacttgggagggtcttcatgtgcagtatgtttactgaagttgttgcatgcttacttgaggcatttttgccttaccagtttaacattcccagaaaaaggtcatatactagtgaaattctgccattttgcctcttaacgtgcatgcttcagccctcttgcccaacttctaagctcttattgggaagctgctgatcaccagcttcaagtgttttctatctattgggagactatatttccctggcactggctgtgatcaattattcttttacagaaaaagtttaaaagccacctaaccatcacctgacgatcagctgacattcctgggggtggtcctctcctgccctgctcatatctgcctaaccatctagttgatatggtttggctctgtgtccccacccaaaacaaattacaatgtcaaattgtaatccccatgtattgagggagggatctggtaggtggtgactggtttatgggggcagtttcccccatgctgttctcccgatagtgagttctcacgagatctgatggtttaaaagtggcacttccatttttgctctttctgcctcctgctgcatgtaagatacaccatgcttctccttcaccttctgccatgattgtaagtttcctgaggtgtccctagccattcagaactgtgagtcagttaaacctcctttctttgtaaattacacactctcaggtagtatctttatagcagtgtgataacaaactaatacaggaaattggtactgggatagtggagtactgttaagatgataacctgaaaatatagaagcaactttggaactgggtaatggtcagaggttggaacagtttggagggctcagaagaaaacaggaagatgtgggaaagtttggaccttcctagagactttgtgaatgctttcaaccaaaatgctgatagtgatacggacaatgaagtccaggctgaggtggtctcagatggaggtgaggaacttattgggaactggagcaaaagtcactcttgctatgctttagcaaagagactggtggcattttgcccctgccctagatctgtggaacttggaacttgagaaagatgatttagggtatctggcaggagaaatttctaagcagcaaagtattcaagatgtgacctgtctttttctgaaagcatacagtcataggcatatatgaagacattatgtgaaactggaacttatgtttaaaagggaagcagagaataaaactttaaagaatctgcagcctgaccatgtggtagaaaagaaaatcccattttctgggggaaaattcaagctgggtgcagaaatttgcataagtaacgaggaaccaactattaatagccaagacaatgggaaaaatgcctccagggcattttagggatcttcatggcagccgctcaaatcacaggcctggaggcctaggagggaaaaatggttttctgagctgggaccagggccccactgctctgtgcagccttaggacatggcatcctatgtccctgccactctagctccagccatggctaaaatgtacagttcaggccattgcttcagaggtgcaagccccatgccttggtggcttacatgtggtgttgggcctgcaggtacatagaagacaagagttgagctttgggaacctccaccttggtttcagaggatgtgtgaaaatgccagcatgtccaggcagatatctgctgcaggggtggagccctcatggaaaacatctactagcataatgcagagggaaaaagtggaattggagtccccacttgggactgcctagtggagctgtgaaaagagtcccactgtctcctccagatcctagaatgatagatccacagacagcttgcatcatgtgcttggaaaaaccacaagcactcaatgccagcctgagaaggcagctgcaggggcagtaccctgcagagccacagggacatagctgcccaaggccttggaagcttaccctttgcattaatgtgccctggatgtgagacatggagtcaaatgagattatttcgaagctttaagatttaataactgccctgctgtgttgtggacttgcatggggcctgtggtgcctttatttgggccaatttctcacatacagaatgggtgtatatacctaatgtctgtaccctcattgtatcttggaagtaacaacttgtttttgattttataggcttatgggttaaagggaattgacttgtctcagatgaaactttgaacttggacttttgagttaatgctgaaatgatttaagactttagggaactattgagaaggcatgattggttctgaaatgtcaaaaggacaagagatttggaagaggccatggttggaattatatggtttgtctctgtgtcccgactaaaatctcatgttgaattgtaatctccatgaatctagggagtgacctggtgggaggtgactggatcatggggcagttttccccctgctgtttttgtgagagtgagggcattctcatgaggtctgatggtttaatagtgataattcccccttcactctctctctcctgctgccatgtaagatgttccttcctccccctttcccttttgctgtgattgtaagtttcctgaggccttcccagccatttggaactgtgagtcatttaaaattattttattataaattacccagtcttagttattctttatagaagtgtgaaaatgcacactactgtaacactttcactttaaattggatcaatcagttcagcaactatttattcccaaacttgttgcttctttgttttagaacaccatttgaattgcaataaaaagagttgcttaagttctttgtagatttgcggggggaggtgggaggggagagggacagcattaggagatatacctaatgtaaatgacgagttaacaggtgcagcacaccaacatggcacatgtatacatatgtaacaaacccgcacgttgtgcacatgtaccctagaacttaaagtaaaataataaaaaataaaaaataaaaataaaaataagttgaaacataaaaaaaaagatttgcaacaaaacagaaaggctcaatttaattattccaattttattcatatattaaataaaatagttatggtgaagaatttacaatattttgctttattgaaatgttattattttgactagtaaaagtgccacactatggtgctattaatgtaagcagaattactagagatttagtagtagcagaacataaaatttatcatgtattttctcacaggtcttacaagagaagaaactggtactgaggtttacactaattttatatgaagtctaaaagtggattctctccctaagattgtaccttggttaatccttttttccttcaatacatcctaagttaagtgtcatgatgtcttactattttttccacagaattaagagcattttagcttgctaaaacatatattatttatttttcttttttcatttgtaattttgaaaatgcatgtggttgattggtttatccactctgtagggagtaagagttacatattatattgtacagcaaacctacacttccctggaatggggaggcattgagacagaattattgcacagttaaaaaagaatttaagccttattaactgtctacattttaagcagaaagatagtttaaagtaatatatttttgctctcaaactatatctaaacattgaatatttttatgcatgcaataaatatctccctaaaaaacatggactagtcatttgatacttgctgggaggttttatttttacaccttggggagtaaagattagaaagtaaccttcataaaatttgagctagaaacatggcgcacacgtacaattaattctttaaaaaaatacctaaagagcaaacaaaataaatggtttcaaaatcgaatgttcagtcagctgtttctacatttaagaaaaagcatttctgctgcccttttctttgctgtttctttgctacttcccacttcatttcttatgtaacccttcatactgtccttctctgtcacattctcatcatatccccaactcttggttttattgtctctgcctaaaaaaaagtcctcttttagagaaacaaagcaaaaaaaaaaaaaaaaaaaaaacaagactctaaaatctgaccttcaccctgctaataaaatgtatatatatatattatatatatatacttattttccaaatttattaaaattttaacacagccagtacaagttttttttgtgagaacacaatagaggaagagtatactgaaactggattttacagttcagaagtagttttctaatatgacccaaatcacttcacttacgagttttctttgctatgcaacagagataatactacttttaactgatttgtgaggataaaatgagaaaatgcatccacaatttacttaacataatgcaataaatttgtgatgtagatcttactgtgagttctcagactctactatcccaatagagttttttgtttgtttgtttttgcttgtctgtctaaagtttatctacaacatacaatggtaaaaataagggcaaaatgttaacttcaccattgtttatatttctaatatttattaaacataaaagagatgcattcaatttgaaagcttatttaagtagtgcatttataattgctttggggggcccgtgggattttgaggagctgcctcaaagaaagtggggagatgtgaggcaaggcttccagctctagcttcagttaaaaaaaatcttactttgtctgtttttttgaataatatgtcattagaggaaatgattcatggccttaaaaaacaacatagaaatcttcttgtctatttgggaggccgaggcaggcggatcacgaggtcaggagattgagaccatcctggctaacacagtgaaaccccatctctactaaatatacaaaaaaattgagcttccagtgagccaagatcacgccactgcactccagcctgggcaacagagcgagactccgtctcaaaaaaaaaaaaaaaaaaaaaaaaaaaaaaaaagaaatcatcttgtctaatggaaaaaaaggaagaaaaacaacaaaataaaacagactatagctagtggctttgtcttgtcttcttctctatctttggtttaactggtggacggctagaagtttaaaggcttatcaactccagcaatacttggtgtgtgttcttgaggtatagcaacaatattggtattaatttatgagttgcataaaattcatgtttgacacttgttatctcatctccagtgatttatttagaatgctttggagaccacaaacataacagaaatttagtaaatgaggcatattatacctatgaatatattttaaaccttatctaaaaataccatcaaaaattagcttctagcaataaagcataaatattacaaataattcaattttgagacatttttaaataatagtatcattactaatctggttctggaagttactgaataatacaataactatcagctgaaaaaatcattaattttattccttttaagaaaattacattgcaaataggtatttacataccggatcatctggattatactgaataacatactctatctgtccatttggtccatcatctatatctgtagctccattgtctcctgaaaatcctgtgaatattgtggtaccaactggagtgagctgaaaggaaaaaagattttaaatatcaattttcattttatcaactgcacaccagaaatgttacagcataaaaatcagctctttattacctaaaggaagataccagttggcagcccacaaccacaaactgaagtgtttcaaaagaacagttttgagccttacacaggagttcttaaaatgtctgaaatgtccaactttgtgattcttgctatgggcgaagaagcagaagacgctgattccgtgttaaacacatttggaccaatttatagccattagtatgttagctcctgtggagaaactgcatctgttgtttctcctcaaaacccttgatgcaatgttacccacaggctagaatttaaactgtaagaaaaagttagtttaaaataaacgatttacgagtgagcaatgaaatccaggctgatgattatatgcaagtggcaagtttgagaaagagaaattggagacaatgaatagtctgtatattagaggaaaatactgggagtttcttgagtccttctgatattggttgagtagaacatgatcaggtcacagcagctggagagatagcaacatcttttcattttggattaaaacatcagaacttaatatgtgtggcatacaaaaccatgatttgatgtgtgacctaaattgctagtcttaattcttacttatgcccacaagagaatcaccgttatttttttttacctgtaggtttttgcgcaatgtgctcttataaccagagtaatttttttaaattttcccctcccagtttttaggttttagctgaaatactactcattagttaaatttcaacttaattagatatcagcttctcccataccacccctcaaatagcattacacacgccacatcagaagatgattccccttttcttgtgcttgcattttgcactttgttcctataatcattgcattgttagaggaactaaatgcacttcatcaataaacataagctctgtgcctctacagactggacgcttttaatgtttgctcagggatttgttctcttaatttttgactaggattccttgatggtaaaaatagcttaagaggcaacaaaaaagttgccttattcagttttactttcagaaactgaaaattcacattttacaaggatccctcaggtaatgtaaatgagtgaagcaagcatgatgagacggtggaaaatagatagaacatgccctctctgatgctactcagagagggtagctgctactagtagctgctactcaatcccagcaaattcttgccatcttggaatatggagcccatgctaccaagtcttctaatattttaattgtatataaaatatcttgatgctaagattgacaacagatttttattatttatttatttatttttgagatggagtctcactctgtcacccaggctggagtgcagtggcacggtctcggcttactgcaagctctgcctcccgggttcacgccattctcctgcctcagcctcccaagtagctgggaccacaggcgcccaccaccacgcccggctaattttttgtatttttagtagagatggggtttcaccgcgttagcaaggatggtctcgatctcctgacctcatgatctgcccacctcagcctcccaaagtgctgggattacaggcttgagccaccgcgcccggctgacaacagatttttaaacattaaaatataaataggtaaaataaaatatgcccattgcctcaacaactacactagtttgcaatctctgatttaggaaaagaatataattatgacttaaaaataaaccataagtacaaggaagttcaggatttataaggcccagtttcctagcaggcagcattgaaggcaaactttggagagctgagaatgaagtgagacgagatcgtttaagtagtacctatgaggacatcgagggaccactggggatagatttagtagaaatgttagtcagctaaattgcttccaagctgacgttcaatatttttcttttttaatggaattcctgttgcaaaagacatccttatcttttataaatattcacccattcttatgtagctgtactttgatatttttattaccaacttatttttaaatcaacatatagaattttgtatatttgttgtgtacaacatgttgttttaaaatatgtataccttgtgtgatggctaaaccaagctaattaacatatctattatatacttttttgtggtgagagcacttaaaaaatctattttcaaaaatagatagttattaactatagttaccatgttgtacaatagatttattgaatttattagttcaagaaatttaaattttgtatcctttgaccaacatctctcaatccatatcccagcccctagtaaccactcttatactgtctgctgcaattacttcaactactttagattccacatacaagtgggatcatgtagtatctgaatatctgtgcttggcttgtttcacttaacataatgtcttccaggtttatccataattttcaaactgtgaaattttatgattggatgacattgatttgtttccatatatctaataaacttaaaaattttgttgccaaaaaatactatgtcatggaggtagatataaaagcaaaacaaaaaatcaaaataaaacaaacaaattttaaaaaattaaacagtatcgtctgtggaaattttgaggaaataaagggggtgcccatgcctttcaatctgcttactggggtaatgtatactattggaccagatttattttgaagagcaggatcccaaagccctacaacttagggagataaaattggtcttgcggggaagatataggacatccagggagaacttcacgtttgccactcttaatcaagattaaatttctggaataaatatttatatgacagaaatttgttggaatagatggtttgaaagattttagtccttacaatgtaatatttgtaaagttgaaggcatatttctaaattcaatatgcaaactattgaaaagatcaatgtttttctctagctctacaatgtttttttgaaatgatgaaaaggccacataaaagtagcatgatgtcttaatatattaccatcaagtaatatttttcttcatcactgacatggctttttccatgcagaaatcacatttgtaagtataatgtttaatatgtagtcctttaaaataaactctacattgttataatgtttaatatgtagtcctttaaaataaactctacattgtatttctttgattgactttcaaaaaatatacttgctgatgaagcctaccaaagattgataatagaccacaggaaaaaaattgaatatgcatttgcttatggtttcaattttaagcttaatccaaagagtaattcaatttcaaatgttctcatttcagaatatgagctcattttgtgtgccacaggtaaatttccctaatcatatttgtgtggccatatatacttttattatttctgaaaaattgcaagtagaaatatgattctataataaatttcattaatttatatctttgaatagaaaataaaagagaaacaattgtattagccgtaggaatagagaaaaccttttttctataatgatattatataaaggttatgaatcatccctaaatataattttaaggtcttttttagacaaaattttagattccttgaaaattaaatgaaaagcattagtgtaatagcaatagatttcagcatgttctttcattcatggctgtctttcttgacaatttcagtaaaaatttctccctaatttcacaaatatggtatttactggctgacaggggaggatgggcaggctcaggaattgtcccaaggtgaggtttgctctcctccatagttccacatttaaggcaaatgtcttagcacagatcactcctgtgtatttctactactagattgtgcaagcatgtacaaatagccattcatatgtaaaatgcaacacaaaatggatcagtcatacatttttctcatgatctgctcaaatttcatgatttgttcaaatggtagacctgttcacatatgagatagggttgaggctaatatgagagaaatagccgagaaaaaagaagataagttatatgggcaaacatgggaggtctgaaaagtctaaaaaggctctaatgaagaggcctatgccagatgcaaaaaagcagaagaaagtagaagcagaaaaaatgttttttaaaaaatagtagatcctggccagatgccatggctcacacctgtaatcccagcactttgggaggctgaggcaggaggattgctgcttcaagtctgagagtttaagagtttgagagtagagatagatagatagataataggcctggacacggtggctaacgcctgtaatcccaacaatttgggaggctgaactagatggattacttgaggtcaggagttggagtccagcctggccagcatggtgaaatcctgtctctactaaaaatacaaaaattaaccaggcatggtggtgcacacctgtagtcccagctactcaggaggctgaggcaggagaatcccttgaacccaggagactgaggttgcagtgagctgagatcgtggcactgcactccagcctggggcgagaacaagactctgtctcaatttaaaaaaaaaaaaagatagatagatagtaggtggttatatgtatattatattcagatcttttttgtgctattataaaactgtgaacaaagagacctaccttatgtttcatagataactctttaatgctatatctcaaaatcacaactaccttattatcattacaaaaaccaaacaaaagacatggcagaaagcccacacctaaatgggcaggtagcattgaaatgtatgcaaaaacagagtgttagtagtgaactgaaataaatttaaaaggtccctcttgacagcctatttgcatccaaaagctctttaaagacagaccataatttttttctttttaaaaaaatatttcatagcatcaattgtagaaactggttcatcagtagaaactcaattaattattcttatttatatatattatttatgcagatgagactgaaacttttcacaatttcttcatattttaatatactaaatcctctacaaggcctctatactggaatactgtatccacatcctcatcctctacctgcctgttcctggttcctcggacaacctcacttttagaggtgatttccacccattcattatgctgttcaattgcaacaggatggccagagcttctggcagctcactgtcaaaaaaccctgcccacctttttttgcttccatgaagaaaaatatgtagatttcactgtgaagtctagttcttcccatgctcttgccagttttcctacaagaaaattttctacagactgtccatgaataaactataaccataataggacccaatacagcaagcacatgcaagtagaataaccttatattcacgaaaccgatggtatgctgttcacttggaataaaatattgagaaggatatgtggtagaaagtcctccacaaatcataatattgtgttgtacatatatatttggtgattagaaaattccactggcatcaatatcattgtgttggtagataacaatgattttctgtttcatattttctggagtctcatgtgtcatatcaacacagaaacaaaaagtttagtaaaaaataaaatactaaaaaatgatttctgaatacctaaaatagtttacacatgtattccacaccaatgccttctgatagattctaatggctttaatgattaaacagaaaccatatgagagtcctaagaagagaaaacatatatttttatgtaatagacacaacttaaataatacctcttcaactggaagacaattggtacaaaaggatattattcaatttggaaacttgcccccaaaaagagccaccctagaggaaaaatttaaaatacgattgatgagattttactttttcccatgcttcctcaagaatccaagttttttgttttctcctacccaggaaaaatggagaatatctgaaggatactgaattttagataagctgaaacagaattaatcactacagttacttatcatataatgatgatttgatgaaagaaatgctaccggggtggcaggtgctctatttctactaatagacattaacaaaaaagaagcattacctttagtgatgcaagattacatatcagcctatgttaaaacactacacatttattttccaattgttaatatcattgatctgatttatagtattaggcagccacttcatgtcaattaatctcctagaaaacccaatcaagataaggcaacattctgtacaaattatcattactagtgaaactgaaggaatcttccacgtttaatcaacaatgagaactatgattcatcctttaactttctccccagataaaataatgttatagattcattcttgcaattaatccctgccttggaaatatgctttagaaatggtaaatttagaaattttaaaccaaagattctccacacatgaaatccagagttgattttgtaaacaggcagtcatcagtggaatattattgaaaaattcaacattttctgacaattatgaaattacaatgtctctgaatctacgattatttattgagaaaatatcgtttgccaaatcattgtttctgtgaccattatattggtcttactttaactagtaaatataacatttgttttattcaaccatttttccaaatcaaacatccgtttgaagtccatcttaaaactttccagaactgataaaaaaaatacatattcttgaattcaaatacagtgcaagttatcttgtaatgatttattaacattaaagaaaacataagaaaagaggtatagccctttttgtctagttaacattaacttatgaaggtacaatttatattaaacaaaatgcagagatcttaaatattcagtatgttgagttttgacaatttcatgaacccatgtaatgaacacctacacaaaaaatataatatttttatcacactgtaaaatttcctaatatccctgtacagactatcttgtcagatgcagctgcttttgacttcaatcaaaattgcttagttttgcctgttcttggacttcaatagagtgtgtaccctttcctatctggcttcttttgctcaacttaatgttttttttgtttgtccttggtccatctattttattctgtttcattaatgtttttcagattccctttaacataatatggttttcatacctgtgttaaaaatcttgatttcattaaaaatcttgattccattttttatcacaaagactagatgattaatattaagggttactttctctgaataaataatagacaaattcatgtagataagtgtatttaaaataaaaaaagaattattactgttacagagaatgataaataactctatctttactaaaaactgaggagcaattaagcttaagttgaatatacatatgagcttatttatttatttatctatttatttatttttgagatgacgagtttcgctcttgttggccaggctggagtgcaatggcacaatctcggctcaccgcaacctccacctcctgggttcaagcaattctcctgcctcagcctcccaagtagctgggattacaggcatgcgccaccacgcctggctaattttgtgtttttagtagagacgtggtttctccatgttggacaggctagtctcaaactcccgacctcaggtgatccgcctgcctcggccttccaaagtgctgggattacaagcaaaagccactgtgcccggcccatatgagcttagaagttgttgaatatttgaatacttgaatgttgtaaaacagctaaaaaattgattcccacgtacatgcttaaagtaaaaagaaatgtattaatatgtgcttctttcacttcctttaatctccttatctctttctcttttttaactgtttcctgattctcagagagaatgtgcccatcctatggaagagaaaaatggggacaagtaagaggaactagagattagtcttacttctttctttaactttagattaagtgccagtactgcatattcaaagaaattccataaatggggatgctcctgaaggcccagtgatttttattccttgaaaagttgaagatatcgagttttgaactccatgatccatgtttctaaaccataatttatttcatattaaaaaatcacttaattatacctagaaattgtaaacaaaacacacaaaatatgtaaaaaaggatattcaactctataaggaatgtcagtgttatgcttctcatgaatactgtctgtgcttttagatttaccagaataattctgataaaaacagatgttcaaaatatatgtattaaatggaaggagatgatataaccacaatgaaatgtaaaagaatagcataaaactatgagaaatggatttggaaagcaaaaactcaaattagatagattcagaggtaatgttaatttcaccacaaagctgaagtctcaataatgttccactaattactgcctgtttataagtgtatctctacactttcatgtgtggagaaactcttggttttcaaatctgtcactatttccaaagcgtatttccaaaacaggaggattgcaaaaaaaaaaaaaaaaaaaaaaaaaatggctaaaacctgcactaagtattttaaaagtatcacctcctttaatcctcaatacaagtttatatcattatttattttgttatcatacttattttatggttacaaaattataggcttagaaagcttctgcctgatgttattattctaatacttggtgaataatctgaaatgatataatttagattatgtatctcattaaagataatttattttgggcccctaagaaaaatgttttgggttattttacagaaggagaaataaattcaacttaattataaaatatctcaaataatatatggcacagtgtcttgtttaaaagtattcattcttaaacactgtgcaatatgttatttgagaaatgttagaattcactattaatgaacttctgaaaaaatgagaaataaacaggaaaacaaaatgtggcacataacagaacccaagattcacagacaatctgaaaccatataatttagattatgtattaaagataaattattttgggccctaagaaaaatattttgggttattttacaaaaggagacataaaatcaaattagccagtacctgcattttaggaaactcttcttcaaataattattactgtcagaaaaaaattggttctcagcaagcaaattatttaataaatttccaaattcaccatgatttcagtgtgcaaacctttacattagtaatcaaatctctattgctagaacatgcctaaaccattgaaaagcattcaataagcgctcaaggagcaaagagaagaagaaatatagccaaccacagtaatttacactttcctcaattatatttcaaaaaataatatttcaacaatcactaataaaaatggtgggtaaaagttcaatgagaaacaggatagttacagtcttaacctagttccccacaatatagctttaatacttattaagtattaagtacaaaattactggtaaatacagaagggaaagctggaagacactgttttgtcaaagtgataaaagccatcactaccaataatgaaacagatacattgtgtgtcttttgtgttacatgctatgataaaaacagtatcatttttgaaacattcatgcacaaagtctacgaatcatgagaaaatatcaggtgaattaaaatttagagacattttatacactcctctggtcctgaaaaatattaaggtcatgaaagtcaaggaagtattgtggaaatgctaaaattgagactaaaaaaattgaaaactaaacttggttttaggaaatacacaataaagtagtaagggctgaagaagtttcatattttcaacttaattttcattagtataaaatagttatgtatttatatatgacatatagtatacattatatataattacatggtatatatacacttaatgtatgacatacttatatatacatataatatatgctgtatatttatcatacacacaaaaatctacctctatgtgactatttatcaattagtaagaggaaagaaatattgtctgaccagtgagtctcaatactgtcaaggtcatcaaaaacaaaaaaaaagcaaaaactatcacagtttagaggagactgaagaaacatggtaaataaaagtaattgttattctgtatggggacctggaatcaaacaggacattaggtaaaaagcttatccaccatgatcaagtgggattcatccccgggatgcaaggctggttcaatatacacaaatcaataaatgtaatcccccatataaacagaaccaaagacaaacaccacatgattatctcaatagatgcagaaaaggcctttgacaaaattcaacaacccttcatgctaaaaaatctcaataaattaggtattgatgggacttatctcaaaataataagagctatcaatgacaaacccacagccaatatcatactgaatgggcaaaaactggaagcattccctttgaaaatgggcacaagacagggatgccctctctcaccactcctattcaacatagtgttggaagttctggccagggcagttaggcaggagaaggaaataaagggtattcaattaggaaaagaggaagtcaaattgtccctgtttgcagatgatgacatgactgtatatctgaaaaccccactgtctcagcccaaaatctccttaagctgataagcaaattcagcaaagtctcaggatacaaaatcaatgtacaaaaatcacaagcattcttatacaccaataacagacaaatagagagccaaatcatgagtgatctcccattcacaactgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctatgaatgactttcttcacagaattggaaaaaactactttaaagttcatatgacaccaaaaaagagcctgcatcgccaagtcaatcctaagccaaaaccacaaagctggaggcatcacgctacctgacttcaaagtatactacaaggctacagtaaccaaaacagcatggtactggtaccaaaacagagatatagatcaatggaacagaacagagccctcagaaataacaccacatatctacaactatctgatctttgacaaacctgacaaaaacaagaaatggggaaaggattccctatttaataaatggtgctgggaaaactggctagccatatggagaaagctgaaactggatcccttccttacaccttatacaaaaattaattcaagatggattaaagacttaaacattagaccttaaacgataaaaaaccctagaagaaaacctaggcattaccattcaggacataggcgtgggcaaggacttcatgtctaaaacaccaaaagcaatggcaacaaaagctaaaattgacaaatgggatctaattaaactaaagagcttctgcacagcaaaagaaactaccatcagagtgaacaggcaacctacaaaatgggagaaagttttcgcaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaatgctcaccatcactggctatcagagaaatgcaactcaaaaccacaatgagataccatctcacacaagttagaatggcaatcattaaaagtcagggaacaacaaatgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactagaaatcatgctgctgtaaagacacatgcacatgtatgtttactgcagcactattcacaatagcaaagacttggaaccaacccaaatgtccaacagtgatagactggattaagaaaatgtggcacatatacaccatggaatactatgcagccataaaaaatgatgagttcatgtcctttgtagggacatggatgaaactggaaatcatcattctcagtaaactattgcaagaacaaaaaaccaaacaccgcatattctcattcataggtgggaattgaacaatgagaacacatggacacaggaaggggaacatcacactctggggactgttgtggggtggggggagggggagggatagcattaggagatatacctaatgctaaatgacgagttaatgggtgcagcacaccagcatggcacatgtgtacatatgtaactaacctgcacattgtgcacatgtaccctaaaacttaaagtataataaaaacaaaaaacaaaacacagggaattaaaaatgaataaatttggttctctatatatgtacatagtgctctaactttttaaagcttaaataaacctttaaaaaactaaaaaaaaacaaaaactaaaaccatctgaataagctatgaatttgaattaataatgtaccaatgttggtttattagttgttacaaaaaatgtactatattaatttaagaagttaacaatcagggaactgtatatgggacatatgagaactgtacacttctattaaaatatcacttaggtctaaattgttctcatattatttaaataaataatgtaaaatatagttgtaaatagaccatttccattaccattttcattataacaaagctcaagacttgaatatatcatttaatataagaaaaataatgtttaaatgtaatatagctttacttctattacatttaatttttataaatataatgcacattgaaccaattatttgtcaacaaatttaataagatatacttatagaatgaaacagagtaaacagagaggaagagatagattttcatgtttttctgtgctttcatttggctgaagtttggttttttgtgtgtctgctaattgataaaatcattaaaaatgtttttagtcattcctttaaaatttcaaagaaaagctaaaatatttaaaaactcattgtttaaaattaagagctaattgatgcagtaggtattgatgaaagatatgattatgtcatgttaggagaaacaagcataataatatttaaaataaattaatatgcaattactaattaaatcagcatgtaataccaggtaagaagaaatactgaaactggtctaatcatcccacagaactgatgtttatgttttcgtctgaataaacctagaaactgatgctcccagttctgaaacttgcaaaagttacatttgccctgtctgagttcctttcccaggaaaccaaccattagacctcccaggtagtatcaaggaactggagtttgccagatcgccacatcaggaaaatgagatgccagaccgcttacctgtcttgattgtctaaccaaccacctgcttcctattgaccttcatttcccctccctaattcccattttcccacatatgattacttttcttccctgctatataaaccggcaattttagtcagccaaagaaatgaatttgaggctaatctcccatctttttggctgaagcacctgattaaatccttcttttctggcaatgtttgttgcctcagtgattggctttctgtgtggtgagcggcaggacctagaccaaagccctggcattttggtaaaaattacctctatggtgagctaactattatgcatgtagttgggcagggtgttcatcttcatgggtcccatttcattaccttttagagttttttcataaatttgtgggattctatagaaaagttattaaaggttatatattcagtcaattataactttttataaccatataatcacatctgctttttcagccattgaattttgatcctacatcatcatcatcatcctatcattctattcttcatcctatagctattattttgtaagtaaggtcttttacagtgtcccctcatgatcaattaaagggcattttctggttgctactcttacaaagtttgaatagaataaaaatcagaacttgtgttgatttgaattgacaaatttatcatagggaaagtgcccatctgtgaatagaatgaagtttaaaagtatgtttattagtcttgctgttatatgggatttagcattcttcattttgtttggttataccactatgttaaccatttatttttcttatttcaaaaatataactagaaatataattagaattgacatgacatacagttattccataaaagaaggtggtaaaaacaaaaatacagttgtcccttgccatagccagattattagttctaggattcatgtatataccaaaatctgcacatactcaggtccctaattgaccctgtaaaacccacagaggtttcacatccatgaatattgtatttccatctatgcttagttgaaaaactgcatgtacaagtggaccctcacagttaaaattcgtgttgtccaagggtcaactgtaaagtttaataaaatatttcctcaaaaagaaatgcttcatggtgaaaataggtgtattttacttttagaataatattttaggaatcatgattggatgaaagcagaaactgctggatataattagaaagctcattgtcatcatcgttcctaccattcaatgagtgttatctattcattgcatgcacccagcaccataggtctcatgttacattctctgtatcctttaacctttaataactaccctaaaagtattatagttttttttaattgagaaaactaagtccattagaaattaattaattttccattattatacaggtaggaagtggtcatcctaaaactgaaacctatgctgtgtgactcaatagattattcccttttctcataacactgaaccttgaacatgattattttactaaactgaatcaagtgcaacttttctgaaattagtattaatatttattcatattaatggtcttacactctacactttcagattttaagactcgggaaataaatatgaattttcaaaatcgcatggaattttctctatgtactcaagccctatcagtctcttgcctaatgtatgtatacaatatggtgagcaagtgctcagttttggagtgagaatgttttggttactgacttagattggctacttatcagcagtgagatcttgagcaaattcattaatgcttccctatttctacactttctcatctgtaaaatgaaaacaatgaacacacaaagtttgagtctgtgggcagctatctataagtactaagtaagttatttcatggaaaacacttagaatttgcttggcacacaatgcaattaataaatggtaactcaatggtaattattataattcacttattattgtaaaatacctttatttcattcaaagtcaggaggtatgatatcagaaatgtggtaaacatatctatgcagtattcttattatgaacaaatttggataagaacaaatttaaaattggtctagtatgaaattagttcctaatgagtatgcctaatgacaaaaggagtaagaaaaataaacattaaaattattataaatctaaagtttgaagacatttaacctggtaagcaggacataattttctatatacttgttatgtcaatatttaccaaaaaacttgattctttcagaaactcaaggttatttaaactgctaatactcaccttcctaaattgtgaatggcattttaaatgtaaatttatgaagcatcctttaaaatttcatgttattaatactgaaagaaacagaacttgattaaacacaaattcattaagctgactgtgaagcacttgggaccctttgcgttgatccttatagagccgtgcgtctagaaaaacctttcaacgaaaagaaaaggtacatttggtcaaaggggaatcatattaatgttgcttaatcaatgagtttagtatttccgggacatgaaaagtagggtaaaaaaatctcaagtggcatgacagtcatataatgaataaatacataatttctctctaatgttttataaatagaccgtaattcatatagttcatatttatcaagttttaaaaagtgttttttgttgttcttgtcattattcttgttttaatctatgtaatttattataataatctggaaaggttatactcgtttctttaaaaaatttactctatatgagcttcttcataaatttaactcaaagcaaactcttgctttctatctcaggaacatcagcgtagaaatatatatgttataggatatttttctgtatgataactgtgccattcctaatttaatgataaacctacttatagtacttctgtaatgtgccaggcactgttctactcaatgaaaaacaaagtgccagctttaatgcagattcaattttaaaggggtagatatcataacaaaaagcaaatacatatgcagtattgttgcagataagtggtataaagataaccagcttcagatagtctgttacaagagtcataaaatatgcaggtcatttatcatacatggaaaagttgtggggcttttttctttctattttaaaatttattatgtgtcttcattgaaccttgtgaggcaaaaattctaatactaccattttcgttttcaggtgagaaatctgaagtacagaacaaattaaatgaaatgtttttaagaaagacaaatgaaactaacaaatggtaatccagcaccagcatcactgtatatttgtattgtcagcagatttagctactatggaaaatctttgaagaatctttctcaacatgatttttgatatacacatgctctaatttattgtgggtatattcaacagagtagaattgctgagtcatagggtgtctgcctgttcagtttttgttgacactacaaaataactaatgtaattgtgccaatttacttatctaccaacaatgtatgaaagttgtgattatccatatctctaccaaaacatgagagtatattttctttcaattcaaagtgtaattgaacttaaaataaataaatataattaaaactccattttggtaggtattataatccatggatggattacttttaaaaatttcattttttatttgttgctgatgtataaaatttatttcttttaaaaaatattggacggtcacagtggctcatgcctgtaatctcagcactttgggaggctgaggcaggcggatcacctgaggtcaggagttcgagaccagcctgaccaacatggagaaaacccatctctactaaaaatacaaaattagctgggtgtggtggcgcatgcctgtaattccagctactcgggaggctgaggcaggagaatcgcttgaaccctggaggcagaggttgtgctgagccaagatcgtgccattgcactccagcctgggcaaaaaagagcaaaactctgaaaaaaaaaaaaaaaattgaccttgtctgcagtaaacttgctgaactcactttttaactgtaattttttttttctgtaaatactgttgggtagttctatatataataatgccatttgtaagtatttaatttaatgccattttccaactataaggagcatttctagtttgtatttattgattttaagctcaattgtttgatgattagaaaacacattctgtataattttagccatgtgggggacatgttgatacatccgtgaaaacccagcatttggtaaattattttatatgttccatccatgtgcctgaaaagaataaacttcatagttgttggatacatcattttaaaatacatcaggtcaatttcgctgatttcaatgttcaaatcttatgtttccttgcttttttttctttacttattttgacagttactgagataacttttgcattagttttctattgctgtcataaaaattatcataaattttgtggcttaaattaatataatttactctcacacagtttggtcagtcagaagtcagagatagctctcaccaagctaaaatcaaaatgtctgtagcactgcatttctgtagactctgaaaatgaattcacttccaagctcattcagattattggctgtatttatttatttttatgttggtagctgtcgactggggttccttcaagagtattcttgcattttcaggctatattatagctccactggtgttcaaaaccagcaatagtggctaagtccttctaagtcttagattgtctttgatctccccttatgcctcatcttatccagttcctcttcccttgcctctctctgactctagccagagaaaattctttccttttaagggctcacactgagattgggcctaccagagtaatccaggataatctccctattaacttccataaccttaatcgcatctgcaaagctatttttgccaggtaagtgtacagatatctttgggaggctttaattcaaattatatgacctcccaaacatcaattttctaatttctaaaacagggatattccttccttgtaaagctactgtgaggactaaataagataatgtgcataaaaagagcttaccacagtgctcataatatagatatagctccataaacaatacattttaatttattttaatatactataggtaacccatgctttagaggtttttatagttccttcctgtctgcctcaggatggtaaaaataaataaatattgactgaaaaattttctctcaatgaaaagatcattaaaaaccagacatatataagctctatattaacttgagataaattcttcacatgaccaagaaaacattatgtctgccttgacttgctcttgtttacttacatcaaaataaattttggggggtgagatgaacctcaaaaacctgccatcactgtcgagaaagatttgtctccaaaacttgcataagaatgatcagcaactgtgtaattttttcttgaaaccaggcaaactatttacttaatgatacaattgtttaaagctaattgagtcttcacttaaagagagaaaactacttcaatgtcttatgtcttgctcatgagaaagacatttgaaaccttgttataacccgtgttcaacatgtagatagaggaattaataatgttttggtgaattcttgacaaactaatagaagaacatgtttacgaagagcgtaagagggtagcatttaatgcatttataaaagtgctgattgtgattatgatataataccataaatgtaaatcatatttatttgtaaaataaggtacatgaaagtagttataatttagaatactagaatgtttattgataagtagtgaggggatgattgacctaaggacttgagttttattcccaacttcgtggtcaattttgtaaccatcaatttatactactgctccagttctcagttttctcatggtgaataaaaagagtgactaatcaggactttaattttggaagcttcttttataaatctgtgataatgactttattatacctgtcttttgtattttaatgaagtgtgaaatattttgacattaacaatctattaaactgtgaacgatttttttggaaaaacatttagatctttcttaattgcataaacttcatgtcttatactaaaaggacaaatagtatgaaaaataccttgcaatcttgcacagaataaaactcatttcatttaattttattacaaacacagcattgtagatgggcaagatagggatatctatttatacacatacacatatatagtatgtatgtatctaattttaatgtatcttcctaatacataattcataatagataaaattcatgtcaactaaaccaatagataattcataatttataattcattggactaaactaagtactagtactatggaagaactattcaaatgaaaaatgagaataatagctaaatttctattttttttttgatgctatttcaagctttaaatgcactgttttttttttcaagaaagtaaatataaagagtatgggcaaaatcaaaggtgaaaaatatgaccatcaagtacacacatttgatattatcaaaccatagaagatatgaccatagtgtcaatgggataggatgacctcagttatctaaaaggaaatgcattgtgagaaacttaccagttcaacaatgtattgacagctttgcacagtaatatagcttctcaaaataatgtttaagatcaaatctttacctttcctataaattttatcactctgatgtttaggagtttagggtttgaagaaattgaagatcaatacatgtaaatattgattatttcataaaaataaatcaagtaaaagagatgaacaaaattttgagacttgcatggtagggaggatcttattctaggcaaaatgaacagtgtgagcaaaggctaagaaagggagatatttatgagatgtgagagagttaatctgaacaggataaggcattatcagggagaatttgagaatgttcagaatacattgacaaatggtcagattatggaaaagcttgaaggtctgccagaagaagtgaccttttgacacccgacaataatgagaaattgcaaaacttttgaaaagtagagttgcatgattaaaatgatatttgagaagttactgtttaacaagacactgaaaagattagagagggaagtggaaacagtcaaatcacataggatgctttgaacttcaaattgaacattataaatttctgaaagaaggatgaactatgaagagggatccaggggcagttagtgacatggatgaggctggaaaccgtcattctcagcaaactaacaagaacagaaaaccaaacaccacatgtcctcactcataagtgggagttgaacaatgagaacacctggacacagggaggaaaacatcacacaccggggcctgttgggggagtgagggggtaggagagggatagcattaggagaaatacctaatgtagatgatgggttgatgggtgcagcaaaccaccatggcacgtgtatacctatgtaacaaacctgcacattctgcacatgtatcccagaactaacatatatatatatgtgtatatatgtgtgtatatatatacatatatatatatagattctgtaagtagatttgttgcctaagataattcacctatcactttataccaaaaataaagttagcactcaaccgaacaaagcaaatgtaactcaaagggtgtatttcaaaataagatcatttatatataattaaaactagttacttggaaattaattagtatctgtcattacagtagaaactcattaaacaaaagtgactcaaagaggtgaagcatttatcgaccagtaattcgtcttgttaaatttaaataggagtttgtattttgtttttaagttatataatttagaaagtctcagattacaaggaacataatttcttcaaactttcatgaacacaagaatgttgaaataactaaaaaatatttttagtaacttcaaaaagaatctagaggttaaaggcccaaatgatctgtttaattcacaaattacagttattctcctgtaaagcaggcatgcaaatttttaagattaaaaaaaaatcttgaaatgaaaagatggtctggtaaaatatgtactatcacattaatgtcattcattttttcatgtgtctaacatacacataataggtcacattagaggtactctagaaatattttgtagcttaattaactaaaaataattaatacagtaaccacggtttaaaaaaaaataaaagtggttcttcacttatgcactttagccaaaagagaaaataaaacaaagcaaaacaacaaacaagcatgtccttaaaaagttacaatactactttttaaatataatttttctaatttgatcagcatttttctataagaattcggttgtgatttgtagttaatttttggatatttcagaacttgattttaaaatccagaaaataactttacatttatagaaccgcagacattttcttccagtatttaattagtatgaccacctcagaaatacaaaggcaatgtatttgtattagataaatgccttaggataataataataactcgtgttatgcctaagtaagcatgtagatggatctaggcaataaattttcaaagatgatgaaaaataaaatatctattattataaatacattatttttcccatagttaaatgaattcctaaaataacatcggaagtcacatacttcttctgagtactatttttttaatgttttcttgatatttctaaacagttaagctcataattttaaaggaatcatttataaacatttattgtatatagttagatacatatatcaacagaaaggacagagagagagtaaatagaaactgacctcattcactgtggcatagtagctttcatgcttgaaagtgggtgagttgtcattcctgtctctcaccactattcgcacttcatggtagataatagtgcccacttttttgttgatgcactggacctgcaccacaatggagtgtatgttcatcggtggctgcaatgtagaaattgcatcttttaaaatactaattaaaaacaaagcttctcatcactgtcaaagcactcgttcattcagtacatttttctattcttgtttatttttaaattataataatctcaaagaaaatgatcattttaaggacaagagaagacaatcataattaatttattgtttaattttgtatctcagcgtgtggaattcaggtagcattatgctcacagttagtggatggctaatgagcgcacccacaaaattaatgcttagaattgatgggattaaacgaagtttgcccctccaaagattaaagaagcaataatataaacttttaatttgaagaaagtgttaattaataaattcctggagaagagagattgtttaacttttatgtttatttatatttttgctggaatattatatgttcattgctgatcaaattaaaaatactgattaccaaaagagaaaatccaaaagccagccaactaaacttactcattctacacatttaaatgcttattttgctaatctttttcactctctaaatatgtacatattatagacacacagacacacagtgaatatcagcccatgtttataaatatagatttactatagcattttttgtataatactatgaagttatgttatgtgacagcaatattatacttcattgtaagcctatagcataatgtatccaagtaataatttaaaatgaactactccaggctattatattttgtcattataaaaaatacttcaatacatagtatacataagcatatgcttacttatctaataatttttataataaattccttgaacgggaaaggtcaaagatatacttcctcaagtgccatggctaacagtttgcagagctggaatgcacacctacaaatatttgactctagagtcagagtattgaccactacaaagtatttctttgtgatttttaaccccttttgagcttatgcaactttatctctaaatatgtcatttttgcagtgtcctatcctgacccctccatcttaaaaaccttgtctccaacctgacatctcctttcaaatttcttccaatttatttttctttattgcatttctcaccgaaaatttggctcgttgtatattttatgtacttgttttggtttgtctgccttcactagactggaagctcaatacaacctgtgtgttattttagtcatgatagtatccctctttccagtaaccagccctatgcctaagacagatgatctggagtcaaactgcatggcttccagttccataacctactaactgtatgatccaggaaaaagtacaaagtatctctatgcttcgtttattcatctataaaattaaggctaatagttacaccaatgagaattgtaaatactgcatgtgattagactatactaggcatatgttaaacacctaagggattacatacatatcctattttatttattaaaaaataaatatccaaaatagtgaaaaaataaaatctataatgcacgacacatttgtaaatgagaaaaatgctacagaaactatatctaagctgaaggaaatcattatttagtttcaagatatttttatggccaacaaagaaaaagaaagttgacttgaatttgtagctgtctgaatgatgctacctagaaagaataaattgaggcatcattgacatacgaaaagaggtctctagtgaaatcacacatagctctgtgtttttatatctactctatttctcctttaatcactgatataaatgaaggcattaaaatcatgtgtataaaatctgtgaatgttacaaaccttggaaggatgtataaatacatttaatgacaaaagacatggttcaaagtcatcttaataagtcataataatgggttacaaaatggtaaatttttgcaataataaattttatcctccaatttgtaatagaaaaaaaatcacccaaatgtaatagacagctacaaacattaatgtaaaaatgtaattgtgaaattttgatagctaaaagctgattttacatgacagcactgtaaatgggctactggaacactaatgcatactgtacattaattaataatatcagataataatatataggtagattataacaggtaccattttacaggtgcatagaagagaaatttgaacacttttgagaatgtataaaatgggaggattttaaatttaacaacatatgatttgtcaaatatctaaatggttgtcatggaaacatccattagttgacttactgtagtttcagagagcagaaataagaaaaatagttgaaaaatatttcaaagcatgttttcaccataagtagagggcttctcttaatccaaatttgcaccaaataattatgtgcctctatcaaagtatctcatgtaactcatatgcacctactatatacccataaaagtttttaaaaaataacaaatagagcagagattcttatcagtagaagagtatagtttatgttagaaataaatttatgccttcgcacttccaaatacttttcctctgccattatgagctaaaatatttgtgatgcttcaatttctttttttcacatttgtctttgtataaaataaagaaaaatcaggaggaaaaagtgacatggaatagaacagactattctataaaacaagacccatcactgaaatatgccagtttgaggataaaagaccattgaaaaagactagctcttagaagtttcctggaaagaatttgaattagatgacctccatttttactaccagctttcaagtgtgtaatagaccttttaaggcatgtccagcatattttaattgtaaattaaaaacaaaataaatatgtgtactgtttgtccttggcacacctcttggaagacaatgaggtgaattatgcacttttaaagttatttatcttccaattattgcaagagagacctataaaaacattctatctcaacttctaattctacttggagtggtaccactgggaccaaaaggtcaaaatcttatcaaatagaggatcaaatgcactgtgtactgaggcctcacttagtcctgctaagtacccataaattagatctaaccaggtcacctggaacagttatcactctcaactttagctccctatgcaactgttagtggcatggctagaacttagagggcaataaattataaccataatggatcacaccgaaggcaaaaattccctgtggctaatatataacacacaatgtaattttgtattggcatagattcaattctgctgtataagaaggtcatacataaaagtacagttctaataagtccattagtgagagtttagggactctaagatgcttaagaatgcattagggaaattttgctttatctttcataactggtggcaaaaataagccatggtaatttgaccttttctaattttctttaattgctttattcatcaaacaaagaagaaaaaaaagctaggtagaaattgtgttcatataactatttaaaactattaccattcatatatacctaaacatgcaagctattctttcaatttaaaaatgagtgcttaacacaatactctgaacgtatacttgcacatttgtgtattagtgtacctgtgtataggttatgatatgtgtatcaggaatgatatatatcaacaattaaaggatactatcattaaaaagtgggtttgagagtatgaagagaaaaaattttcccacaaaaatgtaaaaattttgtaactctgaaaaagaaaaaaatataaaatagaaatttttgttatgaatttctcaatcatttaggattcaacatgaaaattaaagtttttataggggatttgttgatattagcagtttagattatagcacaaatcttcaatccaatatattttttttctagaaaccaaatgatttggaagtcaatgatttggggggcagggaatgcatttttggcaaatctgtaggaatttatttttcataaagtataggcaaagtttgtctaattctcaggagtgaattttttttgtcatgatatttctgtctatggacttaccacctttataacataatcattcctatttcacaagtaatgtggaagacagtgaaaggaaataagacactgtgtgttttagaaacgacttttacataaaaaagcaaacttaaaggaaatggctggccagagttgtcagtgtccttcacaaattaaattttcacaatgaatagtagcatatttactgaagatattacctaaaaagaaaatatcaatttgtaaatacaattatgcatatgtgacatgtagatacatctatagatttttcacagtgaattattaaggacattcagtctatttaatggtaggtatttgttatatgaaaagtttaatgtgggttaggattaatatgacttagtccttggatactaatagcaacttttataaaactgatatgaggtgatcataaataaagtcagtcaaaaatactattaaataatatggattttagaacaaggaattgcataccagtgttattagaaaataatttatacagaagcagcatttaagatatctcttagtagcacataaaattcaactgatagcactggataacagtgatttcaaagtttatgttcaaaagaacatcagggaaggtatggtaagaaaaaattggatatggtcatgggacaataattacattagttttcttagtttgtagttcatacatttctaaataaaaagaaaattatatagacagggtgcatcttgaatctagcaaaactcaagagacagatagaaaacagtttgcaatgaaaaggtatctgtgggcacagtctctgtttcagcactctggttgtagaataggttgaatcaagacaggtggtagacaacaattagtttatatgagtgatgactaagaggtcttatactaaagttatgttgactgatggagatgcaagatacaaggtggagataaaactactaaacttagcagttgaatggacactggcctgggcaggggagtcaagccccttttgcagctaccaagttagagtctgaaagaaaagaagctaagatatttgatgttgttatgaacataatttctctcgtttcaaaagcttttaaaattttgcccaggattttgagataagtattataggactgtaccagagtcatacttttctttctgttattattttaattattgatattgtcatgaccattattatcacatgcccaatagtgatgagagcattttggccatgtgagacaatcatttagcatttcaaaatttttatgtgatgtgcctttattactgagactcttcatgttcaccccaaatatcacattctggttgtttctcttttgtgacttttaattttgtaactcttcctttctttttttaatttttgggtgctgaaaatttatgtaactttagtgaacaaaaaaataaaaataagacataaaaataaatgatgaccataagggaaaatcttataaaccaagttttaaaattataaaacagttcatagtcatacaatctcatgtaaatgctttctaattaaatacaaatatctgagcgttgggtatttttattctttatattcttcctcggaaattttcatgaagatcatgtttatcagcttatttttaacacactgttaaaaatgtttctgtctatattgtttgcttttaattctattacagccataattattcaaacgtccccattaagagacagtttattgcctcaatgagaaaatgtagaaaacatgatttgcatcactttctctggaaaataaatttttctctaactgttgctaaaaagatggtataattggatatggatctaccatgtggccctactccttgctccctggctatagattcaaaccagtgagtatttaattgttatttctctcagaaattttaaaacaaaacaaaacacagtgactttaagccttctttaatggccactgcatcaaaagtttatgaagaactggcatggcatgaacacagaaaacacttaaagtcaaatgaaaaacaaggaagtggagtaaaattataagtgtataaaggaatctgctctgcagagagaaaaatagagaatatgcacagagaaaggcagaaactagagaccatatggtccaagaccaagtagttttcctctctccctggtaaacatacaatttccataaaagtaaattattttttatatctatgctattggtattgttaatattctctcccatcagctggaaatcatttgaaggcattgttgtgtcttccttataagccaaataactttgattaaaatcagaatattcttagaaaagcataatttcataacaaaaattcagtggaaaattttctataaaaataatttcaagagcaatttaccactaagaagggttaaagttaattataggctagtgattataatacaaagctttcgccattgttagtaggatcaaactcaaattgttggttctattttgatattcagagcatatatatatatatttgaaatggaatatatatatataatatataaataaaaatatatttttgaaatggaatatatatatataatatataaataaaaatatatttttgaaacggaatatatatatatatataattttttttctttttgagacggagtcacactctgtcacacaggctggagtgcagtggtgtgatcttggttcactgcaacctccgcctcctgggatcaagtgattcttctgcctcagcctctacagtagctgggattacagggtacctgccacaatgcctggataagttttggactttagtacagacgggttttcaccgtgttggccaggctggtcttgaactcctgacctcaagtgattaactggccttggcctcccaaagtgctgggattacaggcatgagccatcacacccagcccatattttttattttgattcattatattcataaaagaacaaccaaaaaactttgggcaacaatcaaaagaattacattttaggtaaatgccctatattttaaaagaaactacaaatattttggtatttatcataataatatagttatttaataataatgtatattttatctatatttagcttttgggaaaaaacattttacattaaataaaatttaaaacagtgtaaataaaggtatatatatttacatatatgaatatcatagtattaatatatatttcattaatactggagagcatattttcaaatacaatctatataaaaagtgtgcactcactttttttaaaatgaattctctactatatctttgtagaaaatattaactaggatcatagagaagcatacagaagaaaaaatatcttattctatatcaatgtaaataatgttaaaacaataaagtaaaaacatacaacacctctccaagtaaactaagattatttcaaatatttacataatattattattttatttcagacattacaattatttagcaatattggtatggaagcatatagggacaatatatcgagaggaccatttagtaaaatggataaaactccctagtccagtaatataatgatggtaaatgaatttatctctataaaacaactaaacaattgtagaaagatgcatgtacaaaaattttcactgcagcatttttgtaattcttaaaaactgcaaacaaacttgacttccaaaataggagattcattttttaaaaatctcttatttattcatgcaataaccaatcatgcagctaataaaaataattatataaatatacatttgtttgcattataattttacatgtattataaattttatgtaaaaagtaggccgacagcaaaatgaacagcataatccaatttaaattaataagtattataaatatacatatcaacacacataaatgcttgaaataaaatgtggcagaataaacattaaatgttattttccctaactgataaaattatcttcatatatatgcttcttattttctgatatgtttaccataagcatatattattttacaattaaatgagactgtaatttccagtagtgattagatttggactaaaagcccagatttacctcactatttgtctagcagtaatggtctataggacacataaaacagatgggcactaggttaaggatattcagaataaaagcccttatgctttgatgaatgaacccctaaaagcactgtggcagcaggaaaacataattcacaagaattcaaagaattcataagtaataaagcacatagtaaactgtagtaaaataagaggcaaattgagatttattaaagactccaaattttagacatgaaatagtataaagtatcaaccactccataacctattgtaaagtggatcataaaccctgagcaatgatgtgaaatgattcaggttcactaagctgagtatctgacatttggatttcataagctgggaacttgtgggtaagcatgtttagagttactctctgagttttcccagggcccagtgcaattactgattataatccactaccctctgcccctctgtactcaagaaagactgagatgcaaataagtgagtacaaagttactttagagagctacttatacctattaatttttttttaatttttccagaaatgaaacatccaactacgttggtaatttagcaatttttttttgaggtagtgtctcgctctgctgtcctggctggagtgcattggtgtgatcatagttcactgcagcctccactccccaaccccaagctcaagggatcctcccaccacagtctgcagattagtgggactacaggcacgtgttaccatgcctgcctagtttttcaaattttttgtcaagacagagtcttactctatttgccaggctggactcaaactcctgggctcaagcagttctccccactgggcctcccaaagtgctgggattacaggtatgagctactgctgtgccaagcccaatatagatattcttaataaaaaaaaatttatgctatctgagaactacttgactggcatattaccatgaaactttttctcattttttttttcttttttgcaactatgtaagacatttccacagttttgcccttcaaccaatgcttactagttgtaaaagcaggctcctgtgagtgcacccaccaaactacatcttcaagccggcagctgagtgacacacttacatgttgccattgttggacagaaatgagttatagccatgcttgtcctactttgccaagggtaccacctcttttttctaagcactatattttcttcttgttcagaaattgacaagcttccaggatattaaaggggaagtctaacggttctccaggacacagatgttcccttcctttctcattcttctttaaatgagttaaagaaactgttgttgctatactcaggaaataaactcaaattatgtaaataattcaatatcatataaacacacacatagacatttaaattataataaacttatattacaggggcaaagaaaaaaaatcactaacatctctatccagaactcttccggtgctgttcaggaaaagcatttgcttaacaggatccatcaacacccagtaatccacattatcctttaaagaaagttctatggtggggtctggtcctccagcagtccctttgatcagcatgttgtccaccagaattgtacctgcaaaccaaagaaaggtacttgaaaacatattctactcatatgaattctttagcaaagatcatgctcttaaaccgcggctggctcacaatcagttttaaagctgaaaatactcaactgtatatctagcataagacagaaaatattctttaccaaaaggccaaagtatctgcattatattatttataaataatatttttggtggaaggcagagatacagacatggtgagttccatcatccattttgtgtttccctctaacaacataaatctgtttccccccatctatcacttctcacaggagttatcactgaattttatcctgaacaaaaggaaatgcctgtaatagcagagtctgatgtctcaattaattctgttagacctctgatgtgaaaaaaagatattgtgaaactaagaaaggaagaggaaatagatttttaaaaagtagctgagcctcccatggtgagaactgcttctttttatcttagagcaaatacataaaacatacatcttgacatgaaagacaaaactagtgtgcagaaatggaatagaagccattcttctttaagacatgtctgggttactctactagaacaacgcactaggccagtgtaacatttcagtgattgctttcttattattttttttcagcaagctgaattgtagacagtttttgaataaaacttgaaaagattatgtctctaaccctttctactgtgttaaagatcccatgcattttacatgtcgaatgcaaacagcactgatgcaactcaaataccatttttccctcacgcagcaatgatctctttgccaaataataatgtaccatggcttagagcaatcattttcaaccgatccattttattaaacttatagatatagaagagatgtggctatgcaagtaaaatgtagcctccaaaaaaacactagaataaatggcaactatcgagagaacacatcgccttaggacagcactcaagaatatacagagaatccataaatacgaatctggcttgaaaaatataacgaaaaaagtatctgttgcattttcttaaggcatgaaattggcctaaatgttataccgttgcataattacaagaaaagtggaaggctctttaaaatattttctcagtaatttaataataactataattatctataatatttctttatcatactactactaccagtctttatccgcctaagaaatgctggaaagaaccatgaatcttttgtaacaagccagaataatgtttaaacacaaatgttgtctcacatacacatacttttgtaaatggcacattttttgcactttttcacatactaggacataattacatgaatattgagtggaatgagtatttttatttttgactgaaatggcaaatacacaacctacatacaatacactccaaagtatagatcagatattgatggcattttattgcctataaatatgttcaagaatgtatatatattcaaggccccagtacatactaatttacaaatacttcacacaactcaccatgaaaagatatttgatctgtatttcaatatataattgagaaattgaaagggaatttattttctcatcaagaaaacttatgtacaataggcaggtcaactaacattaacattaataccttgactcaatagtgtttaagagtagcaactgcaaatcttctgattgtgtgtatgcatgtatatatatatatatatatatatatatgctccatatatatatgctccatatatatatgctccatatatatatatatatatatatatatatatatatatatatatgctccaagctgcgagcagatacactaagggaaggagccattgaactatctttacaaagcaaatagtttataaccagataaagttttaatagtaactaatattaaagtagtgaaacaaaaacactgtatctggatttatattttatttaaagattctaactttcatggaaaagatctatagttttcttgctctcagctcactcctgagttcaatgattgaaactcaacaaaaaatctttctactgctggtgtgttgaaagagttttgtttgcttgcctgctttcccctttagaattgtccatttgtattgccaaaaagaaaaaaaaaagcctctcaaattttcatatacaagcttgctttaagccaaaatttaggggagagagagagaagagagcaaagcttaggcagacatgatacaaggagcaatatacatattttttaaaaattaacctaagtgttcactctgaattgcctgaacaactgtgcccatacccctctccttagaagaatacgtgacacccaagctatagttagcattaagccagaaactcctgtctctccctatcccagcagtggtgactgtatctttccacacatcctaagttttcaagatctgaaaagctagtgttctagacaatattggcaagcagctaaacaccagaatactctgggtgtattgggataatgtgctctctttcctccttcgttactttgcaagcttccctttttgccaataaaccttttgcttaatgtgtttcatttgatgtttaaatgtattctcttctttgacttcattttaaatattacagataagttaaaaataaaaagatgggaggcacgacacaacactaaataagaaaactggatggctctattaatgtcagctagaacaagcaatgtttaatagtggtaacgagacatatttaattataataaagggatcaacaggaataatcctgagtaggcctgtcttgcagaataggtaatacccaagatgggattcaccttacatgaaattttcctttcatcataataaaaatggtggcagttcagaaaatggaattaaatttagtttgatactcatataatagaagttaagagagctggccctggaatggataggcttagaatccaatccataatccaccacttaccaactatgtgaaagtggataaccgcatttaccctcgatttttctccctacaaaatcagtactataagagaaaaggcatttctactataatactatatgtatgttcctgaaaaagacttgttctcttgtatttagaataataaaaatcaaaacaatcacaatcgtgttaaaaatattagcacagttaaatatttattgacattttcaacacatttcttggctggtcaatcttttacagccttaaatactgggatttgtgcttcatcctttaagaagtaggtattgagggccatttacctctagggacgttttttataaaaatggaaaacttcctctttcatttagcctctttattagcctattaattcagaaaaataactttgcagcttctttttatgtacttcctgattctcaagagagattaacatattaaattacaggagttcatgtaactgctaatatagactctatttgtacagaataaatgttcttcaatagattttccattttttcttaagatcttctcacatagctagccctttctttttaattgtgacattagagcttgccacccatacaagaggatagtgggcattaagtatggtccaaaaaacctgtgacatgcttctaccccaaagaaaagtctatgtttctatttcccatgtatatgattatgtggttacataacatgagattctatgttgtatacatgtgtctatgtgtctgtataacatgagaacacaaactgtgttgtgttctgagtccataaggaatacataacaacctgattgaacttggaagcaaatgcttccctaaccatgtttcagatgaaatggtagccctgacaattccttgattatactcttgtgaaaccttaagcagagtacctggctatgctgtgtctggactcctgactcaaagaaactatcaaataataaatgtgtgttgttttaaattacctaattttaatgatattgttatacaataacaggtaatttacacaggatttaatgtcaaaagatctatgttcagaatcttggccgcacactattaactaactgtgagcttaagcaagttcccaagatttttacaatcagcaatatagagttctatgagaaaacaataaaaatgaatgtaagtggaggcacgcaactacccaatgaataacatttttcatcctacagctactagcaatttatatagatttgagcatataaaggagttatatattatttttcattaaattgggaacattatcaacaaaatgattttaaatgtaaaatgtactttctgtacaactgaaataagagaagcacagaacatacttaaataccagcaagaaaaaaaaaagactatgtatgcatatgtaaaatataaaacaaaaagaaggcaacagtttattcacagtaaccgttgataacttttcatgaaataaaaggccatttcttgctggcaaaagcaaaaatgaacaagataataagcaaaaaaagtcatactactaagatcaaaaatgcttattagtacttattagcatttgctgactgtattaactggactaagagataaaatagaaagacgttcagggaattaccatatttaattatcagactggtgtaaatgggaaaggtttataccctcagaatattgcaatattttattattttcaggccatcaaattgctgcagttaaaattaaaagtacaagcataccatgccgtgtatgtgtgtttttgtgtgtgtgtgtgtgtgtgtgtgtgtgtgtgtgtttcaacataatgattaaagtgggtaaaaaacaatcttcataccccactctcctcaaccaaaaaaaaaaagaagagtatagaatctaatcaggcagttctgttcattagaaaaatatgtcccaggggttgaaatcaaagaaacaaatattggttattttattttattttatttttgagagagtcttgctctgttgcccaggctggagtgcagtggcgcaatctcggctcactgcaacctctgtttcctgggctcaagcgattctcgtgactcagcctccataatagctgggattacaggcacctgccaccacaaacagttaattttttttttttttttttttttttttttagtggagatggggttccgccatgttggccaggctggtcttaaacttctgacttcaggtgatccatccgcctcggcctcccaacgtgctgggattacaggcgtgagctactgcatccagccaaaaatatggttttaaaatgtatgtgaaagattgatttgaaaagataaaagccaaaaaagccctgcttgatgaaaaagctcaacctcttaacctgtgtctccattagaatcaattataaacctcaaattttgggtttttcttccattccctaaccaaacaattaaatctctaccaagctgaagatccccccccttttttttttttaactaaaacttcatttcaacttgtgaaattcctttttttagtgaaaatgcaactgtagaaagttgttgttgttgttagatatgtgatttaaaatataaactttttgactgcgattttaaacactatttcaaagttttaaatgattcgattcagtaaatttgtaagtgtgatttattagattgaaagaattgattaagtgtcttaagaaaaaaatcctcttgggtatgcttgcctacccttctagatgtttgaagagtttgtattaaatttatcaacatcacagtagtttaattattaaagattgcatatatagtactttggataggggaagtaagtttgttaagcttatgagttaatagaactttaatcacagaacaaattaaagttttttcccttagtttttcagtcttcctacggttatagcaggaatgaaaatatttacgttatatttatggtcaaatacgattttgattttatctgtgtcatttacacatatttaatattagttaaaactcaagcaatattccatgaaaagacaacccacatattcaaaaaataaacaaaaacacctaattgactgtaggacaacaaacaattatataagacaatatgtttaagaaatggatgtggaattaactggtagtagtgaatcaatgaacatatttcaacaactccatttatttcattttttgagtttctggttgatccaaatccaagtgtatattccaggcagagagaaaggtcacatcataatcctcctccatttctcctctgatttcagatttaatttttaatataagatatttaaaaccttttattccatagataaatttgtacaatagaaaatgtggttttttagtacctctaggagaattctgagttgtcataaccctacagttaaatctgttttctcacctataaaatcattcagattaacaattctgtaaacaataaggcaaaattatttaatatgttattgaaaataataaaacagatggatgttatgacaatactaaatgtgaattagaactatgttacagaaaaatgttttgtttctataggtaatttgcttctggaaacaattaattggaggacatatttaataaccatacgtgctcaagcagtttgcttttttcatgtaaaagtgggcaagtattaagactaaattctgtcatttttttctatggcagtgcctatcgtagaaaaacaaataagcttaagtttgataattaaagcagcaaaaatgtaattaactaaagagtactcaaatattcaaagttttctgataggcttatcatttgagaggttaatccagccaaacaaatttaatttaaagtactctctaactgcaaatgaagtaaactttctaagtcatattccttttcaatagcacaagtacttgccctttttaaaaaatcaaataaactaactaaattaaataagattctttcaggtattttctaaaggtcattttattcatttggtctgtaagatgatgaaaatcattttacacattgaagaagctatttcaaagcctgacgaagtactttactttcaaaaatattttctaataatcattgcataaatgtttcacctccttggttaaattgattcctttgtgttttattctttttgatgctattgtaaactgaactattctcttaatgtcttttttagcttattacttgttaggtatacaagtacaactgatttttgtgcattggttttgtatcctactactttgctgaatttagttattagttgtgtgtgtgtgtgtgtgtgtgtgtgtgtgtgtgtgtgtgtgtagactctttagggcagggatgtccaatattttggcttccctaggccacagtgaaagaagaattgttttgggccacacaggtaatacactaacactagcgacagctgatagctgatgagttacaaaaaaaaaaaaatcccaaaaaataatcttatgctgttttcagaaagtttataaatttttgttgggccacattcaaagttgtcctaggctgcatgtggcctgcggatcataggttggacaagcttgctttagggttttctatatgcagtgtatttaagaaagaggaagattgtttaacttcatataataataatcagatacttgaatatgttttattatttatacataatattattcaaatattaatcagagaaccacctgaaagtgattatctactttctcaacataactttttcccactataaacattcattgttatgcagaatatataaagaacttctgaaatccaacgaaaaacaaatgatctgattgaaaagtgtgtaaagaacttgaatcaatagtttttcaaagaagatatacaaataatcaataaacacacagaaagatggtgaacatcactaatcattggggaaataaaaatgaaagctacaataataaaccacctcacattcattaggatggctactagacaaaaaacctaaaaaatagcaagtgttggcgaggatgtggagaaattgaaacactacaatgttggttggaaagtaaggtggtgcagcccaaaatttcagttacacaaaagaaacaagttcaagagattaattttacatcccagtaactatagttaataacaatatattgtacacttgaaaattgctaagagagtagattttaagtgttgtctgtacaagaagtgaggtaatacatatgttagttggcttgatttaaccattctacaatgcatacacatatcaaatatcatgttttacaaaagaaatatatacaatttttattaataaattgaaagtttaaaataaaatcatatggaaattgtggaaaacaaatgtttcctcaaaaattaaaaacagtattaccacgtgattcagccattttacttctgagtatatactcaaaagacttgaaagcagtctctggaagaggtacttacatacccatgttcctggcagcatcattcacaatagctaaaacttggaagcaaattaagcatccatccatggataaatcaataaacaaaatgtagtatatacacaaaaggaatattattcagccttgaaaaagaaggaaattctgacacatgctacaacatggatcaacagtgaggctggtatgctaagttaaataagccactcatgaaaaaacaaatatggcatgattatacttgaaactgacccaatacttccatatattttttaataaacatagatgtgtactcttctgatctgaaagtttgaaatttaccaaatgatcttcaggcctctcaaagtatcaaaaaactcaccatatcaccacatccagacaatgagatgcaggatccctcattcattatgcttgcttccttgcccctctgtaattcctgtttcttgcacattattgcatttcttccctgctatataaacccctagttttagtcagtgagggagataaatttgagacagctcccatctcctcggcagtatcacctgattaaagccttcttccttggcaatattcatcgtctcagtgattgagtttgtgtggcaaacagcaggacctagaccaaatccctggtgttttggtaacacacttatatggggtacttaaagtagtcaaaatcattgacaaagtaggttgttaccaaggacttggggagggagtaatggggagttattgattaatggtatagagttttagttttacaagatgaatacagttctggaaatggatagtggtaatggctgcacaactgtatgaatatacttaataccactgaactgtacactcagatatgtttacatctgttcctcttgcttcacttgtccttatcgtatttgctacaaggcattaggatcaattatcccccacaagtatggaaagtcttttctctgttcaaacgttcatcagcatgaagggtccaaaaatggccagaggacaatctgagcttccaattagtcagaacaatagttgagtttcgttgtcaaagcgttcaacttctggtcctagaacccaaatgtcacccagctgaaggtcacagacaagaaagccaaaattattcacgaagatcattaagtaagataggaagagagatcactttcatcttcacttcaagttgcccaggctctgttatgtcatgccatctcctgcatagctattcaggagagggcatgccttcgtgacctctaatttaaagcatacgccacatactgtaagagaatgaccaaacctcatagaagttcatcttctactagccgttatctgagaattaagaattctatcccaccatcttcttctgctagctgcttctgaatggtaggcattgtagtaacattattggattaagctgtggtgtgagctctttgctatgatccttcaccttaaaataaaataaatcaccttgttggaaatgaggttgtatgtccaccagataatgatcaaaagcattggaaagacgttctctgagcacatgaatgttgtttcaggtagaaggtctacagacaacacaaatccatactgaatcatatttatccatataaggaccctcctccatgataaaagtgggtttaatgccactggtcagtgagctggttccctgaggaatgataccataatagggattcagatttgggttctattactggcacattgagtatcagcaacagaagtaaccagattagccttagtaatgctatcttcttgagcccacatattaatcccatttaggtcactatgagcactttacacacagggtcatttatttatccctattgagaccaggaagcccattctgttacagcgtccctcactgacatccctaatctacagaggaaaaaaaaacaaaacaaaacaaaaaaaaactgtagggctcttcaaggaagccagatgcccttttaccaatatacttgttaaatcttgctgaagtgcatgtcctctggttatcttagaagtgtatagataaaggctggtttatcagattacacatgaagataaattcattgcacatttccatcactctgaacttttaaactcctctaaaatagggcttctcaattttaatgtgcccatgaatcacctagagatcttgttagaattataacttatgatttagtagatatagagtaggagggtagagccgtctagttgatgctgcttgtctgtgtgtctcactttatgaaagcaggctttatcacaatgtttctaaagtgtggtcccctgacataagtatcatcttcacacgagaacttgttcgaaatccgtatttgcggctccatcccaaactattgcattagaaactcagagatcccatttcagcaatctgtgtttaaatagccatccatgaggctgggaatggtggctcacgcctgtaatcccagcactttgggaggccgaggcgggtggatcacttgaagtcaggagttcaaaaccagcctggcaaacatggtgaaacaccatctctaataaaaatacaaaaaaaaaaaaaaaaaattaaccaggcatggtggtgggcgcctgtaatcccagctacttgggaggctaagggaagaaaatctctggagcccaggaggcagaggttgcagatcgtgccattgcactccagcctgggcgacagagtgagactccgtcttaaaataaaataaaataaaatagccatccatatcattctgatgcttgttgaaatttgagaaccttgttttataatgtgctgtaaaagttcagacattttgacttcattaactataagctattattgagacttggtttcagttagccaatctagcagactattaacgccacttttcattgtggtagccaaaacatcacaccctgaattcagggtgaatgcattcatgcaaaagaattcagcttcagcaagttttgtattttgttgtccattgtctaacgtctttagaattcactcccatgcatgatttctagctccctgccaatagtgacaatgacctataccttttgttttgttttgttttgttttgttttgagacagtctcgttctgtcgcccaggctggagtgcagtggtgcgatctcggctccctgcaacctctgcctctggggttcacgccattcttctgcctcagcctcctgaggagctgggactacagctgcccaccaccacgcccggctaatttttttgtatgtttttagtagagacagggtttcaccatgttagccaggatgatctctatctcctgacctcgtggtccacccacctcggactcccaaagtgctgggattacaggcgtgagccaccgtgcccagccaacctatacctgttttgtagtataggctatcttgttttaaaaaagatcttatattcctgtcttgactaaaagctaacatttcttatggccctagaatcaatgagagatggtataagtgggtcatgaaaagaattgacattagctcttgaggaaactgtccaaatatagttactgtaaggctattaggcagaagaggactagagaaagtgagagggtctatgttcactagccagaaagttcatgaaattgagatattcaatgttttcaccattatcattttcccatctcatgtctcaatgtcccttttcttccccagtgccaattttcagtgccttttctataggttaagaggatcaaaagggttgagagttccaagtatgttgcatctctgcaacacttataatcataaaaagatgggctccttcaaagctgccctgatgaccttctgtttccccatgtgctcttattgcattttatacctgttagtttacattttccctatatacattctcaagtatatagagaatatacacttggttgtcatgagaaaccaaatgtaataataattacaactattgctacagtgagtaattgctgcagccacttgatcatccaatactctatacctgcactcatcccatgccaccacaggtgtcatttgagtaattgtgatgccacacctggcaaaaattagccacatgctatgtgaatctcccacctccacgaaaggagtttatgcatggatccttaatatgcacactccaatccaagaatctcattttgagttattttttttttcttagagacaagtcaagcaccaattactataatacttggtgtaccagcaagaaaatgtcaccctcaaatttagataaaccaatgtgtttttagtaaaggaaagcttaagagaggtgtgagtagggtataggggaactataagaggtaatgtcatacactgacaaacaaggaatacagaagaaaaatttcatcaggaaaaaaaaaaaacaacataatctaatggggaaatgtcatataacatgagccatgtttagaaaagaaggcagccagcttggagagaacctatgcaacacatacctggctattatttacctctttcccttcatattctcctttctttgcccatttgtggaagccaactgaatgtcagatggctcaggagccttctgatgcaatccatgcatctctgagaaggtgaagagtggatgtaaaaggcaaacagatgtatctgcacattacctcctcaaggcattgtcttctgaattggtcttgtcaagagaatctcaatcaacaatgggatatagattcgggagaaattgagaggaaatttatgagttaaagcttaagtgattggcttaggaaagcaagtgccatatagtgtgaggcataataacactgtggtactggacattgtttagttgtagtttcctttatgtgtctgtataaaatcaacttttagttatataatttgctctatagtacaggtactttgtttcaatctctctctttccactataagaattgcatacacatttgaaagctagtttaatttaaaaaaaagtactaatttggccgggcatggcggcttacacctgtaatcacaacactttgggaggctgaggcaggtggatctcctgaggccaggagttcaaggtcagtctggtcaacatggcgaaacccatctgtacttaaaatacaaaaaaatttggtaggcatggtggtgggcgcctgtgatcccagctacttgggaggctgaggcagaaaaatcacttgaacccaggaggactatgttgcagtcaggctagattgtgccactgcactccagcctggcttgggtgacagagtgaggctgtctcaaaaaaaaaaaaaaaaaaaaaaaaagaaatgtattaatttattagcttttattgtgagtaatgaaagattatacttctgtccttagatcatattgatagtatttataacgttacataattctatattttgctccaaaaaaaaatctgtggccaggcacgctggctcatgcttgtaatcccagcactttgggaggctgaggtgggaggatcacttaaggtcaggagtttgagaccagcctggccaacatagtgaaaccctgtctctactaaaaatacaaaaattagctgggcatggtggtgcgttcctgtagtctcagatactcgagagtctgaggcagaaaaatcgcttgaaccctggaagtggaggttgtagtgagccgtgattatgccactgaactccagtctgggcgacagagcaagactcaggctcaaaaaaaaaaaaaaaaaaaattgcattgctgcaacatgagaaagctgctcctctagtcagagtatggctaagggaagtacatcataacttttaatcactgatatgtgattaaaattttaaagttttgataacattttaattaatgatttaagatgtttggctaatttccatctgaatttagattcaagcactttgcaagcctgttttaatctctatgcttaaaaaatctacatattaataaaatcagccttactacatacaagctgtcaacaaactctgttctaaacacagtggtggtatgaagtcaagtacctttctagctaatggtagtcagcttacacagttgttcaatggggcaacacaatcatatctccaactgttacagagattgaaatgattatcatctgaactactgcacttgtggcaaagttttctttctcaagaaggtttttggtaaaatacagatctatcaacaggagataccattacatttttagcacttaccatatcatttgcagagggatagactcagaatatgatagttgccatgaaaaatagtgaacagtaaaaactgaactaaatggaatatagaacacaagtattggaatgggaggcaaacgttaagaggaagagatatgggaaaatatatcaactcattattcaagcttatttaagcttcatttacatcacaaaaagtttccattcacaaccttttcaaataaaactgaaaggtttccatgatattttaaaaatataatctgtattttatcttaacaagaacttggaacaatattctatccaccattcctgatccaaacaagtgcccaatcttcatctatcttgcctcatattttcagtataaagagcccattcactttttagggaaaaaagacacaaataacacaatggcacaattgttaagtttctcattatatacaaccctatagctaataatgcacatgtcatttccatttctaggttgactaattttgatgggcagaagtgctctaaagtatgcttttataaacctcatatcacgtggtactccatggctgaaacatggcttaatgcatgttttaggatggtgaaggaaggagagaagggaaaaagaaaagacgaagaaaagaagaaagaaaaaggaaggtgaaggaaagaaagagagatgaagaaagaaaatgaaaatatgaccatgttataaagaaaattgaaaacatataattattttttcttaattttagcctgtgtagaaactcttaaggctgatgatgagatagatattttttgccataaattacatgaatctattcatttttacattcttattatatagcattagaatatgttgcattatatgtagactccttagaagatacacgtaaataaaattatcggggaacctgccccgatattcatgtaggttcttttctgtttttcctaagcatctgccagcttgagaagtaaagggacagagtacaaaagagaaaaattttaaacctgggcgtccaggggagacatcacatgtcggtacgttccgtgatgccccacaagccacaaaaaccagcaagtttttattagggagtttcaaaaggggagggagtgtgcgaataggtgtgggtcacagacatcaagtactttacaaggtaatagaatatcacaaggcaagtggaggcagggcaagatcacaggaccgcaggaccgaggtgaaattaaaattgctaatgaagtttcgggcaccattgtcattgataacatcttatcaggagacagggttttgagatcaactggtctgaccaaaatttattaggcaggaatttcctcttcctaataagcctgggagcgctatggaagactggggtctatttcatccctgcagcctcaaccctaagaggcaggcgcacctgggggcgctgtttataagcctatacctccaggtgggtattctctttcccaggaatgtttcatgctgagaaaaagaattcagtgatatttctcccatttgcttttgaaagaagagaaatatggctctgttctgcccagctcaccggtggtcagagtttaaggttatctctcttattccccgaacaattgctgttatcctgttcttttttcgaggtgcccacatttcatattgctcaaacacacatgctgtacaatttgtgcagttaatgcaattattacagggtcctgaggctgtaattacatcctcctcagctgacaggattaagagattaaagtaaagacaggcataggaaatcacaagggtattcattggggaagtgataagtgtccatgaaatctttacaatttatgtttagagactgcagtaaagacaggcataagaaattataaaagtattaatttggggaactaataaatgtccatgaaatcttcacaatctacgttcttctgccatggcttcagcaggtccctccgtttggggtccctgacttcccgcaacataaaataaaaaaaaaaaaagatgctttcaacttagtgactattattcctgtctatctctatgtgcatgtattacacacacacacacacacacccacattaagaacccactaaatattgttaagttcttggaaaatatgaccttaagtgaaatgacatacaataggtccttgaataacatagtcatttagatataattataatacgcaaaaaatggattttgttatgcatcgttttgattaaagtcacagtttccaagaacctactgatgacattaagtttatacacacacaaacatgcacacacacaaacacacacacacacctacacacacaaaggtagttatacacaatatactgactgccttataagaatgttttttctatcttgtaataatacatgagtaccacatttttcaatgcatttaatcatgctgtatctgagaatgtgacttattaagtcccataaatatatctaatacattttagagtataaatgttcaatgtattattgtagatataatatgaaactgtgcatgggagtggagtgaggaataattgaagaaaaggctcttgctgaaccaatttacctatgggagatcagaatatgccaccccaatttaggatggtttggcataaggtttgttgagctgaaggcaattaagaagcagatgaagaaaagctctctgcctctatttacctaaaaggacgatatacatttacaaagacaaaaaatatcccccttcccctctaaaccggggaggacaaatgttatccactgaagagaactttagactgttatgggcctggagatggcaccagaggaatctacattaacaagctttacttagcctttatctgccttttctttgccttgcctcaagttgctgtctttagaaattcaaaatccttttcctttgtcatgtcgcttccctaaaactttactgttctttgttgaacaatgcgttatataagctgaaattcaaactcacctccttggcggctactcattcccttgctgtcttccatgtatatatgaaatacacgtcaataaacttctctggcttttctcttgttaatctctcttttggtccatgggtccattccaactaatactttatcagaattgaggaaaaaaatattattcctcttccaaatagctatttagtattttctggctgacagagcaagtgtcttgacagagaactcacatttcattctctttccaacactcttcttttgatacactttaattataatccttaaaaatcagtctctgtgttagaagttgacatgatatatgaaggaaaagggccactttttaattctggaagttaatgcaataacataaagtagaaaaatagcatattttgaaatatatttcatgtcaaacacagacatatccttctaaaatgcagcatcaggaaatacttaggcataataacaaaagttcaaactatgatttcaaaacagagaatttgacaattcaagtatggatatgataagcctttattctgatttttttccaaatattccgacagtggaaaatgttcaaacaaaatttgaaggaggaggactgtgtactatcttattttccctcaatatttttcttatatactttaaagtaattttattctgcaatattgtgtcgaactatgaatttctcaaccattgtttctgaattgcaataaagtcaaaccgagcaagatggctttaatattgccctcatcttgacgaaactttaaacacttttcttcctgactgcatgtcctgacctttattttcttagagtgtttacttcagaaaattttccattgtaaattcttcctatgactctttgagatgtaaatagtctcccagccacttgtgagttttataacccagggatgtcttaaaaaacttggagacatccctttgaaatattgttatccagaaagatattttcccagtctcccagtttgtatggataataggagcctaaattccataagcaacaattaaacaattaaatgtggtccaaactcagggaacaaccttcccttcacttcctccaatgcttttccactaaaattttcttgcattgtgtttcaaaagaactgagttcaatttctatccactattgcaatagccttgaataaagtcttgcctgtttaactctatctggtataatttttcttcaagagaaccttaattagtcaagttctattttggcaatgggattcatattggaacttaattttatattataaaaatggataaataatcacaaacataaaatatgaatatatgtttccaacaacattgtgtgcatcaaaccaggcactaaatggcaaaggtataaataatcataataacaacttttgtggtgatagagttttttctagatgcactagatatgctgatattcttaaaataaaaattcttacatattagccaaaagatacttctgccagacaaatgttttattcattattacaaggattctagaccttttaaaattaagatattctgtttcaaagtcaatgtacaaattcccctaagttcttaaaaaataggggcaggtttcatggtgacctgttcaaagatctattgctgagatagattttagtaaatcaatttggttcactatcccagttggtcacaaatatgagtttttgttattacttcaattatcttattcattgcttactcaaaataccttttaagtcttatcccatgcagagatcagatggtaaggtttttaaagtaactatatgactatcagacttatttccatgtaacttgctttatttttgcctgtctttaagattttattacataaaaagtaataaaaattaattttaatgtattcctaaaatttcaaaatcttgcttgtttaaaaaaaaattagtcttaattaaaaaaacactatggaagaaaataagcctttaagtgatctatattatcctaatgatgttgttatgttacttaaatcaaaatttgtgaaaaaaataggttcacacttctgaatctcaaataaactttatagatcaaaaattaccaccaaaggtgctcagaaacaatgactaaaatttccatctctagcaattttttatataacaaaattgtcctaacaatactagctaataaattagagtttggttacaaaatgaaccatgataaaatctatcacagcaggaaaattttagaaaaggtcaagaccacttatgtgatcttaccttcaattttagaccaaggaaagtttgtaagtgaaatttaacccttcaaaaatgccccccaacatagtatcttattcttgtgcaacctggaaaaacaaaaaaaactgatattagaacctaggttattttatttgctgctggattatttgcttatttgttgttttaaatcagaaaaaaaaccccaaatattctggtagcctagaaataatcaatagccttgcagacaaccaagtatccgggttgccttatgaactaagcataggatagaattaaactagacactgctaaaatgaatggacaatttttagtggtatgtatacaaaccttaaagttcaaataatgtaaatggccgacatcaaacatattttctaaactatagaattttacaccaaacagtatgttctgccacagtaaactgtctctggctttcttaaaagtgatttattttatactgcaaattattctgtcatgtccacttggcatatatgtgttcctttctgattttctcaacaactctctcttagaaggaaagcattttctttttagaaaccattttgaatacataatcacatacatgtaacagaacatttaaaaagaaactgtttcagccaaaactatgctacctactctcagtgaagagagttgcagacaacttttgtaggacatggaaaagaagccactgaagttcagtgtgtaacatttatatgattaaatataatataaatataaataatataatgattaaagatgggaggctcaggtagcttggacactgaggatttgggaggaaagcaatattacagtgtgataattgcaagttatcaacaaagagtcatcagacttcttgcatttctccataagcttgatgacaagaacatcaggtgggtttctctgaaaagaactaaatttacagaagttagagaatttagagaaattagttgaagggtgtctgactttcacttgacaattttaaagggtgaaagtctaaatgaagaacttttgcagattaatggtctgcggttaggaaataactgtattccaactagagatgagtctcaagtgagtatttcccaccagcaaatgtgggccatgcaagagagtagacaagaaggagatgatctcaagcccagcccaagagaatcaccatgaggaatgaggagacctcagcagtaagacgctgggctgtgcagccacatccgcgggaacagcaaaagttagtgaccagaagacaaattctccagccatcccaggaattgccagaaacagctatccaaatttggaggtctccaaagaatctgcctacgtggttcacaatctcaggagttgccaaaatcagacctagagagtacagcaatgcaccctttcttttctttttacctctaatgctttttccagggtcaaacctggaggagatgaaaatcagtatttagtaagttgaagaaacagagatgaataaggcagagagagagcaaggttgttgacacccaggttctaaggcagctgggatgcctacaaaaggatatccaagcggaaaaaaattgaagtagatttctagccaaacttagaagtcctctgtgtctaatgtatttcagagtaggagataaagtatttgttggattagcacattagcaaaattatctagagaaaggaatacatgtgtaatgtccaataaaagccagtgattctccaattgaacataaaatggactaagttgataagaaatgtggggctctttcaacaaatagtttaaaatcaaaatcatgaaggtggataaaatatttctttacccccagaaaataaacggataaagctacttctactatctttgttatttttcactctactagccctaattatttcattactaacttatcatcaattgaaagttataaaatgcatgtttccatcatgatactatgtcatatatattttaaaagatggttataaaagtcatctgtcattattaaattaaattttgagtcaatatatatttgtattgggctatgaatatgcataagaaattaatattctgaataatatgtactctttcagtgccctggaaaagacaataggagcctgatacaatttgtcattcttgcacagtgacagttaatcgaaaattattaattcattatcaaagtatcatttccatgacaaagacgagaggaaaacatgcagactgtgtccagatttcttccagatatctaccagcaaaatatcaccaaaattaaacaatgaaagatagacgaaaagagaaaaaagccagagggagaggagagagaaagagagagaatgattatgttttacataaaaaacagtaaattgaattccttacttgatttttataggtattgttcatctagtttgtagtaaagggaacatagctatagacaggaaactgtcattgttgagaatttggagcttaaaagtattcagtaattttaaatgcaggacatgtattttcgaaaccattcataattaagaaattaaaaagattttagtaacatttgtgaaaaacagaaagaaaattatttaaaagtctttgctcttcagagatagtgcctggctcttgtagattcctttcacctctacactatgctaaaacctggctttgtctaaaaacaactttagctatagatggtcactttctgtaaaggcttttctttgttattgtcatagcattacagaatattgatgacttcaatatcacctacacagaaaaactgtatatgacttttggaaaaaaaatgagagatttagggcaagcaaagttatgctgttgtagattcaaaaaaaaaattgacattttaggttaagtatattttcaatgtttcaattataactgtaaatctataaatgctggtagaggtaacctcattagaaataactccttattctaagagcaaagagaaacctgaaatgctaaaatggatactcattcttaataggatcaagaaacaccaaatacccgtcaaatatccgaagattatattcaatgactctgaacaaggaaaaaagcaaaaaattaagtgaaacatgaatgaaagaaattacagaaatctaaacaaaggtataatctatattaatggattgtaaaactcagtagcttaaggatgctaaaatctcctcatgtaatgtcaataaaaatttcatcaattttgaataaattgaagaattaagtctaaaacatatacaattcaaattacaaagtatatgcccataatttatgactttactgcttaattctaccagcatataaagaagaacacatcttaaacaaactattacaaaaaataataggaaacacatactattttggtttttgatgctagcataaccctgataacaaacctgacaaaaatacatcaaagaataaaaagtacacatgaatatcctcattaacacagatacaaaaatacttaatgaatttatttagaaaataaatcaaatccagcaatctataaaataatgcattatgaccaagttggttttaccaagaatgcatggttggtttaatgtataaaatacataaaatcttattaacagagtgagggaaaaaaacataactcaaacaacacagaaaattcatgtatcaaaagtaaacgtgttcaagataaaaaatattaagcaaattaggaatagaaagtaacttcctcaatctgataagcaaaatatttacattaaagaaaacagaactaaattaaagctgacgggaagaagaaggcaagattatacaatcttataatttctattcatcatggtagttggaattcctagccactgaaataaagcaaggatcaatgacatatattaacaacaaagaagaactatgctcctatttagaaacagcatgatcgtttatgtataaaatattaaatacagataggccaccttttattgctttctttattagtttattgaactccataaatacggcatttttttaaaagtttgaagatttgtggcagtccttcaaataaatagcaaatttattagccattttttccatgtgctcacatcatgtctgtgtgtcacagtttggtaattcatgcaatatttcaaattttttcattgttatatctgttatgattatctgtaatcagtggtttttactattaattactattataattattttgggatgccgcaaaccattcccacattacattgaacttaattcatgaaatgttttgtgtgttctgattgctccacctactggccattctcccatctttctccatctcttcaggcctctgtattccttaagacacaacaatattaaaattagaccaattaataaccctacaatggcttctaagggttcaagtgaaagagttgcacatctctcaccttaaatcaaaaactagaaattattgagcttaatgaggaaggcatgttgtaaccaagataggctgaacgctagacatcgtgcatccaacagttagccaagctatgaattcaaagaaaaacttcttaagggaaactaaaagtgctattctagtgaatgcacaaatgataagaaagccaaaaaaccttattggtgataagtagaaagtttgagtgatctgaatagaagatcaaacaagacacaatattttcttaagccaaaacaaaatccagagcaaggacctagctctctacatagctatgaaggctgagagaggtgaggaagccacagaagaaaaattggaatcttgtagatgttggttcataaggcttaaggaaataagccatctccataacacaaaagtacaaggtaaagcagcaaccacatgattacatcaatagatgcaggaaaggctttcgataaaattcaacacacattcatgtcaaaaactctcaaaaaagttaggtattgaaggaatagaccttgaactaataagagccatatatgaaaaactcacagccaacattatactgaattggcaaaagctggagtatttcccttgaaaaccggcacaggacaaagataccccctatcaccactcctattcaacatagtattggaagttctggccagagcactcaggcaagggaaagaaaaaggggcatccaaataggaagagaggaagtcaaactacccctgctagcacaagacatgaacttatattcagaaaccctcaaaatctaggcccataagatccttaaattgataaacaacttcagcaagtctcaggatacaaaatcaacgtacaaaaatcactagcactcctggacaccaataacattcaaggatccaaatcaggaaatcaatcccattcataactgccacacactcacacacacacacacaaacacacacacaaacacacacacacctagaaatataattaaacaggaaggtgaaagatctctaccaaagaactacaaaacactacttaaagaaatcagagatgatacaaacaaatggaaaacattccatgctagtgaatagaaagtattatttttgctaaaatacctataatatccaaagtaattcatagattcaatgttatttctattaaactaccaatgacattcttcacagaactagaaaaggctattttaatattcatattataaatattcatatttattaatgataaaatattctattttaatattaatattcaggccccaaaaaaggacctgaatagccaaggcattcctaagcaaaaaatacagagctggaagcatctggctacccaacttcaaattatactacagggctacagtaaccaaaacagcatggtactggtacaaaaacatgcacatagaccaatggaatagaacagagaacccagaaacaaggtcacatgcctccaactatctgatctttgacaaagctgacaaaaacaatcaatggggaaaggactccctatttagtaaatgtgtagggagaactgacaagccatatgcagaagattaaaactagaccccttccttataccatatacaaaaatgaactcaagatgcattaaagacttaaatgtaaaaccaaaaactataaaaacccatttctctggacacaggaacaggcaaagatggcatgaccaagatgccaaaagcaactgcaacaaaagtagaatttgacaaacgggatctaattaagctaaacaggttctgtacaacaaaagaaaccatcaacagagtgaacagacaaacctacagaatgggagaaaattcttacaaactatgcatttgacaaaggtctaatattcagcaactaaaaggaatttaagcaaatttttaaggaaaaaaaccattaaaaagtgggcaaaggacatgaatagacacttttcaaaacaaaacatacatatgagcaacaagcgtatggaaaaaaatctcaacatccctaatcattagagaaatccaagtcaaaaccacaataagataccatctcgcaccagtcaaaatggctattattacaattaaaaaagtcaaaaaatagcagatgccagtgaggttgcagaaaaaaagcaatgcttatacactgctggtgggagtggaaattagtccaaccactgtggaagagagtgtggtgattcctcacggacctgagaacagaaataccatccgaccctgcaatcccattactgagtttatacctgagggaataaaaattgctctatcacaaagatacatgcatgtaaatgttcattgtgtcactattcacagtagcaaagacatggaatcaacttaaatgcccatcaatggttgaatggataaagaaaatgtggtacataaaccaaacttggaatgcggtacattccatgtgtaccacatggaatactatgcagccatataaaggatgagatcatgtcttttgcacgaacatggatagagctggaggtagttatccttggcaaacaaatgcaggaacagaaaaccaaatactgtatgttctcacttataagtgggatattaatgatgataacatgtggacacatagaggggaacaaaacacactgaggcctattgaagggtggagggtgggaggagggtgaggatcaggaagaataactagtaggtactaggcttaatgtctgagtgatgaaataatctgtacaaccaacccccatgacacaagtttacctacataacaaacatggacatgtactcctgaacataaaataaaagttaaattaaaaaaaaaaactaaaaattacatgcaatatttgtagtggtacaaatatatttatgtaactgtaaaaaagagagatgtataagaatatatacaaaatgtaataatggttacttccaaacaatacatgaaggctagaagttgaggtgttttttttttaatctgtaaggttttaattcttttaaaaaagaaaaagtattagtgtattgtttcacaatttttaaaaaatgtacaagaatgttcttatttctaccatattggtctgcttctttgtattttttctggcccaacccaaatcagtcttttcaaagtttatctacattggttagagatggagccttatagaacattgaattaaaggcagacatccaaacagttattgtatggaacagatctgcgtactaaatatgaatgtgtgtattgtgtgtgggcttatagtattaacaatacacattatgtctttttgttttttatgtgtattgtctgtgtacctgtgaatttcagtattcgtgagctatgcattaatgtataccacagttaaataaatgaattagttgcagaaaaaggaagatcaaagttggaaggctttatctatctgattttaagatgtactaaaaagccacagaaataaataaataaatgaataaataaataaataaatggactagaataggtaggaattagtcaactttatccttaagggccagatattaaatatttcaggccttgtgggacacatatgaggtgtctgtcactttttgcccctcttcctcctcctttctcctcttctgcctctttttctacctcttattttgacaatactttaaagatgccaaaattgttattagattgtgagccacataaaaacagcccaggagtcataatttggcaatttttggaacaaaggcaaaaaacagaaccgcagtagcctttccactaacacttcacaggaatttgatggatcaggaaaaacctttgtaacacatgatgctaggacaactgggtatccatatgaaaaacaaaagttaaccttaacccctacctcctaacaaacacgaaattaatcaaagaaggagcaaacgtaagagtaaaaggccaaactacaaagtatttagaagaaaacaggggattatcttcataacctgctatgaaacaacacagtaagaaacaaccataaaagacaactttaatatattagagtttcttaaaaatttaaaacttttattcttcaaaagatacctctacattaattataaactggaagaaaaatatttgcagaacttgtgtctaacaaacacttgtatgccaaatacacaaaactctatgacaactcaataacataaggacaaattttaaagtggacaaaacacttgaaagaaacttcctgaaggaatgtgcatgaataagtaataattacatgaagtgctcaatatccactgataaaaatttcttaaataggcaaaatgaatctatagtgatagaaaacaaatcagtggttgcttggggaaaaggatggagaaaattgattggaaaagagtacctgggaactctttagagtatttaaatgttttataccttgtcagagtggcagttacatgtgtgtatatacttttcaaagctgtatagttaacgttggtatatttcattgatttcaatgtaggtaaatctaacctcaaatatccataaatataataatcatatggaaggtcacttccaaattggtggaggaatagttgaaaaaatagtctaatattatcattttttaatctggataatggctccaggatagtttgttatggcattcaatttattctgtatatgactgaaattttaaaactcttaagctaaaaagcatttgtcacatgtttttgctgaaatattggttccttgtaatttctcacttaattcaagcagacatctaaaggtgatttattttccacccagaaaactaagagtacaaggattcacttgtgtccacaagggaatcaagtgatccaggagaacgtgcttcactattttttgcttttcctgacccttaaacagcttctaattcctcttgctaaaaaaggaaaagggatggctgggcgtggtggctcccacctataatcccagcactttgggaggataaggcgggtggatcacttgaggtcaggagttccagaccagcctggccaatatggcaatacctcgtctctactaaaaatatacaaattagtcggggtggtggctcactctcgtaatcccagctactagggtggctgaggcatgagaatcacttgaacccgggaggtggaggttgcagtgagtggagatcatgtccctgaactccagcctgggtgacagaatgagactctgtcaaaaaaaaaaaaaaaaaaggaaaaggaagcaaagaaaatagaaaagttacttcctctaaggtaaccctaggagttttcttcactatatttaggaacataattagctgtttttttaaaaaaaaaaaattgatgcatgcttgctttctctctatatagaactatattttgcagaagtgttaatgatgttttgaaggtgacaatgttatcccacaacatataatttcctctcttaaaagtactatctttgaaatgggctcacataatatgtaaatatatggggataaatgtatagtctcattacaaactataagaattattccatatatgtaaaatatgaactactataattgggtgtaaaaccaaggttgtaaatttaattttaataatttgcctataatatttatcagtccaaagtgatttgaaaagaaaatctattaacatgttttacaatattcttacattatttctatcattatgtatgagacaaatcatgatgtgacagcatgtgacaagtgtagcagatgctgtggatcagcttacacaaaacttattccaactacctcctttgcacatgtttctgaaccgcataactgagaagctaaaattatacttaaaggattcaattgcagctatgattctatgtatgattggggttactctgacaagattattttttatataagacattgttcagaatgtactatgaaggggacaggtgttacactttttgcagttacaaatcggggtggaagtgctgtggttctggtgttagctgtggttctgtagttggcaatgttggcatcagctttctggaaccaggcatctggatcatgggaaaggcagcatttcctaggtgatatggcttggctatgtccccactaaaatctcatctcaaattgtagctcccataattccctcatgttgtgagagggacccagtgggagataattgaatcatgggggcagtttctcccacagtattctcatggtagtgaataagtctcatgagctctgatggttttataaggggaaacccctttcacctggctctcattgccttgtctgccaccatgtgagacatgtattttgcgttttgccatgattgtaaggcctccccagccaggtggacctgtgagcccattaaacttctttcttttgtaaatcgtccagtctcaggtatgtctttgtcagcagtgtgaaaatggccaaatatactatagcagatcagttatgttgtggttttgcatctcattcctggcaggtcaaaacagaatctatttcttccaccctttcaatcatatgtgaactatttatgccacttaataagtcccttcagcttgaagaagctagggtatattgttttttgtaactaatatccctaactgatattgcagacttcacataaaaacatcctgttgaagatgaggaactagaagattctttccccagggacatatgatattaaaaaaaagctacaggtagctggtctttactgtgtacattatcaacctcttacccaaaatactatagtggtattcactgctataactatttacagtatattcagctgttttcttacagtcttagcaaaaccatcttctcatctgttatgacttgcatgtaccccccaaattttgtgtattggaaactaaatgcccaaactcatatgttgatgatatttggaggtggggcctttggaggaggtaatcaagattagataaggtctttagagttagtcccccatgttgagactggtggctttagaagaaaagaaagatgtgagctgacttgggtgctcttgccctctcactatgtgctgccctctcaccatgtatgatacagcaataaaaccctcaccagatgccgatgccatactcttggacttccaagcctccagaaccataagaaatattttttttctttattaattacccagtccacagtattctgttacagcaacagaaaagcaattaagacaccatctcacacctggttttgtctataccttgtgagaacctcacaactgtaattcttctgtataacacatcaattaaaatagaatctagacaaaatgtcagtattaaaacaatcaggaaaacagggctgggttgataataaggccacaatatttgctgcctctgagaatttgggaagggatggatttgaagaagaagttttctgcttgcatatctagttcttattcatatgcacacaagcctaaggggaaaaattcaggctcatcgtccttttgattgcttaaaagcatgtagcagcttccaatttacctttcctaaagaacaagtcaggctgcagaaagatcatggttttgaattcagccatggcttttaatttatttcttttagactttgcttgactggaaagctctggaagctggggttcaaaggcaattgtgtttaaagaaaatacttagttgggaatattctaacagcaactgatgggtttaataattcttgtagatactatataaaattttgaatagctagtatttaggtaaataattgcaaagaaacactcttcttttggaataaattacatggagtcctgttgctgtctacttgcaaataatctcattcacgttttgatgaaactcacaatgtacacattttctgaggaaaatggaaacaggaggcctcctgaagatacaataagatgattatatttattttcaaacctttaaggaaagctcctgcaagttaggctaaaatgtaaattttagtgaggattctattagaagttccaaggcaacagttactttcaaaaatgatagacccactgtgagcaaaagagagaagataaggactctgaccgagctggcattgttgaataaggggccctgatttgctgctcaatagctgactctgcaggtttcaattataggaatagctggaataatactgctctacaatattactggtagaatttgcaaagaattgatatatagagtttaagtatgtgtctctgtatgtgtgtttgtgtgtgtgcatgtgcagcacacagacatgcattatgaaaagggagttattcaagtaaaaagcacctgccgctaccataacaggtatgatctaggctgacccatgatgcttgggtgggtggtgggacattaagaatagaacatttaactacaggcatgcttatattccagttatatataggcccactgcacctctaaattgttgcactagagtctttattttggctggatttaaaggccacttcccaaaatttgtgcagaatctttgtagttacataattaaaaattgaaagaatttaaaaaatgacaactgtagtctcactgactttttaaaataaaattaaaagaccagtataactgtaagcccttgttcagaaaaatgttaattccttacgatctagactcagaatgtggggtttgaatcacaattctatcagtcactagcaatgtgatcctgagaagattacttagtctctctgtcccacagtgcctggtttataaactgggaataatatttattttaaaggattaaatgataagctacagatatgtctttttgcagtgtgactagaaaatagtaaacacgtaataagtgctggttgctgctaccataatgatcagtgtatttctatattgtttatttctggatatcagtacttttgatataagactagacagtgaattcctcaattacaggggctatgtctccagtaaacaagaaaatgcctgtcacacagcactcacattaaaagcttagttgaattgatacaacttgtcagagagactaatactgagggcacgatggccttatcatcagcatatcctcattactttgactagattatttaatttattctcttttactccttcttacttctacttcagttaaaggcaactggggagtatagaaatttgaatatttagctttttggggctatgtccgtagtttattcactacttagggtgacctgtgcacatgctaaatgattaaagaaggcaaattctaggatggtaagtagagaaatgtgcattatagattgaaggcatgtgatgggcaaaagagcctgaggaactgacaatagatggaggaactgacaatagatggaggtcagtaaacaaactgaaaaacaaatgtaagggaaaacatctgataaaattaaaaaataaatatcttatttaaaaatatacatcttcttaaatatatatttatattttaatatatatttaaaattatatatatgttaagtaaaacagaagttactaaaggaacttccacctttgtatgtttgcttgaatattacatctttaaaatagcttttgcaagagatgtttcacaaaagaagttgatcttacaggtattgtagttttctctaaaatgcctaaagattaatactccgcaaagtatttcagtcaatttcaagttggggaatttggatgaccaagacatctctgttctctcaattcctcagaggacatacaccgaagttagttgtgatagtagttattatgcctattaagggtgagatccttccaggttctaacttctattgtcctcaaacacagcactctgaaattctagcattaatgactgttactggctacttacaacaagcaacttcacttggatctaccatccagtttccaagctaccaacattaccttgttgcattgtttttgttgctgttgtttctttttttgcgacagagtctcgctctgtagccagggtggagggcagtggcgtgaccccggctcactgcaatctccgcttccctggttcaagggattctcctgcctcagcctcctgagtagctgggattaaaggcatgagccaccacgcctggccattacattgtttatgtacaagctagatgataaggaccaggcaacacttgtgctatcatattgcatgtgtgcaaggctacacagcctgttgatgcacacaggagagactaagaaaggcagacctggccatggcctacctacttgcttactgaactttgtattccacgaaagaagggagcatgaacatatgtttagcaggaaacttaaagtctagcaaatttcctggcccatagtattgtattctagttgtttgttaaataaatgaatggtctgtatacaatatagcatctctctctctctcaacgaatagcaaaattttttaatagacaagtaacgaagggccttccaatttaatgataataatacatggttggctatctattacagctctttgtgattgttggtttgtgaatctgaaggcactatttctcaaagtgaagtccaggaaccacttgatcaaaggtcatctgagttgctgtttaaaatttcagattcctggggtcacttcctgcatctccacctctgacaacaatattcaggaaactatataatcaacagtctaccaaggtgattttatgtacactactatttcaaaaccttagtgctagctcattctctaggtgaacaaatgaaacaagtataaatatgataaaaagtaagagatctattgatcatatttctacatgaagagattttctatttcagaaattgaagtaatcagctttttaaaaaagcctttttgggaatcaatgtaagtttcataattcagccagctgaccaataaatattaaaaaatgtttaactttcttatatttcatcatttaaaaaaatgagaaattattccatagtctatgtctgtctgtatacattattcagctcccacttataagtgagaacatgcggtattagactttctgtttctgagttatttcacatacgataatggcctacaattgcaataatagacattggagacttagaagaatgggagggtgggaggagggtactggatgagagactgcttaatgggtacaatgtacactatttgggtgatgattacactggacatttggtaatcatcacccaaatcattacccaaatagtgtacgttgtacccataaagcaatctctcagcctctcactactacacaatatatacatatgacaaaacaacacttgtaccccttaaatttacacaaataaaacactacaaaagaaaattgaagaatgatcctatttataatagtgacatgaactaatttgaaaccatgtactcataggagatataagaagaaacaataacatgtcctagaaggccaaaaactgaagacttgaatcaaatgaaagacatatcattatcttgaatgagaagattgaatattacaaacgtgttcatttactcgaatctacaaacttaacattaatctacaaaattaacataattccaatcaaacatttttggagggttttggacctggcatgtttacatgacggaataaatgtgaataatcaccaggtaactctataaaaagaaagttattaagacagagttctcctataatgaatgacaaacataatattgggctacagaacagaagtaggtatacaaatatggaagaatatattacatttattttgaaattaaatttttgataaagttagaattttcagtcagtgaatacttgatactttatttaaaacacagttgtcaactttttactatacgtcaggctatatgaaaatattaactgatttaagtctctttacaatcttacaaagacttacaagttaaaaattttaaatttataattttagatacatgccattatcagcattatataacacatgagaaaacgaagcccagagagtttatgtcacttgctgaaagcaacagcaatagtaagtagtagagccaggttgtctgaatgttctttaataccatgatataagatttaggctggcacttgaagaaaaagaattaaaatcatactagagttcttattttaaaagcagattaaaaatagaattttatttcatttaaatgaacaacataaaaccaggaacgtattagaaaaaaaattggtaagtatttgcatcaattgatgtggtaaaacgtgaaatgtgatatcaagttacataaaggaaaaatattcaaccagaaataccatttcacatagaaatgtttaaaatgtttcatatttcacatagaaatatttaaaatctatacctctaaagtatttatgaaaaaattcaaaatatgataagaaagtacattgtggtatatgtttaaattgtggtaatatgtttgtttttttcctattgtcacagcttaattattgataaggtctttatccacaaaaggggttcaaactgtgcaatacatttttgtcacactaattacaaaggttagtattactatgaaacaaaagtttcaagatcaattaaaaaatatggatgttccaagaaaaattgaagaaatttttaaaaatagtcaatagtttaaaaaaatcagacagagaaggaggtaataaaaagagagaagtactaaagtaagtaacaagagaagaaaaaaaggtagaaagaagaaaataaatattccatgttgtcaagaaggcaggagattctcaaattttagcaatgggattatttgaaagtaatttagaaaatagttaagtatttatgcaaaattattttaaataatattcacagatgtgatatatgtgaaaagaaaatagttgaacataatcaaaaaaattcaaagattataaaatgtattattacaatctatataccacatattatattggccactagggatgatataaaggtaaatttagtgtgacagacaaacaatgaaaatattagaaatggtagaaaggtgactttattgacataaacaaaaatgacaaaatgagaaataaaatgggaaatgttgtatgatctcgattgggtaaaagacaatttatctacatgtgattttcccatacaaatcatttgatccaaatggtatttccaatgacaactgaaaatataaagtgaatttaaggaggtgaataggtataatattttttaaaaaatcgacttttttattttttaaagacaggttctcacttggatgcccaggctggagtgcagtagtgtgatcacagctcactacagcattgacctccctggcgcaggtgattctcccacctcagcctccagagtagctgggactacaggcacatgccaccatgccaagctaaatatatatatacacataaaatttttaaaatttttactttaagttctgggatacatgtgcaaaacgtgcaggtttgttacagaagtatacgtgtgccatggtggtttgctgcacctattgacccgtcctttaagttgcctctcctagctccccaccccccaaaaggccctgatgtgtgttgttcccatccctgtgtccacgtgttctcattgttcaacccccacttatgagtgagaacatgcagtgtttggttttctgttcctgtgttagtttgttgggcatgatatcttcgagcttcatccatgtccctgcaaaggacatgatctcattcttttttatggctgtgtagtattccttggtgtatatgtaccacattttcattagccagtctatcactgatagacatttgggtttgttccatgactttgctattgtaaatagtgctgcaataaacatacatgtgcatttgtctttatagtagaatgatttatattcctttgggtatatacctagtaatgatattgttgggtcaaatggtatttctggttctagatccttgatgaatcaccatactgtcttccacaatggctgaactaatttacattcctagcagcagtgtaaaagtgtgcctatttctctacagtctcacaggcacctattgtttctgactttttaatagtcgctattctgactggcatgagatggtatctcactgtggtcttgatttgcacttctctaatgatccctgatgttgagcattttttcatgtttgttggccatgtagatgtcatcttttgagaagtgtctgttcatatcctttgcccactttttgatggggttgtttttttcttgtaaatttgtttaagctccttgtgacttctgcatgttaagcctttggcagatgggagactgcaaaaattttctcccattaatatgtttttgtagagatggggtttcaccatgtttcccaggctggtctggaattcctgggctcaagtgatccacgcaccttagtctcccaaggtgctgggattacagatgtgagctacctcatccagcaaccaaaattttttagtgttattcgccaatgctgctattaaagaattacatttcagtttacacttacgtcgatctactttaggaatttgtatactgatttgcatttatccaaattggaattttttttaaatactgggacttttctctcacagaagaggtctgagatcttagtctagcataaatgacgaaatggggagtgatagaatagaaaaccaagagaaaagaagttatttaagagattaaaagaaataattatctgaccctttcacatagtcttgggtgctgaattgcaaattctgctgtttctgctgtgacagaataataataattttcttttcaatgatatagagatatttaacaatgtttactatttcatagcactagcaaaacaggaaaaaatgcttgatgtaataaaattatttcacccgattattaatcaaatatagaatgggagaatgtatattaacattatttgtcttttgaaataatattatcacaaatattaacaaactttggatagctttttgatatcttaattcctgataattgctactaattcatttctaagtaacaagtacaatataaattccagatttaaattaaaaatatttgatcattcacaatgctatgactgtattacatttcaatattttacctcgtgttattttctccataaatagagtggttatggttcacaggtacacatgctatttgtttatttatttcattttgtagagagggtcttattattttgcccaggctaaaatgcagtagctattcaaaggtgcaataaagtgcgttacagcttcaaactactggcccgaaaagatctggtttagcattctgagtagctggaattgcaggtgcccagccactgtgcccagccacaattgccactgtgcccagccacagtcagctttttcaagaactgtttaagataacaggttagggaaaatcaggataatattttgaggggaaagaaggtaaaatcaattaagacagggtgcacagagtacttgaatggtacagctgatgtttcatcctttgtactaaatggtgtgtatatgggaattggttatattattttgactgtttgtagtcatattatgtacatatgtgtatacataatttaaaaataaaagacaaaagtaatataagctaaaattatagatattaatattaattttatttaaatataacaaagatttgccagtattcaaatgtctgcaattatccttaaaatgcacagaacctatgtttaggtatagtatcactgttcatccagccttcattcactctaatctactcttatctaaaatttgtagtgtaagtaaaattacattcggtatgacagaagacaaattacagtattagaacattatggaaaattggcataacattgtacaatcacccataactttattatttatcattttgtaacttttttattatattagtcaaaaaatctaactgtacttaatagctaatacatatattatttgattttttaaagactattattaaaataataataatttgggggtgagaaggcctattgaaaaatgaccaacatataaatcataaataagtttgatgcaacaaatatttgtaagtcttataggtaaaaatataaaaatttattctaaacaaagctaaaagacaataatatgcattgggaaatatttgcaacattcacttcaagggttgatgtccgtagagaatttttacaaattaataaacatttaaaaagttgaggagtggcaatagctatgagagataatttacaaacacataaaaaccaatattaaaactgtttaatctgtaagtacatcaataaaaattttattatagtagttattttatctattaaattagaaaaggtcaatacaactgataatctcccaagggaatatatgggagaagcgctttctcatacacttataatatattgttagaatgccattaaataaacatttggcaaaaatctatatcctctgtcaaaacaatttaagttctagatctctagaatccacatatacatatacatatatacatacacacacacacacacattcacacctatatatcaacaactcaaatccaactccaattctttcataagcagtattttgtccaacaaacaaatttatctaaaattcttcttggcttttctccattatagagccagcaattttgtgtagctctacctctaattccttcatttgcatttatttctgctttcaagcccttatatgaggcaaatgggattaatttatttcattatcttaactagattcattgctttaatttgtcaaactctgattgatttgctcaactcaatcttgtgtgttcaagaacttaatgtggatttctgttccacctcatgaaagtcttttccaaaaacttgctaaattcttgactcaagacattccagttagtaatgcatttctctgctcaaatacaatagaagtgtgctctaataaatactcttcaacaatgtgcagttatttctccccaactatcaattccccttaaagcagaattttactaaaaatggctttatccttctgggaataatcagtaaaatggcaattggagggtgaatttaaaatatactaaaagcagatggcagaacatgagtgcagatttttactacaaagcttaggaagaacaaaaggaacctgaatagagaaaatgcagaaaagctctccctgggctattaggatgtagagagcagaagtatgtttaggagcttcaaagagtctgtctctttgcaactgtttatcttaggactttaaggaaataaaaggtgcaagtgaaccactctggattataaaatagaatttcacacagaaaaatcaactcagttaatatgcatgttgcttacatggaaatgttgagaaatttttagcaaatagaaagtggtagatggtaggtatatataaaataattgcagaaaaaatgtgaaatgaagatgtatggtattacttttatatttaaattgttaatatgttgcccataatgctttatttcaaagaatgaaaaaccggaaaaatagttccttcctaacttcccctgcagccttgtcttgtggagcttgtattttacttcatgagaaatgccaaagatatgtcatttaagctgaaacctccagcagaattagccagaatatttgggaaaaagatgtttccagaaaaagagctagtataaatgtccttaagcaagacggagctcatgatgattgaggaacaacaacaacaaaaagattatttcacccaagaaaagtgaattgggagtacagatataaatgatgagatctgaatacgattcatggagcaggtcaaactaggatgtttgggtgtggtctaaatgaatgggtggcatgagttgttttaaggagaggagtgacatgatttgacaagttcttaagagatccctttgattactctggggagaatagaacataaagtagcagaaatgaaagcaaaggggagatagtgggaaataattgcacatttataagcaagagatgatgttggctgggactctgattatagcaacagatgaagaaaaaaggaaatactgagaatagttgattggatttgctgacattctcaacataaatggaaatcagtatttttttctaataaatatgatatgcataaatatttttaaatatttaattcttttaccaccagtggggcatgagtagacttcaggaaacatgccagtacagaaccatataaatgtgatcattggtagagataggctttaataggcatttgaatgtctccctcaacctggaataccacgaaaaaagcttttcgcttcgcatgttgcattattatcataccctatagctttctaccattttcagttacttaatattatgttttgcctcaataaataatagtactttctcttattgtattgtattgtatttgcagcaattattagtgaagttttacgtttcaatattacatctaaaacaaaacaaaattgtcccatactattttccattaaaacacgagatcactatgacaaaaaaagctaaaatgtcatgaaatgacttaaattggatgagagtatatgaaatacattaagaaataatctctgactctgtagtttttttatttgtaggttttactagaacatgaaatcaatatgtgaatcctggctggagtttgcatctaaatgtaataaaataaaatgaagtttaatattatcattgaaccattagtgtacattagtgagctggactatataaaataaactttattatatttagcatttgatttttatttatgtatattataaaatgaatatagtttatattataataaaaataaaagaagtagtatgttaactaattcgtataagatgcctacaaactacatacctgcctaaatttttgacctgtgaaacttcaatggtttgtgttagggcctacatttatatatgtacatgtgtagtgtatatatacatatatatatatatatatatatacacacacacacacacactatatatatttttgtgttatatatacacactatatacacactatatacacactatataggtttgtgttagggcctacatttatataggtacatgtgtagtgtgtgtatatatatatatatatatatacacacacactatatatatatatatacacacactatatatatatatacacacacacactatatatatatatacactatatatatatatacactatatatatatatataaaaatatatatatatatatttagggagggcattgttaatcctttaattttaaaaattttaactttgcagacaaagttgattatacctgtggcagaacaatgcatacagcaataaataaataaataacttttattttctgtggagctcccagaattatgaattattggatagattgagatttgccgaggtcattttcttagagttgcaagagcataggagaaagtcaagggaaataataagcagcacttgatttcctttaccacagaggatgggattctaaaaccaaattatctgactataaatcaagacctatcttttacaggctatgtgattgtggatgttacctcctctatgcttcaatttcctcatctgtaaaatggaattatagcctaccctattttgtagtatagtgaggataaattgagtgaatgtatgtagttcctagaatagagcatgacacatgataagtggtcaataaaatattgtttactactagttatgtgacagtcacttcacacatagtaatgatttaataaaggagcaagaagaatgtagagcacagcttctcaacatcggcactacgacattttgggtcagacaattatttaatgcagagggggccataggatgtttagcagtgtctctggccagtagtgtacctcctcctctccaagttttgacaattgcaaaggcttccagacattgacaaatattccctgaaaagtaaaattgtcccggcttgagaatcacaaatataaagtaaccactcaaagattacattactaattttgattgaatttgaccagcattatgaaatcaacataagcttaagtttctacacttgattttgtcattgtcagttagggcagcagagaactccagttctgaaaattctgagcatgtgctaatagcctataatataatcaaaactttcattttgaattgtatttcttaaaaaatagaaaacgtattaagcagcaacatggaataattaaccacaaaaatatggaacataaatctcatttgcctaatatctcttttgaagtcctgtttcactgtataagtattatgtgttttgtttcacagctagatacagccagttttttctctaagcctaaggttactcctcaaatttatggtggctttttgctcttctaagtttctataaaacttcagcaacctgcagcaggttgaaatttattgatatttagttattcaccaggccatatttacagtcagggattgacttacccaaaccagatgctccccctgccagcagatcactaggagatattgcaataatttccctggttactaaattagcaaaagattctcagggagagagaagggcaagatggcacagtttaatacttactattattcttttattctttaccatcattccttttgaatggattaagaatctgacatacacataacttactaacgaaagggagttaggtgagagggaagacatatttgtctaagaaaagtcttagagaaatattttgaaaagagatagaaagaagagttggattggagtgggtgggtagggaatcacagtaaggagatggatcattcacaatttctttagacatggtgaggcagccacaggaagtctgaacttgttgaaaccctaatccgaagccaaaaaaagtgctcaataaggtcatactttgatcacctctgcctaaagcagttattcacaccctacttttgggagaggaaacatctacaaacctttgttctctttgtttgttagcagagggatgacatgaatttgggaaaaaagtttgagagacagaatgagatttagctcaaacaaatgattgactcatgctgggttgaaaatgtgctctagccgtatgtagaaagctgaaactggatcccttccttacaccttatacaaaaattaattcaagatggattaaagacttaaatgttagacctaaaatcataaaaaccctagaagaaaacctaggcaataccattcaggacataggcatgggcaaggacttcatgtctaaagcaccaaaagcaatggcaacaaaagccaaaattgacaaatgggatctaattaaactacagagcttctgcacagcaaaagaaactaccatcagagtgaacaggcaacctacagaatgggagaaaagtttgcaatctacttatctgacaaagggctaatatccagaatctacgaagaactcaaacaaatttacaagaaaaaaacaaacccatcaaaaagtgggtgaaggatatgaacagacacttctcaaaagaagacatttatgcagtcaacagacacatgaaaaaatgctatcatcactggccatcagagaaatgcaactcaaaaccacaatgagataccttcgcataccagttagaatggcgatcattaaaaagtcaggaaacaacaggtgctggagaggatatggagaaataggaacacttttacactgttggtgggactgtaaactagttcaaccattgtggaagacagtgtggccattcctcagggatctagaactagaaataccatttgacccagctgtcccattactgggtatacacccaaaggattataaaacatgctgctataaagacacatgcacacatatgttcactgtggcattattcacaatagcaaagacttggaaccaacccacatgtccatcaatgatagaatggattaagaaactgtggcatatatacaccatggaatactatgcagccataaaaaatgatgagttcatgtcctttgtagggacatggatgaagctggtaaccatcattctgagcaaactatcacaaggactaaaaaccaaacaccacatgttctcactcataggtgggaattgaacaatgagaacacttggacacaggaaggggaacatcacacactggggcccgtcaagcggtggggggaggggggagggatagcattaggagatatacctaatgtaaatgatgagttaatgggtgaagcacaccaacatggcacatgtatatatatgtaacaaaccggcacgttgtgcacatgtaccctagaacttaaagtataataaaaaaaaaaaaaaaagaaaagaaaatgtgctttttcaacaggtaggttgaaaatgtgcttcagcatttaggataccagatgtaaacatccatgcatagaattagaaaggttcaactttcatggctgctatggtttgaatgctccctccaaaacttatgttgaaatttaatccaaaataggataatattgagaagtggactttttaaagaggggattggatcatgaaagttcctccctcatgagtggattaatccattcgtgagtggattaatgggttatcttgggaaggaaactggtggatatataagaaggggaagatagacctgagctagcatgttagcattctcagccctctcgccatatgataccctgtgctaccttgggactcttctgagagtccccacaagcaagaaggctctcaaaagatatgccccatcgaccttggatttccaagcctccttagctgtagaaaataaattcagttctgtataaattacttagctttggatatactgctataagtaacataaaatggactaagacaatggtcttatcctgaactttgtaaactagaattggctgtttagcttcagcatgtatttttttatagattcaaaataatttcattttgaattgcataatgaaggaatgtcataaggttttcagcatatagaggctctaaatatcagtctggcattgtgataaagcagagagtttaaaccaagtcctatttgtgacacatgacctttctttctggttacagctcagtaacataggaatggatacttaactcaaggataagcatataatacatgaggctttttttcaaaattttgatttagaaaatgaagtattctagtatgttaattatagacatttcaactgagaagtctaatagcattggaccagaatagtcacagcagtccaaagccatggataaacttaagttaaaggcaacaaataataagagccttccacattaatctctatcagagaagatgataaacaggtgaatggggactagaaaccatgcagctttagaactagacataaaacaaacagctatctaatgatttcctatttactatgagcccaagatattcttgtatcctctcagttaagctcctgttttactaaggaaatttaagtaagattctgtctcttgcaagaaaataacatctaagacatcttcgaatttaatgctgctttaattttgtttataccagtggtccccaacctctttggtaccagggattcattttgcggaatataatattttcatggacagggttggggggaaggtttcgggatgaaactgttccaccactcagatcatcaagcattacactctcataaggagcgtgcaacctagatcacttgcatgcacagttcacagtagagctggtgcttctatgataatcaaatgctgccagtgatctgacaggaggcagagcttaggagtaatgctcactcatccacctctcccatcctgctgtgtggcccagttcctaacaggccacggaacggtaccagtttgtggcctgggggttgggacccctgttttacactataacatttgcacacgtctctcatggcctgtctttcagatctgctgtttgtctcgactcaagtctagctacctgaaaattagattttttttttaaattgaatttgaatatcttaaagttgaatacacagtctccacttttacacggcccctactgtcttacatcatacctctctagccctggaagatagcaactttacattcacttttcctgttttagggctattattttatcttcagttatcaaaatctatctacttttaaatactttaacttgaaaatacatagtaagcaattatggattatttaaaatagttttcccatgagtataaaaaaaaaaagaatagcaaaagcaatatttgttgagtatttaaaagtgccaggcactgtgcaacatgctttgcttaagtaaatgtttgacaaaatagaaggtcttttaaaagttccatgttttaacgttaataaccatatcaagataaggttagatattctatcaaattaccatttttgtgaagataggccttttctgctatatagaatctcctcaaacctgagtgttcacattatggattatctagtatactccacagctatcaagtttgtttgtgtttctttctcaagtaagctatcttatttatcttatttctccttatttcttcagacttttcctctcatttctttctctttttctggttttttttttttttttttttttttttgagactgggtttcgctcttgttgcccaggctggagtacaatggcatgatctcggctcactgcaacctccgcctcctgggttcaattgattctcctgcctcagcttcttgcatagctgggattacaggcatgcaccatcacatccggctaactttgtatttttagtagagacggggtttctccttgttggtcacgcttgtattgaactcctgacctcaggtgatccgcccacctcagcctcccaaagtgctgggattacaggcgtgagccaccatgcctggcccctatcctctcatttctaaggaaatgacaaattaagtattttatgcaaatacagtgtagggtcatttaaaatattttttgtaatagatgtctctgtacataaatctatttaattttttcttttacaataaaaaggtattaatgtgttttagtttcaccaaaaatttcagtagaccaactgtgtaaaggtacacatttatatcaatttttttgacctagtaaaaactaaagagggaaagttattcaaatatttcagcataaattccctttccttgaaattgcaatcgtcatgtgtagctacaattgctcagtattactctgtagtatgagtagctacaattcctcagcataagaaacactgaagtagacaattgttaagaaaacaaagtcataacaaaacaacaaaaacaacaaaattaaaaactaggatatagaaacattaactaaatgttactcttgaagccgatataagagaaattattgtactagacactgtggttcatcatccagatcccatcttcatgggaacacatcaatcccacactcataggggatatcagcagctgaccattcacatctgtacctttcacgaaatattgccctaagacaaactaaaatgaactaacctgcccaaagcggtgtctcctttcggagagcatccattgactcatagctggctaatgtagtgatacaaagatgcaactgctttgcctcaatttgggacaactctgaaagatgcccagtaggactggctgaagactcagttcaaagttgtcaaataaagtaaaccatgcccagttgaatttacattgtttagtatgagtatgtcccatgaaatatttaggaattacataaactacacattattcatgatttatctgaaatttaaattcaaccaggcaacttgtaccttcacgtggtaaatctggcagcttttacttagttgcatctgcattgtaggtaagcatgtcggtatgcacagacctctcttccgtgcttccttacaagtgcgtcccagaaaacaagtattcatctcagagccaacgggcattgaggcattcgataatcatactcccaaaggtcaaggataaagaaaatatcccaaaagcagcaagagaacaaacaagcaaacacataacatacaatggagcttcagtatatctggcagcagattttcagtggaaaccttacagccaggagagggtggcatgacacatataaagtgctgaaggaaaaaataaaaaataaaaaacttttaccctacaatagtgtatccagtaaatatatcctttgagcatgaaagagaaataaagaccttcacagataaacaaaagctgaggaacttcatcaataccagacctatcaaagaaaaggttgttagtgagcaagaataaattatctgaggatacaaacctcactggtaatactaagcacacagaaaaacactgaacagtgtagcactgtaatggtgatttataaattactcttgacttaagtagaaagaataaatgataaatcaatccaaaataataactacaataacttttcaaaacatagacagtataataggacatcaagagaaagagcaataagttaaaaagcggggggagattttcaagtgtagaatttttattaggtttctttttggtgtttgtttgtttatgtaaccagtgtaaaattgtcatcagtctgaaataatggtttgtaagataatatttgcaagcattgtggtaacctcaaattgaaaaaattacagcagatacacaaaaaaaggaaaagaaagaaattaaatcctactgccaagaatatcacctccactattgtaagaaaggaagaaggaagtgaagaccacaaaatcatcagaaaacaaacagcaaaatggcaagagtaagtccacacttatcaatgataacttgtaatgtaaatggactaaatgcttcaatcataagacacagaatggctatggctgaatggatttaaaaaaaaagacaaattatctgttggctataagaaacatttctcctataaagacacacatcgactgaaagtaaaggcacggaaaaatatattctatgccaataaaaaccaacgaaagagcaggagtatctatactcatataagacaaaatggatttctcgacaaaaactgtaagaagagaaaaagaaggtaattatataatgataaaagaagccaattcagcaagaggataaaatgattgtaaatatatgtgtacccaatactggaacacccagatataccaagcaaatattattagcgataaagagagatatagaccccaatacaacaatagttggagacttcaacaccctactttctgcattggacagatctaagacagaaaatcaggaaagagacattagacataatctgcactatggacaacaaggatctaatagatatttacagaacatttcattcaatagctgcaaaatacactttttccttcttctcctttttttttttttttttttttttaaagacagagcctggctctctcacccaggctggagtgcaactgtgtgatctcggctcactgcagcctccaccttctgggttcaagtgattctcctgcctcaaccttctgcttagctgggattacaggcatgtgccaccatgcccaactaatttttgtatttttagtagagaccgggtttcaccatgttggtcaggtggtcttgaactcctgaccttaggtgatccgccagcctcagcctaccaaagtgtttggattacaggcgtgagccaccacacccggccaaaatacacatttttctcttcagcacatggaacattctcaaggatagaacatgtgttagatcacaaaacaagtcttaaaacattcaaaaaaattgaaatatcaagcatcttatctaaccacaatggaataaaactagaaatcaataaaaaattaattttggaaatttaaaatatatgctcttgaatgaccatccagtgtttcagtgaaaaagttaagaaggaagttcaaaaagatccaaaacctatgatataacaaaagcagtactgagagaaatttatagcaataagtgcctacatcaaaaaagaagaaaatttcaaaataaataatcaaaagatgcatcttataaacctggaaaagcaagagcaaaccaaacgcaaaattacttgtagaagaaaataaataataaagacaagagcagaaaaaaaaattccaatgaagaaaacaatacaaaagaataatgaaataaaaagtttgtttgttgaaaaaataaacaaaatggacaaacttttaaccagctcacttagcaaaaaggagaagacccaaataaataaaagtggagatgaaaagggagacattacaactcataccacagaaattcaaaggataactactggctactatgaacaactatataccaataaaatggaaaatctagaggaaatggataagttcctagacacatacaagctaccagaatagacgcaagaagaaataaaaaaactgaacaaccaataacaagtaacaagattaaagctgtaataaaaactatcccggtaaagaaaagcccaggacccaatagcttcactgctgaattctaccacacatttaaagaactaataccaattctactcaaactattctgaaaaataaaacaagacagaatacttcaaaactcattctatgaggccagtattatcctgatatcaaaatcagacaaagacataaaaaaaaactataggccaaaatttctgatgaaataaatatcattgcaaaaatcttcaacaaaatactagctaaccaaattcaacaatacattaaaaagattattgaatatgacaagtgagatttatcccaggtatgcaaggaaatctcaacatatgcacatcaatcagtgtgatacagcatatcaacagaatgaagggcaaaaactgtatgataaattccattgatgttgtaaaagtatttgataatgttcaacaacctttcatgataaaatgtctcaacaaactgtgtttagaaggaactaacctcaacacaataaaagctatatataacagacccacagctagtattatactgaatggggaaaacctgaaagcctttcctcttatatctggatcatggcaaggatggccactttcattactgttgtttaacacagtacagaatgtcctaggcagagcaatcagacaagagaaagaaacaaagagcaccccaactggaaagaaataagtcaaattatccttgattgtagatgttataaccttacatttggaaaaacctacagactctatcaaaaatctattagaactgataaacaaattcaggaaagttgcaggatacaaaatcaatataaaaataaaaaattttagaaataaaaaattcaacacatttacaatagccacaaataaaataatatacctaagaattagccaaagaagcaaaagatctctagaatgaaaactacaaaagactgatgaaagaatttaaagcatacaaagaataaaatggaaagatattccatgttcataggttggaagaataaatattattaaaatgtccatagtacccacagcaattcacagattcaatacaatctatatcaaaataccaatgacattactcacaaaaatagaaaaaaattctaaaatgtatgtggaatcataaaacacccagaagaaccaaagctatcaaaaaaagaaacaaacaaacaaaaaaaacctggagaaatcacattacctggcttcaaattacactgcagtgctacaataatcaaagcagcatggtctgggcatacaaacagacacatggactaatgaagcagaatagagaacccagaaacaaatccacacatctatagtgaagttattttcaatgaagatgccaaaaacatacattggggaaaagatagtctctttaaaatatggcgctgggaaaactggatatccatatgcagaagaatgaaacttgacccctatctactgccatataggaaaatcacatcaaagtggattaaagactgaaatctaagacttcaaactatgaaactactacaaaaaattgaagaaactctgcaggacattggtctgagcaaaagttccctgagtaataccctacaagcacagaaaaccaaagcaaaaatggaaacatgaaatcacatcaagttaaaaatcttctgcacagcaaaggaaaaaatcaacaaattgaactgacaatccacagaatgatagaaaatatttgcaaactaaccatctgacaaagtattaataaccagaatatataacaagctcaaacaactatataggaaaattgataacccagttaaaattggcaaatatcaaatagacatttctcaaaagaagacatacaaatagcaaacgggaacatgaggaggtgctaaacatcactgaccaccagagaaatgtaaatcaaaacaacaatgagatatcatcttacaccagttaaaatagttttatccaaaaaacaggcactaatgaatgctggagaggatgtggagaaaagggaatcctcttacactgtgggtgggaatgtaaattagtacaactactatggagagcagtttagaggttcctcagaaaactaaaaatagagccaccacatgacccagaaattcaaattttaggtataaacacaaaagaaagaaaatcagtatatcagatatatctgcactcccttgtttggccagcactgttcacaaaagccaagatttggaggcaaagtgtccatcaataggtaactacatttaaaaaatgtggttcttatatacaatggagtactattcagccataaaaaatgagattctgtcatttgcaacaacatggatggaactagagctcattatgctaagtgaaataagccaggcacagtaagacaagcataacatgttctcacttatttgtgggatctaaaacttaaaacaactgaactcacagagatagagagtagaagccttggaagggtagttgggggtggagggaggtggttaatggatataaaaattagtaagaaagaagcaacaaaacctagtatttggtagctcaacagagggactatagtcaacaataatttaattgtaaatttaaaaataactaaaaaagtgtattggactgtttgtaacacaaaggataaatgcttgaggggatggagactcaatttttcatgaggtgatttttacatattacatgcccgtatcaaagcatctcacataccccataaatatatacacctattatgtacccaaaaatattaaaatttaaaaatatttaaaaatttacttgtaaaacagcctcaggccaatctttcaggagatattgcacaagaaggcattgttattataggagacaacagctccatgtgtgctattgccccaaacacctttcattgggacgagacgtggacgtggaagacagcgatatagatccacatcttgtgtagccctaggctaaaatgtgtttaacaaaaaaatttaaatgttaaaaagtatacatttaacaaaataaaaaacttatagaacaaggatataaagaaagaaaatatttttgtgcaggtgtacaatgtgtgccttaagctaaatgttattacaaaagagtcaacaagttaaataaaagtttattaagtaaagatacagtaagctaagattaattactgaagaaaaaattaataaatttattgtgatgaagtgtacagtgtttataaagtctacagtaatgtacagtaatgtcctaggccttcacatttagtcacttctcattcactgactcacccagagtaacttccattcctgtaagctccattaattgtaagtgccttgcattggtgtaccactgcttactatttatacagtatttttatcataacttttccatgtttagataatcaaatattttccattgtgttatagttggctacaatttccagtacagtaacatgctgtgcagacttgtagcctaggagaaataagctataccatatagcagaggtgtgtagcaggctataacatctaggtttgtgtaagtaagtacagccaatcatgttcacacaatgacaaaatcacctaatgcatttcttagaaactatgcctatcatcaatcaaggcatgactgtatatcagaccactttacttatccaaaatgagccttgtgacaaattcactctctagaacaaaattggatgatgaattagtaaaaagaatcccttaacacaaaaattatgacattttcttacatcttttactttgttagaccaagaatagaagacttttcttctcactagtaactgcaatcaattggtatgacttggagtaccaggtatatcactcttggcaacacatctatttttagtaggacaaaactgatgtgaaaaactgaaaatctcttcaataagagcattgaaactaggaaaggggtttagtgagatttagtatatgtatttatttacttctctgtggtttttaaacttatcttacttcctctttttaaaactctgtcagatttatcactgatttcagaattacaatctttaccatagactacaaatccctgagtagttatgtgatttcctcccttctatcttcccagtccatctcataccatacatttattggtcttctatgtcctagacacaccagccttttaagaggactctttattaatcacaaagatgttgaacagatgattctgacagcctggaattttctctctccacttttctttttcttttacctaggttgaattcattgtttagatctcaactgaaatattccttctttgtggaagcttcaccacatgacccagattatgctaggtctcataacatgctggggccttctcaatattgtgattaaccatgagcatgatgtattttgcctggactatattgcagacaaagggcggactgcaaatgcagctgccgaacaaatatctgtggaaagaaaaaatgattccttattttagacctctactctgtctcattagcattaaatgtcacacaagtcttccaagcttatttatctgattttccaacctgagataaaatagaagcagctaatagatacacagcacagtggaaaggcaatattagaaataggttcagcaggacaggcgcggtggctcacgcctgtaatttcagcactttgggaggctgagaagggcggatcacgagatcaggaaatcgagaccatcctggctaacacggtgaaaccccatttctactaaagacacaaaaaattagccggtcgtggtggcgggcgcctgtagtcccagctactcgggaggctgaggcaggagaatggcgtgaacccgggaagcagagcttgcagggagccgagatcgtgccactgcactccagcctgggcaacagagcgagactccatcttaaaaaaatgaaagaaagaaaagaaaagaaaagaagaggagaggagaggagaggagaggagaggagagagagagagagagagaaaagaaagaaagaaagaaagaaggaaggaaggagggaaggagggaaggagggaaggaaggaaagaaggaaagaaagaaagaaaaagaaagaaagaaaggaaggaagaaaggaaggaaggaagaaggaaagaagttcagcaatggaaaagaaagtaagtcataaaagtgaattagaatgcaaagtcaaagaacacatccacatttaatgggtttttttttgtttgtgtttttgaaaatttaattgaagaaagtaaagttaccctggcttataataaagttagatattataacaaaagataagtcagtgaccttaatatgcaatgtgttttggtttactcatcagataaaatatgttattaatgaacaaaataaaaaaatctaaaaaaggaacatgtagagaaacctagagcttagcagtatagttctctgaaatattaataagttaagaaatatacaccaatgagaaatgacttcagaagtttcactccaagggccattatagctctggaaattcttaaaggattcattaaattttcaagcacagaaatttgttcatttaattgatttttatatatgctttttaccccttttgttagttctgatcatccttaacctacacaccaaatatgctacaattaaaaagagaaagctcataatattttaatccccaaacataaaaactgaatttattaagtacctactaaagtctagaaactttgttacacataccacataattttataactaaatatgtaacatcacaaaatcgagattcaaaatctaacattggtggaaaatgcaaagcatgagtttaataagatattaaccaaaatgcacacctctgtctctgctataactacctcacctctggtttgcactagacttgggttgccacttgatccatagagaaccgttattaaaaacaaaccagagagtaattatgtcaaaactcacaaagccctgatttaaatcatgagaaatctgaataaagcctcccttgtcacacctgtctaattagcacggactctaaattgaggaggggagccctaaaaaggaattttgttgtagctgtaaaaatgtatactctttaccagcagttacaaaaacaaataatcttcatttgaagcaagctctccaatttttcaccaggatagtgaatgagcaaagctacatatatcctgcagagttgctagacacacaaagcaaaggatataggtattacactaattaacaacaatgggacaaatcattaaacatcaagtagaacattcagccaagatgatgaacaaattatctgtaagctaagattaatttgttactgaagaaaaaaattaataaatttagtgtgatgaagtgtacagtgtttataaagtctatagcaatgtacagccatatcctaggctattaaatgttataagtattagtagtagcagtattggtagtattatcctcttttcaaattttaaccacagagcttacatatgtataatgataacatgataaataggaatcagtttttacattggttttgatggttcacactgtctcaactcatggtatcttgttagcaaaagtgcctctattgtccagttaggcctgattttagtctggcatacaattaaatctaatatgtggatgcacataaacagtttgattagatttttggggaagtaggtttctgcagacatgagccactgcttgaatatgcaatatactaatccaatcaatcaccttgatacatttagttgttttatttttataattctctataacaggtttatcagtcaaatttattggttatacttattggtgtaaatgaagaaatactttttttgttccctctcatcactacctttaaatatgctcgttggaatctctttttcccatcacttgagaataactccagccaatctccagctatctagcaatttccaaacacactttcaataaaattgaaagacaataaatctatttttggtaaatttgacttactttcaggttttaaaaaggtctagttgcatgtaaattaaaactacaattttgcaaccaaattaaaacattttccctacctgttcctcacctagctcagaattgatatgtaacaggaagacctgtggttgtttatccagatgtccttcttttgtctatggctccattaggattgtaatggggaaaacaagaatcatagcaggaagaattaaaagaaaagagaaaagctttttttttttttttttttttttaaataatctcatctttatttctattgagaggcaggcacccaaatgcttcttctgtcggggagtgaatttgtaagttctttgtaactctgtgctacctatttgttaacctgagtaatttgttctcctgctcacttcttgctaacacttgccagcggatacctgaagcctcttacatcttctgtggcatgcacttggcctatatatagcatattcattcacctaaagtgggaagaataatctggcatcttttctctttccccatcttgccatcaaaagctgcctcaacgagcatgtagccttcagaattttgaaagccagaagcaggtaacaacttgccatgtttagcttcatcttgaaactcttgaggacacctatcaaactttcccaaaactgtctcatcatgtatggttccattgcaggatgggtgcaatgctgagtgccagcaggggaggaatatcccattctttccttcttgaaattgcccccagtctttttgagctctcttcctatttggaaggagaactaaagcaagtttagttctcctcacaaaagagaaaataattgaaagcactctcacttaggcagctaattcactgtctatatgataattcttagaatgcctagtcctctctttacataagagcacaggtaattgaggtcaatgaaggttgtagagtcacagaacttgtctggctactttttattaaatcctgcaaagacttaactattcttctgtaatttagggataccggtcatttaatagggaataaacaaaaatctgagacataaggaaattctgtatccattctatatatgtataaattatatatagaaaaatagtttagaagagttaatatcaatttgaaaataggaattttaaagctgtgaataatacatagcataaatatgtataaggattcagcaaaatgttagttgacatgtggctaaataaacttaaagtttaagaaagataagaaaagaaaccaaatatgcataaatctggggacaaaatttgatattgctgctaataaaaaggggaggggcatcatattgggaagcttcattaataaaagtaacaaattatgagaacaaatagtcttattatagtttatctggtgaagcattttaatgaggcgtagttgtctgttccattacggaaagagttttcttatgtgtgctctggtagattttcatgtggccacactgaaagatactcccaaatgtctgactaataattctatttataggcaactgttctgaaggtttaaagtaaggaggatgaagttcatttggaagcagtggggaaaaaaatggtaatgctgggctttgaattttatggatgctgtagctgttctttatttttcaataaataaatgttttaaatgccatgttttttagctattgcagttaaactgccctcatctttttgcccagcaaaaaacccattaagttattcactgagattgactctagattttttataaaattaataactttgctaccagtttctcaaaaatgagtagaaacgacttttcaatgcaaatgccagtttttgctacagtgaaattattctgtctgtagtgactatttgaacatttatgggcaataggacattgagagatttagtatatgaactacgaatagatttatccttagattatctaatacatgttttccaccttgcaacataaaacctgatctctttttaaagtcctggttgttctgaaaaatgaaatgaaattatagtaaatggaattttgactggggggaaaaaaacttcacatgatttaagagaatggatgctggcaattgactatctactgtttattcaaagcttatagattagcaaccagatgtggcagaaagttggctgtttttcattcacaacaaaaacgatgctgtgcttaatgaacggaggtttgttatcccagtaataagtaaaaggaacatgaaagcccttgtgtttaatgcttatgcaaataagctatttgcaggtggcttttgggcagaaggtaaaatagtttcaaaactgggtcaagttttttaatcctcaaaaattgccagctagaggaaaacctcctaaaatctttattatgctatttgccaagtaaatgaaatgacatcatttatcatttaataaattacatatgaaaattcttttccttatgatttcatcaatcaacaaataaattctagaggattctagatacatttatttggcatattttttaatgcggtatcaaattttgtggatattcttttagagaatcaatttcttaaaatggcattgaacatttaatttaaaatgcccttcttgaaccatacatgtttattagaaaattattttatataggttgtccattaaaaaacaattttctatgtatgtaaacatttatgataactgctcaatattttggtccatatttatttatctacctatttattacacaatacaaatattacactttgtaaaattaaaggcctagtctaatattactctatgtcggaagtaaaataattcagagaagtctatattaaaagacaagataaaacacaaaatgatgagaatcacaaaaccattgccaaattttcagctatgacatttattctccatgtggccttaggtatcttactctcttattttaacctttgatgactataaaaataatttgttactaagaagccctctcgctttagtagctgtgactataaaattaagaacataattcacaaaaagtgtttgagtcttcctgaaaacattttaaaatatcaattaatcattgcacaatacacaatcgcctgatcatttgctaaaagagggttgcattctcatctctgttcactctgtcctttctgagactcatataggtgtgagagctagaaaaaatattaatgtgtagcaattcagattttctcattgatgaatcacttcagcagtgcacagaatactttgtaattttaaaaaggtgtttttattaatatacttctactattctaccccaatcaacagcaaatttacctaaatcatgagactgctggaactgctaagttttataaataaaagacttaagaactactattaaaccctgtgaatcctttatctacaatgagaatgtccatgagtcagctcttctgaccctctggccagtgttctggagttactgatctgcaactttctaattgaactctagcttggtatgtgagagcagctgtgggttaaccagcggggcgacatttaagtcttgacattgccattaatgattcaccacctgttgcaagttcaataagttattcacacaccaaattgtggccacagaattcattgagataaactaagttagaaggattgggtgtcaataaatgtttgctaaatcagaattgttaatgatagaaatccgtagcttaacaaagttgagaaatcttgtcttcttaacgtgtatttattgacttcccaggatatgtcttagtgaggaaacatagcttctggcatttattattagagggataaggaataataaaccacagtgattgagagacagggaaaggccgggggacctagagacacagtaacagaagaagtttaattggctaatgaaataaacttgagataagagagcagagaggaggttcaagagatgaaaccacatattcctctctatctgctcccaccatcaagggaattaataacatattttataatgaatccctgataaatattagtgtataattgaaaatctattaaaatgactatttctcagggtgcagaaaaatattaaaacaagtaaagttgccataagatggaatattatattttcctgcatgtctgcttcaaggctgaatcctaatggtcatgtatgtaggtaaattattcttcctacagcaacttctgggaggtggtatgtggtggggtataaaaggccaggggtgtagtgagggtaaagtgtaagtactttgatcttgagccttgactatattggacttgggatctcagaaatcttggggataaaccgtggattaaatccataaattcataaagtgttggttatacaacgggtagaaactacgtgccacttttggagggacagtctcctttttttttaaaaaaaaaaaaggccttaaaggctatatatatatatatatatatatatatatatatatatatatatatacagtcttttttattataataaatactattttgttttttttaaatgaaacaatctgcacatatacaactccactctgaaggcaattatttacataattatgcataaattcctatagttatgttagtagttgcctttcttcagagtggagtcatatatgtgcagattgtttcattttaagaaaagaaatatttatttatttgattaactgaaattatgcttaaaaatgattaaaatgcacagatctgtcttcatgaagtttaaatgtcttataagaaattaaagtaataaagactacaacatttattatttaactgtaactgtagtgggtagtaaaagagaaagcccagtgtgttggctttcagtagtaaaaaacccaacttgtggttaggaaacgccattgtttattgtatctaaattaatcaagttgtatcctgtaacaggtttcctgttatccactcgtcttccaacttctgaagtatgctttaaatgacaagggagaaacccagacactacattttctaggatctcagcacaacagagctccaggtgaaattatgctaaatagtggcatgagcgtgagatgtgggtggcataaagaagaggtttagagtgtttttctggtgacctcctgtttaagtttgacaagcatctgaaatcactgctagcaactttcccataattattgtgtttccagcctttatgaaaatagcagcaattttttttcctttctttgcctatgtacaccatctaatcatgagataagtctccttcttagtccctatattaaatatctttttacatgaaatacatagattgggatctttttctgacctgttcctgtctgacatattcttcaactctaagatgagttcatactcatcttcggaagcccctgggaaatgggaagttttttttcatattagatgttggtagatatagaggcccatcctttaataaacatctatgtgccagaaaatgtactaggcacttagatacattattcatgtaactctacacaaatgtatcaacaacacaaaaaaaaatctgtataaaataataattattatatcccttatatggaaacagatccagagaggaagatacactagcacctgtaaatagaggatccaagaattaaacatccatctgtcggactgactacaagctctttctttttcataaaatgctaatttctctcctgcttctaatatttgtatcaaaatttgtcatctattgttattgggtttataggtgggtagtgactccttggcttctattttgttctagtggattactgtcttctttattttcattctagtgtttattgagagtcctaattaatcaacctggctgctctgacttccatcagctcaccattgtctcttttcccagctcataatttctgtaacagagctctaagctatgctaaacttctgctatatgctgtcagcctctctaaatccaagtgctcttatctgccaagtttacatacacatgtttaaaatcttcttattgaatctacatacaaagtcttcatgtcttcctccttgaaataatagcattgtgagagaaaaaaaatcttcattctttttaaaactaattcagaatgtctaggtaacacaagaacactctgcaacaaacaagaggtaagggaatatttacctggtatttctgtgcctcattatcattctcactcattataaaattggtatctgaaaaaaatcttgctgtaaaaacaaaaagtaatgtatagagagtataaacaaagagtttgcttcacatcataaccattatgcatcccattgccaaagggaagatagtacactacatgattccggggaggagcatcattcacatagactatagtgtgcatggcacatgcaagagaccccacagtactacccgctttgttctctttgtagacacactcacggatgattcatactccctgacctggagtagccaaataaagagttgcatcagtttattatcattctttccagaccactttctaggtattcccattatacattccttcaaatagaaagattttattctgtaaattgcatcgcactgtacacatttttttctgaaatctgaataatttcatacagtttcaactgtgagagtacctgacagactgacctaactctaagctaaaacactcataaactagcacagaagcttgtcatatcattacacatttatccattgctctaaattacttatagtttttcctgaaacatctattaatattgcagttatttgagatgactgtgagcttactatttgccagtgatgacatgagcaccttggtttagtctagtgcctggcatttaataggaccattctatttattttcctaaactctggcagcaagattagctctaagcatatttttttatcacaacaatcgtccatctttaactacatgtgaggaaagcactttcttatattgcattacacatttttatatggccacagaaatccttacttaatctgacaaaattaagataaatttctttctcctaagttcaaggaaagaatcattctctactgtttccaaggagatgattctccttttctcaattgccaattgtctactgcttgtcctgggttccatcttttcatatgtcatgaggattctcaccccagtgttctgctcctctgagtcaaagcccttgacttttcacttctcaattgttttgtttgtaatttttttgcttttatttttttctccataaatgctatgaaagtgtatgtaaaaatttacccatcttttattttatatttgttatcacattttattcacataccaaactatacaggaaatgaatataagcacatctttcttagtaggaggtagaagtaaaattttgtttagaataaaaacagaaaaaaagagaatccaattccatatcaccagtttgctcctgaatgtgcaataagtttccacttatgagcttgctactgtacacaacgcaagagcttttaaaaaattgtctacatgatagtggttaagagcgtactttaggctaggttactttaaaaaaatatgtcatcattacttctgccatcaaaagctaattcaatgtatcataattgttaaagttgagtagggttaaggattcttctcattctatggtttccttataaacacagtttctaataaatgtctatttttttctgtgaaattaaaccactagatattgctgaatgtctgtatatttcttacatttctagaatctcattcttaatttttttcttatatttttccttcaccaaagtcttaaaacctatgcacctggtgtctattatttaaattctgtgatgtattttatttgactttatttgtgtttttagtcttttcacagaaattagtttattgtgatcttcttttccaaaaggacttaattcatatctcttttccatacctatcttcattagcaggttgcatttcagtttcttcagtgcttttttagataatatattttactacatctttcttcacaacactgtatatgctctgatgatcaggtctctcattttttttaagttcttgtcccctttgggacccatgacaaagtaaagggcagattttttctcacctggcttaaaagtaaaaagccttcatatgtttctcctctgattcttcttaggcccagcatttccaaaaacaaactagtacacaaaacattagagttgcaatgatacttcaaaaggttcaaatactaatttttgtctgctttctctctatagttttcttgtagagaaattttctgttatgaaggttgaactatttgctatatgttaatattttccaaataaagtttccaaactgatatttaaatacattctctcatattcaaacatattctgaactactttctgttgtgtctctagatcaatatttataaaactagacagttcatataatttttttcctttgctaactttcaagatcatatcaaaaagtactactgttgattcggttttttgtgtttcattatttgaaactgtattgacctttttcctcttatttctttatcatttcctgttatttcatctttgtgagtcttcccattaatgtctttttctttttgaattatttattttttaattgacaaataaactgtatatatttaagatgtaccacatgatgtcttaaagtatacatacattgtggaatggctaaatcaagctctttaatgtatgcatatttaatatatgcattaccttgtaattgggccccttgagattttagtatctcagcatttttagtgcctgagatttaaaaaagtcggattaggctcttgcttgcttgcacaaaagccaacatcccttgttctcacaatacaattgcaaactgctgatgtactgtttctttgtcaagcaggagaagataacttcaaggtaacaaaaaacattcgcagaaggaaagaatgcctataagattgttgcaactaactgttgagacccagaagtctggttgctcaggatgttatcagagattaaagaaacacaaacttccccattggttccctaaaactccccctctcttactctctggctgcaaacaaacctctctgctttctcttattgttaagacatatctgacagatcttgccccgttctcgctttggccaagtggaataaacttttatctatctctaagcgttggtgtgtcagtgtttggtttcgactgagcatctggtacatgagcctgaatttgggtctctacaacatcttcacctagttactatttttgtgtgtgtgtggtgagaatacttgaaatctactccattggcaattttcaaatataaatgtattgttattcactgtagtcaccatgatgtgcaatcaattttttgaacttattcctcctggctaactggaattttgtgtcttttgaccaacatctccgcaatttcccccatgccctagcttctgatgatgaccaattaactctctgtttctatgagttttacttatttaaactctacatataagtgagattatgtcatgtttgtttttaagtgcctggcttatttcacttgacataaagtctcccaggttcatacgtgttgttgcacatgacaggatttctttcctttttaaggcccattaaccttttgtagatctgttactgaggtaatcaaagcttactggacaattatgttatttgagtaaattgaaacataacagcttataaagggtcaaatggtagtaatagcctaagaaataggtttggaatattatttcttagcataaaagacaaagataatattggtcagagtcttctaggcttgaattcttggctacttagattttatcaagtaaattgtaaaaggataaccaatcaatatttcacatgtatttctgtatgaattttgatttgacaagaaagactgtgaaaacaaaaccactattatctgtgaactacctaatgtggaaataaatatccttaaataaaaccttgagaaagtatattactcaattttttttctacagatatcccatatgttataatatttaactgaaaacaaaatctttcttcttaagaaaagattttattcagttttagaacgttaaagtttctccactctaatatatacagaacttctctaacctttaaaaatactgctttgcttattactcatgataattgggccacatacataattaaaacacaccatttattattttgccatgtgaaagtggcatctggttccccaacttgacttcaaactgtaattttaaacaaataataaagtgttttgaaacattaatgtcattaattgtcttatctattgtctatgttcatcaggagctgtgacatgcccaaaggaaggtaatcagaggaaggaagagaagaagctaagttctagagaatccattaatcattccttagatgactgaccattttattattttcccaagtaagctgaggctgacaatatcatgaatcatttacatatatcagtattcaaatgttccatttttaaattgggagggggtatgttttagaatagaataatgaaattccctccatctcctcctaatgtacatcattaagaagaatctaatggaaacataaggttctaaggctcttgttggaaaccataatcagaactggaggaattctcttatggaaaacattaaaaaaaggaaattctagcaatagaattcattgttaaagctgtaagttacaacaatattgtctctgcatgctgactgtaatcctctataatcttcaaaggcaaacaggaacagtaataatcttttcatgtactcttaacttccttctctgaaaggctagaaaatgtcttacatgtagcactcatagtgtcatttaatcaaacccagtttctatttttcttcaacttctagatgaatggatgcttagtctttcgggcacaatgtgaatttcttaagggtctgtagactacatctcctatttttacttctcaaagtttctctcaaattgtgataaaaagtttcactctattggtactgttaactgccaaccactttgaaggcctcctcctccacttttttctttttccccatatctaggcaagcagtaagaaaactcagagtctctattccttggctacggcagggaagttcaaaccatttaaatcctgaactattggggctgagggtaagggactcacttgggcccaacccttaaccccattaaataccagaactccactgactcttccttaggtttcacttcccactgaacctgagccctttttgttgtggattattttgccctttagtaggtaataataccatgtaagtaataaatttgtttcatttcctttcagtcttgatatccataaattactaggggcaggggtggtgtagagttgcctagtattcaccaaataaagtaaaaacaacacacacactgagagaaaaatctagagaaacattcccacattgccacacacagttttcttgcttgcttctggtaaatataaccttctctatccatgagttcaattaacaactttggataggaaatattcataaggaaaaatggatggctgcatgaaaggagagtgttctacctgactttattcactaatcaggatatgcctaaaaactgggtggcaaaaactgaactgtaggttttgagaaagattctaataacaagaaaaatgtacaaacatttttattgttgtttatccctaagcaagacagcataacaactatttatacaacatttacattgcattaagtattacaagtaatctaaaatggatttaaaatatatgagagaatataagtaggttatatgcaaatactaggccattttattaaaggacttgagcatctggagattttggtatctgttgggggatgggaggtagggcggcaggtcctggaatccatcccccatggatactgagagacaaacatacatagaagctacaaaagcaaattacttatttcgcctcttgctgttgacttaaggaaaactatgcactgtatcatcagtatagagagttcttgaaaagcctagatcctcccaaagtttgaataggtgttgcaaatagcgagatgtggtgatagctcaaatagagaacctctcgggaaaaccatttccacatttagaagcaagtttgaagtggcagatgactattccttttttataaatatatatatatatatatatatatatattatactttaagttctagggtacatgtgcacaacatgcaggtttgttacatatgcatacatgtgccatgttggtgtgctgcacccattaactcgtcatttacattactttttctactgaaaatattttcttggcttcctgtcaagtaatgtgagttgcaaaaggcattgaagattggaccaactaatgaaatggaatcaggacatggtttcataaaataagagtgtttttttgtaattatttatagtttcttcctttttttatttttttaacttatttatattccaaatacggtttgtcatttagctcaactttttattttgccccacatatcttcttacggcttcttggtttaataggataataaaatttctaaagcaggctggtctatggcttccttaaattaaccctgcctcttctcttacaaaagttactaaaggcaaatataaataatcatgaccaacatataaagatatgaatgagatttacagagaataactttactcagttatatagcgttacccacaaagggaatttactagcttcaattgaaaaaaaaatcccatgacacctatgatatttacttctgtcatctccacattcaaaagaaaacaaacagattacccacatatttaatcactttttattttacaaatgctctgtaaacaaaatgcttctcagacctattcaatacaattaaaatataacatagctttgccaaaaggtgtattccaaagttatcagttagatttattaactgataaagattagcaatttaatgtgaatgttttctttagtgaatatacagaattctctcaaagttaaattattaaaaacatacctaaattcacctaactcaaaaatgtagtattcttatactcaatatctgcacattctcacatatacaaaaatataatctaaatgttatttttaacaatataaaatttgtttctctctttgttattgccaagattgcactgactgttgaaatataaaagaaaaacagcattaaatcaggtgtgataaaatcacctttttctgtttatcttcactactggcatttattggcacttggaaactatttataaactcatattcttattgctaacatcaattattatgcaaatacttgaaatttttactgacttcataaataatgcatgaaagtctatagacttcaactagtgagcattatcttttgtggtttataaatacagaatacagaataaggtatagtttggatgagtctgaacaacagatgtttctgctttatgaattctggtcaaatcatttggaaagagttttgtttatacaataagcatctgcgttttggaaagttaaactaaaaattattttgtcattttctctaatagcttgggacctacataaatctgttaagttgaccttaaatagaactgaaggtgatagtagaggtatttaaaacaagtttggatagtttttacacatgtaaatctataacatacatttaccaaaatctaatatttaagaattaatggaaattatacagttattccaactctaaagttttatgacacaaatatattacttagatagtatcttcacattaattttgtttaaaaatctccattatgctttagaggggatttcagtgagaatatatataccccatcatattttatcaagctgaaaactgattatgcaactttttgtaagtacagagcaagtttaatccatttaactcatgccagacttcaggcatttaagaataactatcaagtattcctttaagaatttttctttacaggctagtcatccttacttccttcaagtaattgttaatttgcttgatgccaggagctctaaattatgtagaattcattttactaatttccattataatatatatttcgtatatatcatttgcttcctcaaaacccacagttcagtttttgccacccagttctgaggcatattctgattagtgaagaaaagcaggtagaaaactcttttactaaaaataaccaaaacatagttgggaggaggtgcttagggcatacatttttgaccttgtttacctcttagccaatactaagtgctttcacatataatcctataaaatgcttctcctccatgctacacttgaataatcaaaattttgaggttatatatatataatttcacaattgcctttttctttctctattcaacaaattctaccccttagacactggctttctctgtttcttctgtggtagttgatagaattttacctatatttatgctaataaatcaattatccagctatattttgcacaggggtcctgctaatcttcttgaattcttccaattttagtatacgtgctgccaaagcaagtgccagctatttttgaagaactgatatgtactcctaagaacacaagataaagagaatcctaggactaaagttggtaagccagttttttttttccatttcctattctttctttttacttctcgtcttccattctagagctgattcacaggaatccttcaaacacttcttggataggtctttctggagtcccttcaaaagttcctgtttatagatgcacataagatatgagagggtctgaattcttcatgagtccatctcttttgttggaactcaagaaaagagactagactggagagtagaactagattttttgagtcatgtgtaaataatgactacaccgcatgtacacatttagatgctgtccccagttcaagagttctgtccactgtcaaaattcatgtccacctggaacctcagaatgtgagcttgtttgtaaatcagtttttgcagatgtaactagttaagatgaggtcgtactggagtagagtaggccctaaatccaatcactagtgtctctataaggaacacttttacactgttggtgcgactgtaaactagttcaagggttgtggaggtcagtgtggcgattcttcagggatctagaactagaaataccatttgacccagccatcccattactgggtatatacccaaaggattacaaaacatgctgctataaagacacatgcacatgtatgtttatcacggcactattcacaatagcaaagacttggaaccaacccaaatgtccaacaatgatagactggatgaagaaaatgtggcacatatacaccatggaatactatgcagccataaaaatgatgaattcatatcctttgtagggacatggatgaagctggaaaccatcatcctcagcaaactatcgcaaggacaaaaaaccaaacaccgcatgttctcactcataggtgggaattgaacaatgagaacacatggacacaggaaggggaacatcacacaccagggcctgttgtggggttaggggagggggtagggatagcattaggagatatacctaatgttaaatgacgagttaatgggtgcagcacaccaacatggcacatgtatacatatgtaacaaacctgtacgttgtgcacatgtaccctaaaacttaaagtataattttaaaaaaaagaaaaaaaaaagaaagtgaaattcagacacggagacagagaagcacacaaagaagaaggtcatgcaaagaaggaggcagagataggaagaaagcagctacaaaccaaccagaaccaaggatttctgagagccctcagaatactggaagaggcaagggaagttccttccctagagccctcagaggaagtacagccctcagaggaagcaccttctaacctccagaactatgaaagaatacatttctgttatttttaagccaccatgtttgaggtaatttgttacggcagctctagaaaacaaatatacacaggactcttctttccaataggtctgaaatataaatgtatatttatatacatctccttgaatatataaatataatagagattaaatataacagatttatagatttataaacatataacagatttatatatttataaatataaaacagatttatataattttgtaaacacaaaatagatttatatagttttataaatgtaaatatatgcatatatatttaatttttaattactaaaattttttctataggctctcaataaggcaaatacacaatgaccaaacagaataataattgcttttcatttatagattataaatgcttttaattgatagattataaagaatttcatttatagattataaagaattactgtgggcaattaaatcaaagccttttcaaaaatggtgcaaaactaaatctatagtattcaactgatgtttaataaatattaaacattattaatatttattgttaattttaattaatttttaattaataattaaaattattaatatttaataaatattaataagcatcttattcaactgatgtttaataaatatttctgtggattattcctctgaaataatattttaagaatacacatgcatagacataaatgtacatacatggttcaatgtggtgttttattccttgcctataattacacgggtaaaaagaatgcatatttatgctgaaatgaaaccattttgctttctaaaaagaaacccagacacacatttctaagtgcaatgacagcaaatactgatacattcacatacattcttttgtcttttgaccttttcaagcaaaatcgtgcaagtatatctaggttacatctgattagctttcacatgttttagcaggttttgagaaattttgttttataactttgataaggtttggctgtgtccccacccatatatcatcttgaattgtaattcccataatccccatgtgttgtgggagggatccagtgcgaggtaatttaatcatgggggcgattactctcatgctgttcttgtgatagtgaatttgttctcacaagatatcatggttttataaggggtttttccctttttgctcagcacttctccttcctgctgccatgtgaagaagaatgtgtttacttccccttccaatatgattgtatgtttcctgaggcctctccagccctgtggaactgtgacttaattatacctcttttctttataaattaccaagtctcgggtatttcttcatagcagcatgagaatgactaatacagaaaactggtagtgcagagagtggggcgctgctgtaaagatacccaaaaatgtgcaaacaacattggaactgggtaacaggcagaggctggaaaagtttggagggcttagaagaagacaggaagatttgggaaagtttagaacttcctagagatgtgttgaacggttttgaccaaaatgcttaaagtaatatggacaactaagtcaatgttgaggtcttgatggagataaggaatttgttaggagttggagtataggtcactcttgctatgcagggagactggcagcattttgccccgcagaactttgaacttgagagagatgatttagggtatctggcagaaaaaattctaagtgctaaagcaatcaagaggaagcagagaataaaaggtttgaaaatttgcaacctgatgatgtgagagaaaagaaaatctcattttctggggagaaattcaagccaatagggaaaatgtctcgaggacatgtcagagaacttcacaatagcccctcccatcacaggcctgaagccctaagagggaaaaatggttttgtgcccctcttccgacaacccatgcagcctcaggacatggtgctctgcatcccagctgcttcagctccagccatggctaaaacgggtcagtgtacagctcaggctgttcttcaatgggtacaagccccaagccttggcagcttacacatggtattgggcctgcaggtacacagaagtcaagaatagagctttgtgaacctctgtctagatttcagaggatgtatggaaatgcctggatacccaggcacaagtttgctgtgggagcagagccttcatggagagcctctcctggggaaatgtggaaaggaaatgtggggttggagccccacacagcactgtctagtggaatagtgagaagagggccaccatcatccagaccccacaatggtagatccatccacagcttgcactgtgcacctggaaaggccacagacactgaatgtcagcctgtgaaagcagctgaagggggggcataccctgcaaagccacaggagcagagctgcccaaggctgtgggagctcacctcttggaaaggcataacttggatgtgagacatggagtcaaaggatatcattttggaactttaaagtttaatgactgtcctattggattctgggcttgaatggggcctgaagcccctttgtgttggccaattacctctatgtggaatggatgtatttaaccaatgactgtatccccattgtatctatgatgtaactaactcacttttgatttcacacgtttgtaggcagaagaaacttgccttgtctcagatgagactttggacttgaactttcgagtacatgctggaatgagttaaaactttggggaactgttggaagagcatgattgtgttttgaaatgtgagtacgtgagatttgggagggactaggggtagaatgatatggtttggctgtgtccccacccaaatctcatcttgaattgcagttcccataatcttcacatgtcatgggagggacacagtgggaggttatttaatcgtggggttggttaccctcgtgttgttcttatgacagtgagttctcaccagatataatggtttataaggggtgtttctcccttagctcagcacttctgcttcctgctgccatgtgaaggacatgtttacttccccttctgacatgattgtaagcttcctgaggcctccccagccctatggaactgtgagtttattgaacctcttatctttataaactacccagtcacaggtgtttcttcatagtggtgtgagaatgaactaatacaatctttttcagcttttgtttcttagggatgcaattcaagttaaggtaagagagtagtgtagtataaatcagccttgctaagacttctataaatcatgaattcagcagctaattcaaagcacaattttgtatatggtacaaaagtatctattgtagatgactaatttcaactctaactatcaaagtgacaaaaaaacgagctatcaacatcagccctcctcaaaaatgtatgcactattttactaatagtaacaactaaacaatgagcaatattaggaagattaaaacccataatgtaatgtactgtttgacagccaaagactttaacaatgtcctattctttctagtacctctggacgctttattcttctgctaacgtcagccctcctaatctttcacattacattcctatattgcaccatttcagaattttctgcctcacagttggaatgttaccagatactcctcagtgtatggaccacctgctattgctctcagctcatgtttggagaaaactggtttatgtaaaattttattttttttcttctggtaaatgaaagctaatttgcaatatgtttccatgggaaaattctaggcataaaaattatataaccacatctaaaattgctaaacaatattttttaaaatacttaaaatttaatgataaatcatagtcataagcccataaaataaagtaatatcaaaatgaaaattaggaacacaaaactatgtgctacagggaaaaatataatccaaaagttctcaaacagtctacaatatctataaaatctgtgtattgagtttctactctgcattcagcactgttttatgcccaaacataatacaatattcctgtttcaagtggagaagtttgggctgtatatgggatgttgtttccatacatcagtggccactgaataacaataaaactcacattctattctcatgaaggcatgcttgtaatggctactgccaaatgagactctattttacaatagggtgtgtatttcttatgtatgttttatgtatctcccttatttaaaggatttctttccatatgcttttcttttattaaagttgaagattctgttctactttacttttagacaactaacttttgttgtttattccatagagtctctatttgtttctcaccaatcaatgttgggcatgaagccaggcccaacagaagcccttagtccatggagaattacttttattcacactaccgtaagaattagtatcttaaaaattttccaatatgtgaatgtagtgcttagaaaactttaatcattctacattgcctttggcattacaattaaatatctggcttaatatataaagcctttcacaatttaacttaatggcagttatcttctctccatacaattcactcaacctcaaaacttaaaactacataaccattcgtggttctttgctttttttttctgtttgccaggctgtatctaagttatatcagattactcaagtgtcatctcttttatacaccctttgtgatgcttgcagggtgaatctttcctatggctaatagtttatataaacatctatcatagcttatgtttttagttatatatttacttgcagaacttgttctttgattacaggcattcaccatacatgcctccctctgacttccttcaaaacatacttcagtgactgaactcaacagtcattgtagcttagtagtaaaaacaacgtattcaggggccaagattcttgcctttggatcccagggtcacgtactagctgtctgaccttgagcaagttacttacttaaactttcagtatcataagtttcattactagtgtgctcatactagtgtacagcaggttcttaaataatgttgtttcattcaacatccttccattgtaacattgatgagaaaaaacaaattcctggtgggatccactgcatgtatacagtttgcaccttctccccatgtctgcgtgggttttctctgggtactctggcttcctttcctatctcaaaaatatgtcgtgttcattggtgtatctacatggtgctaaaatgacagagagagagaaacagagaaagagagagagagagtgtgtctgtgtgagtgtgcccttgatagaacagtgtcatgtacaaagtttgttcccaccttgtaccctgagttgcccagaaaggctttggacacctgcgacaggaacaagaaggcgaataattatcttacttgtttttattaatctttcttaaaagtacatatagctcatgtttatttcaatatttaatattataaatatttttatctttatttagaagcttgatgttttcatgaaaagaattatgtcataggaacttgactcttgtttatatcaattaccctatgatcaagtttgttcctatataagttgttttgcatgaagtcgtagttgtcaagaacctatggaggatgttaagtgaggatttgcagtataaaattcttaggttatttggagaaaaatgacttaatataattagtcccataatgtaaagattttagagattgacgtgaagtcagtgttttatgaggatattagaaaaagacaggtgagagacaggatagaaataagaaaaataaatattgaaaacatcgtttccaagaaagaataatttctatatgtaatcataaaattgcagtaatggatggatttactaaaaaatctattccagtgctcagatgaaggaactgaaggcctgtgaagtcacacaagtttaaagcagatataggaataaactcctatttcactggtctcttccagagaggtttttgttttatccttgactaaagtctgcaacgtgttttccttatgtcaaatcttgctcttaatgtttttaggcattctgtgaccttttgttgactacttgacttagctctttctatttgccattactttaaatgtatattataagcctgcattgaagtttttcaaaataaaaacatacccaagctgttcttttccacagatgatttggggaataaaaaaggagaaataatacagtctaatttcactattgaaacagagatcagttgaactaaaacagaagaataaatggggtataaagcagtccactaagatattcataatttcatactgaactctttaggaattgtgatttcttaactagattcatttatttatttgataaagttttactgaataccggctatgtgcctgactcatctattgattagcaagattaacatggttcctacactcacaatgctcacattttgctgtagaattcataataataaaaatcatcataatcataaaacttgaaatagggacaactgatagccatggaagtacttttctgaaaggagtaatattaccatatttcaggttttaaaacgtcatttcagaaaaaatatttggagacagttggaaggaaggtagagtatatgcaaggagaaggagacaaacaagatgctaatgcaacagggcaccaaacaccaagaaataagcaagtaaaacatggagcgggaatcccagttttttgcagaagattaaaagagaagccttgagagacatgtatttggtataatacacaaaatatcatcatgcatttaatatagggagtgagggaatgaaaggcatcagaaataactttcatctctctggcttgagaaacattgagtagacaatggtggcatttaatgagataaggaaaatggagaataatatattttatcgaggtagcgagttgaaggatgatatgaattttgaaccactgagtttgaagtgcacttgaggaactccaacgtgggagagtgttaaatagccaatgctaattagaaacattcattgaaaaatgtatttttaggagaaatcatgacattaaaactagaaagaacatatttttgaataataccatttatattaatgtctgataaacagatacaaagtgcctaaaggattcttttttataaattattgatcattcatttaaatgatactagattagagaatatttacatcacctgctataagagtgacagcatattagccaatggtattcatgctcgactatgcaattcagaagcaacatcaaagaatattcttcattgtgttcataaactttctcttaagtgaataataaagaaaatgtaatgcctagcaacattttctagcaattattcttctgcaatgcatgaatacatatttgtgctattgtagcattaggttcaacctaattaactcagaaaatcatttatgcacaatagcctatctttcatgtacagcagatcatgtacattttctttactttttgcaagttgtatgtaacattagcacacaaaaaaatagtggttgtggttctcggttcttagcactgctgtttatcacatccatgtccatgctagtttttccatgtgtgatttaactaccaagttaaccatttgagattagaccatctcttggatttatgactctgtgcctataatattcgagctgcctataggtctttataagcatatatagcaacacatgttgtcaacaacaacaactgcttagatattaaatagctgaaacctctggaattaggcaaactgtgtgcaaatattaaatattgcttcagaccttgagaaactttttttcaactacctgtgcacatatttcctcacctgtaaaatgaaaccaatgataaaacagaacctccttctttggactatagtaagaatttaatatttaatttttaacaaattcttatggtaaggacttaatatttaattcttgacaaattcttatggtaatgtttaattcttaccaaattcttatgataaggatttaatatttaattcttaccaagttattagggtaagaacttaatatttaaaatattcatttttcagcatatatgaagttcttagaatacctactagcatatgataaaatcttagagaaatttaacaattttattataaattagattgcttaatatataatcatgttacatgagttgagatagtcaatgcaaataaaaaataatcttcactggttatccttttatgttactcagctttcaatttctcataccatctcaaagaaaatgtagctagtagttatttttcagaatctgagaagtgttctgcaaatgtgcgtaataatttttgtcaatgttgaaaatctttaggactttctgtaaagtcgatatttaatgagttgaactattgtctttagcatttatgtcctaatttttggaaggaaacacacacacacatatatatatatataaaatgaaatcctatcttacttgacctaaaactgcacaaaaatttatatttgctgcgtttattttgcattggtaatatcaattttcttccatctgaatacaagtcatttggaaaattccttacatccaagttcttcagctcctatttgttaatcctttctttctttcttttcttttcttttctttttctttttcttttcttttttttttttttttttttgagatggagtctctctctgttacccaggctggagtgcagtggcatgatcttggctcactgcaaactctgcctcccaggttcaaggaattctcctgcctcagccttccccagtctggaaatacaggcacgtgtcaccacacctgcttaatttttttttttttttttttttttttttttttaagtagagacagggttttgctatgtggcccggctggtctcaagttcctgactttgtgatctgcccacctcggcctcccaaagtgctgggattacaggtgtgagccacctcgcctggactatttgttaatcttgatcttgttatatatcaactgctgggttgctccatgattttcacattctcttcctttagtttgtattgtgttggtttttgtttctttcataaaacactaaaaatgtttacatcattttaaaacatttcaaacataaaacaatatcctaagtagcttaacagtagagtccacacatgttgggtattaacgtaaaaacttttaagctcgttataagatcaatcagtctgttcatatcagtactcaatgagaacattaacatgttcaactctgttcagtcattagagaagcatatataaaacatattccaaaaatctaataagctgagtgaatgccaataggccagtaaatattgatataggatgttgctttgatggtaccaatttcattttatatattgtaaggacttccacctactattagagtaaatttcaagctatataatctcacattaagtgtcatttgcaatctgaacccaacaattcaaaataattatgttttaccaactctaataataataagacaaaaaataatggctattacttatcagtaagcaatctgagacctagtaaggatagatgacttatccagggtcatagtgttagctggtgagagagccaggagttgaaatgaggtggtttggcctcagaaactttgcactaagcccctaaatgtattaacaacactacgccaaagccttgccaggaagcgtttcaccatcttccagtgggaagccaagtaaacataaacttttaataaaactgtctgagtactgtcagagaggtataaacacttctaccagacagtaatttttttcaccatcctggaagaccctcaaggtcagggattatattttatttgactttgtattcccagagcctcccatgacacctaccccatagaggacctcattaaatgtgtgctgttgttttatagcaaagtgattccaaagcggtagtagggctagagaaaaaaaaaggctttacagtatgtacgagcgacatttgaactccgtcttaaaaaaataaatataggtactcaaggaagaaacacagagaagaggacatttgagacagagaaaacaacatgtgtgaacaaggcctgaagtgggagaacaatggatatatctaaataataggcgtttggatgtagggaagccagagatagtgtcgggcaagattctggacaggggtttgtggcggtttaggaaggaaaacctttatgtcaggctttcaccttcatagcttcacctgcacagccagggctctgttgcactggaatcagtagagggaatgggtacagtttcaagaagctctccaagagctgggaacaccctatttgtgcctcagcgtggttgaaatttagtctctccatttatgagcattacaaattttaataaaatgcaacaagggcacagttggggagaggttataaatgactaaaacaaaaggagattttaatattgaagagtatagaattaagttttcaaaaagttcgaaacagagtgcttatatataaatataaaataaataaatgtgattgacattaatttattaataacaaaacttgcaagaagataaatctgcttacctggttttaagcattgagaggaactaggagtttatatgcattttgggggaaatatatttaaataatatttttgtgtttacacagaataattataatagcttacagatagtaaaactatcatatttggggttattgtctcccctagacaaaatctataactaacatctatatttacaatgtctaggctctcatcaaataataaatagtgaagtcaacataggtaccttatcccatgtaattcattaatctttacacaagcctcttaaacagtgctccagtatgatagtaaaataccatgtcttccctctccggttgaccttatttccaaggttgagtatctagctagctagctattttaaacaagagcaacctaattctattgatttaaaagacagaataatgatcactgcaggagacagagaaagtgaacagttaaaaaagatgtttcactaagctaagggaggaaggagggcctaaatttagtgttggagattgaggttatgatacaaggtttacagactaaaaagcaataacatgccatgaagtagtttaaccttttatgttttcttgcctctgtacttctgcaccctctcacaccactacatttgtctgcaatatatttcccttatcctttttaaaataaagtttcacttttaataattaaaggtacataataggtatatatatttctatcttattattgatacatagcatttgtatatatttacaggggacatgtgatttttttgttacacgcgtataacatgtaatgatcatgtcatagtatttattccctagaatacttttcatctcaatgcgttaaaaatatttcaaatactctcttgtgtctatttagaaatatacagtacattgttgtttagtaactaaagtttactctcaatcactggaaattattctttctgtttaaatgtatgtttagacccattaacctactctctttatccttcccacatacatttcctagcctctggcatctagcatactagtctataccttcatgatattaccttttttagccccacatatagtgagaacatgtgataattgtttctgtgcctgatttatttcatgtaacataatgacctccattttaccccatgttgctgcaactagtgttatttcatgcatttttatggctgaatagtttttcattgtgtgccaataccatatcttctttacccatttgttggttgatggacacttaagttgattccatatctctgttattgtgaatagtactgtaataaacatgggggtgcaggtatctttttgatatactgatttcttctcttttgaatagatatctgttaatggcattgctggaacatagagcagttctatatttacatttttgagaaatcctcatactgttttccacactgactgcactgattgacattgccaccaacagtgtataagagttcttttttctccacatcctccccagcatttatatatattttttgtcattttgataatagccattctaactggggcaagatggtatctcatgattttgatttacacttccatgatgattagtgatattgaacattttttcatatatatgtaggttctctgtatgtcttattttgagaatgtctagtgcccattttaacaatgtgttgagatccttgtataatctggatattagtcccttgatgaaagagtagtctgcatatattttctcccagttctacagattgtttctttactctgttgattgtttccttagctgtgcagaaatttttctgtttttgttgcttgtgtttttttaggtctcagccataaaatctttgcctagatcaatgtcctgaagtgtttccccaaagttttcttccagtagttttataattttgggtcctaacactatgtctttaattgatcttggctgatttttctatgtagtgagaaataagggtccttttcattctttccatgtggatatctgatcttgccaacaccatttattgaagagggtgtattttccctagtgtaggttcttggtgtctttgtcaaaaatcagctggctgtaaatacacagatttatttttggacaatctatttctgttttatttgtctgtatgtctgtttttgtatcaacattatgctgttttggttgctatagccttgtaatatcttttgaagtcatgtagtgtggtgactccagttttgttcttttcactcaggattgttttgaatatttggcctctttatgggttctacataaatatttttctatttttgtaaaattgccattggcgttttgatagagattgcaatgaatttgtagattgttttggtatggtcactttaatgatgttaattcttccaatccacgagcatggaatctttccatttgtttgtgtcctcttcaattgcttttatcagagttttgtaattttccttgtagaagtatttcagctctttggattactttatttctaggtattttattgtagctgttgtaaatgggattgccttcttgattcttctttcttagctaattcattactggtatatatgaacaccgatttgtgtatgattaatattgtatcctgtaactttatttaatttatatatcaaatctaagaaattttaggtaaaatgtttagattttcctagatagaagattatatcatctgcaaagaggaaaaatttaactttttcttttccagttcgaatgccttttattttttttaatccatctgatgatgctggctaggcctttgagtactatgatgaactgcagttgggaaagtgagcatctttatttttttccagttcttagaggaatggctttccactttttccctttcagtattatgttagctatgagtttttcacatatggcctttgttatgttgaggtatgttcatcctatgcctaatttgttgagtttttatcttaaaggatgttaaattttccctatttctctgtgtctattaagatgatgataagattttgtccttcaccctctttatgtgatgtatcacatttattgattagcatatgttgagcaatctttgcatctgtggaacaaatcccatttgattatggtgcattatcttttgttactgtttgtttcaatttgatagtattttgttgaattattttgcatctttgttcatcaaggatatcaagctgtagtttttttttttttttttttttttttggttattgtttttagactcttgtctggtattggtatgagggtgatgctggcctcacaaaataaattggctgaaattccctcctccccaaatatttaaaataatgtcaggagaaatggtgttagatcttcttcgtaaatttggtcaatttgtcagtgaagcaatccagtctcaaacttttctttgttgggagactttttattgttgatgtaatcttattactcattgttgataagttcaggttttctatttcttcctaattcaatattggcagattatatttttccaggaacttgttcattttttctaggctttcaaattagttagtgtagggttattcgtaatcgtctctggtgatctcttgtatttcagtgctatcagttgtaatgtctccatttttctgatttatttgggtcctctttctttttatcttcattagtctagtgagcagtttataaattttatctttttttggaaaacaactttttgttttgttgaccctttgtattattattttcagcctgtattttgtttagttccactttgattttttattatttctttccttttgctaattttggtttggtgtgttcttgcttttaaaatttattgaggtgtatcattagattgtttatttgaaatctttctactttttaatgtaggcgtttattgctaaaaactttcctcttagtattgttttttttctgaataccatagtttttggtatgttatgtttcaattttcatttgtttcaatacattttttgattcctctcttaattatattcttgacccaatggtcatttagaagcatgttgtttaatttccaaatattaatatagttttcaaagttcttgttattttttattccactgtgttctgagaagatacttggtatattttgattattaaaaaaattgagacttgttttatgtcctacaatatggtctattcttgagaaagttctatgtgctgatcagaagaatgtgtgttctactcctgttggatgaaatgttaggtaaaagtattttatgtttattgggtttaaagtgcaatttaaaggcaatgtttcttttttgatgtttttgtcaagatgatctgtccaatgctgacaatggggtactgaagtcccccaaatattacattattgcagtctatttgtccttattgatctaataatatttgttttatatgtctgggtgctccagtgtttgctgtgcatatatttacagttgttatattcttttgctgaatttattcctttataattgtataataaccttgtctctgctgtttttgattaaaattcaactttatttgatataactgtagctactcctgctcatttttttgcttccatttgcatggaatatctttttccatccctttacattcaatctatatgtttctttacaggtgagatgtgttccttgtaggcagcatatggttgagactttgtaatttttaaaattcatgtctttttgtttgtttgttttagattcttgctctgttgcccagtttggactgcagtggcacgatctctgctcactgcaaattccacctccaaggttcaagcttttctcccacctctgcctcctgagtagctgggactacaggcacgcaccaccacatccggctaatttttgtatttttgattgagaccagattttactatgttggccaggctggttttgaactcctgacctcaagtaatctgcccgcctcagcctcccaaagtgcagggattacaggcatgagccagcatgctgcccccatccctgcctttttttaactattaagccagtctatatcattgaactacaaaatttaatcaatttacattcaactttatttttatatgtgagggcttagtcacatataattcaccacacatacatgcaggtggtggtgaagtcttgctggggacagggccatcaggtgggccagtctttggcccccattggcggcagtgcaggtcaattatgtctttccctaattttcagggctgcatacactagcactggtgtcagcaggtctatgtaagcaggtctatgcaattctgttgtccctgtgtggcttgcttgggtgttggcagtgacagtgatgaactgggtgggtgagtgggtcctctggctccaaggcagtgggtttggtggtaatagtagtggagggtcaatcctctgactctcaagccatctgtactggtgttggtggtggctgtgacaggctgcaatggccagtctctaggcttgcagttggtgcatacatgcgggtactagctgtggtggtagcataggttgagtggactcattttcaagcccctggaaatagtgctcagctgctaatagtgtaggtggggcaggatgatacacaggcccttgaagggtgtgcttgtgcactcaggagggtagagctacatcacatgggccttccctcagccccccggtagtgtttacagtcactggctgtggtatacaggggtggagtgatccccaaacccccaacagaatgtttagatgaaggtggcagaagctgcacttgcagcactgctgtggggttggggtggggaagcagaggttactttcagttttagtacacacgagcagatagctgaggaatgcaagtttcagccctaggtgacagctataaaccgggcagcctttcttcggggtgcttttaagcgtgtggcgaccctgctgctaaaggttgctgggtcactgtcagtgcctcatgctttggtcctagcaacagtagccaccagtggtgcctggctgcaggtgggggaggtcagtggcgttctaggaatctggagaggcagaagttggactctagggcaggatgcaaactggtggggactgggctctcaaaatagcactctgctgtggctgcttaggcttcagtgtgggtatggcacccattcttaactcccttcccagagcaatgctcttgccatccccatgcagcttcctatgatagtttcagtgcccatatgggttgaaggactctaccatggctaagatttcaggaatctgctgtggaaatgtggaccactggggagcatttgcttactctttctccagactaaggagcctctgcatactccttgccaattgtagccaagcgggctgcctcgctttggtctcctttcttgccttaggtgttttctgtcacatctctgttgaattccagcattttttcttaggtgatctattcaaagtgtcattatctactccttattttgtgaaggaggtgagtaccggatgctttccatcagccattttgaaggcgccccttcatctctttattcactgatcaggtacaaagacccttgaaaaatgaatgggttaagggcatcaacaccccacacaattgaaaaaccatacgtgatttttggctactccaaaaattaactaatatccttcccttaactagaagtcttactgataatatattcaattaacatataatcattctgtatgttacatgtattgtacaatatagttttacaacaaagcaagctagaaaaaatgttattaagaaaatcacaaggaaaagaaaacatatttattgtgtattaagtggaagtggatcatcataaagaacttcatcctcatcctctttaagtatgccaaggaggaggaagaagaacaggggttggtcttgctgtctcagtggtggtagaagcagaagaaaatccacatataagtggatgcacaaagcccaaacttgtgttttttaacagtcagctgtattttttctaaaaacgcttctcaggctatccaaacctaaataaacatgtatttattttaactactgtagaaactattgccatgcaatcatttagcaattactcatacaatgtcttatattagtttctgttttatgtgagcagctatttagatctacttttgtttaattttctgaaattatttaatagaagattttatactattggcatatagtaggcatttaaaaaatagctgacttattgcagaatcttctattttaaattttatttatattttttgattttttttttactatagaatatagtttcctgcatattcattacaaaaacatgaggtatgataaaagagcaaagtgttatatttaaaattaatccttcaaacaatgaatcaagtgtaacaatatttccctaggtcagaaactttaaaatacttaattttataagttaaaaagaatgttttggtaaatactgcaaaatacttttaaaattagagctgtatatttttaaacatctttttttcaaaaaagtaattatacatattttgagtaatgctcagtcatagcacagaatataaaacataatttttatatgacactctgatttatgagagcacaaattactttttagcattaagccagtgcaatcatgtgggtcaccttccaaatataaagaaatagggggaaaggaaagtgggcaacttagtaggctatgaataaggtctaaaagagtgtgttcttatatttatgttacaaaaataaagtgtgtcctttttgaaaacaaatcttaaatatattttcaggcagattctacatattgttctgctgcaaaaaatgttgttttaacatgtttcccctaaactgcatgacttagaactaaacataaaaatggtatttggttgctgttccaaatgttatgcaaaaaaaaaaaaaaatcaatttgatgggaaaactagacaaattagtcagtgggaattaggtttattaagaaatttcacctaatttttgttgcttttaatagttgcagttttaactgagtgtgaagaaaagttgccaagatgacatatgtcacatgtttcttcaattcatacatcctcaggcactagccaaaagccactgtatgtgtgtttttttcaaaacccacgtatgaaacaacagaaattcctttaataaataatgattgttatctactatgtatcagccaatgtgctaagcattggaaccctcaagaacgtcatgatctgcaaggaacatataagagacacaaatccagaaaaattaaaattaaaataaaaacgcatggcagtgatagcaacaggcacagtggattgtcgtcaggaaggacgtggggtcaaaagaagatttcagaaggaaataataactgaccacagttttagaaaatgggagcgagcctggaaaggagtggacaggtgtttatgcagacagagttgcacataggtagaggcatgggaagagaggaatgaccagatggtaaaatatatcctatatacagaggagcatgtaaattatcttcacagttgaaaagagttattttttaaaataaactcttctataaccattcttcaccatttttagagtaaaaaattgttgatttaaaaatgtgaggaaacacagacttctacataattgtgtactttgtttcacctaaatgcaggtgacagatagacctcagtgaggtggctttctttttaatacagaatttttatagatcagttttagataatggccacaggagtcattaagagccggaaaatggtaagaagagacaacactagcttaaagtgaatgcaaacacatactctttgagattttgccagatacgagtcaaaaataccttttgaggaagaagttctaagaaagtaaaacataagcaagaatatcttttttaaggggatatttggaagcatattgagcaagttattgccaactaaaacatatccaaagatactggatattgtccttgataaatgttctagaaacttttaggactgagaaatactagggtaagcaatgaagaaagagttggagagaaaaaatttaatggtcattttgtttgagatgagaatgaattttctcgtctgtctctctgtttctgagcacgctatgactgtatgcaagattttcctacttaacttcacagttttccttctattttattgttaacacttccattctcactaatgtggttggtaaaataagtactttaattatttgcttgcacattcaatattaaaataccatgctgtcttcagtttattatgagttcaattttcaagacactataaaaataatataacaatccattaaaagggtattctaaaatattttgtcattaggttattattttattatcttcaagtaaacaagaaatacatgagtaaccctcagcatattataaaaatgtgccaataaatttaaagaaaatttataaacataggaattctaataatttttctatatacatgaaggtgattattccaaattccattagattttctaaagtattatatattttgttatttttaaattctctataaacataattgtgaagccactttaatcaaataattagaaacaataatttgcaagcttgcaaaagaacacattacatatacatcttttaaacaattaaaatctaaagagtgattcctgataaagtaaatttagtgtaaacagaaatgcaaataaataaaactttcatttctatattcgaattgcaaaaaaatttgcaataatgaatatgctatttttcttgcttgtaaattatggtcaaaagatgtctgctgaatccatcacaatagtatcctaatttctcaactagaagaaattttagcaataaaaattaagtttagaatgataccaaagcttagattcttcaatacaaagaaaaaaaaatagtctcaaatcaatccttgttttacagatgaggaaaaattggatccaaaaatattaagtgatttgttcagttatccaggtaggaatttcaggatcaaaacaggaattgggtttgttatgtcaaatcctatgctaaagcctgtaaataagcttcttccaggtcattaagtcacctctatgaaagtatttatctcagtagttcatatgatgacgatcctttttaaatgtaatcaactaaggtagtactccctaaggatagggttaaacacagcaggttctcaggacaggctgctgataaatagacagagatctaagtgtgtagtaaggaagaacagtctatgactgagttagttaatggacgaagtataatccataggaattttttatatgcctttgaattacataatttattaacaaaacactaaacaaaacataaacctctctgaagctacaaatgtcacatgactgaaatcctggcatattttgctaaatagaatacagtaaacaatcaacactgattttgataaaatgtttcgaggtttttcaatgaaacaaattctttgaacagagtgaaaattaatttttacagattatatcaatacaaatgttacataaaacaatttcttaaaaggaataaaaactaagttctacagattatataaatacgtccaacctcttttacatggaaaacagtatgaaatttagcctattctgatatgttttcacaattttatataatctacaacttattctcctaaacttttttttaatgttagacttttaattgggctacttacaacaaagaacaaaatgttttatcatacatttttccaagtattttatataagtgtaattaagtttcatcatgcaggttcaagtcgcattgccacgattaagtggctgtgaactattgatttgacttatttaacatttcagtaacgactaatgccagtgattattgcactgtatggaagttgcaaaaaataattataatattcaacgtttattttacttgaaacttaaaactttatttaagaacatgaccagccatcttaatttaccttctaactaaatcattgtttgagttgtatatgtttggaaaatttatgtaacatttttaagccttaatatcactatttataaaattccgattacaattcttacttgcaagatccctatacatattacagattatgcatgtaaagcaactaataaagtgtttggcacccaaatcttaattcacttgcatttaatcatgctggacctatacagacctttaaacagtacagcaattataatcatattatatttttttctgaaatatatcttatttatacatatttattcagataagcaaaacataattagcagaaataaaaatcagtgtcatttattatcatttttgcattgcctctgagggcaagagatttctattagaaaactggtatctgtgatatttatggacatagctgcaggtaaagatgatgatgatgattgtgcaggaatgccatatgaattatttcaaaagtggtaataaacttatattgatccatttttacataaactgtcaacaaattcccccaaggccaggccttaacccattatatatatataatgaaagtgttaaagcttgtagcataggtcctggaagtgccctataaatgtaatcactatgcatattggatgtaatcactatgcatatgatatatatacatatatgcatatatatatgcatagtgattacatatatatatatatatgcatagtgattacatttatagggcacttccaggacctatgctacaagctttaacactttcattcataataagttacatggtctttttataacactatgataaggctattttctctacttaataaatgaaatacttaagtgcctgactgaagattacacacatagcataaccagattgcaaatatagggagtctgaatccacaaggcatacactcaaggcccctcatgctgcctgatgttgctgctgtagaaaggacacagataaatagaaagtaccatgactgactgttgtctagagttctttatctctgtattttgaaatcaacagattatctaatggattaagataacataatcattttctttcagatgaacagctgtgatcaatttagcaggtggtaactttttttccccagtgaaatgggaaaatgttagggtacattacaggtaataaggtaaattatttgataaaattttcatttcagttgcatatatgcatgtatgtatactggatcattatataaaaggtgtttcttttaggttataatccaaagaagttttgaaagctgagtttttttaaaagggtgatcagaaatttggaggaaagacagaattgtttgttcataacatgtactttcaattttgtggttatgtttcaactctttacactatttaccttcagacttctagaaaccttttctacactccaggttctttttgtggtcatctgttattctgtggtcatctatgaatgaacaagcatacaggcccatcatggggtcaaacctgtaatcctgattccatcatcactcttctctcctatcttcaatttgtcatcaatttctaaagatatattagatttgcattcttctttccagtatcaaattttcattaatttatttcagacaccatttctctttccttaatttctgttccaacttccttctttgcctccagcctatcttgtttaatccattctccttagtgctactgagggagcctcctaatccataaataggatcatgttacctccctgataatttatttacatctttctcattaagctgacaataaggtgaggctcttcatggttcagctgtaacttactccagccttatctctcagaactcatgacttaaatactacaaaatagttcatgcaaaaatctgaaattttctcagagtactttctgctccatttttctgaaaatgttctcccttttcctttcctcacacatactcctctttggccaattcctacatatcctttagtcctcatatgataagccattgctcaggaagccctcctggatcctttatttcttggttgggcatccctattagtgttctttttatttttattactgttcctataacaacactcatcatgatgtgctagaattgcatctctacgcatctgcgtccatcaccaaacagtaaattctttgagatcagtgagtatgtgttttgcacacagagtatggcatagggcctgttgtgtactacattcttataaagcatgtgtgttgaatgaatgaacgaatatattttttaacttttattttttcttcttgagacagagtctcactctatcacccaggctgatgtgcagggatgcaatcttggctcactgcagccttcgacttctgggttcaacaattctcacgcctgagcctccccagtagctgggattacaggcgtgtgccaacacgttcaactaatttatgtattaatatattttagtagagacaggctgttctcaaactcctgagctcaagagatctgcccaccttgtcctcccaaagtgctgggattacaggcatgagctactgcactcagccaaataaacaaataatttttctttttaaaatgaaatacttacttggcagagaccacctactgttacgcaatcattctatagtctttaaaatctaacactaatttcaggtatcaaaatttatatttttaaatgtttatatatttattgtcatgtgagattttatggtggtcaagttcaaagggcccaaatatctagtcgccctaataatattttcagtgtttttcaaaagcttacagattttgatcatttactaatgacactccactgctcactcaaagctacactgactagcacaaatatcctgcttctttgcttagagtgaggctgctagttggcgcattttgatgagaaattccaatcggcaggcatatgcagatttggatattttttaaaaaatgaaataagacattttaaaagtaacaggtttacagagaaaaagtttactaaaacaggtcctaaggaaaaagactttgaaaccagttacctagcaaactataaaagctaaatgccccaaattgtaatgatagccagttgcaccaaaattcaatgttattcatattttatttttcaagataaaaaagttactatgtattgccaagtttgaaactgaatgctctatctcattcctttaagccaaatctttacaagaaaaggatttctacttcaaaagaaagtgacacaatactcataattaacataaaaataagcatttgcctaatttcaggagagtacattaagtcattagtataagtggtgttttgctttgcactctctttacattattccatctctttccatctgggagcaaacttaacaagcaatttaaaaataattggtgaattaaattgtcattggtggcctcattttcctttttcgcgtatgtcttcaacagacttactctagcagtaccattaatacagctgcggtaaaaaaaatctgtgcaaatggcatgttataaaattaaatggtaacatattgtgttgcttgggatcacagtcaagtctagaggcaaaatagaaataacagatgcaatacaaatgtagagttattatgtgtgtcatactggaatctagcctcacaaaattagcacaatatgctctacctgaggataagctagggaaaagaaaaaaaaaaaaaagaaagaaagaaggaagattgtgccagcaacataaatggagacatagaaacattttaatcttaatatggtaatacgttttgaaaagaaattgtacatagattttttatttaaaatttcagaccaagagaaatgccttctatattaatatagttctccaaaatgttttttggatcatgaaatttctgacattccttttgaatttagtgaatttactagtttgaatggtcctaattaaattcttccctaaagctatttacagaggtacctcctgattttattagtcctttagtgatgctgcatgtctggtttggagagtaacttccagcaaatgaatagtatttatgcttaaaacttaaatgtgtgtgtgtaacatattgaatacgtaatttaatataatatctttaatactatgctttactaattatctaatttatgtgtgatacatcatatcatcatatagctgcctgggtttgttttgaattgtaatccaaaattaattatctcaattataataacttttatctttacattaaaaagtaaaagatcccttttcctcatcctcatagaaaaaaataagaatgttaaaaagaatcaaaactatgttttttggtgaaattactggctccatttatttgccctcccgctacttatgcttttttccatataactttgcagttccttctctaaaaattccctctacttacccgtttctgaacaaaaatatctcacttctcacagaaaaaaatgagggatttgaaaaaataatactgttaaattatataaacatatagtaagcattttcttacaactgtgagtgtaaatgatgtcacattgcatttactatccaccattcactacctcacttcaccgcctcagctaccacaactctcagaataagtacccatctccagaaaaaactcttgagtctgtttttagtgatttgatttagatgagtgttaaattatttgcctcgaaatataattatgactcactagagttgaaaataaaaattactattataatgagttctatgagctagatgaacaagtctacacaccatttgtaaagtacagtggttttgctagctagttggtagaatcacgatcaagtgatgccatcttggccagccatcagcaaactgtaatagctgatactgataattatgaataacagcaaacttgaaaataattacataattaaatacttatttgtgtaatgagctgcttttagaatctatgccagtgggtcaagtaagaagaagtaattggatcagtaggagacatttagtagttaagagacttgcttgtgcacacctaaaaactcaatggaggttaagtagcatatcactgccaaagagattctctagcactggtgggcctcagcaaaaccgtaagtggccttgtgagactgtgggactttagcacattactgcaatagactcataatcttatctaaatcaaagactctgaaaaaaagtgttatttgctacttaaaatgcaaaccattctacttcaaaatatatagaggagaaagaggacttgtcccaagataaaatgtgtcacatttgacaactatcaaccttatcagagtctaaaacttatatgaatacatgctgaaagtggatgctcttagttgtatttatccccattattaaacctaaatagagaagatcaaagccaaggactggaattttgaattattagtagctacaaatttctttcttaaagctttctggggcaagtgattgtcaacttcatagagtagaaaatcaaattaaaatggaataaatattattattctgaagacaagtgttccttttttcatagaaacattaaaagtatttgctaagtatgataaaacacgtatttctagaaaacagcagatataagacagtgattttcatttttttctatcgacagtataaacattagtatagaagtatgagagcccgtattgctgatgtttggagactaacattccttgcaaagagatgtctatgtcctttccaactctaataatctgtgattctataatttgatattaagcgaagattttagtaacacctaatttctgaattgaaaagaatttttaaaattctcacccacttactcaatacttgattttcttctatatgaatagcacagtcatatagttcatgcttgagccaaatttatattagcctaaatacatttttgatgaaatatttttgtttcacaaaaattcttatattacaaaattttctctaatatatatatgcttactgcattttaaatcggtctggcgctactggaaattgcttcatattaaattataagaaatttaataatcaataataagtatttggctgggttaaccatatttcttacataacaaatgctgataaatatatgtgtgtgtgtgtgtttgtgtacatactcttgtcaaattctaattaacaaaaatgtttaaaatatgttgataaatgcaaataaacattcacaatattattatgatttcatacatgttttgcatcaaaaatggcaacttgctattatattaatagctacattttaattggggtctcactaatctagaggctactctaatagcttccatgtattgaatgcttcctttgtctggaaagatagacttttatatgttaacattggtaatttctgggtgatgggactgcacatcattttatcttgtaattcttgattttgatatttctacaatgaacaaacattaaaaacacgattttaagatgttataaaatatatattatcctatttctcttttatttttatttttcaatagtttttaatttttatacaagctttggtcagtgagtaatggtacttccacagagtacataagatttcaatgtccaaagcaagtcagtctgtattgcatatattcagagctccatcaagtaaaattcaatgttaatacagaggtaagtgttaacagagaggaacaatgaaaaatcctatttaggacctgacttcaaatctcataagggatcagaaataccactgtactgctgaaagtgttttcctaggaaaaacagttttcatagcatagctcgctgagaactaactgatttttggcaattagatcacccatttttgagttaaaaaaagataacaattgaatatcatttgaacttctaatacctattaagaaaaaagttatttaaaaatgtttggaatttttggttggaaatctatgcagttttgaaattaaaatatcgattgtgagaatagtctcattcaaagttgaaatacactcttcagtaacaaaataatactgaaaagggtgagtgcaatgacaagaacatcatatgaacagatattatattctggaaaaagtataaaagcagattcaagtgatagagattgatatcccaattaaattaaaagaatgcccagaaaatcagcataattttcaataaaaatgatactttattatgagtaggtaagtagagagtgtatttatttagatgctccccactggtgtccttgtgaaaatggatgtcaattgtgtcaataataagcaatgctacttgcacctcaatttctcagaaggtgttcaggaaaagaaggtaccaggtaccttagcaggcaatgggaatgaggttgggatatttgaaaaataaaaaagggaaagattaactgaaacacttgtaaggagatttagatctccaaaattcttctttaactcacaatcaattgacttcagatttgcctatgcccatatatcacccctcacacatcaagattagaagcaagcacatatagcagtggcgaggtagtgaatagaacaaagtagccatttgtagcccagaatcagaaatgtaggaagtgatccagagaatagagcttgcatactgactgcagggggactatgcaaggagtaaaatattaatttctaggcaggtaccagaatctaaacaatgataagcaggtatatatctaccagctatcagaaacaaacatggcagagattcaaagtagagagtcaggcagactaataaaagataacagtagtcaaacagtatagaaacaatgtaatgatcacaaatgattctgtttctgccatccttcttctaaaattctatatgtgacagaaagtctaaaatgaaacaaaataatatggaaattataattaaaaattattcttgactgagttacagtcaacatgaacatagggatatggacaacagcaacattagaggggtcatatttgcagggtctttctggagtcaagtgaatttggaattacaacatggtatgtgtttaatgctcagcaattatgttatgagcaaacaacaagttatattggtgtgggattttgagcaaaattgctttatttattttatttattttatgaagggagaggaccaaattttaaatttcagttgaggctttccatttgcagaaatggtagattttcattttaggaatcttccattagataatgtcagctcctaatacttctcattctcttgtaatttctttttttattaaattgagattctcagtgaggtcatagtgtaatggagaaaaaataggtctgcgagaaaattgtgatgtctttaccaacagaaggtgataggatcgcaggtgataaaaacaaatgaaataaaagaaacagaaaacctaaagaaatcaatcctatactttgtccactccattttttttctcctttatttcttccactttttcttttgaaaggtacccttttagttccaaaaatgtagagaagagtatattcattattttagtttttgttttctttcaattgctttaaaatatttttctatttgatcctaacattcaccctatcaaaaagatattttgaatgttttgacaaataagggtgatgatgttcagatttcagtgatgcacttagtaattagcagagcctgtatccaaacttgagtttgacacatttttaatacctatgctattccttacaagctatgttaggttatagatgatttttcccactgtccaaaactaattttttatgtccttcataatcttcagaaatgtgttttgccactttaaggaggaaaaattgtctgtaaaatccaaaacagcaattttgctgttgcaatggaacccaacgagtgatgccagcccactgaattgaacagaaagacagtgatgattctttgtgaagagaaaaaatatacatacacctctataatgtgaacagagcataataagtggcatttttgcaatttggctgcttgacatcctgtgtgaagttctgaatatcctttttttgagcataaagcaaggacatggctttttttccccttcatgcactcaagggactcactcaaacacctaataatgctgttcaacctttaatacattcataatggaattccccagttagcgtgttttcacttgcctgggtagaggcaccagctacaacctcttcaaatacttaaaagaaaatactgttcacattaattgtaagaatcttcaaaagaatgctagaatacctcaaatggaaaattcacaagtagtagcagacaagaagacatagagcataggagtgaatagtagctataaatcagatacaagccacattaatgaattgagataagaagtgtgaaataaaatcgatccccgctcatcagagaaggaggagagggttatttttaatcttgggatgaatttaaaatcaataaaaaagtataatagtctcataaacagaaatcgaacgacaatgcaaggagttggaaaaaaattaaaaacaaagggaaaaaagtacaccaatttacttcaacagttacaagaagccttgtttgatagtgttaactgtattcataatgaacatgtgtatagagccttttaaaacatcccatcaagcactgcacagctgaatgtgaccactcaaataatatttggtgaacataaagaagaatgcccataaataataatcttccaagtcaaacatcttagatctaaaagttaaggctacaggaagagtgagaactctttgtgtgaagacactcataattaacaatatataagcaactacataaggctgaaataggcagggattgtgaaattccacaatatgagaacacttattttcttcttttcctctcataaattttgttcagaataccaatttggggaatcaagcagaagtaatccctgctaatagtgctgacactatgtcaaaagttttgagcaataaaaaaaaatctccgactttctatataccagaaactttcattttaccctagaaaatcaaaggacccctttaactaaaaatgtgtttctagaaaagtgttccaaaatacgtcatatggggatctagctcctcagccaagcaattgagcctcttttccttttgtaagcagcatatcaaagtaaggccaaagttggatactaagaaaagaatggagttacttatatttaatatttaggatacaaaataagagcaaagtataattgcataatgcttgctacatttcaaatttgtctccttctggaaggaccttcatctctgctccctgaaagccaaaaacaacaggctactatttttgtttttcatgaagctagatattagccagttgctagacttcaactgtgatatattcatgagaagacacaagctggagaatttcagcctagtctaagcaggacagatggagttgctttttacctttatacagatcacgagtttttagccatttatttttcaaaagtctagccttcagcagggagcatccatatgcgtgtgtgcaattcacattgagttctgaaacaagacttctggtttatccataaatctggcaaaataaattctcgaggcatagcctggcaacaaagaacttgaataaattctttaaagctcttttgtagtgaaataatattagaagttggggcaaagacaaagccatgagaggtgttgatctctaacagttttatgaaaagatgtttaagtaacttttcagtggcatcaatttaaaaatctagtcaatgatgtaacgttgaggatggagtttgctgacttttatcttccatgagcagtcagactaaccaggtgttagtaatttgaatctaagcaataaagactgtgaagccacattgatatagttaccataaatgggaatcagtgagtcccaccagcgtcacagagaacaattcagtcagtagcttgggcagggccctgctagtcattaacaactccattaagctaagacagaaactggaagcattgcccagagaggtaatcagaagcactatgctcccaagactttccttaacaggtgctcattttcatcctggtaagatttagaactaagcatatacatatttaagagaatcatattagagtatggatatttgaaatctatcaatatttactattttatattcttaaaatatttcagataatttgcctttttgaatcacatttgtacttatgatgtataattaagtaatttacatacagttatattaaacttagatctattaatttcacatagtagaggctactagttattcccaaatatgttcattcttcctttctttcttcctttcccttccttccttcctttcttttctttctttctttttaaaatactgctccttcctgtacactgattttttttcctttcttgttagcagtaaaaatcttgattttttttgtaagtctaaaagactgtaaaaccttccattctctgctcagttatttgtgatgttaggactgagttctaactacttaaatgtatttatagtgctatataaaacttccagaaagcatctttgggggaacaggggcttgcccttttcttcttctctccattctctttcttgggactctactttaatgattccagtttaagcagccattatagaccatgagattaaggattagaccgtggccatggaataatgttgatctgggaggaaggtgagttaatgaggtcttcagagagctgcagtactagctgctggtttcatatatctagacttctttcataaaacgcaaactgccattcatacttgtcattattatatatttgggaggttctatatttcaagaagctaagccatataataaatagtttgtatttaaaaagtcagagtattttaaaaggatatatgcataatggaatactattcagccataaaaaggaaggaaatgatttctttgcagcaacatggaaggaactacaggccataatcttaagtgaaacaactaaaacacagaaagacaaatatcacatgttttcacttaaaaatgggagctaaataatgtgtacacatggacgtaaagtgtggaatgattgaaaatggagactcagaagggtgaagaatgggattggggttcaccatgggaaattaattaatgtatacaagtgtgtgttattctggtgacggatacactaaaagccctgacttcaccactacccaatgtgttcatgtagcaaaattacactgttgtcacataaatttatacaaataaaaataaatcactaaaattacaacttttcccttattagctttatgaggtttatttaagtactcatgagtggtgtctttcagtcaaaataactacaaaggaaattttctatctagatttatataactgatataaaatatctctatagatctatccgtacatcaatatctatcaattacttctaaaggttattaactatacagttttctaaaaggatccacacattaatcaagtccccttctcctcttaaagtcatagtcaaaagttgttagaagttgctataaatataagtaaataatatggttttgtaggctaaacccagatagtaaaggaactaaactaatattgtaatgtcctagcctttcattttaaacaaacaataaaaatgcatatatacacaaaactgttttcttatgcaaaatgctgataagcattttttctaaaataaatcaaggtcacgtgatcaaagtgaagcttttgacaaattagactagtttgataacctgggttttaaagaaactgtatcctttttccttgattttagaagagaacagcaaaagataattataaattttattttaaaatataatgtgtatttttctcactaaaagacgagttaatatgaaattcctaaacttttcatactgttttactattgagctaacattactttcacatataagtaaaataaatttaaaactatgttttcaatcaaattagattataattttaagaaacatttttatagtaatggaatatagttttgaacttatattaaacccaaattaattggatacttggattatttttaactaaagtagaatattaaaatattggttaccagcgtaattttgacatacattcctttgattcttatttttacatgttatagagtagcaataacttagggccgtgtttgaaaatgtcttaatgtttgcctttttaaggtatggtaaaaaaaaaaatgtgtatggccgtcagatatcatactatatgtattcattagcatagctgtagtgttagacaaatctaaaccccatttcactccatgatgtagaagttaaatactaaaaattatgttaatatgggtaatttaaaatatactagaatcagtactggcagataagaagaattgtgtatgaaaagaaagataatgcacttttgtttattaagggaaaatgagagcagttttatcctaaagtgaagtatcagttattttcagatgtgaaatagaatagtaaatgataaaacctaagcaaatacaggaagtcatagtttttggaaacgagaatttaattatcttagattataatatcaaaaaataaggaatctcaaaaaatgtagtagaatatgttaaaattttcccaagagtaggttagttttcatggttggtcagttaatactgaaagcataaagaagcttgtgaatcttttactgccaaatattaacagcgcaaaattagactatttctattgaaataataaattaatcttgaattacttagtctgattttaacaatatataataattattttccttccatgtaaccttctgacatgaatggctcaccagagttgtttcctgtgtgttgtgctgaatttattatgccctggatcaatcaattctgaaggagctaagataccattaaattgggttaatactttctgtttatttaaaatattgtattttcccttgattaacttgtattcaagccatgaccttttattgttctcaaatactgatattaatattctaatcaagtgaatagatccctctgataactcttgacattttcttctcaaaattaattcctaaatttagaaaaatacaatttagtgtgccttttatacctaatactatcttcgtgatatctcagatgatcacagaaaaatcacaaatgtttgtcttttactctataaaaaagagtaatgctgaaaataattatagttgttggatatgctcctcatttcttacatagctcaacactatgatgagagctacaagaggagttgttaaacaaaagccttctctaagatagttttgttcaggaaaaacatatattgataattctctggagtgtagagtctctgaaatacatacatcatacacacatacaggcatacattagagagaagagagagatgtacatatacatattctggagactacattctggagatttataaatatccttatacttatttttaacctcagaacataattactaaatacccttatgactaaatatatattataccttaatagatcttactattctttatccttatgtgttggtcctctaataaatttgccatagccatttaattctgtctttgccaggttaagatttgcttgcttgcttgcttgcttgcttgatttcaactgtcctgtcttcaatttcaaatgaggaaaataatatccacaagtgcacctaggtaaaatgtttagttcaataactggcatgtgatcagaattaaattataaatctgatcctaaaatgaaaactcaaaatgagaaagcattaggattatatttctgcttctctgacatgaacactttataattaattgaagagaaatgttgagtggctaacagccagaggaacaagcatggctgtcaatgcatcttgactttctaattcctcatacaggaactttaaaagttagcatatggctgagcatggtggctcatgcctataatcccagcactttgggaggctgaggcgggcgaatcacgaggtcaggagatcgagaccatcctggctaacacggtgaaactctgtctctattaaaaacacaaaaaattagatgggcgtggtggcgggtgcctgtagtcccaactactcgggaggctgaggcaggagaatggcatgaacccgggaggcagagcttgcagtgagctgagatcacgccactgcactccagcctgggtgacagagcaagactatgtctcaaaaataaataaataaataataaataactaataaataaataaataatgtctcaaaaataaataattttttaataaaaaaatttttaaaaaagttatcatatgatatgtcctcaagtttatgttgaaaatgtaaatcacaggtttttaaactttgccacgtaacagaatcagctgtataactttaaaaacacacatatgccatcccacccgatccgctgaatcagaatgtctgaagtagagtattttacaaatcttcatcaaaaatatcaatgactagtaaaagtcaaaatactgatcatattaactgaatatttcatatgtagggctttttgtcaatttactattttttacctgaaataaatgattttgtgaagatataaaattaggagagaccattttacataggtgtattccaaaaatatcacctttccttaagtcagatactgaagtaatgctccaaaacccaacaattacatgttactccagatgcattagctttaatggcattgggtggtggtttaatttttagcccaccctggccagggatatttccttagtgacagcagtatggtctgcagcaaatgtgaactttaggaaatgcactaacgtataagggaaaggcagctatcagcattcagtcttctctgaaggtaagtatagcaaattaagagagatgtagtagaaatgcagtagcagttaagggatcaattcaaagttatcagaaaagggtatcttgtaggacaagttcaaagctgaagattgaattttaaatgttattgtgtgttacatgcaagtctcttctcatattttaaatttcttaacaaaatccactaacaaagtattatccctatgatgtctcaaaaaaaaaaagaaagaaaagttaaaaaaaaaaaagaaatgaaactccaagaaatatgatcaaattcacacagttaacaactggaaaattctgaatgtaaagatagctttttcaagtatctaagttctttcttcaacagtccacatagttttaagaaaccaaaactacattaccttgtaacttcccaggttaggtttatagagtagatgattagaaagtaataagttcttaagaggttaagaagagaaatttaacttattcctttgatattgctagggaagaaataaagaaagcagtggggacaatttcttgtagttggaaccccttatatcattttttatttttcatttttaagagcaatacagagaagattcatcaatctatgttcaggtagtaattgctttttactactttaagctcatctgtaaaaatcaaagtgaaactgactaggttttacgatattttctgaaaagtcaaaattctggtctttgctatcccttttaggaatatatggtaaaagtttccctatttgctcattactgattcatctgcataatgaagagttaaaatcttattgagaaatgccttgcaatcagttgagaatctaattgtacctgtttggaaaggttagttacaaaagcacccacggtgatccaaacttatattacacatcctctgattatcacatttaaagtaatatgtcatttgttattcatatttagtgttacaactctttaataaccactcaatctatttccctttaaaaggacagctgcaataacagcaaaattgtaaaccttaagtgtagcgtaagaattcaaggtgaaacacattccaagtagtagcttaaaatgtcagtatcatacatggctccctgaataaaagaggcaagacgtgtcaacctgaacagacattcatctctttgcactaaagtgagagatacaaagacctgtaccactcccagtagagagatgtgctgagacattcaagagtcaaagacgctcagctgtctgaggcaaatactgtgagtcttcaggtctctgtaaattgttctacagctgtgaaggattcaaagtaaaatttcagaatgatcataaatgaataaaatgtggtggattatagtagttactgtctttggctgtccgtaatttattatgttgctacttcttgtaactgtacagtagttctcctttattcaagtgcttgctttccatggtttcagttgcctacactcaactgtgttccaaaattattaaatggataattctagaaataaacaagtcataagtttcaaattgtgtgccattctgagtagcatgataaaatctgttacacctctccattccttttttatcacaagaataaggatgagtacagtactataaggtattttaagagacagactacattcacataacttttattacagtgtattgttataactgttcaatcttattattagggttgttaatctcttactgcctttaatttataaattaaactttatcccagtgtactagtctgttttcatgctgctgataaagacatacctgagactgggcgattcacaaaagacagaagtttaatggacttacagttccacatggctggagaggcctcacaataatggtggaaggcaaggaggagcaagacatgtcttacatagatggcagcaggcaaagagagagaatttgtgcagagaactcctctttataaaaccatcaaattttgtgagacttattcactgtcactagaacagcaccagaaagacttgccctcatgattcaattacctcccactgggtccctccctcaatacatgggaattcaagatgagatttaggtgggaacacagtcaaccatatcacacagttatataagtataggaaaaatgtagtataaatagggttcagtattatccatggtcttaggcatccactgggggtcttgggatatattgtctgtggataagaggggactaatgtattttcatttctctgggggtgggggcaaacaaaactcatagaatggatagattatggtgcctcctacacctacccaaccaagtgaaaccagcattttacatcagagtaccttattttcactgaacacagatattggcatattgtatcctgtcacccctgcatagaattttctaaattagaagagatggatacatctattttgctctttgattgtgaactttaaagtgtatgtttggagagaaccactctaaagagaaaacatctagagtgggagatgacaatcttaaacttcacccaaatccagtgaccctgaaaaaaaaaatgaaggttaagaaactcccccacccgactgtaaactagttcagccattgtggaagtcagtgtggcgattcctcagggatctagaactagaaataccatttgacccagccatcccattactgggtatatagcaaaggactagaaatcatgctgctacaaagacacatgcacacgtatttttattgcggcactattcacaatagcaaagatttggaaccaatccaaatatccaacaatgatagactggattaagaaaatgtggcacatatacaccatggaatactatacagccataaaaaatgatgagttcatgtcctttgtagggacatggatgaaatcggaaatcatcattctcagtaaactatcgcaaggacaaaaaaccaaacactgcatgttctcactcataggtgggaattgaacaatgagaacacatggacacaggaaggggaacatcacactctggggattgttgtggggtagggggaggggggagggatagcattaggagatatacctaatgctaaatgacgagttaatgggtgcagcacaccagcatggcacatgtatacatatgtaactaacctgcacattgtgcacatgtaccctaaaagtataataataaaataataataataaaaagaaactcccccacccttttgtattccagagaatggcttactgcaaagaatcaccctttcccatacaacttagataagacccacagatggatcccttttttatctatgaaaagatcagacacagatcctccaaattcacattgttgcctcataaatgattggctaaactgttttttctccactgattaactggaacaaaatagattttaaccaatttcggttaagtttctctctttctgccacatctctaaactttgacccatcttcagcctgaatcagtgtagcaattctccggagattaggtaggccgcagagtaaaactttctctgctctatgatgcagccaatcatgccaccctttcatgccacatataaccttacctacttctccctagaaaagacataccctttttgcctaacccttgtgaggctggcagatattatggtcatagtttttttctctattttaatagtccctttcttcacctcacaataattcttttgaatagggtctctctttgctaaatccagattcctctttttgactttgaaaatgaaggccacagccaaggaaagtcagaggcaaggaaggacaagaagtaaaagaggatgtcttggtggggttgaatccattgctcaattctggaggccctactttatgcagccctacagttgtctaacccacaacctttgactttagcatggagttcatgctctgatagctttcaactaaagcagccattctctcctctccccagctcttttctttctctgttgatacagataatattttgtatttgagggtctgaaacttttcaaaattcaaatgtcatggattgaaactactgtccttgcacagagtgtgagaatcaggtggtgtggggggaagtgctaataatggtctatgatccccagaaagcaacctatgttctaatgtaatttctacattcatattaaaatttagagatgattttatgttaataactcatctgcaaaagtgcaaatatatgtggctatatataatgtatatgaagcagtatgataaagtaaggagatatgtctcatgtagcaatgcaaatttgagtttaaatccctgttgtgtaatttttttctaaatagcttctgcatctataaaagaaaatatatctcctttattaagagattgttgtgataactacatgagataatactgacacgttttacatagaactcgatccataataagtactgaataaacaatatttgctactaccatttacattctaagtttaagagtagcattcagaaataagagaggatataatttccttgagaagaatgcccttgataatctctggtccttccatagagataataaaagttagagaaaggacaaatggggagcttttcttttttattcatctcatatttaaactttgtaatcacctttggattctctcttattaaccacctctaacttatcttcccccatccatgcaatatttactggatctatttcaggtctgtgtccaaaactttagttttctactctttgagttcaatgtcacattacttgtctctcaaatggatttcacaatagtctcctatttggtccttttcaagtcagattttgctttcacacactccactgaatgtgctctcttcttaataaaaaatctacaagcattcctctattactttaaaatcatttcagaaatcttaagaataggactctgtttcagataagggtaaaattctggacttcaagtaaaacatgaaaactagattaaatttcaggttattgtttctcacaggggaaatatgatgggaggattgtgctttacatatccttggaaagatgtttgccttgggatgttttttacccaaaacggtgactatagttatgttacctgcgactcaatatgcattcttcttttcttcttcactagtattacttcagtttggtcaggggctggcaattttttcaatttaaaatttcatttcctagatttacatttccatgaaactaagtttccaagtggaaacttccagtttcctggagaggaagtcctttggagagagttttgttttctttatgtagacaccaccactctttccttcttgctgcttccaccttcctcataatgtctgaaattaaggtctggggttttgagatacaggaactattttgcaaccatgaaacaagtcacacattgaagatggcacagttgaaagagagaagctgatactaggacatttgtgatagcatcaagccactgcatcacccagagctgcccactccagagttcattcaactatacaaaacaaacctttatttgataaagctaccatctctgaaggttttcttttcatgcattttatctgaataccaattgtgataggatgcccaaatagttttcaccttttctccaacatttatactaagctcaactctgaacactgcgatgatagaaatttaaaacttgagagagcttatctcagcctctcaatacttcccttattttaaaagttttaatggaaaaatttcaaacatatatttaaaaatagtaaatactatgaaatgcagtcacttatccattgcccaaactcaagattatcagcttacgaccacccttgttgtatccataactttacccgttctgtattattgtacatagagagggtaatgtatgcctaaacacattatcacattaccaaggaacacttattaacccacgcctcactgcagtgcactctcctgcagtcccctggcactggaccatagtgcttttgttggcagcacttgtgggagtgttactgccagtggacttggaatatcttggcctttccagcacatcaagcaattgacctcaaggggccagagaacaaagccacatcctggtccaagccatccagggttagagcaggaagcccaggagtgctgagcttagctttagtcccctgaaagcataaagaaagaaagccaattgactaaacccaatttgtaccacaggaaaaaaaaaaaaaccctcaagggcaccaaacaatataaaagcacaaatccccatccaaaggaaagaaacttcaaagattaaaagaacattagcccccacagctgagaaagaaccagcacaagaattctggtgactataaaacccagagtgtctttttacttctaaatgactgcactaactccccagcaatggttctcatgcagattgaaatggctaaaatgacagacatagaatttggaatctcgatgacatgtaacctcaggaagatacaggagaaggttgaaaccaaatccaaagaaagcagcaaaacaatccaatatttgaaagatggtacagctattttaagacagaaccaaactgaacctctggaaataaaaagttcactacagcaatttcagaatatgattggaaacaataataaagcattaataatagaatggaccaagctgaggaaagaacctccagggcttgaagactgtaccttctaattaatgcaggccgaaaaaaataaagaaaaaataattaagaaaatgaacaaaacttttgataaatatgagattatgtaaagagaccaagtctatgactcattggcattcctgaaagagttggagggagagcaaaaaatttggaaaatatatttgagaatattgtctatgaaaatttctccaacttgctagagggggtgacatgacaatttaggaaactcagagaaccccagacagagaatatataagatgactatcgccaagatatatagtcatcagattcttctaggttaacatgaaagaaaaaaaatattaaaggaagctatacagaggggaaggcaacataaaaagggaacccaattaggctaacagtggacatttcagcagaaactttacaggccagaacaaactgaggtcctatatacagcatacttaaagaaaagaaattccatctaaaaatttcatatccagccaaactaagcttcataagtgaaggatgaataaaatctttttcaaataaacaaatgttaagggaaattgtaaccaccagacctgccttacaaaaggtccatcagggagtggcaaacatgtaaagaaaagaatacctgctaatacaagaatgcacataagtacatactgcactgacactacaaaggaactatacaattcactctacattaataaacagctaacaacactgtgatgacataaaaccctcacatatcaatattgaccttggatgtaaatgggctaaacacagaatggcaagttggataaagaagcaagacctaatggtatgctatcttcaacagaaccatctaacatgcaatgaaacccataggctctaagtaaaggaatgaagaaatatctatcaaggaaatgaaaaacagaagaggcaaagggtcctattcttattacagacagaacagtctttaaacctacaattattaaaaaaaagatgaagaagtacattacataatgataaaagattcaattcagcaagaagacttaactatctgtaatagtctgttcttgcactgctataaagaaatacctgaaactgggtaatttataaagaaaagaggtttaattggctcatggttccacaggctatacaggaagcacggctgggagggcccaggaaactttcaatcatgatggaaggggaagtaggcacttcctcacatggccagaggaggagagagagtgaaggggtaagtactacacacttttaaacaaccagatctcatgagaacttactcactatcactagaacagcaagggagaaatccgctcccatgatccaatcaccttccaccaggcccctcctccaatattggggattacaattcaacatgaaatttgggtggggacaagaatccaaaccatatcactattctaagtatgtaagcagccaacaatggagcatctagattaataaaacaagtacttagaaacctctgaagagacttagataaacatacaatgataataggagacttcaataccccaatgacagtattagacagatcactgaggtagaaaactagcaaagatatttgggttctagagtcaacacttgaccaaatgcacctaacagacatctacagaacactccacacaataacaatggaaaatgcatccttctcatctgaacacagaatgtactctaagatcaaccacatgctcagctataaagcaattctcaacaaattcaaaaaaagcaaaattataccaactgccctctcagacaatagtgcaacaaaaatagaaatcaataccaagaacatctcttaaaaccataaaactatatggaaattaaacaacttgctcctgaatgacctttgaataaacaataaaatttaggcagaaataaaaaaaattatttgaaactaaggaaaacaaagatacaatatgccagaatctctgggacacagctaaagcattgttaagaggaaggttcataggactacatgcatcaatcaataagttagaaagatctcaaattaactatctagcattacaccaagaggaagtaggaaaaaaagatcaaaccaacctgaaagctagcagaagtaaagaaataaccaaattagagctgaccagaatgacattgagatgtgaaaattcacacaaaagaaaaactacggaaagcagtttggtgatttctcaaagaacttagaactaacatttgacccagaaatcccattactgggtatacacacaaagcaacataaatctttctaccaaaaagacacatgcgcacatatgttcattgcagcagtattcactacagcaaagaaatggaatcagcccagatgcccaacaccagtgcactggataaagaaaagatgatacatatacagcatggaatactatgcagccattaaagaaaaacaaaacaacattctttgcaacaacattaaagcagttggaggtcattatattaagcaaataaccacagaaacagaaaatcaaataccacatgttttcacttataagtgggagctaaacattgagttcacaaggacacaaagatgggaacaataaaaacaagggcctacttgaagggggagggaggagggcaaaggtcaaataactatctattgggtactgcactcactaccttggtgacaaggttatttgttcaccaaaccacagtgacatgcaatttacccatgtaataaacctgtacatgtatcccatgaacctaaaagttgagaatagaaaaaaacaaaaacatattaacccccaaatgatttactgtcacttaggagaggacaggggtctaggatatgatgattcaccaaaggttccatagtcaggcccggtggttcacaggtgtaaccccagcactttgggaggctgaggtgagcagatcacttgaggtcaggagttcaagaccagcctggccaatgtggtgaaaccctgtctctactgaaaatacaaaaattagctgggtatggtggtgcacgcctgtaattccagccattcaggaagatgaggcagaagaatcacttgaacccaggcaagagaggttgctgagatcatgccactgcactccagcctgggcaacagaagtgagactccatctcacttggaaccaactcaaatgcccatcaatgatagactggataaagaaaatgtggcacatatacaccatggaatactatgcggccataaaaaagaatgagttcatgtcctttgcagggacatagatgaagctggaaaccatcattctcaggaaactaacacaggaacagaaaaccaaacaccacatgttctcactcataagtgggagctgaacgatgagaatacatggacacagggaggggaacatcacacaatggggcctgtcagggggtgggaggcaagggaagggatagcattaggagaaatacctaatgtagatgagttgatggtacagcaaactaccatggcgcatgtatacctatgtaacaaatttgcatgttctgcacatgtatcccagaaattaaagtataataataaaaaaaaaaaaggttccacaaggtacaagcaagggtgatcataatggaacactttcacgttggatatccaaaggtataggaataaaaaagatttgagaatattgggaaataaaaaaaagatgatattcagaacagactaaattatctctctaatttggcataaacagtctgcaaaacaagggtgttttgttaattcacaacttgtaaaataaacaccacattattccatctaaagtgataattgatttccacagtgttaaaccaacaactttgaaaagaatttcatagtccagtctgatgccagaatccttatgcttctttctactttttgatcagtgtatattttgtaaacatacacaatgacaaatgacagcaaagatcactattttacattctcccttctactcttctacttctccatttttaatttgttctttaatatgaagttcttaaactcattatttaaagatatccaatgctatgaaaatttgatgtgtataattctccatgattatacatataaaagtatataattatatatgatttgttttatttgatttttaaataagtaatattctatacatattagtctatggcttggtttttaatgtgttatgataattcccccaagggtaagaaaatacttgtattttccaatttttgcatgcatgcatgcatatccatctgtaattataaatgaatcagtgtaaataacacatgctagattgctcttcttaatataatatgttagctgttcttttttccttcttttctcctgtttttccttttcctcctccttctcctcccctttcctctcttcctcctctgtctttatcttctttgatcagaccactcccttcttctggctaacaagtgtggaatgagaatgcttaaattcaaacatttggtcaagcagatatgttgcctagagcaagataacatttcctcacttgtaaaatgaggataagcataggccctacatttgaggttttggtattagaatatatattcatatacaaaaatgtttaatataatgcttggcacataaagagactataatcagtgtaagcagttattaactaccctgcttatctttccagccattctatttatatttttcacttgtttcgcagtgtttcagttataacagccttttctctcttccttaaataggccaaactttctcttgccttagggcttttgcactggttgtttcacccttaggtattttactatgaacttacttacgcatctttttctgcttctttttgccctctaaagtactatatataagttctataaaagttggaatctggtttgttgtgttctacactgtgtctctacagcctaatatcatgcatgacacagagtttatggtttaacatgtacttgttggatgactgtaaaattccatttgatatttagtatcagagtaacccataaagataggtattatttcctcaattttataaataataaaagtacaacaatgaggcttaatgctttattgatagttaagctgttgaattgggcttgaatgcagtttccttttctgtgtgttgtattctttccactgtttcctatgtgttatgcatttttaaaatacacagaaaattagctttatgagattgtaaatctcttcgaatcatgcattttactgtctctatgtaaaaattataagctcacaataagtacataatatgcattttttattactaatgattttcttcccttcatgggtttatgctttttctaaatgtaaaatatttgtctaatacatatatgtaaaatacatagtatgtgtaaaatatccttttctaagcttgctataaaatcttacttgtttatttaggtgttgatagttaaaattaatttggcaataggtatgcaggggatgtctctgaaacccttggaagacattgatggtttctgaacttcaactggtgtagcagattgaaggcaaatcccaggccaaatatacatatatatgtgtgtgtgtgtgtgtgtgtgtgtgtgtgtgtgtgtgtgattatatatatttatatataatatataaaatattatataatatatacatgttttatattatatatatataaggcataagacaacacagagagaatatgtttaatacgacagcaatttagaagtaggaaacagtcattgcttgtgaaataagggaggctatggtagttgctgtgctgagcaataatgaccaagtgaacataagtgggatattgcagccagaaataggaacaaaaacagaatagatagaatatttaaaaaaaaaacttgaaagctactgcttagaatgggcttgactcacatagctgtactgaggtgaaactaaaccaagagatctttggaaattttctcccgagacatacaagaatttacctagcaatatacagtatgcaccctttaaatcatcaggctggcaaaatcatggtttgtgtaatacttgacattgaaagttaaccccttcttttatttataattagagacaaatgaagaactatgtagaatgtgaggcaacaagaggtgtttagattgttctttcaacacttaaagacctggaatgtctggtcctttttctccacttttactgtaataaaggcagtccaaattctcatcatttaacccctgaatgaaaacaggatcccaacaacttgttcccctgatgcctgaggccaatgcacagtgtccggaattttcctcttaaatgtgaactgaccgtggtggtccaatcctaaaatctcacttcaggctcctagtgaagaactgttagttcttagctaacatcacgtttctcttggacagctcacatattcatagttgtcttctaatcttaaaatacacataaattcactcagcaagcttgtaaaaatgtacatatttggacctcaaattcaaagattctaattccatatttcttggatgtgacttggcaatttacttctaaacacatgctccagcaagtgaaataaatgactatataggcatgaagaactacttagatgccctaaacaccctgctattttacaactatttgccaagaacatcttccctgccaacttggtctttttgtcttggaaaattgctacaaattcctcacaaccctgttcaggtattgttcaggtactgatcacttctccaagctttccattattcctccttccctccactagatggttaatagattccttctctatatcaattctgtgccttgcagatacttattttactgcctattttatattttggctttattgtcatcttcacaaataaagcgtaacctcttgaagggttgaaaattacttttggtattagtggttagcaaactacttggcacatgttaatgaagaattaataattgctgaatttagcatttttacactgaccctaagagtaaggaccaagttctggttctatcacttttgttcagctaattatatgtagagatacagatatacatatacatatatacatatataaatttgaacacagggttctcctaacacacatcttaataggtacagaggagaaagatcttggatgtttgaaaaggtagagttgccattttctctctgtactctctctgtacatgatttttggattgagaatatatctagaatgtcaccaacaataaataaactatgctgggaaaatcatttataatagacagatttataatgtcaattattaacatactgcagactttttcaaataggggagttcacttggaaatttaaaaaatgccagctggtcggttctgagatcacagaaatgaagattcctttgcaataaaaagaatcactttgtttttttgtttttttcctaaatctccacttctgcttatagtgactgtacccaaatcaaggagttataaatattaatctggtaacttcaaattgagaattcatagccactaaaatgggttgccttaagaaaaatcttttttccatcatccaaggtcatatgcctcttatcaaaggaactacacatatattacaaagttattttcagtttttctcatgaatttctatgtatacacaggtctctgtatgtagctaataacatacttagggcaaaatgaaagaaaggaaggcaatatttcccatgctcctaagttaaaaaccctatttgtctgtgtgtaatatggaaatatttacatattatctgtacagatttgatcatatgccaaaacatgtcccccttcaagttctatctgctttggacatccaaatacaattcaaataactttcaacagttttacatgtaatgaattctcagcaaattaacacaagaaaataaaaccaaacaccgcatgttctcactcataagtgggagttgaacaatgagaacacatggaaacagggaggggaacatcacacactggggcctgtcggggggtcgggggctagggaagggataccgttaggagaaatacctaatgtagatgacgggtcgatgggagcagcaaaccaccatagcacgtgtatacctgtgcaacaaaactgcacgttctgcacgtgtaccccagaacttaaagtataataatgaaaaaaagaccaaagacgttttgtgtgtttaaattattcttaaagctgtataaaattagcttgtgaaagttgatctaactaagatacaacaaataaaatgatcagtgatatggtagatctctcttcctatagagtagcgatattatttaacatgatcattgtttagttataacaattacttaaaaagaaaattttgactcccatttggtataatttttctggaattcggtattaaagtgtaactcatattgttagatatttttcaccttgcattgtccatcacagtatctactgtatcaaatgcacagttcatgaatcagatcagctcttttatatatctgatatatcatagtttattaaacttgaaatttttgcgtggaaaatatcacatctgagccacttggaactttggagtatagtgaaactccaacacactgattttttttctcaatccaaataaagcatattggaaatatgtatacttgcttaaaaatcgtttctatatagtcagtatttaggtggataattcaaaagtactctacctaatataatgtgaatactaaggactaaaaaatatgattaaatttggaatctcaattttagagtttttgagatgagtttttttttgagaaattaacattaaatcattttcatgttttataaaaatggaacaaagtattctaaaatgtaaagaatgcttgtcctaatacctagtaagtaatccttaacatagagcttgaatcatgtaataaattgccattgttctgccctaaattttcaatgttaaaggttaacacttttgggtctaatagaataacaaagcagaaggactcctaagacattcttcagttgactaaactgtgagttggtactgaattgcctacaaaaactggactgaaaaaacagtgtttgcatttcagtaaggtgaatgtaagaaagccaattattaactcattagtattccgcagctttactttcaaagggtaggagacaaaaaaatgaaagaagaatgtatatataattttctgtgtttattctattgactgtgtgaaggtaccaggacagaataacatttggaaaaaaacaaatatgtattcataaattcaggagacagattctttttatgggcaaaacatgatttttttttgatcaactgattcaaaaaaataataatatgcaaagcaatggttatttccatataaccttaggctttttcttaataacaacacaattctaatttttgcctttaggattcctttaataattacatggctaataaactattgcttttcctcatgcatatataaatactgacttgttccttatgagaacattccagggtattattagaagcatttgtcttgcactttactctacgcaagcactttaatgatctcacattgtttggaaatcccaatgagcttttgaggtaagtctcctagccttatcattttacagattttcatttaaataataataatacttttattcctgcatagagtattatgtaatatatttaatacatatataatttatacaaaaatatacatgctatatatatatatgcacatctcatatgcatgctttttaatgcctttacattttttccttagtgttttattttataatcagtgctttataaaaggatgcattccttttgaaaactatgcttccttcagctactaggaacacagtatggtatatggaaagaaaaaatgaaaacctctgacaacacttgcagctaatatttattagattctttttgcttcataaagtgcataacaaatttgcatgcattttactcatatgatctctcacatcaagcggtaatggtggatatgtttgttattgctcctatttaacagatgagagtactgaaatataaaaaggtaagtaagtttcccaagcaactaagcaagtataagtcaagatctgaaacataacaatgtgtctgtggaatctgatttttaaatactgttaatcactttaacagcactaatttggcaataacttatttcaaaagctgcttcctttctctaagcctcaatttcttcatattaaaatttcagtatgaatattgcaacttttaggatactcatagcacaaatattatgtttaaattagtgattatcttagtactgagagtaatggtgccaataataatagtttccatttactaagtctctactgtataccagaagcactgtgaacattacttcctctaacctgcataacacatccccaagacgaacatttcacattttatagttagaaaaattaagaatcagagaaattaattttcccaagatcatgtaactaggacatagagtatctggagttaacatcctactgtatgtgactcaaagatatttattttcttatcaccaaacattgtaagtaatttttactgtattttacacatcaaaaaccttagccagcacactatcatacatttactgaaacagagtagatatccttatctttcacttagaggcattgcagcatggttaagggcaatgctcttgaagtcaatatagtaccatggaattaaaaacaagaaaaaaactgggcaagcctcagtcatactctactacagatgctctttgacttatgatgagattatattcaataaacccatcataagttaaaataccctaagcctaagatggatttcatctacccaacctactaaatgtcatagcataacatagcctaccttaaatgtgctcagaccacttatattggtctacatttgggcaaaatcaaatgcttatttcataattaagtgttgaatatctgatgtgattcattgaatatggcactgaagtgaaaaacagaatggttataggggtgttcatcatttatgtacataactgaaagcacagtggacataaagagtgtttgaagcattgaactaaaattaatcgccggatgatggagatgctacagcaacagagtcaccaatttctccttcttctgatgaggttcaaaaatagctggtacaggttgagtaacccttacctgaaatgcttgggaaaagaagtgtttcagatttcagatttttttgaatattggaatatttgtattacataatgagatatcatggaaaggggacccatgtcaaaatgcaaaagtcatttacatttcacgtatacacacatagcctaaaggtaattttaaatgatattttaaataattttgtgatatttttacatgaggtcgtatgttgaattttcttcctgtgacatcatgttggtgctcaaaaattttcagattttagagaatttcagatttcaaattttcagattagggatgttccacctgtagaagaaactggttattgacacttattgatggtctagagtttgatatggtttctctgtgtccccaccgaaacctcatcttgaattgtagctcccataatttccacgtgttgtgggagggacccagtgggagataattgaatcatgggggtggtttcccccatactgttctcgtggtagtgaataagtctcttgagatctgatggttttataagggtttcccctttcacttggctctcattttctctcttgtctgccaccatgaaagatgtgctttttgtcttccaccatgattgtgaggcctccccagctatgtggatctgtgagtccattaaacctctttttctgaattcacagtgttctttggaaagatagcaagtattgattgtacagcttatttcttattattacatatctttctgtaacaagcaagagcactgtgtctctgcctgtcagttctcatgagtctctcctaatcgacgtgccatttctttaacatctgtatgccactgctgaatgcagcaaaggcctccacaggtttctttgctgtacactttcttggttcctccggtttaacttcttcctctgcctcaacttctttacttctttcttcctacagtttgatcacttgaaaactcagtgccaacaaacccatgaatatcctcttcatcaatacccaattttagctgtttctcaagtgctaataacttgttacctactattcatcaacagcagagtctttgttaaagcttttgaatgtgttcacatatgtcttcgaaactttcttccacatgccgatcatgcactgctgtgtgacttcttcccatgctgttgcgatgttctggatggcacttaggatgtaaaaacttttccaaaactcttggagaagtcagccagactcagtcacttcactaatctacacaaatccttggcataaatatactttgaagggagctattgctccttgttccattggttgaatgaatgtggttttgttcagtttcaaatacacagtcaaaaaaattgcttttatttctgtttgtttattcacttttcctgattgtctttatgcagagccctaaagaagttagtggtaaagccaaacccttgacatcagcagaactttgagcagcatatttggttcttcatttctcctgaaaagagtgatagccaaagaacatatctaccctgatgccctgggaaaagttaatagtttggctgacagtacttgaacataattggagcatcggtgacagggaggactgaagaagatttatgtgattaattctctctacttgggtacagagcttaaacacatttgtgtcacatataggtgctaaccaaagagtaacttcagcagatggataagtgaaaccatttgtaggagatcaagtgggtccccttagtactcccttgtgttgtgatcaaagttattggaaaactacaatggactaacacaggaagaactactaatggccaaggctcttcaggaacaaaatttcaggtcattgtttcagacaaaaggacctgatgatctggttaaaataaaagtaataatgaaataggtagtacaagaaggaagctataaacaagctatgaccatgtgaccaattgcaaacataagaattgcgataattatgaaaagttctttcttattttggtgtgaatgtatttcaaaaagattaaccaaagtttcccttttttccacgtctcctgccatctaacataaaaatgtgataatagtaattaactttatgtcaccgtatttaactcatatgatactaaagagggagaagtgtatcagaagtggaatgaacatcgaccactggtgaacaaatgacttttgtgagtttgtatccactttcagagtgatggttagcgtgctttcagttggtagaagtatagatgcgtcaccttggaaagaagcatgattttaccgttacctttatttggaatgtaaacgtgatttaaaatggaatacattgatgtcaatttgagaggtaaactttagtgaaaccatatttttaagaataatttttttcctgttaaaattgctgcagcacccattgtacctcgtgtgggtaccctgttctgctcttgcatgctgttgctgatctgctgactttccttgtcagtatgaagtagttagtagcatacaggttaaaggtggtaacagatatgggttacaattattgtccccatggactctaatttggcttcatggatatcagtttgccctcactctcctctgattcacactaacttttccttcccagctgccagcctaggtgacctgcagattcttcacgcctaccaccagaaacagagagaatagcacttcacagattgctacaacagatcccagttttatagagtttattttttacagaaaatcttgattcatattgattattgtgttgtttgtttccatattaagtctcaactgatgtcttcagtttatgtgatatatcatacggtcactttatggataatgcatttgggtgatcacattaaatttggaaaatagtctttgaactcctggaattttaactcttagtctcaaaccaaacacatatctagtctaactttctaaaatatgactgaaatagatttatatagctactatatttttagtttcaaattttctctatacatttttaatagcattgtttaatacaagtccctggatatgttttctatgacctcaaaatgttttgaaattttgggtcaaataaggtatgtgagtgcttatttttttttctttgggggagtgttttcaaatgaactttgaagcccagttggacactaaccaaacatttaagaaaacataccataacccttgattttataaaagaactaatacctgctaatccagctcaataatgaaaacccagagatttcatctttcaaattccaagttgacatttggtgttgttatttataatgtcaaaagccagcaatttatttcttaagagaaaattcaaaacaccccttctagggttcttgacctccggatatctttctgtccaccaagatgtctaataaaacataaagtttccatgatataaatttaatatggattactgaaatttgagtaagagttcttattaaatttaaaagtacagagtattctttcttcactagtgtagatgcaggtatggtttcaggaaacctatcatagcttgaatattttaaaactctattgatttttgaacatggtatagacatttctggcattgtgtgtgtgtgtgtgtgtgtgtgtgtgtgtgtgtgtgtgtgtattattgggggatgatgcgtatatgtctaccaattaactgtacatacaataatatcttgctatcctacaaaaatggcattacatttcattttaattttttaatgaagaaagggttatcaaaatttagttactacttctgaaaatttaatcttaattttaaactagaaatgtcaaatggcaaatgggttttttcctcatttcatgaactgcaaactcacataacatattgatgtttgttaaatcatttgcagtttcttagaggttttaaataaaaatatttactcatgcagaatagttattttttaaaattactaacacgtagaatagacagcaaattattaatgaaagtataatttgactttccattattttctttaattcaaaatattatattctgtctaattatactctttaaaaatgtcatttcatgatgcacgtgtctactttatctaacttcccttaaagcctaaaagacctaagtgaagattttaccatcaaaagttaaaaactaaagcgagccattttccaagaattagacagtatttttacacagccattaaatcataccacatgacaaggctgataaacttcatctgtcatatgaaattatctaatacccctaaaataaaatataattttataaatttacctggttatctgaataatcagatttttcattttatgaaatattcttaaatgtacaaaacattttaaaaatatgaatacataaaatatgtatattttatactttaatttgtgatagtatgggttttaaaatattttagtgttagatttctttttctttgatttggccaaatattccatttcatttatttttgtttatttatttatttatttatttatttatttatttatgagacacagtctcactctgtcacctgggctggagtgcagtggtgcaatctcggctcactgcaaactctgcctcctgggtttaagtgattctcatgcctcggcctcccaagtagctgagattacaggtgcacgcccccatgcctggctaaaataatattcagtctaattttatatgtctacacacaaacacaccagtattccctcacattagaatattgttatattattttctattatttcaaaaacatcttattgaacacaaaacaaaatttttgtcatcattgtagacatgacaatgcaagcaaaaacatacttgaaattaaaaagaatcacactatgtatttttatacatgcaaggtgaattttgattaaagattaattatgttaaaaaatcttaatcatattaatactccaaactatcctaaataggcaggtaagtctcatttaagtctgatgcagctgttatttgtgaaactcatgttaatgttaatggttcactttctcaaaaaacagtatttgaaatgcctactatgtacctggagaaattcttggattacagcaatgaatcaaaaaagatagtctttgccctcacagaaattgcatgtaatataatgatccaaatattctctattctgagataaaaggtgctgacagttgtttgcagaaaaatattagccacaggcttgcatgtttaccttccatctgtcttctccctagagcatggcttcgtattcacaggcttacaaaattctgtctttttatatagggaattcttcttgttttctaaccactttgttaacatgaaaacaattatgtgctttactcatgtaataagatttacagaggatatttcttttacatattgttaaaatgttagtgctatctctgaacaactatatcacagaatgaagaaggcacatctttgtgtagtcttaattttaactaatagtcaataattgaaaaacccagaaataaattaatctctgattccttctaaagaaaacatatatataattataataatgttcacacagcttcctatcagtgttttacttgccaacaataataaagactttatacaaaatagtgatttttaatcagataaatatataaagttagcaatttaggattatgtgaaaggataataattatctgttaattttaaattgctggtattttagtcaactgaaaatctatcatgaatattagctgatttacctctcctgaaaaaaaaaatgaaagcaaggagtagcacacagttagtttttttaaaaaagtatgaacaagtatgaataaaaattatattttgtgagatttagctggaattttgaaattggctgaaataaaattgaaataattgcttttctcctgggattcaaaatagacttcaaaaaaaaaaaaaaaacagttttaactgaaacaaatctattcattgtgaaacattatttcaaatccatcagggtccaaggtgttaaaagaatattcaaataatacaaataaaacatttacttagcaaaactttcatacttgctatgcaatacagaatggaaattctaatagaggtatcaatggttcatcagtaacagaaaaacaaagaaaacatttgttataatagtgttccataaaacttactcatcgaaaagaaattttagactgattgtttctaagatttggtaaagtctcaagtgtagcatgaaaattaatcacttgggggatggagccaagatggccgagtaggaatagctctggtttacagttcccagcgtgagtgacgcagaagacaggtgatttctgcatttccatctgaggtaccgggttcatctcactagggagtgccagacagtgggtgcaggacagtgggtgcagcgcaccgtgcaccagccaaagcagggagaggcattgcttcactcaggaaactcaaggggtcagggaattccctttcctagtcaaagaaaggggtgacagatggcacctggaaaatcgggtcactcccaccttaatactgcacttttccaacgggcttaaaaaacggcacaccaggagattatatcccgcacatggctcggagggtcctatgcccatggagtctcgctgattgctagcacagcagtctgagatcaaactgtaaggcggcagacaggctgggggaggggcgctggccattgccgagttagttgtttgattaggtaaacaaagcagccaggaaactggaactcggtggagcccaccacagctcaaggaggcctgcggcctctgtaggctccacctctgggggcagggcacagacaaacaaaaagacagcagtaacctctgcagacttaaacgtccttgtctgacacctttgaagagagtagtggttctcccagcacgcagctggagatctgagaatgggcagactgcctccttaagtgggtccctgacctgcgagcagcctaactgggaggcatcccccagtaggggcagactgacacctcacacggtcgggtactcctctgagacaaaacttccagaggacccatcaggcagcagcatttgcagttcatgaaaatctgctgttctacagccaccgctgttctgcagccactgctgctgatacccaggcaaacagggtctggaggggacctctagcaaactccaacagacctgcagctgagggtcctaactgttagaaggaaaactaacaaacagaaaggacatccacaccaaaaatccatccgtacatcaccatcatcaaagaccaaaagcagacaaaaccacaaagatggggaaaaaacagagcagaaaaactggaaactctaaaaagcagagcgcctctcctcctccaaaggaatgcagttcctcaccagcaacggaacaaagctggatggagaatgctttgacgagctgagagaagaaggcttcagatgatcaaactactctgagctgacggagaatgactttgacgagttgagagaagaaggcttcagatgatcaactacgctgagctacaggaggaaattcaaaccaatggcaaacaagttaaaaactttgaaaaaaaaaattagatgaatgtataactagaataacaaatgcagagaagtgcttaaaggagctgatggagctgaaagccaaggctcgagaactacgtgaagaatgcagaagcctcaggagccgatgagatcaactggaagaaagggtatcagtgatggaagatgaaatgaatgaaatgaagcaagaagggaagtttagagaaaaaagaataaaaagaaacgaacaaagcctccaagaaatatgggactatgtgaaaagaccaaatctacgtctgactggtgtacctgaaagtgacggggagaatggaaccaagttggaaaacactctgcaggatattatccaggagaacttccccaacctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaagattgggttacccacaaagggaagctcatcagagtaacagcagatctctcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccccaaaagagctcctgaaggaagcactaaacatggaaaggaacaacaggtaccagccactgcaaaaacaggccaaattgtaaagacgatcaaggctaggaagaaactgcatgaactaacgagcaaaataaccagctaacatcataatgacatgatcaaattcacacataacaatattaactttaaatataaatgggctaaatgctccaattaaaagacacagactggcaaattggataaagagtcaagacccatcagtgtgctatattcaggaaacccatctcatgtgcagagacacacataggctcaaaataaagggatggaggaagatctaccaagcaaaaggaaaacaaaaaacggcaggagttgcaatcctagtctctgataaaacagactttaaaccaacaaacatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaattgaactcatctctgcaccaagaggacctaatagacatctacagaactcttcaccccaaatcaacagaatatacatttttttcagcaccacaccacacctattccaaaattgaccacatagttggaagtaaagcactccccagcagatgtaaaagaacagaaattataacaaattgtctctcagaccacagtgcaatcaaactagaactcaagattaagaaactcactcaaaaccactcgactacatggaaactgaacaacctgctcctgaatgactactgggtacataatgaaatgaaggcagaaataaagatgttctttcaaaacaacgagaacaaagacgcaatataccagaatctctgggacacattcaaagcagtgtgtagagggaaatttatagcaccaaatgcccaaaagagaaagcaggaaagatccaaaattgacaccctaacatcacaattaaaagaactagaaaagcaagagcaaacacattcaaaagctagcagaaggcaagaaataactaaaatcagtgcagaactgaaggaaatagagacacaaaaaacccttcaaaaaattgatgaatccaagagctggttttttgaaaagatcaacaaaattgatagaccgctagcaagactaataaagaaaaaaagagagaagaatcaaatagacgcaataaaaatgataaaggggatatcaccaccgatcccacagaaatacaaactaccatcagagaatactacaaacacctctacgcaaataaactggaaaatctagaagaaatggataaattcctcaacacatacacccccccaagactaaaccaggaagaagttgaatctctgaatagaccaataacaggagctgaaattgtggcaataatcaatagcttaccaaccaaaaagagtccaggacaagacggattcacagccgaattctaccagaggtacaaggaggagctggtaccattccttctgaaattattccaatcaatagaaaaagagggaatcctccctaactcattttatgaggccagcatcatcctgataccaaagcctggcagagacgcaaccaaaaaagagaattttagaccaatatccttgatgaacattgatgcagaaatcctcaataaaatactggcaaaccaaatccagcagcacatcaaaaagcttatgcaccatgatcaagtgggcttcatccctgggatgcaaggctggttcaatatatgcaaatcaataaatgtaatccagcatataaacagatccaaagacaaaaatcacatgattatctcaatagatgcagaaaaggcctttgacaaaattcaacaatccttcatgctaaaaactctcaataaattaggtattgatgggacttatctcaaaataataagcgctatctatgacaaacccacagccaacatcatactgaatgggcaaaaactggaagcattccctttgaaaactggcacaagacagggatgccctctctcaccactcctattcaacatagtgttggaagttctggccagggcaatgaggcaggagaagaaaacaaagggtattcaattaggaaaagaggaagtcaaattgtccctgtttgcagatgacatgattgtatatttagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctagaaatctgacttacaagggacgtgaaggacctcttcaaggagaactacaaaccactgctcaatgaaataaaagaggatacaaacaaatggaagaacattccatgctcatggataggaagaatcaatattgtgaaaatggccatactgcccaaggtaatttatagattcaatgccatccccatcaagctatcaaggactttcttcacagaattggaaaaacctcctttaaagttcatatggaaccaaaaaagagcccgcatcaccaagtcaatcctaagccaaaacaacaaagctggaggcatcacgctacctgacttcaaactatgctgcaaggctacagtaaccaaaacagcatagtactggtaccaaaacagagatatagatcaatggaacagaacagagccctcagaaataaggccgcatatctacaactatctgatctttgacaaacctgacaaaaacaagtaatggggaaaggattccctatttaataaatggtgctggtacaactggctagccatatgtagaaagctgaaactggatcccttccttacaccttatacaaaaattaattcaagatggattaaagacttatatgttacacttaaagccataaaaaccctagaagaaaacctaggcaataccattcaggacatagtcatgggcaaggactttatgtctaaaacaccaaaagcaatggcaacaaaagccaaaattgacaaataggatctaattaaactaaagagcttctgcaaagcaaaagaaactaccatcagagtgaccaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggatataaacagacacttctcaaaagaagacatttatgcagccaaaaaacacatgaaaaaatgctcatcatcactggccatcagagaaatgcaaatcaaaaccacaatgagataccatctcacaccagttagaatagcaatcattaaaaagtcaggaaacaacaggtgctggagaggatgtggagaaacaggaacacttttacactgttggtgggactgtcaactagttcaaccattgtggaagtcagtgtggcgattcctcagggatctagaactagatataccatttgacccagccatcccattactggatatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacacggatgaaacgaaaacatcattctcagcaaactatcgcaaggacaaaaaaacaaacaccgcatgttctcactcataggtgggaattgaacaatgagaacacatggacacaggaaggggaacatcacattctggggactgttgtggggtggggggaggggggagggatagtattaggagatatacctaatgctaaatgatgagttaatgggtgcagtacaccaacatggcacatgtatacatatgtaacaaacctgcacattgtgcacatgtaccctaaaacttaaagcataataataataaaacaaaatagaaaattaatcacttactgtttttaagtcatttataatatttactctgactgttgtcaataagatccctcatatctctaaataaacccttttaaagatactgaataaactccttagagaatactgatgggatgctatttgctattttctcacaaataatgctcactccttgcctgtcccgaagtattaagataaaaccaagcacattaatcaattttcaccaaaatatattcaataaagaagatcattttatcaagcaaagtaaatatatttgtaaggatttatctgaaatgtgaagctgctactattgaatcttccctctttattaatgattttttaaaagagaatgtaatataacaaaaatcacttattaattttgatggtaccacactatgaaattttctgacactaagtattactttccaatagaaatcatcacattcatattgacctttggtatgactgtaataatcctctactttgtgttaaatgaggcagtgataccactgagccaaattgaatgacttaatgcattttctgattttttctgagtaaaatatatttttaaataataaagttggccgggcgtggtggctcatgcctgtaatcccagcactttgggaggccgaggcgggtggatcacgaggtcaggagatcgagaccaccctggctaacacggtggaaccccatctctactaaagtacaaaaaattagccaggcatggtggtgggtgcatgtggtcctagctactcgggaggctgaggcaggagaatggcgtgaacctgggaggctgagcttgcagtgagccaagatcacgccgctgcattccagcctgagtgacagagtgagaatccatctcaaaaaaaaaaaaaaaaaaaaaaaggaataaaattatctgtgattgtgaacaaacatctacacacagttgtgaatttgaatttttaattatgcgctgctatgacattgagtgatgaaaaaagaattattctttgtaaattatatgttactagatgaggtcaccatcaactgatttgttggcaaatcaattaaaaagtcaaaaacatttttgactaatctacatacattcaatcaacatccatcttctctatttcaatcacatatgctctttctcatcttctccagctatcttcttgccatttcttaaacttatcagcatattcatcttcagagtctttgaatttattcctctgtctataatgtaaattccctggatgaatgcatggctcacatcttcagtcttaactttatgcagttttgctctaatgtaatttcctcaaagaaacaagtcgtctatctgaaacagcatcactgcctcctcagttgttaatcacaccttggtttcttgctctgtttcgtttttactccctgtctctatctccatgtggaaagtggttttgcctgttttcttctctgatgcatcgccagtaccagaacagattctcacacaatatagagtgtcaataatcataccttgaagaaataactaagcaaacaaatgattaatgaaatgactgattgaacaacaaaattatgtattgggcatgtgttcaagattgtttgtaacagggaaggagagaattgcaagcaggtggtctttacttacattctatttcagctgttttgttgtaaaaatgaagacaaatttgggagaataattttaatactaaactttgactaggaactattgtctttcttactcaaaaccaacttaagaagcaacactctcaaccacacccaggtctgacaactcaaagcactgctctgtaaaattgtaaattttcaaaagcaaacacacaaatgacagtaaaagcaatatcatagtttccaatgtgtcctgaggtacatgaaaagagcttagtgctaaccaggtcagcatttttggaatgagaaccaaggattactgtatgacaaaatggagaatctagaaagcaaaaacttggatcaataataaacaaaatcttgattcttgacatcaatggcaagttgctttggtggattttttaaaaaagcactcaatatattagtatatatctacattttgttgaataaacccatttgaatttaaccaaaagtagtgtactttaacagtgcgtagattataacaatttcataaaaattttatattgagtatacttaacagattcatttctattcatactgaaaagtaattatacattctttgcttaaactacactacctgatataaatataaaataaatgctcattttagtatatatgtcaaatttgtatgaagtagtcatagatgaagggatagcaagtactttcatgttctttaaatcacatgacatacttacatttagttgaattacataagtaattcaatttaggaatacttggcatttgaatatttgttttgaaaactgctgtaggaaatattttaagtccaaaatattttcaagatagtttttgaattactatttatatctagcaattgctaagaaactttatactgttgattactgcactctattcaaaagtgaaggtagtgatcagattttcagtgtcttaacagggaagaaactcacagtccaattgtctcagcaacacaaatccgaagtctaacagtcaatatttgatcataaggaatggaagaaatgaaataactgtttacggcaaaaggaaatttagagaagaaaggccttaaagacagggaatggtaaaatctaagacctcaagagagcccgtgtaaggaagagaggatggagaaatactgcttaggaaagttctgtacaaagaaaatcttcatgacctttatttcaaagccagtaattgaactttggtgcttcctcccctcttacatcgataaatttccacaagcaactcactccccaaataacttttaaaaaattatacaatctaaatgtaaacttcttcattgagtccatcatggcatccttggttgatgttgctttcaaattatggagacaactcagatttacctttcatttcccaaatttactgagagtgtacaatatattttaaactttaaattcatgaagctccttcagggtgggttttctaatctctcacgtagtgatatccttttgtctctgcatctgtccatttctgtacagtcacagtggtgtgttccaaccatgacttaaaatcattttctccttctctttacgtagcagtgcctgtacacttcggcagattctgagaattagtttgaatgagtggttccaaagtatgtttaatgtcaatctatagttgctgtaaagcagccaaggactctgatgtggctggcactcagtggcaggtctttaagtagtcccagagtaactgtccccacctctcttctttcagtaaggcttcaatgctataagcaacttagagtcaagagaaactagaaaatatctgttcagaaaggtattttagacattctcacttaattaaacatagataatgtgatctgtttctctaaatccattctcccctcaaaatgaaattacatactaaatacgctctacatgctagttcaagagctttctggtggtagtcaggaactaacatatctctttgtgtgtccactttgcccctttacaacgtaagcttagtattaccagcaattgtgatgaaaataatctcttgttcagcccaagatgatgtaatgaatctgtcattaaggtgctgttgaggacaaagatcaggaattgaaagcatctaacagagcccaggatgagaaagaagtttatggatctctgcctgttaaattcataattcttccaagcatgcacatatgtataaatgcacttgacatatatattcacaaagaatatttctgtcccacaaattataaaagtctttgagagatagagacatgtgtataaataagtgttctataaatgtagctcaatgacttacataaacaattagctataatttaaaaaatgagctatttagatgctttgctttagtagtgaatgtatttagatatagagattatttagcaatagacatcagttaagtgagccacaggcaatttgacttcaagtaaatttactaatttagctgattaaagatttgttaggcctttcttttcaaagaagcttcaaagcctttaaaaatgagtgctcatcattctggtaaaataggaaacccacatgttttattactaccaattaaaagatactggaaaggagaaattaagagagtatagagcaaggctaaaaataagtatttcttttctttctttttttcagacaggatctcactctgccacccatgcttcagtgcagtggaatgatctcagcttactacaacctcccctcctggcctcccaggttcaagtgattctcgtgcctcagcctcccaagtagctgggactgtgagtgtgtgccaccacacctggctaatttttgcatttttagtagaaacagggtcttgccatgttggccaggctggccttgaactcccgagctctagcaatccagctgcctcagcctcccaaaatgctgggactacaggcatgagccacccaacatggccaaaaataattgtgtcattgggaagttttgattgcctaaagaaaaatataaaaacatttgcatggattgtttcccttagatttttaagacaaaaatgattaaagcactacattataatatctggcagaggttcatttgatcaccatatttttagaaatttaatgcaaaagagaaatgcaaaacatttactctctagatcagtatttatacttcttgtgatgacttaaataactctggcagctttctgagtagttggcagtttctacaaaatatgccaagtaaggagcacaacattagtatactatatcatgtcattttcttctaaaacacaaatattgaacttttaccacctgctactgtacagcagtgctatggcaacatcttcgtagagttcctaagctcctttgaaaagtaggatctaatcagcacaaaaggaaataaactatcatcattgctgttgctataattacctagttggcaaaataagctctatctatacagaatcacacattaaaacaaatttgcttaggaaaactaaatgttttatttcagcccagcttacattttcaaatgaattggttaacaattagaaaagaaattgttgataaaccttgcattatgtttattgaatttttatttctggttaaaaaggttaactgttttcactgtggaatatttagaaaatatagatttctttctttaaaaatagttagccataaggaagccataattcatcactgtaacagagaatcttttttcatatatcttttactttatagtattttaatattttttctctactgtagacacatttgggatttatttccaacttacataaatgcatcataataactgtaactccatatgattttattatgaataaggatagattttaaaaacataatcaaaatgttcacatttttgtaattacttaatgtggcaaatattttattaatacttaaatttgtttaatcagaggccagcagtactgtagatatttctgagtgatttcacagaatgtgtgggaatatacatctgcgtcaattctttaaatgagtaaaaggagcatctgtaatgcagcaaaatcaatcatgaagaagtaactgatgcaggaattgcctatacaggtttccaaagtacatgtacgcgtgtagattgagttacaagaaaaaggtcactttctaataaggcaactgacaattattttgtaaaaaatatgaaagtgcaagcacatactttagaacaaatattaggtacaagcttaatggaagagtctatcatgtaattagcagacaaaatgagccacagaccacatttacatacttagtttaaaatagaaacagagtcccaagagataaccattttactgctgcccagttgaggagaaaacactttcaatatttctacattaacgttcagagagtcaaggtggccgatgcagaacaaaaacactaatgataaggaaaaaaagtttttccaaagaagaacttggtatgaattagatattaattgttaattacttcagaaggcccaagtgaaaattcagacttctttctctgctcttggccttatttcatgttcccgctttctaagcacattaggttttcctattaatcagtcacaatcaccatgtctaatcggctgtggatctagatccttaccagatcccagccaatagaagttagcaatgtaaggcttattttgtggaccacttctttggaggaatacgttgtgtttctgttagatgactatacacatgatagtcaacttccagcccatatctggatgcattcttgagatgactctgaatcaaataatttcttttaaaccaaaactaaatatttatattaattgaatgagacttttataaattattccaagtaaagcatgaatttccagagactggcataatttaaacccatactggaggggaattatccatggatttgggttgaaactttcattttagtacctctactcatagtagattgagaattaaaatctgaagaaaaccctcttagataagacatttgtaaaataaaaaactcacttaccattccgactttcttcatcaatagcaactatggtagctggtggtcctcccctagctagtttgcaatctaaagagagaaaataaccaaaagtaataattgactgcaggggcacacacaatgagaaaaaaattcattgagatgtatattaatatttaaaaaggaaaatcttgcaatctaattaatatgcatcactacaattaatattatttaaaaacattttataataaccacatagattccttaccacatcataatacagtcactttgtgcatcacaaaactactcaaatcttactgagaaaacaccagcagggaccactggagagcagaagtccttcaggacagagataatgggatggaaatttaacccaaagaaataacagaaagggatgattaacaaggataaattgtaattaaagcatcacaacagaaacaaacataattggactttaattgtgataaagggtctaattagagagagtgaatagaattttaataatgttctaaagagaataaaacaaagacagacaagcaatgctcatgaggttgtttggggtttttatttttgtcatcttaccctcatattgccagtctggagtcaaaagtatagagtcatcaatggaagcagatcagaaaaatggaagaaagaaaggaagagagaatatatgtatatatttagtgagagatttaaggatataaaaagcattatacaataacattatctaatgatttgtggaaatagaatatataaaatccctatcagatttcctacttctaatataatgttaacacattcactggataatacacatcattagcattttaaaagccgttacaaaaaagactagaaaataacataaagtaaattggtatttttcttacgaaaaggtaaatacgaattacttatgaacagtctgttatctgtatgctgaaaaaactttaagaatagtgcctgtcaatcagtagtgatgattaattcattatttcaaacactgctaatatccttccaggtatcacatgataatgaacataaaaaatagtatgagctataatatccatgacagttgaaatgtgaaaactttgcctgcaggatgtcaaatgtgcacctctgagacataaagtactctactaggaaatactttgtgaggcagagagggctatgtcatgcagttatacatacatggcacactcctgtacagcagtgcaaattaattttgcttgaagttttccaaatttgtgtgttatttgggaaataatttcaaggtttatttacttattaaaattctgccatttattatgtacatatacatgaataattaggccttcaggaagcactattctgtattgtaaggtatgtacgctctcatatgaagcaaagaagctgggagatctacacattttctctctttacacttgtcaatattgaaggagttccaagtcataacattttcagatctaaaatatctcacactcattacgcctcttcctctccttatgccctcctacagagcccagcactacactatttgtcatctctgctcttgatttagtttcctcgctgatctcccagaagtcttgttctcatcctgcattcatctattcctttcatgagaatgattttcatgtacccaaatcaaaagtgaaataatagcattcctctgaacaaaaaccttacatgtttcttttggagaaaatgaaaaaaaaatcagaagaacaaagtttcttcacatggccttaacatcctttattgagaattaagcaacctgtccttcaattacatgaatcctcttactgttgctggaatgtagcctgtatttttagcaaaattttgttatctaaattcattgttgcctttttttgcctagcaaatctctgcttctttttgtagaattagatatttcacatatttgcacctagtgcgaattaattttgattaaagccttccaaattttcatgttacttgaaaaatgatttcaacatttctttatttatttactgttttataaaattcctccaattattatgtacatagaaatgaataattaggctttggaaagcactgtattgtaaggtatgcactctctcatatgtacacacacacacatatacacacactcatgtcactgtgtgccaatgccataatacctactgaaaatagataaaaattatgtattttagtgtgaatgttggtagaggaataaatatttaatcaacaactttatgggcaagcagaatatagaataataaaagaaggggaaatttggatataaatatttttgaacctttttacagtttgttactattaagtttaaaagtaggctttatgaagctaagccaaataatatcttcatattccagcccttcctcactctccgcctttcccattctcaaagttaattctccattcataccaaaccaaatttatgttttttgcatcaactgttaaaatatactttccactcttcttcccctggttaattttattcctttttcaggaatctgcctacgcatcacctcttcttgaaaatccttctcgttgtcattctagattaagtccttattctctgtattcctgcagtacacactgtatcccattggactaattgccccattggcacaatactaatgtgtctttctctctcacaagagcttcttcagaccatgcctgcatcattttcaccttggtaacctcagaacatgatactggtcctgaaagaatgtttgttgactttttccacaatgtagtctgctaagctacaatcttccattaaaacctctccatgagagcagctcagaagtctctgttctcactaacccctcaatagcagaaacagcccagaagaagctgcttaactacattttctcctgctacagtacccttagataattcccactacgatttattattttagtagattcaaaattctccccaataaaacattctttatatactacatatacttctggataaatacaaaaataatttaaacttttttaagactcaaaacacaaaatgaaaagaggttaagcagacacataataaataatctattaataacattgttcataacaaagtgtttgtttttaaacgatgcattcacgacagcataattaattagttttgaagtgcacaaaagcatttttaataagaacaattatatttagaattgtcttggaaagaaagtaatttggatgtaatagccaactatatattatgtatgaaaatatccaaatgtaaatcaaagggaagactagaaagcaatttgggggatggggagattgtaccctatggtctgtggatcatctgtctgccacaggaaagtcaggtgagctgctgatacctgtaccctggaaatggacttccttaatctatttaatttcacccttgactgtcctggttaaatcacaaattcattgtttttcatgcctaaagtttctagcctgttaggcctatactcattttccatatccaatttgtggtaaagtacaggatatgaataccaataactgaatgctcagtgtggcttatttctgcaaacttgtcacaatgctaaaaataagccatatatttaaaaatattcatatgcaatagatgggatttaaaatccaaagaggagaattaaaaagacaaataatgactgatctcacagatactaagcctgtgatactctgttgtcattgtagcctgaattttaagagcatgttacagacaggtcagacaaaggcttttgaaaatctaggattttccgaatatgctcatttcgtagaaatgagagcaagcacccaggaattcaaattctattcccactttagcctattctcaaaatgttcttttaacgttgatcaatgtgttttcaataagacttcaaaactatttactttaaaaaatatattaacatagtaattgcccttatatgttaataacttgtgtattgaatttcctacccatatttatcttctgagcctgggtcccatttgcccagacaacttctgtacttgcaatttcaaagttgtcttaaatgtagccctccaaatcgcatcccagttgctatcatagccgaaaactggatattttcaatatatattatttcagtgaatggcataattctgcaccaagccacataagtcagaaaccaggaagtcacatttcattttacccatgtttctagctttccaaaatgtaccgatcgataagtcttgaatttaattcctaaagaaaaacttgtcatatccactcactgctttcaatctgcagtggtaccaggctaatcttgtctcttacctaatcaaataggttttcctaactgctttccttacaatcaatcttgcccttactctgagttaattttctgtctttaagcagagtgatctttataattaaaaccttgcttatttttaaaagaatttaccatttattttaggttataagctaaaatattttggccatctacaactcatcacaaatatgattctagaatgtaaactaacatattttatataacctacaaagtcctccacaatatgccttctccttccctctccagtctcatctatttccatgtccctcttttcccaaagcaaaatagtttttgatcccttgactaggtaaggtttcccaatatatactctcataactctgcctcataatatcaatttatgattacttgattcttcacagaaagaaaactcagtgataacattgaccttgtttctattcctcacggttgtgtccacagggcagattttcctggcacatttttgattccaagcaattatttactgaatgcaaaaacaaagggcctcaatcaaatttgtaacaataaaattaaaacaacactctgtacattaattcccttttttctttttaatttttcaaatgtctttctcaagtgcaagtacagcaggtccttgaatgacattgtttcattcaatgtcatttcattataacaatgaaaaaaaaaaacaactaattccaggcctgagccactatctgtgtggattttgcaagttctccccaaatctgtgaggactttccctgagtactccagtctcctcccacatctcaaagatgtacatgctaggttcattggcatggctacatggtaccagtgtgagtgagtgtgggtgtgtgtgtgagttgccctgagaaggaatggtatcctgtccaaggtgggttcctgccttatgccctgaggtactgggctagcaggctccctgatgggaggccctgaactggtaaataattatctcactttttttgattaatctttcttaaatgcatgtatagctcacatttacttcaatatttaatataagaaatttttggtctttatttagaagtgtggtgatgtttttgtaaccataactatgtcataggaacttgtttatattttgtttagcctaaaataaaattggtttcattttatgtcatttcattgaaagtctcaatttccaagaacctacggacaatattaactgaagacttactgtaatgaggaaaaaattgacagataatttgttgtctaaagataaggtcattggtgacaactcagcagatgtgaaaggctaccaataaagtaagaaaggtgtagataattctgcaagaatttgaggttatttggaacaagttatgaaagattagagagagctcacaataatagacaaagtaaagtgatgaaaaaaaaggagaaaatgttcacttgcttccaaatgtctataatttctattagaattccaagatgttttatgattttaccaaactgtatcttaaaggaataaaactaagaaatttcaaatactaaagtttaaattatatcaaagatcaacttaccttttttttgtcatcttagaatttttaagctatttccttacaagctgcctaaatcaccagtgaactctgtggcacctagtagagtatttgacttaacataatcatttaatttatttgctgaattaggaaatatcttcctctatggaaaattaacaaaatgaataatccatcaaatccttagctttaaccatttcaaatctttgggggagtgttttaagatgttaaagaaatgggtttctaatatattatagtggttgtgaacatgtgctttggagtcacaaaacctaacttcaaatcctaactttggtttttaatagttgtataatattggacaaattatttaacctcttgtatttcattaatggggataagagtaattacaactaactcatatatttttacaacaaggacaaaatgaggaaatctatggtaatttcttagaagagtgtctggcaaaatgtatagacagactaggcctacatttgcttttattagtatccttattttcattaggaatatattcgaataaaatgttttttctatttttttcctttcatgcaagggctgatagtaaatatagtaaataaaccctcagctctcccaaatattcagtgagggcagatcttagttatatatgggattgtgaaatatattgttattaagaataaaagtaattacatgaaatgtcactggtggtctgtagggacaaaaatttgcttgaattcctatcccagataccaagctagatatactctgatggattaaatttactagggaaaaatagactccttgaacttgaagcttaaaaaaagtaatggggttctcacagtcctctactggtcccagtatgcccctgatatgagttggtgagattccacagaaagatcaaggaagagttgcagattttgtgaaacctctattcctgccaacatttctctattatctgtttcgttattcagagtaatctagtctcttgctcatgtgtttgtatttacacagacacacacacacactgaatctattgctaagttcaaagcaatttggcacctcattcaaagaaggtactgtgttctctttaaatttcatgctacacaagcattctgttttcaatttgcatgtcacaagcagcaggagagggacttttctcatttttcctgttgatctttggtatattcattttcaggaaaatacacacaggagtgaaatcttaagacagatactacttattttacattttgactgcttcatccaaaagaaaaagtttgatcttgaatttataaaatcaatggaacaataatctaacttgtatgatctaaagttacagtcaacaaactaatggaaaaagacaatgatagaacaaaagcaaaataaactgagtaaatttaaggacagagcaagtaattcagttccaattcaagaacaggatatgctacttgtgttactctcttggcattactatttgcagatttcagatttcaccatgaagggagcaaatgatattttatgtaccttagtgtcattattaattgaattatataatttgatgaagactttaaaacaacattgtctagtaatatccaccaaattcattcatggtaattactcaacatcattgctttcatcaatacaatttactctagagaccatagctacctcaatctgtacttttaaaaaaaacaatttcttattattttattttattctaactggtctatcaacaacagcagacttgaacataaatggcatttggtcagagaccagaagcccatacttagtcttaagaagtttggccggatgcggtggctcacgcctgtaatcccagcactttgggaggccgagacaggcggatcacaaggtcaggagatcgagaccatcctggctaacatggtgaaaccccatctctactaaaaatacaaaaaattagctgggcgtggtggcgggcgcctgtagtcccagctattcgggaggctgaggcaggagaatggcatgaacccaggaggtggagcttgcagtgagctgagatggtgccactgcactccagcctggcagacagagcgagactccacctcaaaaaaaaaaaaaaaaaaaaaaaaagaagtttaaggttctaggggctttaggaaaaaggcagaatatgaaataaattgtcagtagaaggctgctccaaagatgaagtatataattttaagattgcttttgttgattgaaaatattattgtactttattttatagttttatgtaaatacattgtcaaaacatgttaatctttgtattcatacataattctcttacatataattcataccacatgagttagaaactgtttaggttttccttccattgtgggttacaactcttcttttcttgtctaagcttccagcaagcaaccatgattcaatttgaggaatttaagatgaacagaacaattcttggtccaaggtgtaatattaccactgacatcaaaagaggccatataatgttgtggttaagaacatagcctttgagacagactgcctaggttaaatactagtcacatttaacaccttgctcactcttaggacctttgaaagttaattaaattttctgtagctcagttgcattatttgtaaaatagatgttgttttagagtagtgtctggcatatggaaatgctttctatgttattgtgaggtaaatttttattctaaccaagtgagcaaatcacttaaaatatgtctgttttttaaaaagcaatgactgtcatttttttttttaatatttcagtagaagtttcttccatttttaacattcaaaggaaaaccacattttattagtagatcaaataaggaatggggcatatgttaactttttaaaaaataatttcaaattttcttttatatttaggaggtatacaatatgcaggttgttatctgggtatactgtaaggtttgggatatgattgattccatcatcaggtaatgagcacagcactcaatagttgttttttaaatacttgtccctcttccaccctctccccttttctagatgtccagtgtctattactgacatccttatgcccatggctatgcaatgtttagctgctacatataagtgagaacatgaattatttggtttttctgttcctgtgttaacttgcttaggataacagcctataactgcatccgtgtggctgcaaacaacatgatttcattctatttttatggctgcatagaattctatggtgcatgtgcagcacgtttcctttatccaattcactgttgacgggcacttacattgaatccatgtctttgttattgtgaatagtactgcaatgaacatacaagtgcatgtgactatttggtggaacaatttgtttcctttttttttttttttttttttgagacggcgtctctctctcgcccaggctggagtgcagtggtgcgatctcagctcactgcaagctccgcctcccaggttcacgccagtcttctgcctcagcctcccgagtagctgggactacaggcgcccgctaccatgcccagctaatttttttgtattttcagtagagacggggtttcaccgtgttagccaggatggtcgcgatctcctgaccttgtgatccgcccgcctcggcctcccaaaatgctgggattacaggcctgagccaacgcgaccggccgcaatttgttttcttttagatatataaccagtaataggattgtgagtctaatagaagagctggtatcaagtctgaaactactctaaaatatcaaggaggagagtctgctccctaactcattctacaataccagcatcaccctgataccaaaacctgtcgaagacacaaggaacaaagaaaactataggtcaatattcctgatgaacatagatgcaaaaatcttcaacaaaatacttccaaggcaaataaagctgcacataaaaaacttaatctaccattatcaagtaggcttcattcctaggatgcaagattggttcaatgtatgcaattcaataattgtgatttatcacatggacaaaattaaaaccaaaaaccataaggtttttgagaatctccaaatttccacattggctgaactaatttacattcccaccaagagtatacaagcattcccttctctgtgcagcattaccagcatcttttgttttttgacttcttaataatagcattttgactggtgtgaggtagtatctcattgtggttttgatttgcgtttctctgatgattagtgatgttgagcattttttcatgtttgttgtctgcttgtatgtctgtttttgagagaagtctgttcatgtcttttgccaatttttcaatgtggttatttggtttatgtttgttaaattatttaagtttcttatagattctggagattagacctttgcgggtgcatagtttgaaaatactttctaccattgtgtaggttgtatttttactctgttaatagtcttttctgtcgggcagaagctctttagtttatgtaggtcccacttgtcaatttttggttttgttgcaattgcttttgaggacttgccataaattctttgtaaatgcaaacatcaaggatagtgtttcctaggcttccttttaagattcttacagcttgaggtcttacacttaaacttttaatgcatgttgagttaatttttgtagatagtgaaagtaagggtccagtttaattctgtatgtggctagccagttaactcagcaccatttgttgaatagggggtactttccccattccttatttttgtcaattttgtcaaaaatcagatgattgtaggtatgtggctttctttttggattctcttttctgtttcattggtctatgtgtctattttgtaccaataacatgttttgttaccagtactatagccttagagtatagtttgaaaaaaagctatgttgtttttgcttaggattgtgctttggtttgaacttgtgtccccatccaaatctcatgtcaaattctaacctccaatgttggaggaggggctggtgggataaaactggatcatgggtgtaggatttgcccttgctgttcttgtgatagtgagtgaattcacacaagatctggttgttttgaagtatgtagtaccttccccttcattctcttcctcctactttggccatgtccccagccatgcttcctgtacagcctgtggaaccaagggccaattaaacctcttttctttataaattacccagtctcaggtagttctttataatgatgcaacaatgaactactacagattgctttgtctatttgggttctttttggttccatatgaatttcagaattttttctaattctgtgtaaaatggcattgaaagttcagtagcaatagcattgaatctcttgattgctttagagattatggcaattttaacaatattgattcttccagtcaatgagtatgaaatgctttttccatttgtttatgttatctatgatttctttcagcagtgtgcagttctccttacagaggtctttcagcttcttggttagacgtactatctaaaagccctacttaaaaggcacagagtgatgggttggataaagtaacacccattcatctggtatcttcaagagacgcttctcacatgtaatgatccccataggctcaaagtaaagggctggagaaagatctatcatgcaaacagaataccaaatggaacaagggtcactattgttatatcaaataaaacagcttttaaaccaacaacaataaaaaagaacaaagaagggcattacataatgataaagggttcaattcaaagacaagacttagttatgctaactatatacatatgcaatattagagcatccaaattcatgaaacaaggacttctaaacctacaaaaagactgacatagcacacaatgatagtgggggtcttcaacaccccactgacaacattagacaaatcattgagtcagaaaacttccgcagaaattctggaattaaatttgacacttgacaaattgagcataattgatgtttacaggacactccatatatcaaccacagaatatacattcctctcatctgcacacagaatatactctaagatcaaccacatggttagccataaagcaagttggaaaaaatccaaaagaaggtctttccataaaacaagtctcaaagaaatcaaagttataccaatcacataccaaccacagtggaattaaaatagaaacctataacaagaatatctctcaaaaacacacaaatatatagaaattaagcaactttgctcctgaatgagttttggattgtaaggcagaaattttaaaaaattcttttaaataaatgaagaaagacacgcaaaataccaacatctctgggatgtgggaagagatatgttaagaggaaagtgtatggtgctaaatgcctaccttaaaaagttagaaaaatctctgattaacgatctaacaccacatctagagtaactagaaaaacaagaacaaactaactcaaaagctacctgaagaaaataaataactaaaatcagggcaggactaaataaaattgaggcataaaaatccataaaagcatcagcaaaaccaaaagttggttgtttgaaaggacgaataagatctatagaccactgactatatgactatataaacaaagaacaaaacagagaagatccagataagcacaacataaatgacaaagatgacattacaactggtccaacagaaacacaaaaaaatcctcagagactattatcaacacctgtgttcacacaaactagaaaatatacaggaaatggatatattcctggaaacacacaatctcccaaaatttaatcaggaagaaattaaaaccctgaacagaccaacattgagttccatattgactcagtaataagaaacctaccaacgaacaaaagccccacaccagatgaactcacagccgaattctaccagatgtacaaagaagagctggtaccaaatctactaaaactattccaaaatatcaaggaggagagactcctccctaactcattctacaatgccagcattaccctgataccaaaacctgttaaagacacaaggaacaaagaaaactataggtcaatattcctgatgaacatagatgcaaaaatcttcaacaaaatactttcaaaccaaataaagctgcacataaaaaacttaatctaccattatcaagtaggcttcattcctaggatgcaagattggttcaatatatgcaattcaataaatgtgattcatcacataaacaaaattaaaaccaaaaactatacgataatcccagtagatgcagaaaaagctttcaataaaatccaacatctcttcatgataaaaatcctcaacaaactctgtatcaagggaacatatctcaaaataataggagccatatatgacacaatacagctaacattaaactaaatgtcgcaaaagctggaaccattccccttaagcactggaacaagacaaggataccattctccattctcaccacttctatttgacatagtactagaagtcctaactacagcattcaggcaagagaaagaaagaaaatgtacccaaacacgaaactaaagaagtcaaactatctcttctataaccaggaaacctcgatgacatcaccaaaaagctcctgaaactgataaatggcttcagtatagtttgaggatacaaattcaatctataaaaatatattaacatttttgatgtgcatttaacatactaaaatcatgacttaatatatttcagtatataaccaccgattgtttaaattacatagtgataatggaactatactttctttttaaaaattatctgaggaatgtttataaataaactaaaaataaacaactcttttttgatacatacagtagacagtatacagcttctaaaagctctttacatggtgaaataagatctgttattccaaaatctttccaaaagaacttttctgttattagcttgtttttcaacattatccaacttgtctctgtgttttgtaattgaaatataaaggagaaaggaaaaggataatatttgtgtccatgtggaaaacaaaattattcatcaaacactttatgaaaagcagcttttatttccatcttgtttctgaaagctaatttgttattttttctaattattcttaatgaggaggctcagaggaaattcttaatcatgattcttactaagacactcaacaaggtcaaaagataaaagctgcagaatcaatgtcactgtttaaaattacactcttccaacagagagattcttaataagtctttgtttgcagagtactttgactactaaataaaattctttgccacaagacagttatgtgtacttaagctgcattaaaaaaagcaaactgtatggattaatttttgaaacaaaaattataagcatttaattacttattaaagaacatatccatgtaaatatgtccttagctgtccagttgtgacagatgttagcatgaaatagatgtgccacatttacaaggtacgggatgttgaagcaattttcctacttaagtgaagtaatataggcttatatttctggaacttcagaagactgtgctaatatttacctttctgtttcatcatctaggatataactatttttcacttatgtgtgaagcaggaaagttgttagacatagcaggaaaaagtacttcgtatcactggctggcagagaaagtttatatatttgagtttatacaggtaactggaaatttagaagtatttttcattgccttattttcttattccttgtcatgaagagtgtttggactgaggttctactatgaaaggtgaatatccaagggtggaatgagtagggactgtggctgagagttatgaaagaagatgattctgaaaaaaataacagaaagcataaagcaaatatttcctactttttccatacatcacatcttgctttctcagaaatttctctgctacaaacccacctgataacaccttccttagagccatagagccaaagtcattacagaggaatgtttcatatagaacaggaagttccaaatgaacctatgttctttttgatacgggagtactgggaagggaagagcgtggtccctttaaatgacatggaagggggaaagggaagtgctgagtggagaagggcgtggtccctggctagggctccataggtgaagactggcgctcctgcttttgtgcccaaatgttgcattttccaagaccaccctggcctgccatgcccccatcctgggcctataaaaagccaagaccctagcaggcagatacaaatacaggtggatgtggtgaggaacacattggcagaagacataagcggctcctagactccaaaaggatgtcgagggagcacaccagcggaagagcacaccgacagacactggcacgcgtgcaggccacccactggtggaaggaggcggagtttggtccggggaagttggaggagagccgtggccccccaaaactccgaatggcccactccaagggaaaaccatctcccttctggctcccccattggctgagagctacttccactcaataaaactttgcagttgttctccaagcccacgtgtgatccgattcttccagtacaccaaggcaagaaaccccgggatacagaaatccctctgtccttgtgataaggaagggggtctaattaagctggttaacacaaatcgcctatagatggcaaactaaaacacatgccctgtaacacatgcctactgggccttcatccctagacactggggtcagagccccacatcctgcccatttgcatgctcccctagaggtttgagcagcggggcactgaagaagcgatccacacccccaacgcatgccctgcgaggaggacaagggaacctttcccatttcgttttcattgtttcacaataaagaagtgacaagggatggatgtctacctatgtcaactgtttttaaaaataatatttcatgtaatgaactggcctatgaaatttgatcatatgatttggatcattcttgtcacacccaattaaaagaaagttgactagccaggggaaaaaaaatcaggacatgtagcatcgctctagaaacgtaattttctgcaagtctggctgttgaaactgcctattctaacccgagacagttttatttataactgctgagacaacttgcaactccagggctaattttccccaccgctgttgctcaccaaacagagtttgccagctccccagaaacttactagtcccaatgcactttctctaagagcaatacataacatttctcatttttataaaatcaccaaccttctctttgttcttcagacataccgaagaacacctgacccgtgtgtatgctccaaattgtgattctttattctcaaagaaaacattgaatttagagatccatctccacatttctattttgacttcaacaatcccattctgcatcataaaccttgagagaataatatccaaaccaagtcagatcagtaatttgatctgacatttcttggggtgaaagaaaacttttgttggcaagtttagcaaaagggactttggccacatgctgaagtatgcatatgtacaaatgaattacttcaaggaaaatgagctaggataacagtttttatattggccataaggataaaaacacattattgattaactgcattttttggagcttggaagttttcttaagaattctctaaaactgaatataataaagtgctaagacaagtattttaccacccttgacatttagaaatgaagtttttgatagtttgttatccacatgtataacatatgatgtggaaagttttatgtcctgctgagcttagttctcataggctcaattttagacaatttctatacagacgcctgcaattttgaatatctgctgctatttatgaggccttcccaagggtggtactccatatttaatttaattgtgtttgcatatatcatacattttgccaacagtaagctctaagagcactttatagttgataacaacttccttcattgctttccaagctatatgatttcttactataaaaccagccttccaccttcagtattgttagttctaacggcatacacgcaatggttttctctactatgttcaaaaagagggtaaaactactaagagtggaaattaatctgttaaaaatttctgttacattaacagcattttattatatctctcctcaaattaatttacttgagtacagtgctagaattgttattctgttgttagactttatgccataaattttggtaatatgtctatcatcaggaggttgggattttcaaaatttttcaattatcataatcagagacaagacctaggaaatgagatcaatttagtccctctaatcacaaatgtctgtactctaaagttcatgaacttgacactaagggaaagccccagaatggattagaaaatgctaataaaagtggagaatgtgtgggaaaaaaagacacctggctaaaggaaggcatgtttccaattttagagcaaggacagagaaatttttacagtagatataagaattcacaaagcatagctgtctggagcaaataatgtctttctctactaaaatagcttcaatactactttgttgcagattgtactaattaacagttatgttaatgatggtaactcatcatcacaatttttattttatgcaaactctttaaataatagaaaagtatgcaatgtattttagaaagatttgtatccatggaacttataaccaaaacaaatgttaattaaaataaagtaatatttttcttctgtcaaattgtcaaaattttattaaaaataatagccactattggttcaagtaaggaattaaaattattttataattttggtgtagctataagttgtttctatataaagaaagaaaggagagaaagcaaggaaggagggaaggaaggaaggaagagaaagaagacaaaatggaaagccaatataccaagaacttttaaaaactgtcctttgaatgaaaaattttactttgggatctatagcaatatagagataattaaagaagtatatattgctgctaaaagtacttataatagtaaaacattatatatgtttattaaatcattatgatttaaacacactctgtaattgtgacagatactgtatattggaccacccactctaacacctcttcttgtatttttctttttgtgcactattgaggcagataaacttaaaactgcacttgccagactcatttgcggatagggtctaccttggaatctgcgaagcagaagacactctcatgacacaagaacataaaggaacaagtgagccaaagggaagtcagttaatcactgggcaggaagtgtatggttctttgggggcagctgtggtagagaaattagtgcaacaccaggttatgatagttgccatgatggggattgtacctatgaggtttccactagaaagttcagattcgtggttaggtatctatttggctctcatgatcttgccgctgtggcatccaagcttagttttctgatgcttctaagtcactagaccacattagtaaattcattacagatgaaagaggctacctggattctatgaaattggatgaatgaataagccattaaaatatatattcatgttgttaaataaattttgatgggatgagtaattctcatggaaagtcaaaaaattataaagcaggttttagaactgtctgtacattcttagttttgagtgtgaatatataaagtctttttaatattaaagactaaataaatgaaacattattattgttattagtgatttcttattgaattcctaaattgcttttaggaatttattataagaaaatagtgtcctttgcatttttataagaaataaatgcattgcatttattataagaaaacatgacaaacacaatttggaagcaaaaataaggaacttcatttgtttagaatacttatagtaaatatcacaaagattctaaatagaataataaccttatcacaatataacgtaagaaacactgtaatgtgaaatctgttttgttaaaacacatttagatttaaaatttcttaagccattggatatgccttgttatcagtgtcacacactgaaaacttctagaagttgtcatttcatctgatacatgaagagcaacagttattccttaacacctccttcaacaccgcatgattctcctcaattcatattttgaaatttgacatatggcactgatggtgatatgacagagagaatctcaatgtgtcaatgacttcatcatattcatttgggcaactgagctagagtcttctgctccatgaagtctgtaatgacattgtgggaaagctgtaggcaggagcttcatattcagatcaaaggcaaatacaaaccagggaagagctatcttccagtcaatatttgttggcatttgctatattataaaacttcaagcactctcccatttttctgctcaatttttcttccattcattgcacggtgagatatgttccaccatgaacaaaggaagttaataagagttttcaaagatacaataaaatagatgaagtttaatatgacatttaaccctattgcttctcaaacaaaatgctttatatacatagcaagctggcttgctatccatcttctgtcactattctctttgtttactattattttgttttaccttttctaaaatgtcaaatatatcagacacacaatagagtatctgatatatttgtagagcttaaaaatcaataatactacaataaaatgaatatttatgtcaccaccacctacaatcagaaataaaatcctgccactatcttataaatcttctgtgtgcactttgatagacttttgcaagttttagggctgtataaaatagatttacacagcacaaattctgcaacttggctatttctctgcattattatgtttttaggttaatccatactgatgtatatacctttagggaaataatgctgtaaagtattccattatataactggatcacactatttacctgttctttattggagagattactgttgcaataatttttatttgtattatgaacaaagaccagatgcatattctggcatatctctcttggtgcacaatttgaggaatattttaggacatacccttaggaacgaacaaaagtgctgtgtcatgggtatagtatatatttatatttacttagttaaaatcaaattattttccaaattggctatgccattttctcagttaccagcaatttcagaattcctctttctccccatcttctataagatttgatatgatattaaacttttgtcattttgattgttgagacttgatattttatgtttttaaatttacatttttttctgactacttggcaacttctcatgtgtttaatgaaaacatgcgccactgcactccagcctgggcgacagagcgagactctgtctcaaaaaaaaaaaaccaaaaaaaccaaaaaaaacccatatatatatatgttttatatatatatttatatatttacattttatatttatattttatatgtatatacttatatattttatacatatataaaatactcacatgttttttaatgtggcttatttaaggaaactttactgatcatagagacataaaaatatttttcttaagtttcctttaacagttttagatttttgtctttcatatatgtcatccatatatgtgaaattatctattgtaattatttattaagtgttgaagaaccattttaattttccacatgagaaataaattatttgaaaaactaaggaaagttaattatatccattttcacctctaaatatcacctatttatacttctattttccatggtatattatggatccatttctgtacctttatatatatatgtatatgtgccttatataaattattatataatatatattattgtatatatttatattatatatttaatatatagtatatattatatataaatatataatacttatataaatatatatacatatgtttgtttcacatatatatacaacattgcttggttcaatttgttaataatttcttaggaaaatttttatccctcctgactttctatggtttttggtgacaacattttcctgtgtctttgaaggctgaagaacattgtaattttgttgcctagatgtttcttggatttcttccataaaactttttgagcctggggtttattgtgtagggaaaacataattgctagtgctagaatttaggttttctatcatgtcagatgtcgctatgtatagttaatgtttttctagaaatgtgtctattttgtacttttttcaatttattaacatatatatttcatatcatctttatctaaaaatctcagtctcttctgcagctataatttcggcaataccagttttaatattatttatttggcttctttctttaatttctatttttcctgttcattttaattataaattaaataatccttggctttgttaagtctgcattattttgatactttatgttttttattatttatttttatcttctttgtccttattctcttttctttacacacacacacacacaatatttcagatagatgcttattttgttgattttcagcctttcttcttttcaaccatgagaagttaaggctataaattgccccctcaatgcttttagaatcacatttcaaaaatgttgaaaatttatattagtggtaatttagctacaattgtcttctaattatgatttcttttttacccataggttatttaaaagatagttttaataaatacaaatgtatttattttacatatttttattactgaattactaatttatgtagatgtcagagaatgtgggtatactaatagattcttttgtaaaatttatcgaaaccttctttaatgcctagtatatggcccatttttaaagtttcatttgttattaaaaataatgtatgttctacaacttaacagtagtagtagtatcaaacctatacctttggtataggtttttatatatgtccactggaaagtttaagtatattttgatatattcagtatcttattgagataggatattgtgtctgctaatctatcaattgttgacaataatgtgtttaaatcttctacagtgatgtttgttaaattatttttgtacgtctgcgattttttaatttatattttaaactatgtagctaggtacatgcatatttagaattgctacatcttcttagtaaattgaacctttataattactgtatagtggccttctttatagctagtgtatttttgccttaatgctttatgatctggtcaggcaccagattttatctcctaactcctatagactctttaaaactcttaaaatcttaaaatataggatccagaccacaagcaatttacagacgctccaaaacaaatgtggattttaaagctttcttacatcaatagactcatgctttcttatcttatctgattgttgaatgattctatttctttttccatgttatcaccacattttaaaaagagtttgttttgttttgttttgtttttgttatccgtgtttttagggagtagttttctgaaattccagtcagctaaaatcctgaaataggaaaccaactgttattcttacaacttccactatgcaacctctctctcgctagaaaaatagtatttgcaaatatcaaaatataatcccctttcctgttaggtgagctgcatgcaattaaactaaacataatttatattttaaaaattattttttgccattattttcttgagccagtgagttctcttatttttgcccctgtgccttagtgtatgtgtctgtgtgtgtgtgtgtgtgtgtcacatgtgcgtgcacacacatatacaatgtttgttgtatttttttctggttaactgagactaaacttgaaatttaaagctggccttccatgaaaattatttaatgatgcaatgcaaagacaaattgctttctacatcaattttctatgcaagtacctataaatgttagataactaaattatcccagagttttcttcaggaaatatcagccttttattcaagtatatgattttctataaagtattgctattataatcttttaatgctaggtgaatccacatcaagcattcaatatttgttggatgatacaattaaatttctctctgcttaggttgagtttacattgtctttaaaaatgtcttttaggcagggtgtagtggctcacacctgtaatcccaaaacttgatgaggctgaggtgggaggatcacttgaggccaggagttcatgaccaacctggcaaacatggcaaaaccccacctctactaaaaatacaaacattagccaggcatagtggcacacatctgtaatctcaggactagagtggacgaggcaggagaatctcctgtacctgggaggcagaggttgcagtgagctgagatcacaacactgcactacagcctgggctacaggctgagactctgtctcaaaaaaaaaaaaaaaaaaaaaaaattaatatcacaaacatggtaaacataaaaattatcacagtgtaaaggaaaaagtaatatatactcacaaatataaacagacagtgggagtggggacaaatttgcattcatattgaatcaagacatttatatcgcctctatacaaaaacaagatgaactaaactaaattaaagggatgttaatctagaaattaaatgtatcatgtcagctagttttaatatatggatgctttgggcattgtaagattaaactttctgaatcataacagaatgaagctcattaaaataaaataaacttacccaaatggaagatgacctaaaagaataatttttgggcaaaatattataaaaatagctacacagatattagaaaatataacaagcaaaatttgatttttactttggtgtacaatgtcccaacattctgaataatacatacccttttctcttgaaaaatatgtatatactgaatgactttaaaacaaatctagaaattaaatgtatcatattttccatactgtttttgtttcaatcagattttttaaaagaactttcatctctaaatttaggaatctctttttacaattttttcatttacagctacctcaaaaaatagtatgtattcctaaaataatatagtataaatttattttgaacatcaaaaagaatctgagctcacctatagcccacaaatggaaatgagaaactcatgtgttttcatatttataaacacatattacatcttatacaacacattatgaaaaagaaaataaataaaagcatgctaatataatttgaatgaacaagaaatgctggaaatatttgaattctacctttcaaccacattaattagagcttccactaaatcatttccagactcatataactgtaataatttcacacctataattatctctccatgttccctgctatgtttattttacttaaattagacatatttcagtatgttctgaagattttgccttatattcaacattacatatttgtttaaactcctcccttcatgaatgtactctcctctgattctataggaccacccctcatctatttttatgcactagctccattatgaaacctttcaaaatcataaaaagtagaaaattttattcatagttcacagttgaagaaaaggcagctcataaccttgaagcctatatcctactgtgatactctttgtaaatgatagtatgagaattaagcctttatttaaaactttttcatgtcaatgtcagttctgtctccaaaacttaaatggcattattaatgaatgtgttacaggcattacaatgcagtgattaagaatacagccgctaataccagcttccttgagtttgaaacctagctcatggctccctcctcctttgttttgggaaaattacttacactttatgtctcagcttccttattggtaaaaaatgtataatatgcaagtctaccttatagaattggtggaagcattaaataatgcagttgtgaaacatacaaaagagtatctagtggatggtaagtgtaaaagtagtattaactattagtatctactatatggggttgtgggttgaagtccactaataatttgtgtcaacattactctggtaagagttcatggcaatgacttgttgattctaggaaatttctgttcatcaatgtattgtaaaaaataaagaacttcactgttttttatttttccatgaaatgcctacagatcaatttactgaagacaatagtctgcttatttgtgcaaacagttcacttatgaaacaagtttatttcttcactatacctaccaattctaaattattatgtcatggattttttccattcctaatcagttccttctcttgaaagatctgcattacacaacttgagaccagactccaaagctccataaatatcccattctgacctcttttaaacacttctaagattctgtcagggtggtgtgctttttgattacaatgtattccaataaattcaggtgtactttacttacagattatctggtgatatattgaggagagcaatgaactgtaagcaccactgtgttctagctgagatcccctctctgatgtgtcttaagatccttgacttgcaaaatgaatgctctactggggaagccttgagagactctgcaactgtgatggtggggtctaggtattgatattgtgtctcaactttggtcactgtcaagttcccaaatgttagttttattttgtctaatgggaaatagaatctattttaggactttttctgtgatctgtttagattggaaaatgttaatgtttgatttaaatctgctttattgctaaattactcaattgtgtccttctgtcctcatttttgtgagtctctaagaggaggtttatacaaaaatggccagacatggatcctgataagttgattcctagagccagctctggaattaataacttcagaaggttcctcctcggactggtatccctcacataaattttccctggagtcaactcttcaaaaccttaggcaaatgtttcttattcttatcctgttcagtctttgagagtcaggttctgtataaaatctcccattaaaaaagtttatgttatccaagaacctcagattatcgaggctgggattaaaaaaaaaatcattaacttggaggcctgaaaacactatgcaaaagcaacactttctactgcttgttgctagattctcatggctttgaatcacactaagtgtatgccttctgtaggctgaacccttgcctcatatatgtatctacattataaatctaatttccatgactgtctttcaaaaaggcataatttctttacaaataatttacagttaagaggctacttggtgaaatttttatattaacagaagttgttaatttgagaggagtcttaaaatggaaaggaggtaaaattcctattacaatgtgaacttaatggccttttccctactttttattttcccctgtctttgtttactcaatacccttttgccttactccattttctcacctggccccttacctcctggattacacaacctgagtttcacaaatctcaattgcctcttaaagttaagtcctctttagacatcaacaagcttcttatagtttatttttagccttcattctcagtctgaactaagaatcaatgtaaaagtctggacaaagtacagaggaatttagaatcattctaacaacatatatcgtaggtttcccagatctacgtaagtgattcttatgttagtaagaaaattaatgtaaaaaaattggattaaaaaatgaagacttaggataatctaaggtgaatgaaagaccctgaatattagagaaaaccagaagtatttaggaaagctatacacagtggagaaaatattttggaggctaccccaagactttcctgaaaataggttggacttccatctcattataaaaagagaaagaatgaatcaatttgaaactttaggaacaggacctccaacacctttagaaaatattcaggagtagatcttgagacagacaggacctaaaccctctcatcatttttgcaaagagccctaaaccaaaattagggaatgtaaaatggaaaaagtacatcggaaaatgacttcattgacaaacagaactccaattcctaactgaacattttgaaaaagtcatggaataaaaacagaataagcctctgaataagttaacagccttacagatgaaacaactggctatttctcctcaatttatcaagtatcagaggaggaagcttcctgaatacaaacattgatagataactgtaagcagaaaggacattggaaaaagattcataaaggacattggaaaatagctattctgcactaactgtgaaactaaaagaaaatttttaaaaaggaaggatgtgataagggaagttgatgctgatctgtggggtcattaattccctgatgtcccatttctctaaacattaacagacagtatcaaggtttctgattgattcaggcacagtaatatagtttacagaccctgccacacatgcattcagtcactcccctagagtcaataaagtatttaggagatgagtatttgcaaaaatctacagattattgtgtatcactctatagcttttgccctcagatctttaacatcgtttgctcatttgagacagcacttcccctcatttaataggtagggatttcctatgtaaacagaattgctaatttaagtgctctcttgatgggctttctcttgagatctctaaagaatcacctattcagcagggcacggtggctcacgcctgtaatcccaacactgtgggaggccgaggcgggcagatcacgagctcaggagtttgagaccagcctgaccaacacggtgaaaccccctctctactaaaaatacaaaaaaaaaaaattggccgggtgtggtggcaggcacctgtaatcccagctactcaggaggctgaggcaggagaatagcttgaacccaggaggcagaggttgcattgaactgagatcatgccactgcactccagcctgggtgacagagcgagactctgtctcaaaaaaaaaaaaaaaaaagaaaagaaaagaaaaaagaaaaaggaaaaaaaagaatcacccattcataatcatatcacacctaatttggactatggagtacaaggagcctggtatcgacatcaaactcaaattgaagatctactgatattggctgaattattggggaagaacacctcacatttctcactgacccatttaagcctccatctacacttgccctctacaaccaaagggaaaggacaaaagccagcagttgtgtctaacagaaaaataattacgaatactatgcactagtccttggaacactcctattcttctgatcaagagatcccagtgggctggggtacccatttatttcagaccttgcaactataaataaaatatttagccctgttttcctgtggtgccaaaattctatattattttaatttccatgctacctgagattatgtattttagcattctaaatccatgttctgctgtttgtattgtcccttttagatcataatagaaaatactcattagtctttctctagaaaaatcaatgatgtacctggacagttttactgcagaagtgtactgaggcacccaggtaccttatacaagtcttctgctagacactgaaggaccttgaatctctctataattctactcttatccaacatgcagacaatttttgctatgttgtcaagatgagataatttttcaggttgattccaactactacttatagctcagaaagtatataatgtgttcaaagaaaaattagaattttgtaagaagaaaatgcactatttagaacatgatttataatccatcactctggagagattacaaaacactttttttttttctaaaactgttaagaaaatatacttattttaagagactttttttttttcggctgtagggggtgaattttttttttttttcagtgagagcaggttaattaggaaagtaaaggaataaagaatggccactccatagagatttcataggttattacatgcaatgggttcccaatattactgaaattactgtacctctaaattttaacttagttgttagtaactcaatctctttgttgtattataagcataattagctgtaggggtgtgtctctgtgtgccctgggagtggcagggttggggttgggggtgggaggagtaggaggctgtgtgatttaaaattaattatttggccttcctaattatcttagatctttttaccaatttgtgcatgatcaatttggacaagccattggtgttttgactttactttatcagaatctttaaagactattcatctttaaagttatccataaatttttcatagactcagtggcaaaaggctactcaccttgtctaagggcaacagccagactagtgggtaattacagtgggtaatcttctgatgtttctgcattatattctctactcttcacctaattacctctgaatgtcaccaaaactgtacagtaaattttaatcacacaaggaaggtattttggacaatgataagtctttgggtagattctaaagaccagtgttaggtttgcaaaacaaaagtctattgggtgtggccaacaaattataccaaaaaattgttatctttgtaaatttagacactatactttcagaatggtgcctaatattactcatggatgatttgggcacatttccccctcaaaccctagaaaaagagaactctagataatttcattcaagaaagagaaaaacagggcctcattttgagatatacaacattactcatgtctaattctgaatagttttctcctgtctttaaatcatactatctgtgcttcagatattatcaggaacactgaacaatttcagtgaggccatagaaatcatcacctggagatttcataatactgaggaggtggtacttcttcaaaacatagcagtacgagaaataatattggcctgtcaggatgaaacatgaggcattttacaggaggaaagtttactcatattcctatagttctttctgtttttattttattaagaaaatatgggaaattttttaaaaattacaagacaaggtgataaatctagtattcccacatctgaccattaaaactttttggtttggtcatgggttccattgtattgctttaatttaggcatttttggctcttggcttagaatgtaaaatacttctgttagtatctgtctgtgattcagcattcaaatatcaggttttcataatcaaaaatatttctatgtagccactctgatatgacaataaatgatcatgcagccaaaacaaaaacaaacaaacaaacaaacataaaaacctaatgtatatgatagttgaaatgatcccaccagaaatctgatatgcaatcaggaccctgaagacagtggtattgattttgattgattatttgtgcagatgattattatttatcctccagcttaggttgaaaaatgactacaagagagttctgagaaataagaaaccacctatgttaacaaaactttttattgtttgcttcaaaaatattttctatgaaaggataaaatcataagccaactaattttattattttcttcaggaaatttccacagatcaatttattagagacaacactctgctcatctgaataaataatttatcaaacaacagtttacttattgaggctgcttgtttccacatgcatctcgctctgcccaccagtcttaaattactatatcataaactctgtataatctcagttaattccataccttaaatgactcagtttaaatcactttaccacaatccccacacacgttaagtacctcagttttgacttccctcttctgaaacattgctatatcattgtcaaggtgatgtttactcttacctattgtagtaacttctataacatttaaattttattactacattatcattcttggactaaacagttaaattgtagttattgttctttcttctattactattaatactactattttggtatttctccatcatttactgttgtgggaaaatgtgagaaatatgactgtatatattttattttattcacccaaactagaatatttgtctcttttatacctctccaaagaccccacttctatttttaaaaattagttgatatactattttgtatacatgtttgtttctatctgcttatttagtttacatgtttccttttattctttaccatctaagtactcaattcaaataagatacagagataaggtcagtttctgatagccaaagaatagcaataggtttggcacaagaattgcgcaggttcctcatgaatttgactctaagaaattgtgaaatctcggggaagacacacgaaggcctctgcatcccagttttcccttatctcacttttctcttctcttttcttttatcatatgtatgctatgtgagaattacaataattaaaatatgtaacatatgagaattaaaatatataataaggatagagcttactacaacacctagcacatcctaagtgctcaataataatccttattactttgtaatgctcctgtgagtctgaaaaataatgtatttaaggctcctagtagatactcttttaacaggaactactaatcttgttattgatattaatatagcttggctatattaatccaggtggatcaacatcctctgtataaatgaaaccacctatttacaaggtattccacaataattcaatgttgcatcttcagcaagaacaagccataggtctgaaaatgtaagtgcaaggcattgagtatgcatttgtgtatgtggtctgattattgctctgaagataaacaactactgagaccatatattctgaatcctcttacaggaatacagtatatgattgaattttttttctatctacagcttgcaatgactaaaaaaatgttggtttgttcccacaataaattccctccaagaccacaaatgagaaataccactttacatgtgcataccttaatgatgacctcttcttgaaaacaaaacaagcatgctttagacagaattagcttctcactgtagagatgactggcttaaatgagaattctgtctttgctctaataagtttatttgacatcttggtttgtcttatagtaaaaaaaaaaaaaaaaaaaaaaaagaaaagaaaaggtggtttgctccctttccccatggtgttaaattaattccatgagcagttttgttactctacacaataatacagtgtgtccccttatttatgtcataatgtgtcataatgtctattgggaaaagagatcaatttatgtaactcaatttgttgtctttaaaggagtttaacattgtatttgagctggacattggttgccttgagctttgagaatttaggctgattcatcatgtgaacctgttgtagaaatgaccttctctaggcttctgctttagtttttacatgaatggtcctaatgtccgcctatagaagattttgtgcacatgatgaccttagggttaatctacatcgggaaacacttaaattaccataataatgttctctcgaaattcttaagtatgattaatgttggttatgtatcggcctagatagagatttctaaaagtgagtgttcctgagtgctttggatgatactttgtaagcatatagacatgaaactatttaaaatcattgcataatgttgcaatatatcaaattattttcctcttgacgtatatttagattgttttttgtcactcattaaaagaatgctacaaggagttttttttatgtacaacactttgtgaccatataaaggcagttgcctagatttggaatttgtatataaaaaatatagatacacacttttgttaaaagcttaaaatttgccctttcaaaagaatgtacatatttaatttttcaataatcatgtataaaggtgtcagctgtattttcataagtttaaatgaaaataactgcttgcgttatagatttttcttttttatgttataaaataaaacttgctctaatttatgggtagaaagaatatgccttacaaatttaattaaaagttttaaatgttaggatataatgaaaatcaccccattcttttttatttccgaaacaagaaagggatgttaagtttttcaaaattgattcacatgagctaacattaaaaccattggatgggttgtgtttgtgtccttgccagttagtaactttattataaaatctctaaatctattaccttctgtaaaatgattttgaataagcatctgtgtaaaaattgttttctttttcactggattagaaactctgttaatgtgaacacagtaaatgaacttaaagaaatagtcaagagtaagaaaatatgagaaaataacttttaaaaataagttggcaagtcaagttctatggaaaaattaaaagacgcttaaacatcttaagtaaaatttcaacatgcctgttacgacacatccccaggaagtttattttcataatatttgatgtgattttaaggtcatcatttaagagaaaataaaaaaggtcatgaaagggattttccacatgagggcttccaattgaaaatatttacatataaaatgttaattgtagaaatacaatccaataatgaacaaagttcaaaagtgagtaaaccctgaagcaagacaaggcaagatatgtaatatctatcaataaaactaaaacattttcaaacatttggtgggaaagactatcttagttaatcagggacttctggcttaaggaaagaaagcaacttgtcagatttaatcaaattcatgggaatcaatagaattgttttcttttgttggttttcccagatatatgtaccaatcagcagtggtgataacttagatgaaaggaattggtggaaggagaaaggtctcttcaaaataggatattatctcacttcctaggtttcataatctctaataaagcactcctaatttaaattgaaaaacatcactgtttatttcatgcaataaattaaatcaaaatatataactggtttgatatttgtttccaagtatttgtcagtctttagtcaacaattcattaaaatgaaaaaaaccttaattctgatttacaaaatgaaaactatcaatggtaattattattattattattatttctatttttagtagcgacagggtttcaccatgtcagccaggatggtttcgatctcctgacctcattatctgcccaccttggcctcccaaagtgctgggattacaggcatgagccaccgcacccagctttttttttttttttttttttttttcctgagattgtatctccctctattgcccaggctggaatgcagtggtgtgatcttggttcactgcaacctctgcctcccaagttcaagggattctcctgcctcaacctcccaagtagctgtgaatacaggcgcctaccaccacacccagctaatttttgtgtttttagtagaaatgaggtttcaccatgtttgccaggctggtctcaaactcttgacctcaagtgattcacctgccttggactcccaaagtgctgggattacaggcatgagccactgtgcctggcctatcaatggtaataccttattgtagtatgtaaggattgtataattctattggatcttgaaaggttggtaagaaatcactgaaatgagtaagaatggaattcagtaactcaatattgatatcaagaaattagaagagaaaacaatacattgtgcataatgaagccaaagataagttaattattccttttatgaaaggtctctcatggcatacaaagtcatgtgatacacagtagcacacctcatctcttacatatgaaattaactaggaaagtgtgtttttcaaaatgggcatgaagacattagtttcacaacatacttatatataatacctagatatacatacatgtaacatatacaagtatacatagcacatgcttcatatatatgtacatatatgaaatctcactctcagtctctctctcttgatatacagacagaaagacagagaggtagagtttcatgtatagagagctatatattataactctttatatatagcacggaatgattgaaaccaaatcatttcaggtccaaaaacatacaagtaagggccccttttgtcagtttagttaggtcaatattatacccacctctctatttgaacttgtctacatgaactgtctctatgaatttcagtaaagtggtaacatgaactctaatgtttgttggacttaaccttttaggagcaatacggaacactattaaatgtttatttactcatgtataggagataaaagatagtgaattcttagcaggcttcaaactaacttttgagcttgaaggtacttatcaaaacttataaatgataaaggaaataaaaaaagtgctatcaaggtggatttttaaaacaatttacattttgcttatcattttgatcttcctcttatgatctatacatttgaaaaataaatacgtctatattattgcccaggttttgaaataagcccagttactaataatgccacaagctaagactgagtctactgttaccataaagccagattagcaatccaagggcctggggaacttccgcttttttagcgcttttcctctggtgggtttgttcttgcatttgaacaaagctatgggtttacatgagtaattgcctaagtatctggacttgccgggtatcactgacaacaggcccaaattataattaactcaaagtaccgtgttaactttttcagccaaaaatacatagaccataagatattaggctttctggaagagtctaagttattggctctggcagcaaaagagtaacatattaactgaagagtaaagacaaagcttcagacaaaggttctctataaataattgtgtcaagatgtcattacatcagtggaatgtagctcaattaacaatatcttttaaaggacatcaccttgccctaccaagagaaggtagctgttaaattgtggctccagcttgaggtttgataatgtggcagctataggatccatttcctgttctagttgtgtatattgtggtaataagaaaagcaacagagccccaccataaccaaatacttttaaaaatacaaccttaccctaagaaattaagtaaaaacaaatcttattcctctggtcagtgttgaagaaaaaaacaaacattcgacttcgactggttgcctcacagggggagaaaaataatagtgcataaaagcaaagcaaaacaaacaaaaaaccttagtgagcctagctgacttgttctcaagaacacagaggaacatggaggagaggcaaggctgttgcctagttctaaattaattaattataaagaattacccccaattaaacactaactcactgcactttttttgtagattccttgtttttcccccccacatcatactgaatccaccaaaattatcatcaaaattttaaagcttgataaattattttgtctatccacttcaaatgattatacatcagacaagatccctaacgacatatcagaatgaattacatatctggatatgaaagaactaggatgtctaatttaaggcaaaggtggagtttgcaatattttagtgagaggattgagaagtatggctaaataggaattaaagtcagcataatccttacattaacggaattttattaaaattgtaccatgttatgagtagcagaaagtatttggaaagctgtttccatgtttacctttagtgtagtagataaaggctatctcaaataaaatgttcagtctaaaatgacggcacattttttcttacaatgattaattttagaaaaatctataatccaatttactgcttgaatttacatggttgcatataaatgatgtgactcctggtgtgaattaggtggcaaattagaaaagggctttttatttttattgttttttagtgagaaagcaggtatcaatataactcagagaaatattccctacatcttagagtgagattaataaatatgtctttgttatcaataaaatgggaatataattctatctctttgtattgttataaagattaagttgaaaaaattatgggaagtccatagtataaaactgagtaccctcaaaaaattactctacaaattattgtttatttctatattattttatcatgtatcaatacatattacattttcaaaaatataaaaatacctcattcttggaaaaaaatgaacatttaagagagacaatatgtcactttctcttcagcaatgtcaagagaaaggaaattttaaacagaaaactgcagatgtctattcctgtaacacaagtggatgcattgatctagcaaaatgagatgaacccaaaccattataagcaataaactcacttcattcacttggattctaatcacatctttagaattgaaatttggcttccaacttccatgttcctacaaggagaaaatgtaccacctaatattcaaacattccaacacctttcctttgtcaattatatttcttttattataaatcaacaaatttgcatgttgtcacatagttgtcttgcatgggtttggttactgtgatcccttctcctgactccaatcacatccagctatggagacaaatataaatttcttgatctgtgaatcaacctctggtccttgatttccccagacaagtatttctacccactgaggcctgaccttaacagccagccagtctctttagacagcaattatagccagtctgtttctaactattgcactgtatttataggttgaaactttttaagtagaaactagatatcaacagggctgcctagggtatttctgaatgatgaagacaatgaggatgatgatgatgtcaacaatgggagagaaaattgtctggaaagagcatgctgttactttctggaattatgaaaatattttattccttgtttggggtggtatttacctagctgtttgcaattgtgaaaactcatgaaattaaaaacttaatttctcgtgttttcttttatgcagattatatctcaatatgttcaggcagtagaaataactatgagatttcttcttcttaaataaaatggaaggccaggcgcggtggctcatgcctgtaatcccagcactttgggaggccaaggcaggtggatcacttgaggttgggagtttgagaccagcctgaccaacctggagaaaccccatctctactaaaagtacaaaattagccaggtgtggtgatgcatgcctgtaatcccagctacttgggaggctgaggcagtagaatcgtttgaaactgggaagcggagtttgcagcgagctgagatcgtgccatttcactccagcctgggcaacaagagtgaaatttcatctcaataaataaatacatacatacatacataaaatggattgtgaagatttgaatatggactattcaatttgtggtataattttttgtcatatttgaagaattttcttcacagagaagctttaggtttacaaaaaaaatgggaggaaggtatagatattttccatatactcctgtccccacccatgcataacttgtattatcagcatcccccaccaacgtggtacacttgttacagttgatgaaacttcatttacacatcattatcactcaaatactagtttatattagggtttattctttgtgttttacactctgtggctttgactaaatgtataatgagatgtttctatcattatagtatcatacagacttattttcactgaccaaaaaatcctctgttctctgccgattcatttttccctgaccacaaccccctgacaatcactggtgttttcactttctctatagttctgcctttcacagaatgtcaaataggtgaaatcatagcgtatacagccttgtcatattgcctttttccatttggtattttgaatttacagtttgttcatgtcttttcaaggcttgatagtacacttacttttagcactgaataatagtccattgtctgaaggtaccacagtttatttatccattcacttactgtagaccctcttggttgttccctcccaagttttgaaaattgtgaataaagatgctgtaaacatctatgtgcagatggatgttttcagcttctttgggtaaataccaaggagaatgaccgctggattttatagtaaaagcatctttagttttgtaagaaactttcagattgtcttccaaaggcactgtgtcattttgcagtccccagcaatggatgggacttcttcttgctccacatgttcaacagcatttggtgtcatcagggtttagaattttggtcattctaataggtgtgtagtgttatctcattattatttaaatttatatccccttgataacatctgatgtgggacatcttttcatgtgcttatttgctctctgtatatcttctttggttaggtgactgttacggtttttggcccatttttaaaatgagtggtttgttttcttattgttaacttttaacagatctttgtatattttgcatagcagtccttaatcagatgtgtcttttgtgagtattttctcccagtttgtagcttgtcttctcattcatttgacactgtctttctcagggaagaagtttttaatttcaatgaaggtcagattatcaatctttaaatgaatcctacttttgatgttgtatccaaaaagtcattgccatactcaaggtcacctaagtataattgtttttaatagaaatcatatttttgaaaaagaaatatagttaaattatatcatttcacattttttatcaatgcttttagctcttccaaaccattatgaaatagttgtatttttattgtgttataaaatcaaatcataattaagcttttcaaatgcaaagctaaaaaatgaaatagcataaccttttgaatcgaattgaatagttcaagatctctatgctctatgttcaagcattatgttaaaactgctgtcttactatctacagaattttctaattagcctaaagagatttttataatttacctataaatatattttgagagggagtgataataaaatcaaaataggtcaagatatccaagtaactttattgagatgtcaagtggcatccagcagaaggtgaagaagtcacagagttacatcatagaaggccttcctgctgtgctatttccttcaacagaaaaagaagctttcatcctctaaggcttccagcatctgctgaaactactttgagtaattcaatcttgtaaaaattatttctgctacgtatacttatctaacacataagtatacttataaaaaaataaaaccttgggcccacttgagaaactaaattatatttagtaaggagatcaattttgcacaccttggcttattgtgctctatttaaaaacatattttcaaaacgtagctcttttttttccctgtcatacacttggcttcagtcattttgctgtaattaaacatgataagtacttccccatgttagtaaggcctgtgaatttccttctgcttgaaatggctcatcttccagatgcctacatggcacaaggcctcctttagttcctgtctctactcatgcactgcatcactttctccaagaaatctacttcaccactgtctaaaatagcccaccacgcattccctcacatcttatcccctccctttttgtacataatacatatcactacctgatatattacatcttcatttgtttattcaaaaaatggactttgtagacttttaaaaaactgtaaaatatagtcttcaacaaatagtatgctttgtttctattttattgtggtataatttacattcagtgaattgcactgatcttaaatattactgttcaacagttttgatgaatggctacaccagtgaaacctgctatactgagaggacaaagagcacatatacttctcttccccaaccactatctaccccaccctttccataaaggaatacaggtagcctgatttatttcactattgtttacctgttacagaacttcatataaatgaaataatacagtatatcaagtttatgctacatgtatattatctaatggtacctttttctattttaaatatatagaatagcaaatatgagaatatttttaaactcatcatcatcattctaaattgtaaactcaatcatcaataaaaattaagatcttagtaaacctcacaaaccattttgtaaaaaatttttgattgccattttgtagtctgtaatatatgatttatttttgaaatgtgggaaacagattcaaaacctagtttcaaggaataatctataaaaattgctctaatataattttaaattatttattttggaacaatcataatgttttcagagaccatagaattttagcacaatatcctgatatttaaaaaataaaagaaaaaaagcaaaacccaagaaattaaaaaactacatatgctaatacagagtcaatatatacttggatagtttgttattactattgaactttttataaaattaaagtatatatatgaaaacagagaatttactaaaaactatactgtgaagaaaatatgtaaagcaatattcttgcacaataggccattcaattatcggtgggttttaatctcattttttatttgatcatgcttattgcttaatggtcatagaaatgttcctttatcaattttcatgggaaagttttgcagcagagaagttccctagaatcaacatgtcttagatgtttgtaaaataagtgatttctttttccaaaatgttaaaatcattagtacacaaaagtcattactacgttaatttattttaaagtgttccatttcagtaagcaggtattaaggaagttggtgttgggataagataattgtgccaaagtaaattcttaatggagttcataagagaggaaatacagtaactgttctactccaaggttggctttgggggatttttcaaaccaacttaaaagtcttggatgttatatctgactggaaattatttctactccctgagaatgaacaacatgctggcaacagtgaaataaggaagcttgaaaaagggaatgagttattctatgaaacagtctgtcctatacatcaagattcttttagtttctcactcaagactttaagatacacaaaaatcttgccgcaagatttctcgtaggtggtgtgacctcagtatacgttgaagtcagagattacattgggttctaacaactcagggtttttagataagatctaaagttaaaagctataaatcagacctctagaggagggctacattggtccaaattttcatgaggaatagactctctttgccaatacaattaggggtgtgtgtgtgtgtgtgtctgtgtgtgtgtgtgtttgtgtgaatgcgtttatctcactgtctcgggagtatgtaattgtgtgataggtggaaattcataaggagaatggatcaactacaagtggtcatgggtagtgccatgtggaaccatactggagcctaaggcaaaaggaaagtgtctggctatatacgtgacttcctgtgctttttaatggttatttttctcagaacacaaaaatagttttaaaaaataatgaaaacctggaaagtagagtattgaaacatacaatctagtttttaggtttaaatatctcatttatacctaaacctgaatatattataatattttcaaaatgtactcttttgcttactcatttttaattgagagaattgctatgtttgacaatttctcttgacaaatgtcttgattaacttttacttaatttcaacttactgatcctttcttttagattttgataaactatttcttgtgggattttcacattggatttctattttttaaatattgcattggaatatatttattctattattaagttgtgttggcattccttaaattctgcacccgaagaaagtgcttcacttgtgtccattttttttcctttcttttttgagatggagtctctctctgttgccaggctggagtgcagtggcgtgatctcctctcactgcaacctcggcctccaggattcaagcaattctcctgcctcagcctcctgagtagctgggatgcaggcatgtgccaccacgcctggctatttttttttttcttttttttttgtatttttagtagagacggagtttcaccctgttgctcaggctggtcttgagctcctggcctcacgattcacctgcctccgcctcccaaagtgctgggattacaggtgtgagccactgtgcccggcctcacttgcatcattctagttgcagccctgatgatgaattcttaggtttgaccttggattgtgtgtatccaaagtgaggcaaaagccaccagaaatgagatcaaagaactgagagcccaatgccctaaaacagactttccatgtagacagcaaatgcacaacgattataagaggaactgatgtagagtggagggcctcgagccagaaatttgaacgaggagaaactactggcaagacaggagatgcaagcaacaacaaagttttggggtacctggggcttaaaagagcagagatcttggcaaatgagaagataccagtcccaccctcttgctctgaggtgctgaagtacgagacaatagacaaaatttgaaaaaaaaaaaaaaaaaaaaaaaaagctgcaaagaaatggtttcctggaggaaagcatgaatgtcttaaatataatgggctttctgttcagtatttcagtatctggtaaatctcatcattagaagcaatgcagaaaattaatatattaccttcacaataccctcattagaacacaattataacaaccgaaaaggcaatgtactaacccatgaggactcacttaactcattacaatggtttagtgagctatattgagcttaaaacatatgctggaatggaaataaaaaaatgaaaaccctgaaaaataagctcttcagaggtttagaaatgaaatgggagtgatgaatagctaggagcaaggacatgggagtatacatggtgccaagagagaaggtatcattttactaaacacatacttcacctttttcacatttcatctaattttagcagcttaaaaaaagcttttgtttttagcttagacagaaactcttaggctttggacccatgttccaattctatacatcaaaaattgtgaaaatttctagagggaatgatggcaggacttctcagaaggttggaaaatggagggtgtgagttgaagaacagtggttaatgacaaaaattgtagatgaggtccacctgatcacaaatcatttctaaaaccatatttggggatttggataatttatttgcactcctaaacctctgtttcttcatcaataactgggcataatgatactactcaggtttcttatgagaattagatgacgaaataccgtgtttgtcatgtaggaaggtataataaattttacacctgcctacatgacatatatggtataattaatttataattaataacttgacttttataactaatttactgacaattacttattgagtacctgctatgtgttagggtaaagcaattcaagaacctaactgaactcctgatatttgtggcttttacattctagcaggtgtgccataatgagtgatattatttataacatcaaacgctaggagaatcacaaagagctgactccaccttgagtttgccttctagaaacagaaaaatagcatgaatcctaattttcacaaagtagatgaagatattcaatttgatactttaagaactttccaaatgaactaatttgaaaggaaaacgaaaagagaggattgaaagaattgtcattccctgttcaaatatttaatcttgtcaagttctctttaaatttgagtggaggcaaattcctgaagatcaagcacctggcctatgaaaatgtattaaatatgttttgatgataatttcagtgatcatagaaggcatttccaaatggaatccattacactgcttcaagtattattacaatgagttctagttctttcactaggttaatagattaataagttttattatcttgcttgtagaaagcattgaaaattcccaaggaagaaaaaataagttcaaacaagtaaccagaaaaataaaagagaaaaaggataattcacttctctattgtaatttatgtgtttcttgtatgtgggattagacccagcaaagctaaaagaggcaactaaaagctcagccccagtgctaattttgtatccttgaggaaatcacataccctttcaagttttaattattcatctgcaaatccaagattataaaatgacctcatattctagttgacaatgtttttatatcaatattttatttctttactttttcctcatactgtgccttgcttctcctttatatgtaaagtttacatatcaatttatacatgcgtatatataatttttctatcaatttcaggagtggataaaggatgtctttgacccaaattcttgccaaatctccttccaagagaagtattgcctattatactccaaatgtacaataccatagcattagtttagtaaaaaacaatatgtcttgtttctcctttatttttcttgatgttttcataattttaataaaaaacacttaaccaaagtgctgaggctgtgtttacaataaggtatttttaaattttatctctcctctaccaacacatacacataaatttaggaggaaaataagattaggtagcatcaatttggtgctaatgaaaatgaaaccagcattgatattttctaaatctaataatgcatgcattttgaatagttttctttgactcatttcccctgaaggtgaattcagattctttaggcattttcccaaaaataatttttaactctctgccttgtagtgaaattttccaaattgaaaagccatgtagaatacactgcgaacaattttacagccttcattaatatataagtcaatgtctaggtcacagcttctattaggtagccttatctttatcgatagttttccccaacttcagattctggtaattgcatgacttaccctaccctctctgtgtttaaatcctagattaaaggaggaaaacagcgtcctgtgaacactagcctcaggtgctgacagcatcatcctttgtagcagtccctgcaccttatccttacttagtaaataatcctttatttaaaaaaaatttgtttgagttcattgtagattctggatattagccctttgtcagatgagtaggttgtgaaaattttctcccattgtgtaggttgcctgttcactctgatggtagtttcttttgctttgcagaagctctttagtttaattagatctcatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcccttccccattgcttgtttttctcaggtttgtcaaagatcagatagttgtagatatgtggcgttatttctgagggctctgttctgttccattgatctatatctctgttttggtaccggtaccatgctgttttggttactgtagccttgtattatagtttgaagtcaggtagtgtgatgcctccagctttgttcttttggcttaggacatgaacagacacttctcaaaagaagacatttatgcagccaaaaaacacgtgaaaaaatgctcatcatcactggccatcagagaaatgcaaatcaaaaccacaatgagataccatctcacaccatttagaatggcaatcattaaaaagtcaggaaactacaggtgctggagaggatgtggagaaataggaacacttttacactgttggtgggactgtaaactagttcaaccattgtggaagtcagtgtggcgattcctcaggggtctagaactagaaataccatttgactcagccatcccattactgggtatatacccaaaggactataaatcatgctgctataaagacacatgcacacgtatgtttattgcggcattattcacaatagcaaagacttggaaccaacccaaatgtccaacaatgatagactggattaagaaactgtggcacatatacaccatggaatactatgcagccataaaaaatgatgagttcatgtcctttgtagggacatggatgatattggaaaacatcattctcagtaaactatcgcaagaacaaaaaaccaagcaccacatattctcactcataggtgggaattgaacaatgagatcacatgcacacaggaaagggaatatcacactctggggactgttgtggggtggggggaggggggagggatagcattgggagatatacctaatgctagatgacgagttagtgggtgcagtgcaccagcatggcacgtgtatacatatgtaactaacctgcacaatgtacacatgtaccctaaaacttaaagtataataaaaaaaaaaactgaaattggcctgttttattatttctcgtcagttctttgatttaataaaccagataaaatctcattataactaattcctaatattagccaagttattttattaaaaataactaagacagaaaaaaattggcttcaatatttggttataattttagaatatgagattacaaagaaattgtattgtactcatgatgttggtagcagggtttaacaatatatcttgggaaataaaatatttccatctatatcagaatgatatctagatgcttgtgtttctcttaatcttttaaagcttctttttaaatgtcttgttctactgggcttactctacagtgcaggtagatatattgaaaattcctaatttttcaatatatgaaagaaaaaagcaaagaaaagaaatatcagaacaaaacaggtatttagtaataaacaagtcaactgctttcttaaaactagagttgtaaattagttctcagacacttccacataagagtcacatgacacttactaattttaacagaaggctagccctgaagcagtgacacatgtttttgtgccatatttaattccacacaacattgattttaatgggaattgctagggagtaactacagttttgcccatggtcatcaaagtcactacaacatgtcttcaggaactatatagtcaattcatcgccctggccaatggccaatttgtaagttagatacatatcttttaccttgttattaaacaaacaaacaaacaaacaaacaagctctattcttctaagtgagttggttacatttaaattatcatttatctatgtatgtacgtatgtatccatctatctatctatctacctacctatctatctatatcttttgctgatgtagaactgctgcttttccagttgtatccaagtaaagttccatatcaatgcaatgatcccttttgtacagttattaagtataagttttctataaaaattagcattggatatgtagactactcatgtagttagcgatttaagttaagaccagacttggagaaataaatattaagtcagaatgaaaatcactgatcagctgacatcctcctttaaaagtgagaatatttcccacagaatactaatcatttaaagacaacttgctgtaaatgaaagacaaagatgaataaagccaaacactggtatgctgcagggcaagatctttgtatatattctatccggtatttgtttttgaaaattatctttattcatgtcatgaaattatcaaagaaaagagtgataaaggatctctgggttatgacagcacttctcctgcgatttttttaaatgtaaggaattcagtcagactcagtcagtctaaaaagatgcaaattcttgggaattgtatccagatcagataaaacgttggacactggttaacacagtatggtccacgtcactgactctcacagttacagtgtagtaatacatcagattatttgccaaaaatgtccagtgatgtttgttccattagtactcaaagtaaaagagtgcatctattctctcaagtaatattgaatgtacagtgtgtttcagacatttgtgaaaaaaatacattggtagttccgctcttgaggagtacgcaatctgttaaagaccaccaagttatttttttttactggaagtctttatgcaaagatagagaaaaatgtctacattgatggctgaacacctaggggattgaggtgtagtgaagataaaagaagagcacagaatgtatacctgaaagacctgaagaaaattttaatttcttttttttttttgagacagtctcactctgtccccaggctggagtgcagtgacgcgatctcggctcactgcaacctctgcctactgggttcaagtgattctcctgcctcagccccctgagtagcagggactataggcgtgcaccaccacgcccagctaatttttttttttttttgtaatttttagtagagacggggtttcaccatattggccaggatagtctcgatctcctgaccttacaatacacccgcctcggcctcccaaagtgctgggattacaggcgtgagccaccgctcccggctgaaaattttaatttcttgacccatattcttcagttccctctaaactatgctttcaagaataatgtaaatgcaagttaaaaatgtagtgtccaactgttctcacattaagaaatcagggttacatttggtgagaatacaaaaaaggaaaaaaaaataagtcaagattaattgatcatattaatttcatggtatcactccacgaaaatccagaataattaaattaaaaacaaaagttcaaggcaaagcattgctacaaaaatttcttataataattaatttactggttatgccccttacaggagtcaggaaacaggttagattccttacccagtgtgcccactaatagtccctttataaaaccatctcctggaggcactagtcctccctcagaagaacagtaggtgaaggagttctctggtttctggccttgaggccagttcctgtttaagcctaaataaatgaataaataaataaataaataaataaataaataaataaataaatattcctcttccaagaggcatctggcagttccccttatccctgatgagtccttcttaagaccatgtcgaattaagttaaatgaatcgaaagtaaattaggattaaattgtataacattgattcatacattgccttggatgatttatatacatttggaaagtttaatactttatcacaatggttaagttttaatgcaaaataaaattatctatgtagtgttttaaaatgttgattagcctactccttagcctttttgaagtactttttaaatttctggtgtaaattctggcatgtagttctttaaaaaaatcctgcaggaagtttttgtgcctttcaaagtttgagggcccctaatcttgggcatacaaatcagtctttcttctgattaatgtggcattgtccatcatttttataaatatgagtctcaaacccttgattgataaagaaaatgctcattataacattgtgacatttggaaaaatttaatattttgtatttttaatataaattaattctttcagaactattaaccttataggaaaacactagagagaatgattttagcagatttttgtaagaactcatctcctaaggtttaagaaatacctacatggtttaaaatagtaattataaacatagtaattttaaaataagatactattttgtttaggtcttccaagtcagttagctggtgtcagttttatggtcagaatgacaaaaatatataataaaaatgtgcagctcatttagctgttgaaggctaatgaacaattaaagcattccataagaacttaatctcacccattttttagtcctatttaaatctgctcctcctttccacaaagttcgaatggcataaattatttaagtcatatacaaagggaacccaatcaggctggcagaagacttctcagtagaaatcttgcaagccagaagggattaggggcttattttcaacactctaaaagaacttaaactaataatttcatattcctccaaacttagctttgtaaggaagggataaataaagtattttctagacaagcaactgacaagggaatttgtaatcactagaccagctttacaaggcaacctcagcggagtcctaaacatggaaaaaaaggacaatttctgccaccacgagaacacaattaaatacatagtctgcagaccctataaagcaaccatataatagaaactacaaagcaaccagctagcaatttcacaatgggatcaaaacctcacatataaatattaaccttgaatttacatggtccaaacaccccacttagaaggcacagacttgcaagttgtataaaacacaaagactcatccatctgctgtcttcaagagacagaactcccatgtaacaacacccatagttcaaggtaaagggttggagaaagatgtatcatgcaaatgaaaaacaaaaaagaacaacagtcacttgtgttagataagacagaatttaaaccaataataataaaaaaggataaagaatgtcattaaataatgacaaagggttcaactcaacaagtagacttaactatcttaaatatgcacacactcaatattggagcacccaattcataaaacaaatacttcaaaacctataaaaagacttaggcacaaaacaataatgggagacctcaacacatcaatgacagcattagagagatcatcaatgcaaaataacaaaataatcctggacttaaatttgacacttcaccagttggacctagtagacgttacagagcactctacccatcaaccacagaatatacattcctctcatctgcacacagaacatactctaagggtgaccacatgctcagccataaagcaagtctcaataaacacaaaaaattaaaatcatatcaaccatactcttgaaccacagtagattaaaaccagaaaccaatactaagaacatctcccaaaaccacacaatgacatgcaaattaaacaacttgctcctgaaggactttcagataaacaacgatattaaggaaatttataaaattatttaaaatgaagacacacaacatttcaaaatctctgagatgcagcctatacaatgttaagaggaacatttacagcactaagtgtctacatcaagaagttagaaagatctcaaattaatgatctaacattacacctatgggaaccggaggaaaaggaacaatctaaacctaaagctaatgagaggaaagaaataactaaaatcagagcagaactgaatgaagtagagacccaataatccatacaaaagatcaacaagaccaaaagttgggactttgaaagcataaacaagagagataaacctccagctagatgaacaaaacaaaaaagagaagatccaaataagcccattcagaaacaaggatgacattacagccaaacacatggaaaccgaaaagatcctgagaatattatgaacactggatgcacacgaactaaaaaatctagaggaaattgatacattcatgaaaacatacaacctccccaaattgaatcacaaagaaattgcaactctgaacaaatgaatcagtcataaaaaaccctatgaatcaactaatgtccctgaccaggtggacataattcacagccaaattatagcagaaatacaaagaagtcctactaccaattctactgacactattacaaaaaattaaggaggaactcctctgtaactcattctatgaagccagcatcaccctgataccaaaacctggcagataaacaatgaaaaaaagaaaaactacaggctaatatccatgatgaacataaacacaaaaatctccaaccaaacactagcaaacctgatccaacagcacatcaaatagctataccatgatcaagtagcctttatttctgggatgcaagagtagttcaacatgtgcaaatcaataatgtgattcaccacataaacaaaattaaaaacaaaaaccatgtaattatgatcatctccatagatgcagagaaagcttttgataaaatctaacatctcttcatgataaaaatacttaaaaaatgagtcaccaaaggaacatacctaaaaataataagagtcatctatgacaaacctatagccaacatcatactgaatgggcaaaagcgggatcaatcccttgagaactggaacaaagcaaggatgctcactttcactacttctattcaatgcagtactggaaatcttagagcaatcaaagaagagaaagtaataaaagacatccagatatgaaaagcagtcaaactatttctctttgctgactatatgtttctacactaaggaaacctcaaagactctgctgaaaggctcctgaaatggataaatgacttcagtaaagtttcagaataaaaattcaacatacaaaaatcagtagcatttctataatgttcaagtggagagtcaaatcaagaacacaatcacatttacaatacccacaataaaaattaaatgtctatgaatacatccaacaaagaggtgaaagatctctgtaataactacacaatattgctgaaagaaataatagatgacacacacaattataaattcattccacactcatggaaggtaagaatgagtattactcatggtcatactgcccaaagcaatttacagattcaatgctattcctgtaaaactaccaatgccatttttaacagaaatagaaaaataggattctaaaatatagaacaaaaaatagcctgaatagctaaaggaaggtaaacaaaaagaaaaaagccagaggcatcatattatccgacttcagctatacaataagtctacaatatccaaaataggacggtattaatacaaaaacagacacatagacgtatggaacagaaaagagaacccagaaggaaagctgcacacctataatcatacgatctgtgacaaagttgacaaaagtgaacgctgggtaatgttcaatatatggtactcaaaaactggctagccatatgcagaagaatgaaactggactcctacctttcaccatataataaattcactcaattcactcaagatggattaaagatttaaatgtaatacttcaaactataaaaaccctagaaaaaaacccaagcaacatcatttttgacattaggctaggaaaacaatttatggctaaatcctcaaaatcaattgcaacaaaagcaaaaattgacaattgggacctatttaaattaaagagtttgcacagcaatataaaaaaattttaaaaagatcaacagagtaaatagataacctgcagaatgggagaaaatatttgtgaattctgcatctgacagaggtctaatacccagaatctataaaaaacttaaacaaatttacaagaaaaaaataaccctattaaaaagtgggcaaaggacatgaagaggtacttctcaaaagaagacatacaaacagccaacaaacaaatgacaaaatattccataaagattgttaagttccattggatcgcatgataatttcattgaatctgtgactggtaaaatttacagcttcagtaacaccagatgtaaaatgaagaatctatatgttggtcaggttataatcaagacattatttttcttgtcataattacacatactcttttatcatgtattttcttgaggaaatacatatatgcaaacaaaacggtaggtgctcttattttctttttaaacaatacaatatgaaatataaatgtacactagatgccacccaatttaagaaatagaacattactggcaaggtgtggtgtctcactcccgtaatcacaacactttgggaggctaaggctggaggattgcttgaggccaagagttcaactagcatgggcaatgtagggaggccctgtctctacgaagaaaattaaaaaatatagctgggaatggtggtgcacacctctcggcaggaggatcacatgagcccagaagttcaaggttacagtaagctatgattttgccactgcactctaggcaatagagcaagaacctgtttccaaaaaaataaaaataatgaaaatatttgatctaaagaaaggaatataccatgttttcctttatttagcatattaataaaaacaataaagatacacatatttcagttactggtatcttagaatatcttgcatatatacaatctgagctttttgatcaggaaaaaaatttaaaagaatctcttgcataccttttcttacactatcctgaattttgcgttattacttgccatagttgatagacagactataatgtatgcacccctaaacagtatatagtttttccttttttaactttatgaaaataaaattatacccttgaatttatacccaaaaattctcatatgaaatattttatccatgcaattaacaaatttaatccaatggctataaaatatagactattataccaaacaattgaggaattagaatgattctataatgtcttttatttacttgtgctacttggataattgttattttcctccattttattttactaagtggagggctggtttatgttaccttttcatggagaggacaaaattaaaggtatctcaaggcaagactaggtgtgggcctgtagacaacactaaaatgaatataaggagagagatatgctagtaagggataccacaatgggcaaatgcttttatttttgacctatggatgggaagggatacacagacctgtagggttaatggtatccaaacacatagaaattctaacatacaagcattcagtagataagattatcaactcccaatttctactaaaaaaaagttcatatgctaatcaaccatatcagttgcttcaattataaacctcatttacaagtcttaatagaaaaggaattgatttttttctgctttcaaagagaaaatgagtgaaaatagacaccctctaaagcatattcaacacctacccaacaaactttcaaaggtagatctatttagctaccaccatttacttgaagttaaaatggtacacaaaaatctattgcctaaatggtagtcttcattttatcatttaaaattaagattcgactaaaagatcaatagaaaaatatttgatctaaagaaagaaatataccatgttttcttttatttagtatattaataaaaacaataaagatacacatgcttcagaatggaaagaaaggtgtttacttttaacggcagaacatatcaatcacctcattattacataatatattatttaaggtcaagtgtagatgctcaagcttgtaatcccaaagctttgggaagctgaggagaatgacttgagctcaggaatttgagaccactctgggcaacataacaagaccccatctctataaaaaggaaaacaatgaaaataaaattagtcatgtgtggtagtgcccacctgtagtcctagacccttgagagactgaggcagaaggatcacttggatgcagggttttgagtctgcaaggctgcagtgagctataatcatgccactgtactcaggcctaggtgacagagcaagaccctgactttttaaaggaactgtatttgcttctattaaacaggtcacaaacactctcaatagttttttttctcaaagttgagatatatggaacaagtttttaaaatttcaccatattgataaaattatcccctaaatctatccagggtaatatattatccacaataacatattttcatatcttctttcttttactccttactggttttctactgcttcaataatttgtttttctctttattctatcttgattcatgtctagttcttgtttcctatgatatcctccttgtaattttaacccagttcatccctctaatcttccattcagtatctctctgctgtgtaggaagcataactgtgctgagttcttggctggaccactgaaatcaagtaatgactgaatataaatcagaatcatggctgtaaataaaaagaatgtgaccaaatgtccattagcaatgatagtctagtcatataaaaatgtggctattttcaattaataaaacaaaacaaggaagaaaaagtaaagacaatgtcaggaacgatgataagaataagcatgtaacaagcaaatggtaggtttgcttcaaccaaatggtaggtttgctttcattacatgaaaattttaccaaattgtacatataaagtcttctaagaacaatatacaaataacattttagtatataaattggctcaagaaagtcatttttcagggactctagatttataggctctttaagtctctttaaaactgtaaatgacccacagaagttggctgccctaaaggtttagattaaataaaccatccagtgcacaattcaaatataagctgaacaaccttaattggaatatctatcctgtgcggttttccagtttctgatttggtactccccaagtagcaatttcctatgaattaccgtttcccaactaagaggtacagaaattcccagtttctttaggaggctgaatattttaaaacttcggctttattaaggttttcaacaaagttctaattaaactacacttcattaatggcttacccccctaccttagaataaggagagctttcttacaattattaaagctaaccttcagaactgttgttaataacaagactaagaacaatttttaattttttttaacttcatagctgtaggctaaccaatagttaacaaataattcattcatttcattggcatcatcagtcctcctagcaatatgtgttttttttttttttaatttaagacttggtgggggaggcggtgaggactgtgcaattactagtcactgttttcccactcattggtactattagcttaacagataaaaccacagataacagccgcaatcaacttcagcaggttcccagaggcaagctcttgctttttgctgattagcttcattcaattatgtcttcttaattgttcatgtgctacagctcattaaatgaaaaataatattcctttcctgtgggtagggcacttgagatttgaaaaatagccacttcatctctgcctcagaggcacaagtaagttgatctgatggtgtctgaaaaagctcaacagatttgtgcagatagccctgcccgagaagggacaataaaattaataaaattgattgttaaatcaagtcaaaaataaaattactcccagtattttcctttaagattaattttcaggaaaattagacccagttttgtagcatttgattatgttcacctctgtaatataattttctttgtaaaaagatcagttattgctgttccattacagatgggatttagggaaagtggagtaaatttttaaatttttctgaaaatagattttgacagattaaaaagtgtgtcacacaatttatttatgaaatattctagaaatggagaaggtaagtttcattcattaaaatagattcattgagtacctactatgttccaggccttttgctacacaatgaggatacaaaaggtcttaacttcaagaggtttattagtctggtggagtagaaataataattcaataataatccattagctaatatatactggctatttactaaggacctataaagtacttggtcgatatgtgtcaccttacttaatctttttaacgatcttataacatagaccatatcatattttttattatagatgaactaaggcttagaaaaattatattgcttcctgatatcacataactagcaaatgctaaagtttagtttgggacaagatatgtatgaccttgtagcattcctatttacaggtactcctcaatttacagttcctatatgcatacatttcagtcaccatgtttagttaagttagaccagttacccagctcaagcgattctcccacctcatccttctaaagtgctgggattacaggcatgagccaccacacctggacggatgtgccatagtttgtaaaagagttgagaatggctgctagctagtagaaaaaaatggtgatattagaaacatgggtatattttcaaatgaattccaaaagtttgagaaagtaatagaatttttgtctgttttgttctctgttatttcgcaaacacagatactcagtacatatttttgcttttttttaaggagatgaaaaagtctgacatgattttataaaaaataaaatttcaaatttcagctaccacagtgtattaactgtaagtaattacataagtacaaattttgctccttgctctttggtccaaaatcattatgtaaataacaggtgtgcttcatgatcagtgaccattggcatcatctttttaaatgtctgtcagtgattgatcactacacatctattattcatcacatgcagacagaaaagtgtgcagttatgttgtctctgtttcccattgataaacacaagtgccatttcttaaaaataaataattgaaagaattggccagaaaagataaaagtacaacataaagtaaaacgttgagtccagtgaaaatggagctacagcaaaatccctgtgggaatattgacactgctgccatctgaggaacttaagctttgcagccagaacaacttagtgcagaggagcttattgacataaatgaagaaagtggatgtgatgaaaaggatgaagatgtatcaggctaagtgacgccagcaaaaacccaaacacacaataaaaaaaaaaaagacttacattaaaggaacttacagagatacttaacaatattgaaagcatcaaagcataaagtgatgaaagctgatccaaatttaagattatgacaatttgccaaggcataaaacattgcccccttcattgtaagccatgtaagaagaaatcaatcactattcaaactattagtaaacattttttaacaaacaagtaaactttaagtctttaacatcaatgtaattaagagggaattggccagcatatgtgaaagtatagcaaacaaatgaaaataatgatgcaaaaaataataatgtaagatatgagttgaatataaacagagttatagaaagaaagaactgactttaattcttttattcccagtgtaaattccaggatgttaaatgaatatgttttataatttatttattttcctacacatttgtaagtgacagtaaaagagtttctaatattttgaaaagaaattaaaggttatggaataatatttattcttgattattaagataaacttgcatgatttcagctgagattatcatgtttatcatccttcactaccatgtaaagcgagaagtgtgggtattaacttattatctgtttgtttaaagtgaatgacacacagcttagtgttacatcaacagaaaaatatttaagaggaaatgacactaaatcaattttaagataatgcttctattatgtatgtttctgtatcgtctttctaaacataattatggaaaaggcatcccaactggtgacataattattgccaataatataatagtaatgacaatatatttgttggtcaattaaaagtaactacattagctttggtaaaactacatttttcacttacatgattaaagacacttatcagtgctcttgtgatcctactttaagatatacatcttcatattaatttgtaaatgaaatgtgggagtttttcataaccaacaggtttaaagctgtgtgaagatatgtgagggaaatatatagttatgtctgtaagaatcagtgatgtgccatactttgtgttttgttgttattgttttcttgagacaggatctcactctgttgcccagcctggagtgcagtggcatgatcacagctccatgcagcctctacttcccactcaagcgattttcccacttcagcctcccaagcagctgtgactacagttgcatgtgaccacacccagctaatttctattttttgtaaagacacggtctgactatgtggccggggctagtcttgaactcttgggctcaagcgattctcccacctcatccttcttaagtgctggtattataggcataagccaccacacctggactgatgtgccataatttgtaaaagagttgagaatggctgctagctagtggaaaaaaatggtgatattaaaaacatgggtatattttcaaatgaattccaaaagtttgagaaagtaatagaatttgtgtctgtcttgttctctgttatttcccaaacacagatactcagtacatatttttgcttttttttaaggagatgaaaaagtctgacatgattttataaaaaataattttgatgttagtaatcattactcaacatatttttgaagagtctaaaggaaatttccactgtttcaaaagatcccaccttccatttctctctatctcatctcctagcaatctacccttcatttattgtactctagttgtgcttatctttttggtctttatcaaacacaacaaatattctgagaccttaatatttctgttccctctccctggaacactattcctcaagaaataaaattaggtaattatttcaatcaagctggtatttaaacatcttctgctcaaggaggcctagctgataatctgtatttaatgttccagttttcctatactctctctgaacccccattggccattctattttgttttatccatagtgcctatcacctgttggcatattatatgaactctttgtttattaacttatttgttaattttattgtttatcatttatgtctatcaatggcatgtagactctaagagagcaggcatatttgtgtgtgttattcattgatatttcaagattaccaaacagtgtctgtcatatagcaaccattctttttttatttttttctgagacagagtcttgctcccgggttcacaccattctcccacctcagcctcccgagtagctgggactacaggtgcccaccacacccggctaatttttctatttttagtagagacgggctttcactatgttaaccagggtgatctcgatctcctgaccttgtgatctgcctgcctcagtctcccaaagtgctgggattacaggcatgagccactgtgcccggcccgttcattacgtaagaataaagaaatatccccttgacatgaaattctgtgtattggaataatatatataccatggcaatgagcatttgtcattatcttagtcagcagtatatattttcctagacaatgaaaagactcccaactggccttttgtatgacaaaaagaactgctaatcactttcccagtttggcttttatttatctccagattaaagtgttattaaggattaatttaatgttattttattccatttagtgaacttttaaacaataaaacacttttatctatgttgttttgcacccatatgacaataaagtgttatcatgcccatactataagtagaaaaacacaggtagaaagaacataactgatttgctcaaagtcatataactcagaagtgaccgaatacatttgcctgactccaaaacttggtctgattttatcatcccttgctggctgtcagatctgatatatcagtccaaaaattacctcttgcttaaaccgatgttttggatgacttttgtaattttctgcgttccatcatttattagcgccaatatataaatggttatttagaatacagaggtttacacatattcgggaccaacattccaaaaatggcttaaatatttctggcagcctaatattatctacggagaattattttcctcaagaacattagtgagatgtgctataataatggttgagcaaagtagcacaacactagatgctgtgtaactctgggaacaccttatttcctgctctgatagaaatctgttaaagaccctcatctgttacaggcagagagaagagcagagtaaaagtgctttgcctacctaaagggattgttgtaagaatctgatgagttaaactgtgtgaaagcattttgcaccctctaaatccatacatttacatgtgacttccctgtatgacacaagctaacaaacaaactagaaacaagcaaacaaaaaaaaaccgagacacaaaaataaaatatctttctgttacctcatttgggaaggggtctaaaaacccagaaataatagtatttacatgtacatgtagttggtaaacattcaatggagtaaaaagtaaattaaaaataataccattagcagaggggaatgtatttttacttatgcatatatacccacatattggatttgtctctatttcatctgtaggacctagccactagccaaatgcccgaagcccctagaaccccagtgcctagtgtggtatgcagaaaataatgccctgttatatgtccattacctaattccaagagccttggaatatgttaccttacctggtaaaaaggactttgtagatgtgtttaaagttaagaacctccatatggaaaaactgtcccaaattatctggatagacccaatctcatcacattagttttaaaaatattaaaccttccttggctgtggtcagggagagaaatgtgattgtagaagaatggcaggcaaatgtaacattgctagttttgaaaacaaaaggagtccagaagtcaagggacgtgggtggccactataagctagaaagatcgagaaaactgattctcccctagagcctccagaaagtagcattaccttgccaatttaacctgattttaatcgtcagacctgtgtcaagcatgtgacttagagaagtataagatattacatttgtgttgttttaaggcactaattttgtgataaattgctaagacagcagtagataactaatacagctagaaaacaattttaaaatacattttaaaaagaacttcaacatgccaatatctaatgaataaaaccaaaaataggatgaaaaattaaaatgaaacttagaatttttctatattacatatttgggaaatttgaattatttcataatattctgatctcaaaaatatgaaaaaagtagcttgtctagttatcattcacctgaaagcaactgttttaaacctgtcattacaatctgataaaaagtaatatgtctcattcagtcccaactacgctcaacatgacccaatcttgtcagaacccaatgtgaagcttcaagtgtacaggaatttacaatgacaatgctccatggaattttcaatgacaatcaatgttccaaaaaagctatgacctacacttgaggctatcccaaggagaagcaaatatcatagcagcatcttacatttgtgaacacagtggtaaatatagagcatacaaaaccatgcatgggtattttcttctgtttttaacaatggataatgaatgtcaaaagtgatattcaaactagcaatatgcaagttaaaattaaatccataaagcacagcaaaataagcatttgttccattgtagagctcacgtttccttgagcacttattttctttcttttccctcctctctgctcctgtcccctcccctccctccttcccttccttcctcctttcctttcttccttcgacttccttcctgacttccatttttcttttttcagctttattgaggtatagctgacaagtaaaaatgaacatatttaaggtgtgcaacttgatttttgtatatgcatacattgtgaaatgatcatcataatcaagctaattaacatatccatcacatccataatgtaaaacatatctaatgttgtacattagatatactgttaccatgctgtacaataggtatatgccacattttccttattcatttatctgtccatggacacttaagttgtatccataccatagctattgtatataaagctgaaatgaaaactaaagcaaatatcgattcaaaattattttatttcctttgaataaagactcagaagtgggattgctgaagcatttggtagttccatttttaattgttaaaggaatcttcatattgttttccataatggccacaccaatttacattcccatcaatatgtcttcctttttctccacttccttcacaaaatttatattttgaagtttgataatagccattcaaacaggaatgtggtgatacatttttgtggttttgatttgtatttcctgataattaatgtcattaatctttcatctttcatctacctattgacctgtcgtctttcatctagctgtttgccatttgtacatctttggattaatgtccatttttgtaaatttatttttctattgagttttgtgaactccttatatattttgaatattaccttttatcagatatacagttgcaaatattttctgtagtttgtcttttcagtctgttgattgtttcttttactgtgcagaagctttttagtttgatgcaattccacttctatacttttgtttttgttgcctgtgcttttgctctcatatccaaaaaaatcattgccagaaccaatgacaagaatctttttcctgatggctttttgctattagttttacagtttcaagtcttatgtttatgtctttaatccattttaagttaatttttatttttgtatgtggtaagagcttatcttcatttttctacatgtggatatccagttttctcagcaccatttattgaagaaaataccttttccccagtgtgtattcttggtgcccttattgtaggctggtttactctaagtgcatggatttatttctgggctctctgttttcttgcattaatctatatgtctgtttttatgcaaattccacactgttttgattagatttgtaaattattttgaaatcagaaagtgtgatgcctctagcttgcttttcttgctcataattggtttagctatttgctatttggagtttattgtggttccatataaattttagaattttttttcctatttctgtaaagaatgccattggaattttgacagggattgcatgaacctgttgattccttttggctagcatggctactaaaacaatattaattatttcaattcataaacatttattttccatggatgaatgttttttcatttatctatgctttaacatttttccttgattcctcctccaagatggccaactagatgcagccaggagaaacatctcccacagagggaccacgacatcaggaagacgggtgtacccctagtaaatcttcagagggaaggcattgagagcagatagagagaagatacagaaggtgggataaagggagatgaagctgggaatgctgcatgtggctaccacacaccaggactcattcctggctcccagcaactcctgtggaaggggtgagttgaacagaaatgagcaactcactctcaccatgagcctctggaatcatagcaggaggagtcttgtcagccaccatggacacttgagttggcagagaaagctacttagtgaagtggtagggacagaactccagctgcagcagagcccatggggtttggtgcaggagcatctatagtggagaacagccagggatgcccatccccctaggcttgatttgctcctatagtagacattagccctaaggaaaggggtgaacgtagactctgtagagcagtcttgcccatgagatgagccaggccccctgagcaccctttggtgtgctgtcttctctttgggccccagcctgcctgtacctgctagcagtgtacccccccaggcacctcaagggggcctgcctcattgctcctgcactggtggactgcagctgactgggagagtgctccagaagagcaaaccctgtgtatacatataagactgcccatgtcctccccacactacagcctcctccatactgctttgctggcaggcactcgctgccagcgatccccatacatctctttgcctgtacatgtgtttgcagacagacctagcctttccttctctgacagtgcatgtgtacacatgtaccatgccatgccatgccactattgctggcttgagtgtgccccatcccttctccccctgttgcactgccatttttgttggagcattggagggcatatagtttgacagctctgccaccaccagtgctccactcctgtgccaaaactgctggcatgaaactaagcacagaaaacagtgtatctactcccatccctgagaggtcactgctgtaagcaagaatgctcacagagggtgcacacagtcctgcgaccactagcgccccatccctgtgctaacaccagcaccagtacaaatgtgcacaccattgccagcagggccctccaccttcccaaaccataccgccacagccactactacaaacacccacatggaggctgtcatcttccatgtggatggaggatgccgctggtacatgcaaatgtggacacatcccactacgactgtcctacaaaatgctttggctgggagtagccattagagtgttgtgaccagcagtctgagatcacattgacccctccagtgcagcaggttcctaaacttgatccacaggtaatagctggtgtatgataccagtctcccagagttagagcacacaatgcagagtgctgagctgagccttggccacctgaagtcttccactaacaaagccaggtgactgaacacagcttataccataatcaaaccctcaaggtcataaaatagaataaaagaaaaaaaatccaaaggacagcaacttcaaagattgaaggaacaccagcccacaaagatgagaaagaaccagtgcaggaactctgacaactcaaaaagccagagtgccttctttcctccaaatgagcacactagccctccagcaagaattcctaatgaggcagaggtagctgaaatgacagaaatagcattcagattatggataggaataaaaatcattgagttttgggagaatgttgaaaccacatctaaggaagctaagaatcacaatattaagatacagaaggtaacagacaaaatagccagtacagaaaaacaaacaaacaaacaaacaaaaaacataaatgacaggatagagctgaaaaacactctacaagaatttcataatgcaattgtattaagagaagaataccaagctaaggaaagaatctcagagctcaaagactgtttttcttaaataagatggtcagacaagaataaagaaaaaagaataaaaaggaatgaagcaaacctccaggaaatataggaatatataaagagaccaatattatgactcattggtgtccccgaaagagatgagaagaaagaaagcaacttggaaaacataagtcaggatatcatccatgagaacttccccaacctaaccaccaatattcaaattcagaaaatgaagagaactcccacaaagtacttcacaagaagatcatccccaagatacataattatcaggttctgtaaggtcaaaatgaaagaaaaaaatgttaaaagtagctagagagaaaggacagatcacctacaaaaggaagcccatcagactaacagcagacctctcagtacaaatcctacaagtcagaagagatttgggacctatattcaataacctaaagagaagaaattccagccaaagaaatttatatttggctaaacaaagcttcctaagtgaagggaaatatgatccttttcagaaaagcaaatgctgagggattttattaccaccagacctgccttacaagagcttctggaagcattaatatggatgggaaagaccataaccagcaaccacacaaactcacttaaggacacagaccagtaacactataaagcaaccaaacaagtcagcataataagtcgacagcaacaggataacaagatcaaatacacattaatactaaccttgaatgtaaatgaactaattttcccaattaaaaggcacagaatgtaagctggataaagaaccaaaacacaattgtatgctgtctgcaagagacccatctgacatgcagtgatgcccacagaatcaaataaaggaatggaaaaaaatctgccatgcaaagagaacacagaaaaaaagcaattattgcaatcctaatttcagacaaaaaagattttaaaccaataaaaataagaaatggcaaagaagggcattatataatagaaaagggttcaattcaacaagacctaactagcctatatatacatgcacctaacacagaaacattcagatttataaaccaagttcttagggaccttcaaggagacttaggctactacacaataatacggggaaattttgacacccccactgacagtattagacagaccatttaagcagaaaattaacaaaaataatcagaacatgaacttaacactggaccaaattgagctgtgaaacagctacataactgttcatcaaaaaacaacataatgtacattcttctcatgtacacacaacacatattctaacaatgaccacacaatcaaacataaagcaatcctcagcaaatgcaaaagaaacgagatcataccaaccactctcttggacaacagcacaataaacatagaattgaagaacaagaaaatcagtcaaaaccatacaatcacatggaatttaacaacctgttcctgaatgacttttgggtaaataatgaaattaaggcagaaatcaagaagtattttgaaattagtgagaacaaagatataatataccagaatctctgggacacaattaaggcagtgttgagagggaaattcatagcactaaacacccccatcaaaaagttagaaagacctcaaattaacaacctaatatcatagttaaaaagctacagaagcaagagaaaaacaacaacaacaacaaaataacaacaaaaacaaacaaacaaaaaaacccaaagctagcagaagataaaaaatacaccaaatcagagctgaacagagactgagacataatacaaccattcaaaagatcaacgaagccaggagttgactttttgaaaacattaatacaatagatagaccactggttaaactaagaaagaagaaaacagagaagatccaaataaacagaatcataaatgagaaagggaatattaccactgaccccacaaaactacaaataaccatcagagactactatgaaatcctctatgaacacaaactagaaaatctagaataaatggataaattcctacacacatacagtcttccaagctgaaccaggaagaaattaaatccctgaagataactataacaaatgctgaaattgaatcagtaataaacagcctgcaaaccaaaaacagccctagaccagatgaattcacttctgaattctaccagatgtacaaagaagagttggtgcattcctactgaaacggttcccccacaattgagaagggacttctcctcaactcattctatgaggccagtatcatcctgataacaaaacctggcagagacacaacaaaaaagagaactttaggccaatatacttgatgaactttgatgcaaatatccttaacaaaatactacccagctgaatccagcactatatcacgaatccaccacaatcaatattctttatccctgggatgcaaggtttgttcaatatacaaaaaccaataaatatgatttataaaataaagagaactaaagacaaaagccacatgaacatctcaatagatgcagaaagacttttgaaaaaattctgcttcccttcatgttaaaaactctttacaaattaggtattgaaggaatatacctcaaaataataagagccatatattgcaaacccacagccaacatcagactgaatgggcaaaagctggaagcactgtccttgaaaaccagcaccaaaaaaatgatttctccacttgctatttctattcaacacagtattggaaattctgaccagagcaatcaggcaagagaaagaaataaaaggcatccaaataggaggagaggaagtcaaactaatcctgtttgcagatgaaatgattctatatctagaaaagcccagtttcagctcgaaagctctgtaagctgacaaacaacttcagcaaagtatcaaggtataaaaatcaatgtacaaaaatgactaccattgctatacatcaacaacagccaagctgagagccaaatcaggaatacaatcccattcacaattgccacaaaaagaataaaatacctaggaatacagctaaccagaaaggtgaaagatctctacaatgagaactataaaacactgctaaaagaaatcagagataacagaaataaatttaaaaaaaaattctatgctcatggataggaagattcaatatggttaaaatgaccatattgcccaaagcaatttgtacataaaatgttattcctatctaattagcaactacattattcctatccaattagcaattacattcttcacagaactagaaaaaaaatcaattttaaaattcatatggaaccaaaaacatagcccaaataatcaagggaatcttaagcacaaagaacaaagccggaggcatcatgctacctgacttcaaactatcctacagggctacagtaaccaaaacaacatggtattggtacaagaacatatgcatagaccaaaaaaacaaaacagagagtcaagaaataagtctgtacagctacaaccatctgctctttgagaaaactgacaaaaaataagtaatggggaaacaactccctattcaataaattgtgctgggataactggctagccatatgcagagattgaaactggaccctttccttacatcatatacaaaaatcaattcaaaatgtattaaatacttaaatgtaaaacccaaaactataaaagcactggaagacaacataggcaatactattctgaacataagatctgacaaagatttcatggaaaatatgccaaaagcaatcacagcaaaagcaaaaattgacaaactaattgaaaaactggtacactagtctccagtgaaagcaactgcacctgaagttaatggaaagaaagaaggggaaaaggaagaagaagaggaggtaaaagatgagggtgataagttagaccaagctgaagagggaggatctgagaaggaagcctctagtgaaaaagaggaaggtgagcagaaagaaggagaaacagaggctgaaggtgaagtagaggaagccaaagctaaagaggaaaagaaagttgaggaaaagagtgaggaagtggccactaaggaggagttggtggcagacaccaaggtggaaaagccagaaaaagccaagtctactgtgccaaaatcaccaaaggaagaggcaaagtcaaaagcagaagtggggaaaggtgaacagaaagaggaagaaaaggaaatcgaggaagctcccaaggaatagaaggtagagaaaaaggaagagaaaccaatggatgtgccagagaagaagaaagctgagtccctggtaaaggaggaagccatggaggaggcagtcaccattaccaaattggtaaaggtgcacttggagaaagagaccaaagaagagggaagccacagcaacaggagaaagaggagaaagtgggaggaaatggggaatgagaaggaagggagtgataaagattccaaggaatccaggaagaaagacatagctgtcaatggagaggtagaaggaaaagagaagggagagcaggagaccaaggcaaaaggcagtgggagggaagaggagtaagacattgtcaccaatgacctagacttaagcccagcagatgaaaagaagggggatgataaaaatgaagataaagtggtggtgaccaaaatagtagaaaaaatcaccagtgagagggagatggtgctaccaaatacatcactaaaactgtaaccatcactcaaatggtcgaagagcatgaagagacctttgaggagaaaccagtgtctactaaaaaggtagaaaatgtcacttcacatgccgtaataaaggaagtcacccagagtgactaagatttgagtccactgcaaaagtttaagccatacgacaatttcaaaatgcatgtgattgacagcttcaaaacagaacagattctcccataggggctccagacattgtattttactttgtgcaatatgaggagactgcatgcaagctcagtgtgctcccccctcagtctttgggggattcaaatgcatgatactgtatgtacctgggaaatttaccaatttcctgcactgttggaagggggtcactcagaaggggagatgtcttgagatgtattatgtaaagtaccaactgagccaaaaacaataaatgaaacacagaactctcttagccttaagaaagctatatatgaataattatgtttaccacactggtgcatttaaaatggacttttcttcatgggagaacctcgttgacacggacagtttgcaatcttatgttgatcgatgtgaaatgtcatagcagtacttgctcaataaaggtcatattggaaacatagtcaaaaaataaataaatgaaagagcttctgcacagcaaaggaaactatcaacaaagttaccagacaaccaatagaatgggagaaattatttgcagattatgtagctgacaaaggtcgattatctagcatctataaggaatttaaacaaatttacaggaaaaaaacaaacagccccactaaaaagggtgaaaagtatatgaacagacacttttcaaacacaaaaacaaaaaaatacttgcagccaaaaaaaagtattttaaaaaagctcaacatcactgatcattagagacacgcaaataaaaaccacaatagaaaacatctcacaccagtcagaaagctttttattaaaaagtcagaaagtagcatatgttggcctggttgtggagaagagggctcacttttacactgttggtgggagtataatttagttcgtccattgtaagaagcagtgtggtaactcctcaaagaaccaaaaacagaactgccatttgacccagcaatcccattactgggtatatagccaaaggaatatgattgatgtattataaagacacatgcccacatatgttcatttcagtaaatgtggtacatatgcaccacggaattctatgcagtcataaaaagaatgagaccatgtcctttgcggtaacatggatggagcaagagaccattattctatgcaaactaatacagggacagaaaaacagaaaacagaaatactgcatgttctcacttataagtgggagctaaatgatgaaaacacatggacacaaagacagcaacaaccagacagtgaggccaaccagaaggtggagggtaagagggagaggatctgaaaaaagtagttattagctactttgcttagtacacaggtgattaaacattctgaatatcaaacccccatgacataattttacctatataacaaacctgcacatatacccctaaacctaaaagttttctaaaaaagaaaaatgttgtattttgcaaaaagtaaacattttcctttattaatactttataattttcagtgtatgtattttcctgtttgattaaatatatttcaaagtatttattcttattattatataaataggatttttaaaatttcctttcagataatctatttttagcctctacaaatgccacttacttttatttagagcaactttactaaattcatgtattaattgtagcatttttggttgtcattgagacttttagacttttctgcctatacacctatatgtcaactgtaaacagagataatattactgtttcttgtctagtttgaatgtctttcatttctttttattgtatcattgttcttgactagaagtggcaagagcaggaaatcttgtacaggattttagaggagaggcttttgggttttccccattgattattatgttatcagtgggcttttcttatatggctattattgtgatgaggtaggttttctctacacctattgtattgagagttttttaaattagaaataggtattaaatttgacaaatatttttccagaacttattgagatgatcatatggtttttgtgtttcattctgtttatgtagtgtatcacattgaatgacttatgcatgttcaaccatccttgcaccccagggataagtcctagttggtcattgtgtacaattttttcaatgtgttgttgcattcagtttgcttgtattttattgagcatttctgagtctacattcatcaaggttactggcctgtagtttacttttcttgtggatgtctttggttatcaggtcgatgctggctacatgaaatgagtttgtaagtgttccatcatctagattttcaaatagtttaagaaatattattaattctttgaatgtttgctggaattctcccacaaagccatgcagtgctggactattctatttcttcttcaatcttggtaggatgtatctttctaggaatttatgtattacttcgcatttatctaatttgttggtgtatatttattcataacagtcccttaagggctctttttatttctgagacatctgttgtaatgtttcctctttcatatacagttttatttatttcagtcttctctctctctttggttactctaggaaaggatgtgtcagttttatttgtctttttcaaaacacaactcagttttgttgacttttgaaatagcttttttgtcctttttaaaatttattttttgccttaattagcattatttccttctttctgataatatttgggttagtatgtatttttttctgtctttggctagttatttttttaggttgtttatttgagatgtttctttttttttttcttcctcagaaacatttaataggtattaacaaacagaagccatgtctctcgaggctgtgagacaagatggtggatccccatgccattaacccccagaacccagggcttatatactataggtaaggagaattgaagtaatttggtcagaatttatggtaagtgtgtgctcttaacagtagtagagtaaaaatcttagaggcattcccagaaccgaggttaatgaaaagccaacatgttggattagcatttaagacagaattggtttagcctgtacactccacctatctgacccagattttacaatttcacattctctcttcttccaagatggtccctgagcctagagagaggttgtttgatattgcacagctttagcagtagtgcattggcaatggaaaacagattgggcccagttgctataatgttccttctcagaaatacttttgctatatctcacaactgttggtatgttttcttttcatttttgtcaggaggtaatttttaattttttaaatttaatcttggacccaatgattgttcaagagtgtattgtttagcttccatgtatttgtgaatcatatggtttcttgtttctttaccattaactgatttacactttcactctattgtgacctgaaaagatacttgatacagtttctatcatcttaaagttgagttgttttgttatctaataggtgatctattgtgaagagtgttccatatgtgcttgaaaagaatgtacaatcttctgttgttgggtaaaaagttctgtagatgtctgttaggttaatttggtctctcctattgttcaagtaagctgttttccattgatttctctgtggatgttctgtccattattaaaagtggaatattaaaatcttctagtattattgtgctgctataaatttctccagttctgtcagtgtttgctttaaatatttagatctgatattgagtgcatatacatttacaatagttatatcttcctattgaattaacctttttatctttatgtaatgaccttctttgcccctggagacagtttttgacataaagtctattttgtctaatgtaagtatagccattctgctttcttttcattaccatttgcataaaatatatatttttccatcctatcatgtttaactatgtgtgtccttaaatagttggtgccaagtttttattctttcagccagttaatatcgtgtgattgggcagtttaatccttttacatttaaagtaactattgatagggaaggatttactattgaaattttactgactgctgtttttcttgttcctttttttctttcttgatgtcttattttgtgtttctttttttgttattgttgtttgacaggctttaattcctttctccttttcttttataactagttttttaactactgtaggtagtagattttcttttttaagtactatggctattttctgtgtgaatgacatgagtcttacataaaatataattataataatctaaaactgataacttctcttccacacaaaaacttcacatttttaccttgttcccattatagattattgatatcagaatttacatatcttaacatgtgtatctattaatgtaattttagttatacctatatttaatacttttttaaattttagattagaattaaaagtgatttacctaccacaaccacaataatatagtattttttatttgcctctataaatttaccattaccgatgagttttatacttttgtatgctcttatattgttatttagcatcctttgatttcaacttaaagtactccctttagcattttttatatgacaagtctagtggcaataaactccctcagctttcgatttttttaattttgtcttaagttttaaaggataattttctgggtatactgttttgattggcagttgtgtatttgtttgtttgtttccgcattttaaatgtatcatccaactcccttctggcctccaaagtttctgctgaaaatccaccaatgatcataggagggttccctaacacataacaagttgtttttcttttgctgctttcagtggtctctgggtgtccagagtatgccagctctcatcattgccctgaaacaggtgagatactgatcctttttagtagtaaccataaatgttggggcactaactggattttccaatttcttctctcctcagggaaaagctgggtgtataatctgctcatgctgaactgagctggggaaaagaactatggcaaatgtttgcaagctcattcaaaccacagactttttcaaactgttgctttgatctctgtagcctccatgggcctaatggatgctgatctccattagttctcatagacacgtcagttgaaagctagttcctcaggtagcagctggaaaagttaaggggatagatatgtagataaattccttccagactgaagctagaggcttgcttttatcattagagtgagcaagtgggagaatttgtggaaatatccacatgcctgtttaaaatggctgctttgttttctatagcccacatgtaaatagtgaatggcaacaccaatagctctcatagacagtgagttagaagccagacctcaggtaggagctagaaaacttagaatgcttgatttgtagtctaacttctttcatagagaatctgggaactgggctttgttgttgtagctagttggtgaatgaggaggtgaagtggaggagatatgggaagaacccatttgtttgggcattttttctcaatgtaccttagtttgtctgtagtagctggccacagtagtgatgattctatttcctgagaggtgagaattgctgccaaagaatgtctgccatggatgagaatacaaagaaaggaaactaagaactctcaaagcagctactagaaacccttcatagaggacaagaattatcttcagttttgagatatatgagaatgattacaactcctttgagcaggcttcacatactgcccaaagatgcttctctagtttgtgtccttcttgctatcagaaagagagaaggaaactaaataaaacaaaataaaaattttagaattttgtgctgtcttggacatggaagcaatgggtcaggatcaagattgtggaaagatgccagttcggatgcaggctagaaaaattagtattgtcctcaactggaatcagcaaccaaaagactaagtgtatgtgtctctgtaggctgaagggttttcagatatcataaaagataagaagtcaagctacacttgtttggaagcatgtggcagagaacacagattaattgtttaaaggatggcccaaacttaaggccaagtcacatcaaacccatcagaaaccaaaagtgtggcagaattcctaacagaaggatgagagaggaagagccttatatagatctgtcttctgtttcacattctgactattctaaagcttttaatgaagaattccctagagtcataaaacaaaggctaaatggtgagtggctgcaaatacacataaaaatatagtgaattttttgaaaagatatactaatttcaggtggctagaaagatttattaacataagtaataaaggtcttttagttgtcaaagtaacttatacttaatatttattgcaattttaaaaaattaaaatgctaaaaattatttgtgaaaatgagttgttttatatgtttacatttaataacaatactttttacataaagaaaatacaataattaaatatatctgaactagtcaaaagataattataagatttaaaattgagtttatgtgcaataaatgtggtaaacaataatgtgatataaaatcttctaaatttaataatattcttggtagaggattctggggcaaaaatatgattttctccatatccctgcccactacccaatatatgataacatgtggcattattaaatatggaaaaatattaaagaatggcagtagactagagagaagagaaggaaaggcatacaggaaatccaggtccctgccctcagagacctctcaattcctggcatatgtttatgttttgaacattatgcaaatttgtctgcatgacaaatttattcttgtttcaggttaagagtagaaatcaacccatagtccttacgattagaattgccttagcataacgattcaatcagtaagaaaatataatagactagagggtaatggagattttaaaatttatattatcttaatatatttattagaaaaaatattagattgctcaataaatcaatggtaactttaaggcttttactgtctactacaaagaatttttatagatatatgaagaatgatggtaaggaagagatatgatgccatgaggcctactgtgagcaagacactgctaatcaggctattaggttggtccaaaagtaattacagtttttgtctttgaaagtaatgtcaaaaactgtgattacttttgcaccaacctaatacttccgcactttggaaaggctttgcctacatcattttggttattgtgagaagacttgcacacataaggaatttttcaaaataatattttaacttgaaatacttttctttgacaaatacagtaaaagtgatagagccaaaaagaggactaggcatagccctgaggggatttccgagcaaaaaaatcccaggggatttgtatgcaaacacttcgctcaataaaaggagaggccaggtgtggtggctcacaactgtaatcccagcactgtgggaggccgaggtggctggattgcttgagcccaggagtttaggacgagcatgggcaacatgacaaaaacttatctctaccaaaaaaaaaaaagaaaaaatagcggacatggtggggtacacctatagtccagccacttagagaggctgatgtgggagaaacgcttcaactcgggagtttgagacccgcctgggcagtttagtgaaacctcatcactacagataataataataataattatctgggtgtggtgacacacgcctatagtttcagctactctggaggctgaggtgggcggatagattgaacccaggatatctaggctgcagtgatctgtgatcatgccactgcactccagcctgggtgacagagaccctctcttaacaaaataaaaaatacaaaaaggagaaagtcatcaaacaaaatgatgtgacttagtctggtaatattcgtcaagaagtcaagatttatgctctcttacaattctgactttcacattgaattaaattaagggtgtcttggcttgtttagtgtagtttagtaaaatacagtcatttgttttccacagctattatattattctccattaaaaaaagaagaagaagaagaaatgagaaaaaaaaatcagtccctagctagaaattttaagagtcaataacatttgggaaatgaaaatatattctgaagtagtataatcatacccaaatttttagactctgtactcaatctataagatgtatgtgagcaaaatattattagaagcaacatgaatgataatcacgcactacaagcgcacgaataatgtttccctgaaaggtacaataaaaaattattcaatgtgaaacaaaacgttgactgcaacaattattaaaatttgactattgaattgtcagtatactcaattatgaagacatttggaaaatataaatgagcactactgtttttgctcattttttaaaaatgaaaatttttggtaatgtctgacctgaaggcagatattcattataatagtcaaatatcataaatacatttcaaatgttatgtattctacataaattactcaggagaggaacatgtaggctcataaacttgcacacaagtaaaggaatgtttcttaggaaaaaattctgtgttaaagatattccacaccaatgtctcaggaaaaggcatttgtagtatactgctccattacctatgcttcataaaaaatgcagctatctaatttaatttagctctgaacagatttcttagcagcataatttatgttttgagaatatctcttaagaatcatagcttgcaatctatggtgcttcaatgaagaataatctgtaaacaaaatctccatctatcaacaaaggccattaaagaccataaaataacccatccttgactgattaatgctgctactgaaagggatttcaggctattaacatccagaaaatatactgccactgtggttgcatttattataaatcacatagttatatgtactggtgtaaagcaatgttttcttaaccacctccctctcccaaattaatttaataacaaagatactttgaagaacactaaatatctatagaaagtaaatgattctatttttttccctagaggaaatgtatgtgaaggcagggctatttataatacattagatagctaaatattggtttaacactttatatgcagttcaattatgttcatatatttatgtcattaaaatagtttctctaatgtaaaataaaacattaaattcatttgtatttcttgatacttttattaacaatactgatggtttttcatgggtaaaatagccatcaaaaattgttagttgttacctttaggttcatcctattctgtcaatttgattgtcactaactcttcctcttaggggatgtgaatatagctgttgagctcatactcttggaaggtaaagaggctttgtttactggtgcagatctcgattttttcaaatatagtatttcacctcagaaatactatctattagctcttatgccttacaaaactactggcttggatttgtccaatggttttaacccttgatcttacctttaacatgcttggaatctcacaaatattttcttatattgtttagtacaaggcactgtctaaatagtttagccacattatctcattccatttacaccaatcccatgagataggtacgttttaaccattttataacataagcaaaactcaatttcaagaggttaactaatatttccaagatcacatagctagtttatggcagaggaggattcaaacacaggactgtgttgattcaaaaatctatagagttaaatgtgtacttgtccttccgtaatatctgaggctagacaaaacaatccctggcttttctctcctgctttctatgaatattctgtcttagactacttagtcattatatatttttgtcttttcagtagagttctgttttgctgtgctagttcttttgggtttctataataataaaaataataataaaaggagaatagaagaataagagtagatcagggagaagatattctgaagataagttggtttaaagagaatgagttaatggatcagcttttgtctctgaagtcaacaaatgacaaagaaatgaaaaaggtgtaccctggaacaatgcatctatctgctggtagtacttgagaaatacatacaaaattcatatttttattttcttttgtttcattttattgcttattttggtcagtgttatttgcttcttatactagtaacattcctccagcacagaacaacatatctttgcaaatatttcattaaatatataaatgtcttaaataccacaaatgaaagacatgagtaacacaatatagtccacaaaactcaaaaggaaataaacacagtttagcatttttttcttacaattgaaaagattttaataactgttgagtatttataattatctatgctaactcccattttcttgccaagttatgtgtctttaaacactatggagtccccttgcaaaatttaacagagaagcaaagatatgtatcagtaatattgatgtttttatttttttaaaaaaaacctccctgataatttaagtgaattggattagaataattaaaacagaaatgaaggacacagaagcacatattctcaatatcgtcacctctgattactttagaattctgttagcatgtgctgtaaaaatcctttttaaaataaatattcccactataagcttaagtttattcatatctagggagaattgttttgttcggataattagatcaacagctgactctttaagctgagataatggcccactagccaataggaatcacacatgttaaggagaacagaattcaaagagtctggtcccttttgcacagtgacagaacatatgaggcagctacatatctagagagacaagaagataaatataagagagcaaccaaatcaagatgtaattactctgcatttaatcaaggcaccttagggttagtccagaccttttatccaaaacagctctgtaaacagcctactaaaccagcatcatcagctttctgtatttctcatctgtctaagtcagtcttccttgtttcaccatattcctacttgttttgtcttcaacactttctgagagaatgaagaaaaatgacaaaaaacaaattgtatgattgtatgaatgattaatatctcctctttcatgttgttcctcttctattgttcaaagagtatagagtgaataaatacaaaaacaaacacaacactgaagttaataaataataaggtccatctcatttgttaaatttcgtttcttaaggtatatgtgtctttgaaccttctggttatttctacaaaatagttctagtggctttggcagagtggtagcataacacatcactttttaaacagagttgaataattgtataaccctaaaagtaaaagaggcaaacaataaaatgaaatgaacaaatgaaataaaatcagaaattctcagcttaacaaaaccacctttcttgtgagcacattttgtgcatagtgaaataagggacatatctctaaagctctgtacacatatatttattaaaataaattgaattaacaattggcactacacagagtggcatgaaaaggttcagtatcttaacctcagctattcactaagataaaaggatcaccaacataaaatcttttttctttgcattgttaaacttaaataagtgttttttctctaaataaaatgattaatttttaattatgtagataaattttggatctaggtggactggaggcataaatgacacttacttagagatataaccagcaaagtcaagatggcaactttacagaaaaacataatctaaaagtttgaaaaacaaactgcagaatatattgtgtgtggctctttttatattctaaactatgttataaaaattttgcctcgacttacttatataagaaaaataaaactggttgcagaaatataatttagtattatgtcttgtgtgacctaacaattgggtaacaattatactaaaatgggacataatttattaatttacacagtataaaacctattggaatagactttgtaagttccaagtaagtttcttatcgtacctggtcagatttactttgcaatgtccatcttaatatttatgtttttaatatttttaaaataaattttaaggcaatagcatgaatagatgaatacataagataataaatgaaactctagctctttataacttaaaagagggtaggataaagaggcatggcataattttacattttaacttcagtagatgacaatatttgggaaaactaaggaaatatggaaggttagacaaaaataccgattcagggctagaaacaatatttatattttacaatgcccattttagggaaacacggcattgctatgtttttaaagcacgctttagagagtgaaagagttcactttagaaagtacaatttagaaggacttcactttctaaagtatgccttagaaacacagcaatgctatgtttttctaaaatgaagagaaagaaactttatcactctcaaacagcaaggcttaaaatttgtagagaatgtgaatgaggaaaagaaagacaattgttcaggaagttcaataaatcatatttgctgagtcattgagttattaaattcagcaaatatgattcactttgtggcataagtaacagggaaacatgttccatcacaatttcaagatgaaatataaaaagcttcagtctctcttttgtctctctctcacacacacatacacacacacacacacacactcacacacatacacatatgcacaaggtaattgaggctagggaggtgaaagaaatgtagagtagggtctctgacaaatgtggtgaagggtctctgtgtacataatgattttttgaacaatctgaagacaattaagcaaattcagaataattttaacatttcagcagattaactggtattaaaaggggaaaagattggcagaagctttattctaatcatgcaccagaacaacaacaacaacaaaaacacacacaaaaaatcaaagtggcaaatggtttcattgattattgtgaactatccggcacccacgagaaaacaataatccaaatttgttagctcctcaaccttggatgagttttcatgagtattttataaattagtgctataatggcaggagacaacgaactcccagaccacttccaaatttaaaattatatagttttccattgaatagtttattattttcttaataaagataactgtttcttaataaaactaatgctatataaagacaaagtggataaaaaatcattagcaagagaattagtaaacaatgcatagcaacatacatgcatatgagcatatatatacacccatatatgcatatacactagacctatatgcacataattgtaattatatattagtataacaataaaaatcctaaaatatctcaaatgtggaaataaaaatgctgagccaacactagcctagagggctgagaggccagaagagattttgagtttcaccatctgttggatcattcaagcatttcacaacttcctgccagtatcaaatctccgctattttatttgttccaagaaattttaaaacaaatgagagaggtaaaagcagttgaaaatgctgaaagttttgttcactttaaggggttattgttgaggcaatattgctcattaaaggaattttaatggcttaaaaattaaagcttttcaaagtcaagtactttatccctttggaagttttagcaatttaaacttgaataattttcatgaccaaagtaactgcaaaactataattttatattacaattgtatttgtaccatctgacctaattattaaatgtttaaacataataaacactaatgaagtgctctgtcactacaaataagcttctggtcagggtgctattgtcattctactttcttcttgtagttttgttacttttctcgtgcttgtccacagaaattcccaccaagagtcaaagttccacttgcatactcctgtgtgtggaacaagggtttgggatcaaagagtctgccttttcattctgggctctgctacttattacctcttccttgaatctatatttttaatctagagtttctaatagttgtgatgaggatcagatgagatataaggcagaattgcatttgtcaaatggctaatatatgatatgtataagatatgctaagtactcagtaaatggtaattgtttttgctatttctgatttgggcttggattttaatttattttttattgaatgttggataggtatttacccattcacacaatgttgtctaaatgttcatcatactttctaaagttaagggataaagtacgctgaaaggtagctattacctaaaataataactatacctcaggcgagataatacatattatgaattgagaataaacacgcattaaataagtggtaaagcgatacaaattgagtttatacagtagaaaatagaagggggttatttctattggcagccataaggctagagtatgttgggcataattcttctttaccagatacaatgttttgtatagaagtatactcagtagattttttaattctgtgtttctggaactaaacagaaatgtgtggaaattgtagaattgggcaagaaatggaattagaagattcaagagttaatccaacggatgtgcatagattgaagaaataagtccaagaaaataataaatggattagaattttgcaatctctagtactcatagttttttaaaagcaatattaatcaatgaaatacatatatgtgcatccattctatgccaagaacatcacagttaccttggtacttgagacacggagacaaataagacactgtctatctctataaaaacatcatagactttcattctagtgagagagaaaaacacacataaactaggaatgacaaaataagacacatacaaataacaacgtgtgaagcatttcatatttacaaaataaacataaaatactgttcattttctgaaaaactttctccatttatcttgaaatatgtagtatttctgtcaaattttataatctattattaggtatagaaacataaatacagagataagtttttcaataataaaaatattcccagtggaaaatggcgatggatacttagtcttaatgtcagtggcatcacagggattggtacagacactggtgaactaaaaatatcacacggtttaaaggcagtggactatacttggaaattgttgctgtagacaacagcaggctcagcattaccaaattatctcatttttttgagtagaaataaattttgatattttaatgtgcaaagcctttaaaaatgtgttcaattcaaaaaagtggctaagaaaaaaattaaaaataaagtttaaaaaaccctcaaaactatatctgtgggtggaatcaacattcaggtttctgctgtttgatcctgaactcaaggacttataaaagggaggcatgaagaagagctctgcaaaaactatagaaaattggaagatacagaaagaacactgaagaaaaagctactgtccttagattttctatggaaaattaggtcaggtataaagaacatattcctaatcagatgaggaacttttaaatcagtgaaatcatagaactgcttctttggaggccttaatttttcatctgtttggggttatttaaatgaagccattgcaagtgtgtcctattttttcaaagtatattttgtggactccccaactgtaatcacaggatgtgcttgttaaaatgcagattcccagacacctttccagatacagaatcaaatatttttggttgggtacagaattctgatttttttaaaaaattaactctagttaactttgatacaaagtacatgttgagaattataccactggactcacagccaccaaagacacttgtttagttggcgactttgagacccagtcagacttatgagtacctcggaactggaacccaagagacgtatttataacaagtttaactaggtgacattaatgtgtcttcagctacatggaggctatattttattgcattatatattcttccttcttgttactaatttctttggatgcccgcttttacaataaaattaataatttagaagcttataacttctttgtaaaatggcatttctagcccaaatacttgtttaaattcagcataaaaaagaaaacctagttcataagtgatatgtcattaaggatcactgttgtttatcatgaatttcattgtatctttaaaaacatgacgtttttatttttattttttaatttttatttatttatttttttaagtagagactggatttcaccatgttggccagcctgtctcgaactcctgacctcagatgatccaccagccttggcctcccaaatgctgggattacaggcatgagccactgcacctggcctaaaaatatgactatttggtaaacatcaccagggtcctaagaatattgtgtagattatttccagtgggatggtagccattgagcaaccaactgatcaaattttaagatcttgtaagatcttgtaagatgtaaaatgtagcactttcgtaattacctaacttatttgtgaatctgcttttgaataatagtaaaattgtgttttcaaagccatcttactcagaagtaaattatgttaatatacaataaagagaacatacacttttactatatgtatatggaaaattactatatcataaggtcttctatacagctaaaatttttgtgacctgggtacctggacttcaattgagtgagaaaatgaaactaagaaagttacagcattgatgaatagcatagtatatactatattaacagtcattactatatattaaaaagtagcttaaaagaaaagaaaaggccaggcacggtggctcatgcctgtaattcgaggtgggaggatcacaaggtcaggagttcaagaccaacctggccaagatggtgaaaccccaactctaaaaatacaaaaaaaaaaaaaaaaaaaaattagtcaggcatagtggcgggcacctataatctcagctacttgggaggctgaggcagagaatttcttgaacccgggaggcagagatcgcactgagctgagatcgccactgcagtccatcctgggagacagagtgagactccatttcaaaaaaaaaaaaaaagaagaagagtaagagtaagaataggagaaagaggaggatatagaatggaataagagtcacagaatgagagtattcagcccaactgtaactttgttttcaagatatattagaagcctggggaattcttctataaattctacttcccatttagcatgttctaaagttcttctgtcatgtcagtataatatgagaagaggtaatgtattttgatacctcctgttttctatagacaaagtatgtagattaagtacatgagtatttgaggttcaaatgcacctattaaaatgacagtataagtatctatttaactggagcaataaacatacatatctttcctaaagtgatacttaggttattacaaatgccctattaggtttagttatcttcctcatttaaaacactttccacatacagatagtagtagactactaaccttatgctggaacatacattatgatgtaaaaccggggaaatatttcaggtaaactcattctcagcagtggtacatgattatgaagctgtgttttatcaacatgattgctgtgagcaccaaataagaacatgcaagtagcttggttagcataatgtatagcacagagtaagaatataacaaatgtgagttactaggattgtaaagattatcattattattgtttgaatagtaatctctgtatgtaaatagacatacatattctactaacagatttgtgttatctacttgagtgtgtgtatatatgcgtgtgtggctatgtgggcaccagtggagcaataatgagtttgctacatgttatatatttctagaatcactaattatgttgaaatattattacaaaagtatgtgccttaacaaactaataaatactttggtgtctaaataagctcaccatagagcaaaatatatgaagacacacagagatagctatatatagagacaacggcagcatgttattccatatggaaaaaaaaatttgtatctgcagataaaatggcactccaggaggatatcaaagcatcaaatggatgttttcattaaaagaaaatttgtacatgaatttttaaaatttcagttcatgatgttactcattagctctatttttaacaaaatgttcccttttgcatagagaaaggaaagtcaaacactgatcttcaatattaatagttaagaacctgaaaacatcttacattttattttataggtttaatctaacttaaaaaaaatgttaaataaaagacaatgaaattgaagacccctcctggagaaactagtgaggatactaatatagactctacctcctcaaaaacctaacttcaaagagattttaaagaagtcatcaattctctcacatggcagactgggataacatctgttaatagagacttaaaaaaagtaagtaatttaaggaagaagggttgataattcattgattgggataagagaggaaatggcaagagaaacaggtatggtttcataatgacattgagataagtctcaaaggctgaaggaagaatttaatataattattacatctagtgatactgatgagaaacacatcctttctccctcagttttctttttgtgcgtaatcttgtaacagattgttcatgttttcagtaaatactgggagtgaggaatggtggaatgcagagatgttaagcagagggatttggtcccaccaaaggtactctaaattaaataagatgtgctcactttgcaaaagtgacttcaagataagtgcctagcttccaccattactgctatactccacttctaacaaaattatcatctttaattttctagactgccgcactagaaccatcatagtgtggaccaaatttacactatttttctacttcctatttctattcttctaaagttcttaatctgtgttctaaatctgggactgggcttctaagagtaggttcactgattgtgttatccaagacaggggttggcaaattatagctcaccggacaaatccaacccacacctgatttttgtaaggctgaaagggtaagaatggttttgacatttttaaacagttggggaaaaaatcaaaaaaacagatatttcttaacatgggaaaattatataaaatttaaatgtccacaatcttgttccccttttaaagatatattgttgattattttaacactacaacaaccagagttaaatcgttgcagcagagatgacgcggcccacaaaagccctaaagatttactttgttctttacagaaaaagtttgctgacccccaactcaataacttattttatataaacataaatttttcaggaaaataatactgtgaacccataatatgattgtagcataatgggaaaattaggcaaagattgataaaataccaatcttattattatacagtcacatatcatataggaaaaatctgatacaatggatttaatatatcagatgggaatttgagataaaaaagattctaatatttctagtcttataaatgaaactgagcctaaatgaagctttcaggggaaatgatcatgtaagacaaattacaggggttggtttctaaaaccgattctttttactctttactgaaggtcaaggatactgaatgtgccagtgcaccttcagaaagcagcctgcatcagcacatttaaaccactgaatggtctcaccacctagtttcttgcgaaagctgagcaatacattttgtgatagataccactgagaaagttaggcagaaattgttattagtagtatatgacaatcataatagtctaacttttactgtaaaactctattatttatatgttttctgtacatcctgtaggattgtctgtattttgcaatagaattgcaatgtgtaagagaaaaagaggcagtctatgtttccattgtcattctaagggacatattatccatacaacacctcctttttcccctttactgaaaagctgtgtataaaacactctaccatgctttcctgaaacataaaagaagatttattactattttaataaagaagtaagaacaaaaatatccaatctcctaatattcaatggagaagaatatatattcttttttaggaggacacaaaaatagcaagcttaagtatattctgttccctaaggtactgtgtaggtggagaaaattatttttcatttaaaattatatacttgtagttcattttaagtaagcccagtggacataaagctgattcattcacaaatgcaaaattttgttgtaattatttgcttaaccaaagcaatattcatcaaaaatggattaatgctaggattattttatttcaagtaaatgaacatatattgattagtgaccttccaaaccccatgctagcaacagtaattactattattaataaaatacatcctctagtgcatattaaatggttcaatttattaaatatgctgatctctgcatacctcctcaagattattttttaagaaaagtttactttgcctgagaaagaaaagatgaaatatgcaaacactaagtttactaaaaccaccaaatacaagctgccttggagtcccgttgttctgaattgtcttaccctcttaaaatcagatgttttaagcagataactcaatttttcatacaatataaaatgtccaaaatccgtgtaattctctgcctctgaatacatagtctctatctatttttctcattgttttaatctaaaaggaacattatgttttctctttttaaaagtaccctccttcagcattgtttttacttctaaactccttagattttctcctcaaatcccatttttctccgcacaatctcatcctcctttagctagaatcactcactggtgattaaacagagtcacgcagaaaataatgaatgcaaaaatgtgggcaggaagaaagataagggaagaaatattcttcaggaaagaaaatgaaacggtatttgtcagcgatgttgtaaaggggaagaaacattagagaaagggtgattggttgatagtgtcaaacgctgtaaagaaaggaaagaagaggtattttttaaattagcaaagtggagaatcatttttaaactttgagttagagttattactgaggaatgagaatttaagtttcctttgtggttttctgtgcttactaaatcaccagctcttcttataaggtgagtgatatatagtaagaatgagagtctgtggggaaggctggtgaacatactttgatgaaaaaatggactgtaaaggagtaccatccctgtcataggaagagatattttagtgtctgaatctgtgagggggtgtgtggaggtcaatgttgatgctctatgtatctaccggaggaaatttatgtgtgtgtgtgtgtttatctattgtaaggggaagccgtgagatatcagacttccctggcttttcctatctctgataagaaacactgtagttctagggaagctgagcgctggaaaggaccttgactttgataaatacaataattggtgacaagatttaaattttgttttccatgagttctggtgatagggcattctggcttgttttatgtcatttgtcctaatcctcttaacctcttaacctattctacaaaccactttaaatatttcttctcattattccaaacccttgctgtcaaacatcattgtaacctgtgtgtatatatatatataatatatataatatataatatatataattatatataatatatataatatatattatataattatatatatactatataatatatattatatataatatatattatataatatatattttctatatattatatataatatatattatataattatatatatattatatataattatattatatatatatttttcccactacagtgggaaaaaccattaatccagtggctatttcctgtacactatctctcgtgtctgtgagctcctttctgtttctattgccatcagtgtctttcacaacctcctctttctttatgatgtgtttcaaagcagattctttattttcattctcccaagacctgctgcaccttgcctactaatgtcagatacgttttcttcaaatgtcacacttcaggttagttatttgattgaatgcctatgtgattcccactacttccatataaagtccaatccaatcaacttaattattcacagttttgttcaattgattttactttccctgcctgactttccatttgtctattcaaggtagactagtttccaccattgcgctgacttcttgccctgaaatcactacttacagccttactcatcaaagcaaacgacatcaattaatgaagtaaaactcttgtcctaggctgtctattggtcttctctgatcctttggcggcagaagctctgcatacatccatcttgcctagacagtgttatgcaaattaacacaaccaaaaacaaaagtcaaattgtggttccttttatatattttataagtactattattaataatgaaaagacttttttttaaaatttgactaacttttttacataatactatctacttcataacatgaaaggattaagtggatttttataaataatgtgcatagaaccatgctgagaaaaatatgaatgttctaacattggtactgattgttattgttatttttactgctaattcttaattagtagagacaaatgttgactgaactatttctttggcgagaaataaataatgccatattttgggctcttcaagccgagtctcttctggcttggaacactaaactatataaattgacccttattatttaaaatgtaaaccacattaaaaattcattttcttaatcaagatgaagctaagatatttggtttccaaaccattaaaatttttatgagcaattctctgtaaaagcatttacctctggtatagtcgactactagttatgtactaataactattactaggatccattagctactcgctttgatctgtgttgtcatgaacaggaagatttggaaactgttgatggtttatacattgactatacaaaatactatattttaaaatgaaatcatatgaaattaatttatcaagattaactgtagtgattacaaggaaagaacagagagtacatgtttgatacattaaaaaatcttttcaaaaaccaaagaaaatcatgggtttagattataaagtcataaggtgataaggcaacttttgctcatgcggaaatatgttaattagttttataatattgtttctccatcgaagtacttatacacgtgtttggctacttaaaatagggtaaagaaataaataaataaattataatgctctaaatgaaatttggcatataccatctctcaaatttgcagtttatagtgcaggaacaaaaaagaaaagggaagtgtgatgaaaatatttagaaccacttgtctagagtttaaaagaattagtagcaaaaatattacaaaatataaaactactgattgccttgaatttgttacctgatcccaagttatgaacattaaaagtgtcataaagaaacaaagtcagacacttgttaaaaatagcaagacagatcttagtaagatactgcagtagggaagagagacttcagtggaaactgggttcagctctgatgaaacaaaaggcagaaggctgtttaaatgctggaatatgctaaagtaggggttcccaatccctgggccatggaccagtatgggtctgtggcccgttaggaactgggctgcatagcaggaggcgaatggtgagtgagcaagtctaagtaacactttgtatttacagtggctccccatcactggcattattgcctgagctctacctcctgtcagataagccacagtattagattctcatagtagtgcaaaccttattgtgaactgtgcatatgaggggtctaggttgcgtgctcctaatgagaatctaatgcctggtgatctgtcaatgttcccatcacccaggtgggattgtctagttgcaggaaaacaagctcaggactcccattgattctacattatggtgagttatataattatttcattacatattacaatgtgataataaagtacacaatacacgtaatgcacttgaattgtcctaaaatcatccccccaccccactgggtccgtagaaaaattgtcttcagtgaaactggtccctggtgccaaaaagactggggaccactgtgctaaagcaaaagtaccaaagcactttgaggtggatgcttaatgtgattagcccagttgtgtttgctaactggcacttacagaaataaagtccctactttaccacagagactgggaaatagaggccctatctttctcaatggttacatttcaaaaggaggtctcccaggtccttgagaaagacattcctgagttgcagatacatttcacaacgacaaggaaaggactacaagtttcctaatgtaaattctctaagaaaagggaagtctgggacccatagccaatgatatggtttggttctgtgtccccacccaaatctcatcttgtagcttccataattcccatgtgttgtgggagggacccagtgggagatgactgagttatgagggggagacttttcctgctgttctcatgatggtgaatgggtctcctgagatctgatggttttaaaaatgggagtttgcctgcacaagctctctctttgcctgctgccatccatgtaagatgtcacttgctcctccttgccttccaccatgattgtgaggcttccccagccacatggaactgcgagttctctattaaacttttttcctttgtaaattgctcagtctcaggtatgtctttatcagcagcttgaaaacagactaatacagtaaattggtaccagtagagtgaagctttgctgaaaagatacctgaaaatgtggaaacaactttggaactggctaacaggcagaggttggaacagtttagagggctcagaagaagagaggaaaatgtaggaaattttggaactccctagagacttgttgaatagctttgacaaaaatgctgatagtgatatgaacaataacatccaggctgaggtggtctcagttggagatgaggaacttgttggaaactggagcaaaggtgacttctgttatgttttagcaaagagactggcagcattttgcccctgccttagagatttgtggaactttgaacttgagagagatgatttagggatatgtggcaaaataaatttctaagcagcaaagcatttaagaggtgatttgggtgctgttaaaggcattcagctttacaaaggaggcagaacatgaatattcagaaattttgcagcctaatgatgtgatagaaaagaaaatcccattttctgagaagaaattcaagcgggcggcagaaatttgcagtagtaacaaggaacacaataggggaaatgtctccagggcctgtcagaggtcttcacagcaggcccttataccacaggcctggaagactaggagaaaatggtttcatgggcagggctcaaagtccccctgctgtgtgcagccagggacctgatgccctgcttccaagccactccagccatgggtgaaaggggccaatttagagcttgagctgtggcttcagagggtgcaggccctgagccttggcagtttccacgtggtgttgagcctgcaagtgtacagaagtcaagaattgagttttgggaacctctgcctagatttcagaaaatatatggaaatgcctggatgtccaggcagaagtttgctgcaggggcctggccctcatggagaacctctcctagggcagtgcagaagggaaatgtggggttgaagtccctacacagagtccctattggggcactgcctagtagagctgtgagaaaagggccactgtcctccagaccccagaatggtagatccactgacagcttgcacagttcacctggaaaagctgcagacactcaataccagcccatgaaagcagctgggaatgagactgtagcctgcaaagccacagggatggagcttcccaagaccatgggaactcacctcttccatcagtgtgacctggatgtgagacatggatttaaaggagatgattttggagctttaaggtttgactgccccctggatttccaacttacatggggcctgtagcccctttgcttcggcaaatttctcccatttggaatggctgtattttcccaacgactgtatctgcattgtatctaggaagtaagtaacttgcttttgattttacaggctcataggcagaaggcccttgccttgtctaggataagactctggactgtggacttttgagttaatgctgaaatgagactctgggggactctcgggaaggcatatttggttttgaaatgtggaaatatgagatttgggaagtggaatggtatgatttggctgtgtccccacccaaatctcatcttgaagctcccatagttcccacgtgttttgggagggagctggtgggagatgattgaatcatgggggcagatctttcccgtactgttctcatgatagtgaatgggtctcacgagatctgatggttttaaaaatggaagtttgcctgcacaaactctctctttgcctgctgccatccacataagatgtgacgtgctcctccttgccttccaccacaattatgagacttcctcagccatgtggaactgtgagttttccattaaacttctttcgtttgttaattgtccagtcttgggtatgtctttatcagcagtgtgaaaatggactaatacagccaggttttggcagaaacaaacattaacttattttagcaatgttgatgtttgtcaggtagacatttaagtgggctgggattgttaacctgggacacagccttgaactgttaaaaagctgtgctagaatttgttcaagtctcttagtgtgggacatgcacaaaatcatttatgctgagaatctgcagttctcacaggccaaggttaagtcccagtcaataaaaatgctcggaggagcctgactaaagtctggtcaaggagagagtctttgccataagaaacttaataataactaatatctctaggctactatttgtcatgcaatgagctagtatttgcagctttttcttatttaattctcatatttcctcttgaggaatatactaggattactgcctttatttgaaatgtgtaacaggctaagtaattttttcatgaattaatgctgtcctcatttatttaaactgtattttcataagttagcactagatacaggaaccaagggaacaggtgtagaagtcccaagaaactgaatgtgtgggcaaagcaaagaatggctaaacacacaacatccactgagttaccatgcacgagaagaagcaggaagatgtaggtcccctgttggccttatattcttcccacataaattatagattaacatatttcctgattttttgaagtttccagagatttaccaacttgatctttcatgtgactttctcttattctggattttcagtgacttttcctctcactttattgtctctaaaatcacagaaaccctgtttaccacaattattttcttaaatttatttctacaggtctttagttaaaaggtacagggaagcagacaaaccttaaacttgataatacgtgggaaataatgttactggtatcttagaagtcatgccagtaattcgtctaaatttaagcatcaattgaaatacggatgcaaaattattatacgtgattaattactttaggtctttcatcagtttatggtagagtaaccaaattgcccttgatgcctctcatgtgtcaagtattgttttgggtgcaaaggatagatcaataatatgacatggttcttgagtcagtttggttatgactggagttggtgagaatgttagactcacattcatgagtggatttgataaatacaatgtggctgacatgatgtctgctctcaccaagacttccatttcagttctttgatttctcctttgctttcgttaggaatggcctatatttggtacaccaaaaatttacactaattagtgagcacttctcctactttaaaagagaagctcaaacaggaaagaatacacacacacacacaatttttttggtatgagattcaaaattcctagaaagcttatgacaaaattatcaaatttgttgaattctcaaaattgctaaatttctgaataatgttcatctagctacagtacttattattccaccggaagaaagcatatgcttcaacacaaaaaaaaaatttgagtgcaaaactattaagtaaaactctgagaaaacatcatttttgtacttggcaataaggcaattacttaaaaaaagttagctaatatttgtgagtgttacatttaattaaacattaaagaactttatagaagtatttttaaaaaggaagaaaggaagaaatgtaataacccagaattcaagagaagataagcaaaatgttatttgacagaatccagaagcacatgaaaaagttaattcaccatgatcaagaaggctatattcctgggaagcaaagttggttcaacatacgcaaatcaataaatttgattcacctcatacacaaaacaaaactgaataaccatatcattatttcaacagactcagataaatcttttcataaaattcgacatctctttatgataaaaacctacaacaaactaggcattaaacatacctcaaaatgataggaaccatgtgtgacaaacctagagcaaaatcatactgaatggacaaaatctggaagcataccccttgggaactggagcaagacaataatgcccactttcaccattcctattcaacatagtactggaagtcctagacagagcaatcaggcaaaagaaaaaaatacaaggcatctaaataggaaaaaaggcagtcaaattaactctctttggtgctgatataattctgtacctagaaaactgtaaagactctttgaaaaggcccctagaattgattagcaactgcagtaaagtttcaggatccaaaatccacatacaaaaatcagtagcatttctatacaccaataatgttcaagttgggagccaaattaagatcaaaaacccatttacaatagccacaaaaaaaattaagtaggaatgcatccaacaaaggagatgaaagatttctagaaggagaattacaaaatactgctgaatgaaatcatagatgaaacaaatgggaaaatgttccatgctcatgaactggatctaccgactacgtttttcccagaactagaagaaagtcttctaaaattcatatggaactagaaaagagcttgaatagctaaagcaatactaagtgaagagaagaaagctggaggcatcacattacctgttttcaaattgtatataaggctactttaactaaaacagcatggtattgtcacaaaaacaaacacatagaacaatgaaacagaatagaaaacagaaataaggctgcttacttacaaccatttgatcttcaacagactcgacaaaaattagcaatggagaaaggactttctattcaataaatggtgctagtttaactggctagccatatgcagaagaatgaaactgcacccttgcctttcatcgcaggcaaaaattgtcttaagatgaatataagacctaaaactataaaagtgctagaagaaaacctaggacatggcattctggacatcagccttggctaagaatttatgagtaagtcctcaaaagtaattgcaaaaacaaaaattacaaaaaataaaaattgacagttgggaccctaaagagcttctgtacctcaaaataaactatcaacagagtaaacagataacctatggaatggaaggaaatattcataaattatgcaacttacagaagtctaatatccggagcctctaaggaacttaaacaattcaaaagtgaaaaaacaaataagctcattgaaaagtgagcagaggacatgaagagacagttctcaaaggaagacttacaagcagccaacaaacaaatgacaaaccctctacatcactaagtatcagagaaatacaaatcaaagcaaatatgagatactgtctcacaccaatcggaatgctattattaaaaagtcaaaaaataacagatgttgatgatatactttgaatatatgtccctacaatatctcatgtaaaattgtaatccccgatgttggaggtgggacctgcttggaggtgtgtttgggttatggaggctgattcctcatggcttggtgctgtcctcatgacagtgagtgagttctcatgagatctgatcatttatcatttaaaatgtgtggcacttccccacctctctcttgcttccactctgccacgtgagagccttgctccagctttacctttcacctgaggcctccctagaagctgagtagatgctggtgctgtgcttcctgtacagcctgcagaacaattagccaattcaatctcttttttaaaaaaattacccaatgtcaggtatttatttatagtaatacaagaacagcctaacacagttgctgaggctgtggagaaaagggaatggttatacactctaggtttgaatgtaaattagttcagcctctgtggaaagcagtttggagatttcccaaagaactcagaactaccgttagacccagcatttacgtgactagggatacacactaaggaaaataaatcatcctacaaaaaagggacacattactttgtgtgttccatcatagcactatgcacaaaagccaagtgtattagtctgttttcacactgctataaagtactgcctgagactgggtaatttataaatgaaaaaggtttaattaactcacaattcagcatagctggggaggcttcaggaaacttacaattatggtagaagacaaatgggaagcgaggcacctttttcataaggaggcaggaaggagaatgaactcaggaggaaccaccatacacttataaaaccatcaggtctcatgagaactcacacacttcgcgagaacagcataggggaaaccgcccccgtgattcaactaccttcacctggtctctcccttgacacgtggggattaaaaggattacaattcaaaatgagattttggatggggacacagccaaaccttatcatcaagacatggaatcaacctaagtgtccatagattggataaagaaaatgtagtacatatacaccatggaatactacacagccataaaacaagaatgaaatcatgtcccttacagcaacatggatgcagctggagaccattatcctaagaaaattaacacaggaagagaaaaaccaaatactacatgttctcacttataagtgggagttaattattgggtacacatggacataaatatgggaacactagcactgggaactactacagagggaagagtaggagtgggtcaaggtctgaaaaaatacctgctaggtactatgctcactatctaagtgatgggatcaatcataccccaaaactcagtgtcacacaatataccatgcacatgtgccccctgaatctaaaataacagttgaaagcataaaacataaaataaaataaatcttcgattggcatgataaatgttaaaaattaaacatcaagggaaactgtgtgagaaacatatggggatactctgtattaccttggcaacatttcagcaaatttaaatttatttcaaaataaaaattcatattaaaattacccctgctaaaattttaattaacaatatttataactttaaaaaggaaattaaatgtgtttcaagaataaggggacactgacatcctccttcttccattctgaagaagatcataaaacataagcacctgcacctgccccaagactggatcaaaaggtgaacacacagatctattaatcactcatctaaaattctcaaacgctaagatattccatagactctaaagtcagacctgaatactacctcaaaggacttgaacaagaagttccaagaaaaaaatagcaacagtagttttaggaggaaatgtgcataattaataggtcaacaaggataggtaagagacagatagcctgaattcccactaatgggaatattaaaaagaaacaatgaaagaaaagtatatacttacctgtacaaatgaaattgtaaactaaagagaattccagtttagcagattaaagctgaagtcttgactcaaatttccatttggtctaaaaccataatggaatacggagactgaaaaaaagcccaagtaaatgagacacatttctgtggaaggagttaaatgattttatttttttcaacagagtaacctgaagaagggagcctgcataatcctgaaggtcagggagcaaattaaagagtaaaggggcatccactggagattttcttctgaatgccttgggttttaagcatatccttttgtgagatgcaagggatgttgggttgtaggcagagctagaaatctttcccttcttattttctagttcttttcagaagttgccctaatcatttagaaaggagatttgcatgaacctgaaagttgcagagtttgctttgtaaagaataagaaacactagtgtcaaagatcaaataaagaaggctggttgctttacccgttattcaggcagagaaggaaaatagtgaactgtgtggaccatgtctaggttcaaggaggagacaggtgaaagcccagagtacctaacagtggagaatttctggacactggaggaaaaaaggtttgatgtgaagaagattcaaaaagtaaaatgaaaaagaaacagtgtaaatatgtcctccccacacaaacactggctcactgagggaaatgggagtcttcgtaatctccaaggtttcagaaaatataaagtatctacctgtaaatcaattacgccccaacccaatgctaatgaatgtactttctatggagagatctctctgcaataaccatggagaactgaaaaactaaacctaaatcataagaagagtttaggcacatattaggagtgttttagagaaaatgtcttctgacagcatggttgtacacaaatcagccagaacttttcatgaccccatgcattagctgatatgccaagatgcccatgcaccagccatgaatctccttctggccactggagccaatccttatcttcataaataccttccattactttcaggtttcttgtgtccatagccaaatgactgaattaaactctgaaaaacttgtattaggagcaaccttgattcttaccaaaaacaatactgcatttcaagaagatgaaactttttatatggtaaattataaaatcttgcactgctttctatacttgtatcaggagcacccttgattcttaccaaaaacaatactgcatttcaagaggatgaaactttttataaggtaaattataaaatattgcactgctttctatacttataaatattttgcatatgtcattatagcaaataacaatttttagaaataattaaagtctcaaagtgttcctttcttgaagtcagcagcagttacaatttgttgtaactagaaaaactgaataatattttattcattttaattattggaggtcatataagtctctggacttactgtattttatctaaaacatgtattttcattttggaaatggagaattatttctttattaatctaagcatgtctatgcttttagaatatgaggcaggctctgcaattttcttacaagacgctaaaggaatggaaagcaaaatcaacaaaaggaaaagagactgagaaaaaaattatacatattgtttataagtttggtgataacaagagttacttttaaagatgcttgcgcgtatacactatcttccaactgtttcagatgtaaatatattaaaacaagcattttaacctcagataaataaaaaagacacatagttaggcatcttcacaattataaactgctgcttattcttatccatgctcctaaaatgccttataatatctgctgtcactgccttggattataagcccaaaacagaattttctttttttaatagataatattataaaggtgattttctaagtgtacacggcctctttaggaagatagcagtaaggctcagatgtatgatttatagagcagagcttttaagccataaactcatcattgatgtcttacagccagatttaattaccttcctgaattttgattattttttccttgctttaaacagatcacacataaaagtatgcctacgtgatatatagtttttcttgtttttgaaatgtatacaaatagtctcctataaataaataaataaataaataaataaataatttattcattcctggacttgctttcttgactcagtcaagtcaaagctaaaatgaaagcaattattttagagacctatgtaaaatacatgcttatttagctgagatttgcttcaaaaactcgagtaaaacaaagagctccatgtaaaaatggtgacattcgtgtttaattttccttaattcatctcatatatgtatatatatatatgcacacacataatttcatacactgtgtaattttacaatctgtactgtcaccaaaatttacctattttatcttgtattctaccagagttctattacatggaaattgtgaagttcacagtaatataactactctaagttgttaatcacatataatacattaagcattgtgttgggtaattggcattcttttatctcttttaatttaatgaaaattgtattagttaggataggcaataatgtgttatggtaacaaatataaaacatcagaagcctaaaataagaaaaattatatattgttattcactctcaatgtccaaattgttctgctattatactcactcaaggatgtaggttgacagagctaataatgacacactcaaaagagggaagaaaaacatcataaatgatacactggatcttatatttatcattcagaggtgacctccacgagttcacttttaatcacaaatattatggtcatatatcacttgaaaaacaaaaacacagaagtataatcctgtcatgtgtctgcaaagaaaacgagaaatatttggtaacaggaataatgactaacctctctcaaaaaaaaattacaagacagccactatcatcatttgtgaagtaaagaaacagaagctcaaaaaagtaagtaacgttaataattgacatgaagtcattaatccagtaatactaaaaactgaatactaatccatttctaaaacctttattttttcctagtattaatattttaattggaacttaaaggtaaaacattagactaatcatcaacagtttatgatgcaccatcaccattagcaaataaatggcgcttttcttaatggtatttatttgtacagtgcaatgaatattaaaaatttgcttaaaccaagaattagagtattaccaactatattcatctgcatgtctctattctcccattcccctgtctctttaccctcagagataatcactttcccataggccagacaagagccaatcttgtaagcagatgtttctaagtgcagcagtctcaggtctcttttctgcatactgtaaaactaaattgtatttaatttgcatatatcacattttccttcctaatatgaatttataaatgtcatgaatgatgttgacaaaccatgaaacaatttcatataaatacattttctagaagccacatataatagcaaatgaagtggatttaagattttaggttaggtctctgaaatgtacaaacagaaagaaggggaaagagcagaattgaaagaagaacatgggcaggaggtcacgtcaccagcatagcattcccagtcagctttctagagctaatgactgatatgacagaagaggcaaacaatcccaaatctataaaatataacattgttaaattctttatttttataacttataaataagaacattaatttccaatataccattgccctattattttccagtactagaaaacacaacaaaattttcaaatgatttacacaacgtcatatcaaggcaaactatagccatattgagacatactcatgatgtaatataagtaaacaagatgtcagtaagttgtgattctcccaagtatataaaagcctttcaaacttttatggcatagcgtaccttctttccttttttgagctaaaattttctactctgtatcactatatctattcctctgtctgtcctactcctagtcaagactcaactaagaatcaatcttcaaaaaaaaaaaaaaaacaattcagggaggctagctgaagaatgatttagttacctattttgagctcccatcatcttcttggaacactattttgatagatatatgagttttcttgtcagtatccctcactatgctgtaaaatctataagagaggtgttagttttctatcactatggtaacaatcaccacagacttaaaataacactaatttgttaccttatagttctgtgagtcatcagtctcattagcctaaaatcgaggtgtggacaggactatatcccttctgtaggtcaaaaggaaaatccatttatttgtctgctccggcttctggagacagccctgttccttgactcatggttcttcttcaattttatcagttaataacagttaattgagtaccactcacaacacgcacttattccatagtcacatttccctcagactttgagcttatctgctttactctttcattttcaaggactctaattattgtattgagctttcctgtatattccaaaataatcttttcaggtcagctgactggtgaattttatcttcaataaattctcatttgctatgtaatgtaacatatttgcgagttccagaaattaggacatagaaataattggggagttattattctgtttatcccaaggggcataaaaattatccagtgtttttaatgagctcaataaatatggtatttatcaatctgaaacaatcaagtttcagaacatgtctgaatctatttggtactgtggacagcatgagcaatattaaatgttagaacatctgaaacagatgaagaccttttatgtggacaatactcagatctacttgactaattagtacagtctcttaaaataattcctttagattaattccttcagataacagatgaggaaattgtatcccagacagacaccgtgattttctctatgtccttcatggaaacagggagactccccctccaccctgtgtcacattttgtaactcgcacaacataaaagatctgcttgaaccctgatgactgatggtctcatgaaaaaaaagatctttattttcagctttttgtaactatgtattttagacatatacattatgagactggattggggtaccaatctcagagagaaagtatgtattttacctttacatttttttatttgattacaatctagtaaacaagttaaagaaagaaacccatggcctcccaaataattgacagacatttacaattaagattattctttcaaaattcaagttttgaatttgaggtaagaaatatcccttcagaaatctcccacatttttgctgtatctacagtatatctcattatactcagttaagtcattcagtaataactaaaatcctaaagtacttcgccaaaaatttaaccagataaaaacaattttaaaaagtagctaatgaatttaagatagtgcctggcttccattttttacacttgtcaactagcctatcttttattatttaatttttatttatttctcaaagaactaaagtagatctaccatttgatccagcaattccactactaggtatctactcaaagaaaaagaaatcattatataaaaaagacacatacacatgcgcatttatttgcaacacaattcacgactgcaaagatatggaatcaatctaagtgtccaccaaccaatgagcggataaagaaaacatggtatatagacaccacggaacaccgctcagctataaaaaataacgaaattatgtttttttttgcagcaacttggatggaactggaggccattattctaagtgaagtaagtcaggaatataaaactaaatacttcaagttctcacttgtaagtggaagctaaactatgggtacacaatgatatacagagtgatataataaacaatatcctaccttaacaagccactgtccctttaattttatctcctgtatcccgtaaaaaggacgtaaaattcacaggtgagtactattcttaatgtctccaaaattaatagctgtgcttgatgttttcttatagaattgaaattccaaatatatgcttataaataaacgataaatccaaatttgttacattgtacacatgttgccactttgaaagttaatattattttcaacttccaaagtttgtaataatattttaagagattcagacaaacatgacctcagaagaatctatgaggaggcatacatattctttagccctagatatataaaatcttatttggtcagagagttaagagttataaagtatttcttggagccgagtctaaatttcttcattttgttacattaaaaggcaaaaaaaaaggtctcagaagtttaagtttttgagagaaaactacattctaaaattcatgtttgaggattatttctccataatttgacttaaaatggttattttaataaattaaatacaagatactaatgccaaatgataaggcaatagaacagttacatatttgacatcactacaaagatattcaatacattgagttgtttataatagtgaataaagtagccaaaaactaataaataggagtattcctctgagagtctggtaacatatactgtaaaatccgcaaaatgtatatgggaacaccaccaaaagaaacatgattaatgttgatgattctgaggttttcaaatagattcgtgtgtatctgcagccacccaaccacacattaaccctgtcacctgaaactatcactatttaacaaaaaagactaatgaaacaatgtactttcctgatatatggcactgaataaaatatacctagtgattatagatagatttttaaaagctggtcatggtggtgcatgcctgtagtccagctgatctggaggctgaggaaggaagatcacttgagcccaggaggtcaaagctgtagtgcatcacggtcatacctgtgaatagcactgcactccagcctggcaacatagcaagaccctgtctctaaataaataaataaaaaccagttagaaaacaaaatgagaaaattgagaaaaataatttatagttaatgttgcttccatctgaatgtgtaatttgataataaagttattttgcatatttaaacataatttctttaacaggaaaacagaaataaaatcagaaaaaatgtaaaaattggaaattttctgccttcctgataatttttttttttttagaaaatcagggcaaaacatttaggaatacttactattattgcaaaaatttaatatcatgggttcaaagacacttgagatatataagtatgtacctttaatacttttctatttgttaaatatagcttagtaaaataaatgaactaataaaattcctaaatgttttactgaacaatgatttttttccttgatgtttagatgaaataatataatacctacaaaaagatactaagtgatgtcaccctgcgtagcttgaataaggacatttactgaaacatttttatgaaaaataaacatatttgattacataatttatataccttttccctccagatgtttccttttttccttccttattcttgaaattacttataaatgacaggaattttatatgagttctaaaatcagaataagaggaagagtggaagaattagaaaaagaaaaaaaaaatgccagttgtgcacttcttcacgatgcctttttaagagtcttagtgacatattaaaaagtacaaacaggccaggctcagtggctcaagcctgtaaccccagcactttgggaggctgaggtaggtggatcacttgaggtcaggagttggagaccagcctggctgacatggtgaaatctcatctctactaaaaatacaaaaattagccgagcatggtgatgtgtgcctgtaatcccagctactcaggaggctgaggcaggagaataacttgaacccaggaggcggaggttgtggtaagccgagatggtgccactgcactccagcctgggcgatagagccatttctgtctcaacaaaatgaatataataaaaattaaaatttttttaaaagtacaaacataatttagaaataaagttttgtgtgtgtgtacgtgtaaataaagcttttctaagaacatcatcataaaacaattgcatttgttttcatgaagaatccaagaaatgcacaaaataatcacttctataaatgcttatcttgaccacaatcaccacttattcagttatcttgatcacaatcaccacttattcaggaacagataagagatacaaatttttaagatctagatccagtagttattgaattaactactttctttctcaaagttttcctacaactaaactgatgatctcccttctaaatgtagcccctttaggatgtttatattagtgaatggccctattctaccttattacataccacttttcctccctttattccacttccactccccatttgcaataaatcatacacaggtacacatatgcaaacaccacacacacacacacacacacacactgctgtgtgtatctgtgtgcatgcacatttttctttatctatttttcaatctcttcacttgtctctagctccacttccacctgcttaaactactattatctctccgttggactatattgctaactgtttatttcacctctgatgttagttttcttcagtctttacacaaatccactctcttcactatagcgagtgatctgttttagaataaattgaatcatgatgttactatttctgcccccttcccctgcccccactggtcctgttccagctttaaaaactttaatggtttcacttagaatgaagactaaaattattatcattggctaacaaaccttggtctctacatacctcctcagtttcatcagcatttgatttacattggcctttattcatattgctatagtctgaatattttaactccccccacccataattcatatgttaaaatataaccccccaacgtgatggtataaggaggtgggctctttgggagataattaggtcatgagaccacagcccttatgagtgggattaatgccttataagaggccccgagagctgtctgtgccttctgtcatgtgagagcacagagaaaagaccactgtcaatgaatcaggaagtaggccatcaccaaacatcaaatttgctagcacctcgaacttagatttaccagcctccagaactatgaacaataattttttgttccttataagcagtttaaagtgttatgtttatagcaactgtctatatcaatttatagtgctatgttatagcaacctaaatggactaagacaagacacttgatctcacctcgcttacttctggtcatggaggcttatatattattccctccatttagaataaactccttgccccattatctttcatagtatctagcagatagtagagaccttaaaaaatacgttgaaagactaaataattaaatgaactgtcaccaaaagcaatgaatatatcagcatattatatgtgcattatcagctatgcaatgaattacagaaaattctgtttctcttactaaagacattatgactattccataccccaaatgatctattaggtcagtttagaggttacagtttattttacattgttttttataccttatatagttattgaaaatttattgaatataaataaaaggacaaaagttttacatttggtaataaatgcccaaaatataatttatataaaaagtatcagtctttattaaaatgactttgacccaagtttattctttataaacgtctgttgtaactctccaatgtaaagaaggcaaattggtgataaaattagttttgttttattttttgggacagaatctcgctctctgtcccaggctggagtgcaatggcacagtcttggcttcctgaaacctccgcctcctgggctcaagcgattctcctgcctcagcctcccgagtagctgggattacaggtgcctgccagcacgcccagctaatttttttgtacttttagtagagatggggtttcaccatgttggccaggctggtctcaaactcctgacctcaggtaatctgcccaccttggcctcccaaagtgctgggattacaggtgtgagccaccacacccagccataaagtttgatgaacctactctgacatatgttttttcatttattttagaagagtctcctcaaatgactttttatattaaacctgttcaaaacgatttctaaacctcaactctgaaaggatgctcaccaaatacttaaatgcacttcagaagtgaaagcaaagatatgttttcttcctacttgcatataatgaaagttaataatagaatcttattgataagtataatttgctaatacattcaaacacatgtgttgtcaaagttggtatacatatagtactgtgaaaggagagtctattttgatattttcccaggatagattatcattttgccttttgtacacacttttctgttgctctcatatgaccttaattgtttaaaaagtgttacttttttaaaaaatacatacttttgttctctgttagagcaatatgtatttggtatagattcagaaaaatatttgatatagattcagaaaaatattccatttgaaatctgggcttttaaatcacataaacatataatactagatgggtttcagttattttcttttttttttttttggcttagctctggttcattttttttaaaattttattttattattattatactttaagttttagggtacatgtgcacaatgtgcaggttagttacatatgtatacatgtgccatgctggtgtgctgcacccattaactcgtcacttagcattaggtatatctcctaatgctaaccctcccccctccccccaccccacaacagtccccagagtgtgatgttccccttcctgtgtccatgtgttctcattgttcaattcccacctatgagtgagaacatgtggtgtttggttttttgtccttgcgaaagtttactgggaatgatgatttccaatttcatccatgtccctacaaaggacatgaactcatcatttttttatggctgcatagtattccacggtgtatatgtgccacattttcttaatcctaacatacttttatatagtcaacaaatagatgaatttttaaaaattaatgccttagaagatgtaaagcatattcagtaagctttgaaaataactgaaacccaaatgtcctacaatcatagactgggttccagttattttcaaagcttactgaatatgcttttcatcttctaaggcattaatttttaaaaattcatctatttgttgactgtataaaagtatgttaggaatctttaacttgcaacatgtcatattacaatatattcactcaaggtcaacaaagagtatttattcttagttgactccttctggtattaagaacatggttgaacattttctgttttcaaagtactttatcttaagcttccagttacttgtcttagcaattccatcattggccagtcattcattctattgaacgtctctaatgacgggataaggctagaaaaaaagattcagaataacagtttctttgcaaagatttttcataatgtatcttttaacattgtattatggtttcaatatttgcatctcactccaaaatttatgttgaaacttaaacatcaatgcaacaacattaagaggttgggcccttaggaggtgattatgtcatgagggctgtgcactctgtaccttatagaagggctgaagggaactaactaggcccttttgcccttctgctatgtgagaacacagcattcgtcttctccaaaggatgcggcaacaggcaccatctttgaaacagaggccaggtcctcaccagacaatgaacttaccagtgccttgatctttgacttccagcctccagaacagtgagaaatacattatgttatctataaattacccagtttctgtttttgttgtggcaggatgactagggcatgtaaatattggtattatactcagaaaactcttagatacaaaattttcagtaaatgaaagatgcatttcttgctattttaaaatttgtaggttggcatgtctgtgtatttttcctttatacctaggaatgaagcagttgatatgcaaaaattattgggatttttggaatttaaattagctagccggtggtagagagatgacaagagtttagcaactgctgagagagacagagagagagagagaaatggtaaatagaaaagtgagaatagaagagacttgaatgaaacctattacaagaaaatgaagaatggagatagaataacacccacacacgaatgaaaaatagtaaaagcatttataagaaggaatttaagaaaatagacaaaaagttgtaggagatagagaaaattaaaaaaaataaaagtacagataccaagtggttgctgagttcctattatttgccagatactttaataaaatgcaacagagaaaatcaaagacaagatggacagaaatttgtaagaagaattgtagcacacagaatgaagtatgtagaaagtattatgagtgttctaagaaagaagtggccaatatattgtgcaggtttgtgtatgtttgcatgtgtgtgtaaatgtttttagacaaagaaaacattaaggaatattgattaatgatgaagaaacattaaatatgctttaaattgaaaatattattataacatactaacatatatttatcatttcttatatgccagaaatatactacacaattttcttgcataacattagttaatcctaacagtaatctaatgagaaagttactattattcttgattatggatagagatcagagccttagagaccactcatcaaaaatcatacattaatattttcaggatttgaaaatgttttatctgatttctaagctcatgctcttaactactatgccttaaatatttattttatattcacacactacatgttttatcgcatgttaatcctctgtttctcttttctttgtttatatgaaactataagatttgaatcatagttcctcaaaactatttcattcttaaaatctttttgtaatctattgcaggtgacacagactattactacactcccactttcgcagtataaataacattctttcaactgcagcctggactcagtgtaaaacactgtattcagaatacaaaactcacgtaaatgaaaggctgactttcacagaaccaactgcaggacttgagtatatatggattttggtacctatggtaggtcctggaaccaagccccaaggatattgagggacaactgtatttttatccccagaacttagcacaaaactgtcatatggtaaatttaatgaatatattttggagaaatagacatataataatattttatcacaacttccatcattttcctaaagttccagggggcggggcccacatcattgtacttttgtgattcctacaccacttattactaaggtattaaaatacaatgattaagagtgtggcagcatgatagggattgtattggatcagtagggcagtattaacaatattgagtcttccagtctgtgaacataggatgtctttccacttgttttcattaatttctttcagaaattatttttaatttttaatgcactaatcatcagaggaatgctgatacaaatgcaaaaatgatatatcacctcatgcttactaggatgaccattataaaaaacaaagcaaaaacaaaagacaagtgttggcaaggatgtggagaaactggaactcctatacatgatgggaatacaatatggtgcagctgctatggaaaactgaaaaacaagttctttaataaactgaaaatagaactacaatatgatccatgaatcctacttctaggtattcatccaaaataactgaaatcaggatcttaaagaaatattagcactaccatgttactgcagcactattcacaacaaccaaggtgcggagacaacctaacttttcattgacagatgaatacataaagagaatgcagtatatacatacagtggaatagtattcagtcttaaagggcggaaagaaaatcctgcaatatttgacaacatggataaactttgaagacattatgctaaggaaaataagccagtcacagagaacaaatactgcatactgcatgataccaatcctacaaagtatctaaagtagtgaaactcacagaagcaaagaatagactggtgccaggggaaagaatagaatggtgccaggggttggagagtgggagaagtgagaatatgctaaacaacatgtgtagatatttagttatgaaagataaaaattctagaaacctgatgaataacattatggtataaagataacaaatacagtattgttaaaaactttaaaatatttttaaaaggtagaacctctacttgactcttcttgcaaaaataaaaaaaggatttggcagcatgagccaggtgcctgagccatctttatggctgttagatgtaggatttgtgtgaaattaagcaagatagcttgaaattttaaccttctgtttccacatctgaaaaacaggaataataataaaattcagcttgtgaaatttttgtaatgattaaatagattaaataagatagtatatacttgattgaccattgatttcttcttcctttgccagaaatctggctcaccccagaaaatgctatttttctgtagccctctcactagtggtgaatgtttttatcatattcttccacaactaggacctgagttgggataggtcctgtttcttactccttcttccctattaccactgccctcttgcttaaaaacaaacaaaacaaataaaaaacacttggtatcatatcatcaaactgcctatatttcctcttcctccattctctcttgagccctctccaaactcagtttccttttcaaggttaggaaagtttggaaagagtttcaattattctttaaatttccaatattttaattcaaactggtatttttgtcaaactatatttattacatattaattccaaggggttcctctgataatctaaagtaaaatgtattctaagaaagagaaaattagaaggaatgttgtccagtgaactattgacactgcacccaacccagtacatgaaatgtgtattcatcactgacaacttgtggaattcattaaacaggacagcagcagtgcctttctccagtcagtgtaaatgtagtttttgagaggaggacaccaaaaatgtgacatttgaagacagccatgatttgattatgtgttttcttgttgctttggattgttatctgtctctatccaacataaaacaaaatccgcaaagatgagattttcatctgttttgttgtctgctatatacacaacaggtagaacagggttgggcacctagtagccccttaaaaataaagctatgcaattttgtataaagctatgtaattttgtgtaacttaaatgtaataatacattattaagtgtgttatctataaaatacaatgtgtgtggatgaaggtatatggtataaatacagagaagagtatttctaaggtgtttggcacttacaaataccacaaacgctagttgttattagaaacctgatgttagcataacaggtattacataatgcttgctatacttgaatgaatgaatgaaaatactcagcataaagcattattaatatttgtttataatgatatatatttttttcctggggagatatcatcagaattgcattccatgaatccagcagatcatgtgtggacaaatctttgatacaaccacataaaatattgatgactgtgttaacaatgttcttttaaaacattatctaagtctaagccttaacagatctcatcagtattccaattgttcaatgaagaaacatattaaatgcaaactagctgaacagtcttcactgagcatttagcggggcagcccttaggggcagtataggatcttacaagagtagggaacattaacagcatgaactgggccactgatgtcaggaacagccactgcattatgatccactagcgttataaacaaatactcagaaaggcagctaataatccgacatgagcaaagaagagaggaaatacctgaagaaagcatgaattcatagtttgagttttctacaaatacttttctaaataatacacaatcatgggataaatactaatttgatctgtaataaattacatatatgaaatataacaaaaatactcaacataaagcgtaaagaattattaatatttgcttataatgctctaatttttcctggggagatatcatcagaattgcattccgtgaatccagaagaccatgtgtggacaaatcttgcatacaaccacataaaatattgatgactgtattaacaatgttctttttaaacattatctatgcctaagctgaagagctctcatcagtattccaatttttcaatgaagaacaatatatatgtaatctataattacacatatatgagagattcagttagtgataacccatgatgtgataaattacacatatacatgtgtgtgtatgtgtgtgtgtgagtaaatttttagagattcacttagtattttgtctacacatataatttacctagatttcttgttttcctaacaggatgcaaaaaaggtacactgtggggtgggtaatatctccttactaaatatttattgactgattttgtccccacgtcattgaccagtgtcatataaatcaaactctcattacctatttttgaattgttgtttgaactccagctactatcctcaaagctcaccaacttgcccttctagctgacgcattttatgtctcaatctactttttattcaatgcttatttatttcattaatcacaaattgggtcattctgccaagtcctgaggaaaatataagtaactgagactgtctctgttcaggattttataatctaaccatgaaaacaagcattacatgacatattataaagggaaagatggacattaattttgattgggtgtcatcagtactaacattggagaacaataaataaattagtatcagtaataagtagaattttagtaaaatctagaacaataaacttttgttaaaattttacattataaaatcacaggacagcatgtggctatcgcatttcaagctgagataacagatttgctctcagatttcccacataatagttgaaccacaatgagaaagcaacttgagttccctgtttctttatagttccctgatctctaaactaggcataataatagtaaaatactaataattattgttataatcacaaggaccctatggagtacttgtgaacattaaagaatataatctatataaatggcttaattaataaattctaaataaatgttggtggttactattagtgactgatgcttacacataaaatgactattgatatgattcataatttcaagagacttcttgagtggtgtattagtctgttctcacactgctaataaagacatacctgagactaggtaaaatatgaggaaagaagtttaatggacttacggttccacatggctggggaggcctcacaatcgtggtggaagagcaagtgacatcttccatggcagcagacaagggagagaatgactaccaagcaaaaggggtttccccttacaaaaccatcagatctcatgagacttattaactactgtgagaacagtactggggaaacagccaccatgattcaattatttcccaccagttccctcctagagcacatgggaattatgggagctaaaattcaagatgatatttgggtgaggacacagccaaaccatatcaagtaggtaggaattatgtgtatgaaataagtaggaacattacttaatgttatatgagaaggcactaaatacaatcagtggcaaaaaagtgaaccctacaagcaatcaatcaagaataacttctaggaaggagggagaaagagagagagaatgagtattgttgtaaactggagttccacaaaggaaattgagcttataaatgagccctggatagatggattacgagaaagaaaagggcaaagagagaggatacagtaagaaaagcaaaaagactttaaaacaatatagacagaaggaaataaaatttaacattccaataatggaaaagaatacaatgtgagtaaacaattggtgtatgttgagaaattctgggaaataatatgagtaggcaaagcaagaatatatcacaaagggccaagaaagcttagatgtggacacaatccagtagatagtggaagaaatgttaggagatacttgagaaaagtactgttttaggaaatagagattagcggttcactgttttattaaaaatagctgaaagacagaagctgagtcacttcaacttctgcagtaagcaaagccatagtatgcaaactggcctttaaatccatgggggaatgtattatctcactttcatggtgcacatctatcatgggtaggtgaaagcaagggaaggagagatccactccacctagtcactcaaagataagggctgactgaggcattaccttttacagctgaaccatctgtgatacatatcttcttaagttgttctggcagaagagcgagaaaatgaagaatttcacatagatttttgttgcatcagcccaacaataatacgtcatacttacttatatttcactgcccagagatagttatacagttctgcctaataggtgaatatttaaacaactcatcagaacaaactgaatatttgcaaaatataactgtttcctacaaatgcaatgtgacaaaggtgtaaaattatttatttatttcacaaatgcacatggaacaccaaatgtgaactaagatttcaatgacaaaaaaaaaaaaccacacctaccttcccagttcttatatgcaaggaatttaatgtctaattccaattttcattgaataatctagactaagctgtcctaggaaaagggagtaaatgtagatagaaaatgacatattcccttgtactgccccatttatctcatcagtcattctgctttaaaggaattatctggtcacattttatcttctattcacatctgctactttcaggacctttctttccctcctctttctttgagattttcagttgctgctctgccttgtcttctgtgtccattcttagctccaatcctgagactcagctggagtctcagaggcttgcatctgagcactctgcattgctcagtgactaaggcaactgaattagggcagggacacctggaatagctcagtcctccacagcaggtggggtctgataaaagccatatgcctaagaccctgcagtatcaaagaactaagactcgcaggcattcctaactggaatctatctctatttcagtgttatgggctagattgtgttccccaaaattcatatattcaacctctatcccctagtaactcagaatgtaactatatttggatatagggcttttgaagagataattaagttaaaatgaggctcttaaggtgaaacctgtaagaagatactaggacacaaggagagacatcacgggtgtgcctgtacagaagggcaacaatgtgaagaggcagcaagagggtagatatctgaaagccaaggagagaggactgaggcaaccagctcaactagtaccttgatcttggataattccagtctccagaagtgcttaaatttctgttgtttaagccacctagtctgtggtatttaattacggcattcctagtaaaaggacaacttttatctctgtttccaataaacatttcaatcccatggtaggaaaatgacaatctgcctaatctctgccacctcctaacaaaaatcttgttttattaagaatacaaacaaaacatattttatataattttcttataattttattaatgtctgatgtaccagaaaatgacacataggtattgtatgctttgccttatttgaactcatgataaccctatgagagaggtagtaccattttcctcattttataaacaagaacagatgacttagatcaagtaacttgactctgataacatataggttaagtaggagagctcattcatctaacacggttacctttcatgacaatgatgatgaaaacagctaacagagtatccacgtgaccattattcatctaaaccccttacattaaataattggacattcataatattcctataatgtaagtattcctactagccgtgtgttatagacaaggaaatttaagcaaagagatattgagtaatttactatagccacagagctacagagttttggagccaggattcagatctaggcagtccaaactgaaggtgtgtatttttaaccaccacattctactgcttctcaaagtttggagtaggtatattagcatctggtaatggctgttgaggatattttaaaacttaggtaatgacttctgctattgtatacttttagaaaactggattgggatcaaaactgtccagtacatgctattttgttacctttggattcttttaatacctaaccttgtgcgattggggtcatagcacagcatgtatgatcatcattgctgcaaacggatacacatcttaaaagtgccaactcagtgttattcaaatttttcctgaaatttccatatgcttctcaagttccttaacttgaaaactcaaaattcttcctgcaaacattttctgattatctctactccaaaatgttttaacagttagtcaattagttaattaaaattttaattggcaaataattgtgcacattacatattttggggtacaatgtgatgttctgatatacatttactttgtgattaaatatgctaatgcacaaatttatcacctcataaacttgtcattttatggtgaaaacattcagaatctattcttttagtaatgttgaaacacacaatgcaatattatttattattgtcaccattgtgtgcaatagatcactgaagcttattcctcctctaactgaaatgttataacttttgatcaacatctcctctttcccatttcattgctcactccacccaccagcttctggtaaccaccaaccacatccagtggacagcaagttaaataataggaagttagagaaagctgacagttacaaaggatatgatgttatttaattgttcagaatatacaaaatgtgtttattataggatacagccccttatggaaaaataaatgagagtggggaaatttcaaaatcagacaaaagtaaaaagtactatgttcaccagaagatggagaagtctgataggaagacactcagaaaaggtcagtaaaaaacctctgagaaaaagaaagttgcaggaaaggtaaatcaataatgctgtttgctgaaatgctacaaaattatagtacttgtctaaggaagtagttactggaagccatagagagtgcactttcagtatagttacaagaaaaaccaaattgcagagcttaagggaattggtgaagaactggtagcaacagatacaaagatttgacagaacatctaactaaagaaaaactctattatgaattgtataagtcattgatgactcagagccaagcaagtttataattacatttttgctcaacttcgatttctatgaagaacatttaaaatgagttctgctttttcatacaattagaatgtgggcatttttcaatcgttctaaaattttcagattattagaaccacaaagacaagcatccaccttaccggatattattgattttatatgcattgcctggactctgaattagaccttttctttcttttccctgtctcagcaggacaaataagaacatctaggccaggagcggtggctcacgcctgaaatcccagtactttgggaggctgaggcgggcggatcacgaggtcaggagatcgagaccatcctagttaacacggtgaaaccccatctctactaaaaatacaaaaaattagccgggcgcggtggcgggagcctgtggtcctagctactcgggagcccgaggcaggagaatggcgtgaaccagggaggcggagcttgcagtgagccgagatcgcgccactgcactccagcctgggcacagagcgagactccgtcaaaaaaaaggaagggaggaagggaggaagggaaagaaagaaagaaagaaagagagagagagagagagagagagagagagagagagagagagagagacagagagagagacagagaaagagagaaagagagaaagaaagaaagaacatctgagcaccaatactgggatattgtaagttacctcagaaataacatccttgggtaaggggtgtgtgtgtggtggggtgtgtgtgtgtgtgtgtgtgtgtgtgtgtgtgtgtgtgtgtgttttagcagaaagagaatcttctaagtacaatgaaatgggcttctatttatcagtaccttttttcttctctctcttttagttctgttgctttccaggatatacacatggctttaacagagtctattactggaatacggagaagctattgaagtaatccttcaaggcataaggtcagaacttagagaagtcacagagtttgtatttctgaacctgattaccagaaaattcttctaaagcaggaaaagatatatgctttcaaactgttatcctacaaccaaatccattttggagacacaaggatccacaagattactcaccttcaggaaaacatgaagacaagaaatgctagtcttggtacaacctaatgaaaagacatagctgagatttcatatgaagataacattgagattgcttagaaaaaaattattggagttaacattgaaagtaacaatggtatttcttgtcatccctttctaaatggcatatatggtatgtaatctagaaatatgtacatatacatgtaatagcttacaaagcttccaataaaaaagacaaaatctctggattttgccatctaacgaaaacaatgtagttactattaaaacttgaatttaacttctcagaataaacatacagtcaaggtttttgtttatttctttgtttttccaacatggttgactgacttgggatgctagttctcggaaagatcaaagttacaggtgaatggtaatgatctgaatgaaacacagtcagatgagagccaggacctgtcagagaacccacaagaagaagctagggtacagaaaaagaaagcaggaagagtctggcagagattgacccccaaggaacttagagaccccaaaaaagtataggtgggggtgcttctctgttcccctcaccctggcaacaacctgctaaccatcgaattattagagagtccttctaccctcacaatcctgggcaatgatgtccgtggcaatttggaaaattcccaaagacagaaatccatgttgttaactcacacaggggtgcccacactcttctcaggcctgaactgagatgtcaagtgccgtactagttgtgtacacatagtgggccactgctgtgcctgtagaacctcagtcattgagtcaccacatcacaagatcccctgcaaacataccccataacctgctctgacatccacaatcaaagggaaacagagaggatccctgaggaactgtggatccctggtaatctagccctcagtgtgacctacccctggggaatgggggtgcacagacagccctccaaagcctgccttgagagaaaggaaatgtagtgtgacacagatcactgaagggagtggcaccggcagccgggaatggatatggagaggtagtcatcttctgctcctcccatctactcttgcagacacagcagaggctctaccagttaaaggccagcccttgtgaaattggtgtaaacttttccagtggttttcacaacagctacacctccattcaaagtaagcccctgccacagaggcttccatgaagagtaagacccatctctccccttctatacaaagaaatagcatcccagcaactgaaggcagacaagctacaaagttgtctgtcatgaacttggggaagaggatttgccctgagcccattttgttggtagctgccggaggggcatacccatggtctccagctgcactatggccaggagtcaaaggacaatgtatatttaaactgaaggtcatgagcaaaatgcaacagcggcatgatagggaagcagatcacattcctgtctgcccaggatgaggacctggtataggcctccaacgctcttccattgaaacattgccacagcccaacaggatctccaccagctacacctgtcagggtgggtgcctccagtcattactgagctaccagagaatgagcaggctcttatgcttaagtgccatcactggactggagagtaaaatagaatacctgttctcagaaaggcacagggctagtgaataagataagcttcctgagacctctgtactctcagcctcgcaggagatagtgtcagctgacacatctaacacatcaaaacaacaggcaacattcaagaaaaccaccatacaaagattacccacaatcaaggaacccataaagaactttggcacactgaaagcaccccaaaacaaagcatatcatacacatcataacataaatcacagtaatcctctaaaggaaaaataaatgatagaaaattcaaaaataagaagtgatatctcctttagatgagaaagaatcaatgcatgaactctagcagtacaaaaaggtagtagagtgttttgacatctctaaaggattgtacttgcactctaaccatagattctaaccaaaatgaaaatcctgaaatgacagataaagaattcaaaatacagagtgcaaggaatttcaatcagaaaaatgatgaaggatataaaaggcaaaatagctatattagaaaatagaacttcatgtattgaaaaagtaactaaaggaatttcaaaacatagttgaaagctttaacaatacactagaccattcagaagcctggtttttttgaattaaccctgtcacacaaatataaagaaaaaataatttttaaaaatgaacaaatccttcaagaaatattggataatggaaagcaaccaaacctatacttagaggaattcttgaggaaggagagaaagaaagaaacatgaaaaatataattgaggaaataattgaggaaaattttcctcatcttgtcagagaggaggacatccagatacaaacaatttagagaatatctgtaagatattatacaaatgaacattactaagtcataaatttatcagactatccaaggtcaatactaaagaaaaaaatcttaaacagtaagtatcaaactatctataaaatgtagtcccattagactaacagtggacttctcagcagcaaccttacaagccagaaggaattagaggtctattttgagccttcttaaagaaaataattttataataaatggcatccaaaatttttataacctactaaacttaatttcataaacaaagtagaaaaaaagtcattcccagacaagcaagtggtaagggaaattttcacccatagactggtccttcaaaaaatccttaaaggacttctaaacatgcaaatgaaaggacaatacttgctaccagaaaagcatatataagtacaaagttcacagatcccataaagcaattacacaattgaatatacaaagtatctagctaacaacaatatgacaggaataaaacctcacatgtcaatattaatcttgaatgaaaatggcctaaatgctccacataaaagatatcattttgcaaattggatgaaaaagcaagaccctaccatttgctgccttcaagggactgacctactgtgtaatgatatccacagccccaaagtaaagggtggagaatgatgtactacacaaatagaaaacaacaaagatcaggggtgctattcttgtatcagatgaaacagatattaaatcaagaaaggtaaaaaaaaagacaaagaaagatacaattcaacaagatttaactgtcctaaatatatgcacccaacaccatagcacccagattaataaaaacaactagacctaagaaaagaaacaagtcatacaataacagctgaagtatttaacaactattagttatataatctgtctggtgacagcaccagatagattatcaaggcaaaagaaaaccaacaaagtaactccagacttaaatggaactcttgatcaaatggatgtaatagacatctacagaacataccatgcaacaaccacagagtatacatttttcacatctgtgcatggaacgttctctaaaattaaccaaatacttggacttaaggcaagtctcaataatttcaaaaaaatcaaaattatgccagttatcttctcagatgacagaggaaataacattagaaatatatatcagccgggtgcagtggctcatgctggtaatcctagcagtttgggaggctgaggtgggtggatcatttgaggtcaggagttcaagacccacaaggccaacatggtaaaaccccatctctattaaaaatacaaaaattagctgggtgttagtggggcatgcctgtaatcccagctactcaggaaactgaggcaggaaaatcgcttgaatctgggaggcagaggttgcagtgagctgagatagcaccactacacttcagtctgggtgacagagtaagaccctgtctcaaaaaaaaaaaaaaatacatatcaggagaaactctcaaaaccacacaagtacatggaatctgaacaacttgctactgaatgattttaggctaaacaagaaaattaaggcagacataagaaaaagttgaaataaataaaaatagaaatataactcaccaaaactctgggatacaatgaaagcagtgttaagaggaaagtttaaagcactaaatgcctacataaaaagataaaaatatcttaaattaataatccaatatcatacatcaaggaactaggaacataagaacaaaccaaatgtaaagctagaagaagaaataacaaaaatcagagcagaactaaatggagttgagactgtaaaaaccaaacaagagattaacaaagcaaaagttgtgtctttgaaaggataaataaaattgataagactgctatttaagttaattaaggaacaaaaagagaagattctaatacgcacaatcagaaataataaaaatgtggcattacaaccgataccacagaaatacaaaatatattcagagtagtctatgtaaattctcagagagtaatcatggtagactatgaatatctctgtgatcaaaaacgagaaaacctagaagaaatgaataaatccctggaaacatataaccagccaagattgaaccaggaggaaattgaaatcctgaagagacatataatgagttatgaaattgaattagtaataaaaaatccattttccaaaaaaagccaggaccaaacagattaacagccaaactttaccagacatagaaagagctagtacccatcttgtataaactaataaaaatattaaggaggaatgactcctctctaactcattctatgaaaccagtatcatcctgataccaaaacctagcactgaacacatacacacaaagaaaactacaggccaatatccctgatgaatagacacaaaaatctgcaacaaaatgctagtgaaccaaatccagcagttcatcagaaagataatttgtcacagtcaagtggattttattccagggatgcacaaatagttaaacatatgcaaatcaataaatgtgattcaccacagaaacaattttaaaaacagtagccatatgatcatctcaatacctgcagaaaaaacattcaataatatccaatatgtctgtatgataaaaaccctcaacaaactaggcattgaaaaaaacatactgcaaaataataagagccgtctatgacaaacccacaactaatatcatactgaatgggaactgtaacaagacaaggatggccactctcagcaatcaggcaaggaaaataaataaatgtcttccatattgaaaaagaggaagtcaaattatctctgtttgctaatgacaatcttacacctagacaaccttgatatttcctccaaaagattcttttacctgataaactacttcagtaagatttcaggatacaaaataaatgcttgaaaatcagtttcatttacatagatcgacaacactcaaactgagaaccaaataaaaatctcaatttcatttataatagacacaaaaaataaaatatctagaaatatatttaacaaaggagaccaatgaggtaaaagatgtccacaacaagaactataaaacactgctgaaagaaatactacatgacagaagcaagtggaaaaatatcccatgatcattgtttggaagaatcaacatcattaaaatgactgtactgcccaaagcgagctacatagtcaatataatttctatcatagtaccaaatttattactcataaaattataaaaaaaaattctaaaatacatatggaaccaaaaaaagagccttaatagccaaagcaatcctaagaagaaagatgaagttgggggcatcacattatctgactttatactataaggctataataaaaaacaaacaaaactcagcatggcattggcataaagatggacacatagatctatggacacaatagggaaactagaaaataaaatcacatgtgtataaccacggttcttcaacaaagctgacaaaattaaacattggggaaaggtcaccctattcaataaatggtgctaggaaaacttgcttgctaaatgcagaagaaagaaacttcactcctatctctcaccatatgcaaaaattaactcgatgaattgaaaatttaaatttaagacctaaaactatagagatcatagaataaaacctaggaaaacctctttagacattggcctaggcaaataatttataaataatacctcaaaagcaaatgcaacataaacaaaagtagacaaatgggacttaattaagccaaagagtttctgcacagcaaaagaaacaattattagaataaacagacaacctatagtatgggagaaaatatttgcaagtaatatatctgacaaaagatttatgtccgaaatctataagaaaaacaaatcaacaagaacaaaacatataactccattaataagtgaggaaagaatgtaaacagacacttcccaaaagaagaaatggaagtgaccaacaaacatatgaaaaaacattcaacctcactaatcattagagaaatgcaagttacaacaaaaatgagacaccatttcatcccagtccatttgtactttttattatcatatatatcctcaaattcaaaacaaaataaaccacaacataaactgtgttagtatagtacattaaagtcagctccactgtgctgtatcacttggcaagtctgaaattccaatgggcttcagaaagttgactatgcaatgcccaataatgacctgataatctcatattagaggcaatgcaaatatatttataagactaagagctacaacaagcttacgaagaaaaccaatttatagcattacaggttaaaccagaagtgatttcctctgttaactaaaattacattactaaaaagtgcatggttcgtggatgtctaatgtgaaaaaagacagacagtgaatactttcctgctcagtgtgaacacttaataagaatgaaaatagaatgccttattatataaagtaataccaatacattgatttccaatctactcctctggcacaatttaaaatgagctcttgaactatagagtcacaactctttttcatttcaatgtgttttccttcaaaatagcagttatttatacatactgcttttaaaaatcatttttaggctgcagattcacaatctccataaatatcaaagatgtgaagttaagttcagatgcacttgaagtaaacaccatgctaactagcagcagtgttcaagagatcatgctgccgatcttatgaaagggaatatactattgtgaattattttgcaaatcccaaaagaagtttatctctcacattattgaagactgagaatgtcttaatatatgcacaacttgaacattgtttgtgaaaaagccagactaattcatctatcttctgatcaatcagtttagccaagcaaagcacaaaataaatgcacatcctttgctgccgttaagagcaaccagtttgcttgtctgtgcatcatgaatgccaaacaaatcttgaataagaacgaggaaaagttaaaagaaaagaaagacaggaaagaaataaaactcaattttcttgaataggaaatttctagggaggaaacattttccatttttgtcttctatcaaatttatatatatataaatatatatataacatattatatatatcctaactgtcattataggctattctaagacagattctgccaatattgaaatatctaagacaggcacaattgggccattgcaaacatcatgtactaaatggattctaaggaacctgaaaattaatgaatctttctaaaatgactgacttactgttaggggaaagcttaagaaatcaaataccaaatcaaataccaaaataccaaatcttttttcatttttctattcttcccaaaaaaaaaaaatagtgggggataaaataacgcaatgcccagttaaagtgccaacaccaaaacaacttatggctgctacttctgaccctttcagggggtcaaattttgttgtcttttgtatttctagctttgtttgagacctttgtttgcatatattcaaaggttagtaaatacaatttaatattgtttccacagaaattaagcatttacctagttagaataagcattcaaacagaggtcttgcattaaattttgtactaaactgtattccttctaccatgctgcaatctttattaagaaacaaaggacatctgatttcacttttctaagcttattttagttaaggttaattattacacagagatactaacctttcaatcataaactacaaattagcattattcatctctgtggtatattttcaatgtaataataaaaatcctggctcgctctaaaggtcaagctaaaagcaaccttaccatcatcatactggcccaagcagatttcaaagagagagcccaggatgatccctgaagctaaacatgtccagagataaaactgtcgaaacatcttctgtcaaagttcactcaaagctgatctgaaataagaaaaggtagaaagaaacatttgacatgttcattaatctgttataggtaaacacaattgtcacagcacagaaaagccttaatgacttcatagttaattacctgtgccacattatccattaacaaagtaacacactggtttaatgcactggaactgtttatcaacataaatttgcagacaagtaatctctaaggaaagacatcttttctgttatttaatttgccagcaagtaggttgagaagttaacatactaataatatcagaagcacactctttaaaatttaagacattatgggtaagtccaatgttaatcagtttaagttactaaacttatgttgtctacagcataattttacaacaaagtgtaagatagtaagccagttgttagtatcctacatgagcatttcaatgaaaatttgtcttatacaattaagtagaaaagcccatcattaaaatgttaattcctttctagtagagtgatcagagattgacttaactatgccaggaaagactaaggaaaatctgtcaattttcactacatctgctttatgaagcatttggatgcatttcattttaattctcttgttttacttttcaatccccagcaagttaaaaaaaaaaaaaaaagaaagaaaacaactgattgagaaattagtggcctgtgagcacatgagaatgtcttattgaaagaatgacatcctcagtttctttgtaaatttaggaaattatccacacagaattgttcaaaatgctcttgattataaattgtggcagactagggattggaacactgtttctctaattcagaggttccaaactcaaatgcctacagaggacaagcagacaaaggaaaagaatgaattagccaaaggggacaatagtgatggtagaggctgtgataaactgtgcaatgcaaggttttctaaagagaccagctggtgctcaacttctgtcagtggttgtgatgtggcaatgcaagccagtgtttctgggtcttctgattttcaaagagaaggcagaaatccaaattttcatgtgatttccaagtgtttacatgattgtgcaatcttctttataagactaaatgcttctagcaggtaatattgatgtctcaagttctccagttttctatttctgcccaggattctctctactagactagctgaggataaggtttatcagagggtacaaaggcacgattttaattctgcttttgtctacattttatttttgatttattgccaagtatttaataatgtttatttgtccagcagcatgtataaatatatatattgcattgtaaaattgtattaaaggtgtaagctctttttttaaactaatgggatacacagttcttgactttaaaagatcactgctctagatcacacacattttaatatgaagtctattcttctttgtttctttatctaagatataaaaggagctgccttctttttaactgggccttccacattttttcctaactggcaaagtgcttggcgcgtgcatttataatttctagggacagaaagcccaaagaagagctcattattagatgccaagagatcatcacaatccacactaacctgtagaaaaaagaaaaataaaattgaccaatgctactggttgtgtagagcagcggataagaatgtggctttttttttaaattcaagcttttcagcttactagttatatgactttgaagaaattaaatagcatctttgtctcacatttctcattatcataatggatataaaatagtatttacctcataagattgtcttaaacattaaatacgtaagggaatataaatacgtgcttaatgcagtgtacttacagaatgagtaccccctaaagcttaatatgagtaccccctaaagcttaatataaaagactcagcatctatggaacctccaaagtcttaaatacagatttactcaatctatctttagcaagggctggaaagtagatattattatccccattttgtggaggaaaggtcaggctcagagagaataagtgactggctcaaggttataaactggtgagtgtctgaagagaccataaagtctgtgagtaagacacttctgctcattccattagagaaaagtattggaaaaattcccagaaaacacagggctcagaagttttcaaggcatatggaggcccaggagagcctgctgtattgcttcccttaaactctgagagagacattctaacccccttcacaaaggattagagctctactaagatttctatatacaatggcttcaaatctttttttatttggaaaaacaaacatgacattaagaaataaaacaatgttatttaaattttaaaaatataaagagaaaccatatacaaatacaaaccagaaaggatatatattggaaaacaaaattaatacaaaccagaaaagatatgtattagaaaacaaaattaaagagacggtaatatcttagcaaaggacaaaaggacatagttgtgttcctgtgtgggtccttgatctgccagcttgacttcctttatagtagtttatagtattatgcattcacaaattatggcatattcttttattcctaactgaagctaatttggtttcatggaacagtctccaatataaaaacaacatgatggatcattattttaaaatcattaatgtcactgccattattatgcctccagaaacaaaacctcttgatctatggctctgcaagtttttagaggattatatgcatatttctgaaagcatcacagacaaaactcataaaaaatctatttagaatagatatagcatttactgcccagaggaaggagataattttaggggaaatattatacttatttgtctttgaataatgataataataacaatttctatagtttttttactctttcatctatatctgcctgatttccaaagaaattttcatcacttcaatgggctcaatatttacagagacctgaaagaaagctatgactcatcacatcaacccgataccccaaaacacagaacacatattgacttagtgagaaaacccagtttctaaacaaagatataatgaaaaggtacctcccacaaagagattgtgtaaatgactacaggaccaagatgtttagtacaatattgtgccaatcaactgacagcctatagtggcacttctgtgattgtgatcaaattaattggaagagatcaaatgctttagacaaaagactgtttttgttactagctttttaatctctagaattaaaagagaaagtcctataggagatgaattccataatcttgctaagtgactgtaggtaaatgaaaagcctgtcaaacaacacctctatggtggtactttacttttactacaaatcccacatcaaactctttccatgttccccgagtatatatttttcctacagaatttattggctaataatgttatgttctaaaaatccaaagcatgttcaattctaaaaagaattgtaggtgacctataaataaatatgttatacttgttttttaagagataattaaattggtgtattcagtactctaatatagctaataaagttatcattttgcaatcgtgacttagaaatagtattctgttgtcaaaatactggggaaaagtgtttttttcctattacagtataatattacacgtaagtggtttgcattccatgtgcattttatgacacaatttccttaggcttaagaatattttactgcaattattcaagacaaacatactaattttgaatttcacatcatttgtatttcctgcaagataaatctcatatttatttatctggcattcaatgttctcaaaaattaatttattcaacaagtacttatggagggtctactagataccactcactcttctaggcagttggaaaatatcagtgaacaaagctgacacatttcttttctcccatggatgttatattccagcaaaataaagatagaccaataacaaacataaataagttatataaaatgttaaaatgtaataagtgacatgaaaatagcagctagcatttcaaaactgtatattgtcactttacaataattttcattcagtaaatgaagtgagattacacaaagcaaccaaaatgctatccgataaaataactgaatgagaactttacaatgaaagtataactattccgacaaccctgacagcatccttgatggtatctactattctgagtacagatttctgtccatctcttggaaggagaataaaggtctttcactgcctttcactttcaaatataaatccaaagtctggaaatacacaaaggtctgtcctttttctgtttatccctgctccctgagtcttgggtgtttgcagtgacacatggcaaaagcagccaaggttgacaccacagcagttttctcttaaatacaattttgacaatgttaactattttttagcctatgtctctgactgctatgtgaataaacactaactttcttgagataccaaaacttggaacacaccgtcattactttgatgagaaaccccataccaatacacaaccatgaagcaagctggagtctcacagtgaagtgagctgtatgtatgcagtctgcccttcaacagttggttcagccaaattactgttattcttgatctgtaacaatatctagataaagctacaaaactaaaacttgtcactgctttgtattccttgtgagaaacgtatgctatctacctgctggaataaagcaaacttcccttcaaagcaacctcagcttcaaactaaaaacatgaggttttccaaagtcactgtatcttaccatactaaatatcaatttgcttaaatgactagagagaaacctgtcttctacctcagcatggtggtaaatattaataatgtcttcatcagtacagagggtacttatcacccttcagcattaccagatgaatcagctgttccttttttaaaatgtgtaatatgaagtttaggaaaataaaatttcagagagcctttcagatatattccttccttctagatcatattatatttttctttactaaatatacatatgtataagtttatatcatatattcatctataaaaatatattgatatttattgacaattttatagtacatttatacatatttatatataaaattatgttacatagtcacatatacaatttatataaagaagtatatattttatttaaatttacattaatgataggtaatatcaatgatattgatattatcgcccacttttttaaagtttgcaatttaaattcaaggggttccgttgtagctaatttgaggtaagtttggaaagtaactaatgtttttataggacactgtgaggtccaacctacctctcccacccggtcctgctaaattcggcttactagatctttgctcgggcttacagttttttttaacatgctactacatctgaatgtgtcttgactaccaaatttaaaatatgtgctaatttggccaggcgcggtggatcacacctgcaatcctagcactttgggaggttggggagcatagataactcgagatcaggagttccagaccagcctggcaaacttggtgaaaccccatctctactaaaaatataaaatattagctgggtgtggtggtgcacacctgtaatctcagttactcaggaggctgaggtagaagaatcgcttgaacccaggaagcagaggttgcagtgggttgagattgcaccactgcacttcagcctgagcgacagagcaagacagattccatttcaaataaaaagaaaatgttaatttgctttttgggtgcactctgtctcaacatatagattcatcctaaacattgtgggataaaataaaattgatgaaaatcatttttaaaattaagaatataaattattaagaactaatcttgctatcacttcaatcatttacaaggtctttcatttcagttttaaacattttaaatatataatcaacagttgtaaacattagatgagactaatttaacccaaaatatatttcccgaaaccacatgaaacacataaggtaagtccaagctctggcattcttatactacagctatggtgaattcttggagaattcaaatcagtgtcttaacatgtctgttgagtctattcattattaaattctggttttaataatagaactttaaataaaagagggaagaacactggttttctttttggggaatactacttctcaagaaaataaatgactgaccaatataattaatctgcttatgtttaaagattgtgtcttcatggaaaaaaactaatattcagtttagtctataatagatacatgccaaatgttataataatgtagtcatactagttggtttaataaaatataaatacaccaaaaatgtttttaaatgagtggaaatttaatctccatgtttactattgctattatattggatattttcttagtgtttatacatacatttactcaattagtatttattttatatttagtgcatatcagacactaagcttctactatagaaataaattattccatttcctcacaatgactttgctattgagcatgcactacatttcatatttttttacctaatatacatttcaaggtactttagtaaaataactccaaattaggagataaataagttttaattgccaatttttttgaggtttccattccatctatgttttcagaaccttcatctaaatctcagtcttttagataaatacatttctcactatttgttagaaaagtcatgggaaaaagcttagtttgaaaggagcaagcaaagggaaatataaaaagagaagcccaaacattatttcatcagtggagtgtttagcttaaaaatataaccaagtaaatttaaaatggagttttaatgctcaagcaaacgcatgcatcattttaaaaaagaagcttgaaagagagttctgtgcagtgttattacctggcacagaaaaatgattctgattaatattcttgtttgatgaatattatagattctaagaaacacaaataaattaatgagtaaatgagtattttcctaaggcaaatccatcagcaaaaaaaatccaaaagtattaagtcagtcaacagagactaaacgtaaaagtatgaaaatgtcagtgacttgtataatgtaatataataaaagtcctggctctggcatgagagagtcttgcattgcattcctagttatgttgcttttggagggctatataagggtaaactagttaaaacttgtgagaatcagtttaaaattaggacaataaaatccattttattcttctgtaattgacagatgaaaatttgaacaaaaaataaaagttaagaatattcatttgttcatttatagcataagtgtttactgagcactgattctggataatgcactttataagatgcagtggctacagctttatgagaaaaactaaatgaattaataataaatacataatagtccatatagagttttcagtctaacagagtgtgacagtcacacctaaagtagctcataatgaatcaaatcctcgtataatactattctatagatcaggggttcagtactggtccatggcctgttaggaaccaggccacagagcaggaggtgagtggtgggtgagcaagcaaagtttcatctgtatttacagcccctccccatcattcgcattaccgcctgagctccgcctcctgtcagatcagcagcagcattggattctcataggagggcaatctctattgtgaactgcacatacaagggttccaggttgcatgttccttacgagaatctaatgtctgatgattgatctgtcattgtctctcattattcccagatgggatcatctagttgcaagaaaacaagttcagagctcccactgattttacattatggtgagttgtatgattatatcattatatattataatataataataatagaaatagagtgtataataaatggaatgcacctaaatcatcccaaaccactctcctgctcccagccccaggtcggtggaaatttatttttcatgaaaccagtccctggtgccacaaacttggggaccattgccatagatagtggaatctatgacttgcttctaatgtgtagaatatgataaaggtaacaagatatcactttattgtttcaattaagttatataagattcagtcttagcacattggagaaagataaatcttcctgctctgtgtaaagaagcaaacgtattgtaaactgcctttggagaaggacatatgccagggaactccaggtgacttcttggaccagaggatggcctccagacaacagccctcagtcatataaccaaaaagaaatgaattctgccaacaatctaaatgagctttgtaaaacaattgcattccatattgttaattatattttgaaaagaaatgtaatttaaatactaaataatgagattttattttatatatgatcaattatatacaataaattattttcttataaatctagttacaacttttctgtttcttatattgaacaaattttgagctataactcagtcatattactttacttgcttttgccattaccatagcttggtaggaaataaggttttaaataatagtcttttaagtaggtgacagatttagaataaaagattcataacagttctaattttaaaaaatgacttcacatgtttaatgacatagcaaacaggtagtatctacattcctaattttttttcttaaatctgcttgcatttaaacaatgtaaaattaattggtaaagcatgtcatttaaaaaaaaaattaaattaaagttctgggatacatgtccagaatgtgtaggtttgttacgtgggtatacacgtgccatggtggtttgctgcaccgaccaacccgtcatctacattaggtatttctcctaatgctatccctcccctaacctccccacccccgcgacaggccccagtgtgtgatgttcccctctctgtgtccatgtgttttcattgttcagctcccacttacgagtgagaatatgcggtgcttggtttttctgttcttgtgttagtttgctgaaaatgatggtttccagcttcatccaagcatgtcatttttattagatatagttggtaatagaaggaaacatataacttttttttgttgtttgtttgttttgagatggagttttgctcttgttgcccaggctggagtgcaatggcatgatctcggctcactgcgacctcctcctcctgggttcaagcgattttcctgcctcagcctcccgagtagctgggattataggcatgtgccaccacgcacggctaattttgtatttttaatagagacagggtttctccgtgttggtcaggctggtctggaactcccgacctcagatgatctgccctccttggcctcccaaagtgctaggattacaggtgtgagccactgtgcccggccaacatataacttttaatagttatttaaatattaatatgtatgtaatggatactagagtaaatactgattgggaaatacaaactgtcattaataaaatatttgttttctatatagctttaatatgtactttttaacatgtacttacaacatttatttaacacgaatagagtagaaaatgtgtactttaatactttgccaggtgacatgtttaagtagaatgaataaaactaggtttatcctccattgcccctcttcttatcagaggggtcatatttcatatgtcatatcttttctacactttattttctacttcacattatatgaagtctaaccagagatcataaagtttcatactatatcaatgcagaggcagaatcaacattctatacatataactttttactttctttgcaggattttttaggtaaggtcttcggccaactgaactgcaactgtttcatttacaataattttaaaacagtaaaattctctcaagaactaagtttgtacatttgatgttgataaaaataatgctaatggtgaatattttttgagtatgatagatgttgatattattgaaatcattagatatgctttaataactttaaaaccaaatggtagactgttccatttcatttctctttgtactttaccaatttatactatgaaaatcatgtatgaaatgtatagtctagaacgtttgcagaaatatcatctcaaaaacagtaactcaaagtctaatacagaaagacatccatataaggaagcatttcacaaatatttctaagctttgatttgatatatattaagcttttaccatttatcttataaatctacatggttaaagaaatgatcaaccttctcaactggcacaatgtgaagatggataatttgacttagaaaaataactaattgtgtagtcatgtaagcccttcatttatgacacaaatccataaaggtcactgtcatatttcttagagactggattttaatgtaaagctgagttttatttttctaggaaactgtaacttttattgaaaatagttcatgtataagcagatttatggaattcaaactcatgttgtccaagggtcaattgtgtgtaattttataattgtaaaactctgtcttatctgtaaatgataagatattacaattagttggttctttatgtttgaggggcaaataaaatttgaataagttgtcttactcacaaagactatgcttcacgaataatacactaagaactttagtctcttcctacaaatacctaattttatagtgtatcctggcatttcaaaattaccaaactgaaaagtagtcgttctctctcttagtgtcaatgctaattgtatggtacgttcattactagagtacattttttctaacttaaatttttaaatttattacattaaatattagattatgctattatatagtaaattcaaactgcctgtataatattgtatcctattaaaatgatacagacattaaattttatgggcattctaatgattgttttccatttttccatacttttaaaataagttgttatatgtcccttggggatggggattattttaggaatactttactacttattaattttccaaaagtcaataatgaaaaatatttacttcccaacacaccctggcaagatattttataagtgaaagacataatttcattctgacctttttaattctaaggccttttcatgttgttttttttttttttttcaatctgatctaatttttaactctctctatttattaccataaccaaatttcattttactttatttttagctagttatttctgcctaggcattttctcctttttcatatttcgacctaagaatttgttcctcatgtaagacttctctgacaagtcacttcctcccccaagtataggtcaaatattttgcgataatccttagcctttcctttgtattcagcgaacacatctcagtttataattacattgcttgtcagtgggtactttggcaatatttgtgtttcactttatgcccctgagaagaggaatcattattagccaagctcctatcccagctttttatcccggagcccagcaaatagcttagcccagattagcattgatgttttgaatgaatgaattttaaaaagaaacgtatcattttcacaaaatgtcctgttatttacattaaagctaatttgttcttgtcaaatctgtattatatatgaaatttagttttaacacttattcctgcagcatttgctgaatatgcaaggatcgataattgataaattctaaggaagttctatttcctttaagacacatttaaggtattgttggagaaagggctatgaatattgtaaattctcacagagagtatggagatgtttgtacataaatatatacttattataaaataatattttaaatcgtcgaacttagataaaatatatgcttataaaatataagaataaaattctaatatacttggaaaataagaaccaaatctcagcctgtaagttaaaacttatggtttatatacaacaaaaactactggggctgtttttatttctgtgacccaattaaactaatcttttctcaaatttcatccctatgtctgagtatactaatattggcaaagccctctctatcctaaaataatgtctattttaatatgtcttcatagaaaagtcattaaaaagcagtgaacatagccactaagtatgattttaatatttttgttgaaatgactaaattaatagaaagtgacaaaaagtaccttaagaagaattttaaaaaacaaaaacaaaagattgaacaaagcatatgtggaaatataaattataattttcttccactttattaacactcttgtctaattagacaataattactttaaaaactaacactttccccttagaattactgctgaagttgaaaggttcaagtttttaattactgctcataaagcatgcagtgaaactttctaaactatgaaaagtctactatcttacgattcagcaagatatttatcttataaaaacatcattaataagtacaaaatctcatttaaattaacagcaagaaactttcattttcctttccagtgtcagagatgggtgaaataaatcaaaatcaaggatcttttgtggatgaaaggaagtagaaatcttaagactagaaactcactaatgtgatgcccatgggcaaagatgaaatcagatattacagatgattttgaagttgcagttttaataatgataaaggtatagtgaaagggagaattgaagcagaaatgaatttcatactgttgcccacaccaatcaactcatcatgcatttcaaaagtatattccggcacaacatggtggctcacacatgtaatcctagcactttgggaggtcaacataaaagaatggattgaggtcaggagttcaaagccagcctgggcaaagtagcaagacccagtctctgcagaatagacaaaataaaaaaattagccgggagtaagggcacacacctgaagtcctaccactctccagaggctgatgggggaggatggtttgagcccaggagttcaaggttacagtgagatatgatcgtgttactgcagggacagattgagagcccaaaaacaaacaaaacaaataaacaaaaaagtatattccactaataccttgtaaatgggggtgtatgaagtttttttaaatcagatataatgataatagcgtgtgtgcatggcagtgtgtgtgtgcgtgcgtgtcaggttgcatatattaagtgtaaacaccacagttatttcaggaagggatcataaatgcataagaatctaagtgtccataaaataccgtaaataaataattaaagctgattgagaaataatgggggctctggagactgtgcagaatttaaacttagcaactttgcagaagtctacgtctattttttccatcttccaattttttaggtaacattgagtgtctggattttcatatgcaattatgcaatttattttaattaaactattttctagtgtatagtgtggccaaggaaacgcagctttatgtgccatccagaccatgttgcaatagtttaaagccttgggcttaaggatctgttagtaacatgacatttgtatgatcagagctatctctccatacgcatttaggaccactgtactatcatcacgtccaaaacttcctttcataatcacaatctttgaaaattctcacactttagagtatcttcctgcctagaaaaatctatcacagtaatatatgcactcaccataaagataatgtaccaggatgctgaggatatactaggtggaaattttagaactgctgttgttcaggattttctcaaaagagaaatattcagaaatatcaggtagttactttacaaagtaacatatataaatatatgtatatacacacacacatatatttatatatgcacaaagggtttcttaaatgcacatgtacctttaaagtaagaatgcattttgggcatagtcatcaccaacacaaagttcattcttgcctcatgtattgatttatgctttaaattttgtaatcatgtgagcaatctttaaaatgataccagattcccaggttaaagtcatttggatgacatttatttatgttttttgtactattttgagtttgagggatggtgttagaaaatcttgtaaactagcttttggtattttctgattattattttttattttttggtgagcaacactaagactggcatttcaacttccaatgagggtccttatataatactcagttaagcatattactgctaaattcaaacaaattttaaaaacaaaaaaagatataaatgattgaaagcatgacaaacgttccctgtagatgttttctaatttttaatacattgaattaaaaatatgcctttccaagtgaattttagatattggttaccaccttcaagatcatcatttatgtatttgtgaaggtgaaagtaggaggcatacataatattatatctgtaataaatgtaactttttaaagtaacataacatctatatatggcaggaaataataatgatacaacattaaatagatatagacctgatgatatagttggaattctccaaactcttgcataacacttatgtaatcaatgtgaatttaaaaacatacaattggccgggcgcggtggctcacgcctgtaatcccagcactttgggaggccgaggcgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcgtgaacccaggaggcggagcttgcagtgagccgagattgcgccaccgcactccaacctgggagacacagcgagactccgtctcaaaaaaaaaaaaaaaaaaaaaacatacaattgacaataatatatgtgatatagtagattgtccaatattttgttggtctaaactacaaaatttgccctgatgattggtgtattgaagagaaaaacaattatttgtatctcatgatacttatcgaaagagtttgtagacaaataaaaaacacactagcaaaacacactctgtttcatgttaattaaagggagaaatactgttcacagaaattagcttccaaaaatcattcttcgtgaaaacacataagtaaactaattttaatactctcagttataactaaaatggtatcatccactatcttccactaactaagtattaaatacagagcataagctattccaactgacatattaaacaactttaagtatggcttatgtctataattttcttgtaatctcattctgaatggagctttcttgagcaacagtaattacagaggagttaagagtctggaaatagttatttgtttatagaaagaaaaactaataagagaatgaacatacttagtctaattagaaaagttttgtttaaactaccattagaagtaaaataatgccacaaactgaaatgaatccctggatattcttaaaacattattgttactttagtttcttaaaaacaaattaagcagacactcattttttccaatagcttgtaaacttttgaatcttgggtataattttaattcttgagagtgtcacatatttgataaagaatgtttgtctaagatttctatgcatatgtgtatttgagtatatgctatattaacatatgtgtattagactgccaagataaaatataactaatcaaagcatttattatttaactttgattaaatctattagcttctttacagattttgctcatttgtaagaggaggttaggtttcttcccccaggataaaagggatgagttatctgtttctcttgggacagatgtactgtggtaaatgcagtgataagagataaatgaaaataaagagaagcccctaaccaaacagaaatgaaaagaacaataatagaaaagagtgtctggggacagtgttcgaggttactttttcttttttctaaaatgattttttgcaattcatgaaaacaagcctgaagcgtaaacttgtcatctcattttaagatgcatttctcctaatattaggtattaaaatataatgatcaggcatatttttaagactcttttcaccttgtttgaaatgtattgcttcacaaagtctttgtggagctttctttttttttaagaaaagaagaaataatacaaatatagtttaggttgtgttaatgcttgaagaaaggtgtaaagggagtgatatgctttggttgtgtccccacccaaatctcaccttgaattgtaataatccccatgtgtcaagggtggggccaggtgaagataattgaatcacggggcattttcccccatactgttcttgtgatagtgaataagtctcatgagatctggttctataaatgggagttcccctgcacaagctctcttgcctgctgccatgtaagacatcactttgctgctccttcaccttctgccatgattgtgaggcctccccagccatgtggaactgtgagtcaattaaacctctttcctttatacattatccagtcttgggtatgtctttattagcagcctgagaacaactaatacagagagagaaagaaggttggagtagggagaagattgctagggtattaaaggaaagccctctgaaaatgacacttgagctgagacctgaataaactaagggatattttagagaatcccataacagggaagcaggcataccactttcaatggctctgagtggggagcatgccagccatggatgagaaacagcaaataggccagattaataagagggagggagtagtactagagatgagagacgtagccaacaagaaactgagagaatggaggtgccacttactggaatgtgatcctccctattggggagcggcaggtttggagtagaaatcaagagtttggctttgattgctcaaataaagtttgaaatatctattaaactaccaaatacagatgtcccatagattgatatgaatgaatctgaaagtcagggtagacaaaaaattgccagtcatgaaatgaacatggcactaacataggctatctacggaggatgtacaaagagagaaaaaatcaggacttgcaaatatttagaggtcagaaaaataaagggtatgtggctaaagagataagaaggagtgagagggaatgcctgaagccaaatgaagaaaggatttcaaacaggagagaatgctaatatgttgagtgccactaataggttgaggaagataaggattgaggattaactcttgtgtatttgcaaaacagaagtcactgatgcccttgagaagagtggttttagtggaggagtgggaacaaaagcctgactagaggttttcaagaaaatagagttcatataatttgttagtgtttttttttactgtgcaagtgagcaaccaaatgcggagataggaagacagtggggacaatgagtccatgaacttggcacatgtgtgcacttgtgttaaagatagagctattaccaatgaaaataatctattaaaaagtacagtgcagacaaaacaggagagagaatggacacacctgcacagtaagagaaaagtcctttcttaggttggtagaggaaattagatcctccagacagtggtaattaaccagagagaaggtccaggataggtggaagtttgcggatgagaaagatgtatcggagctttgaggataaagagaatgtatgaaggattcctttgaaaagtaatagtgtgaattaagtggcaaaatggcatacagttatacagttattgcatagggatgatggaccacttgatgtttgttttttcttttattttccagccacatgaagctgttggcatgtaggattagagtagacaaactactatttttattttttttatgtttagttttctttataatacacttcttcaagtttaccaattaaaatattttgaatctcataattaagtcttaaatatacgtgttcatgggtggtaattacttaaaacacttggatagtagcaagcaatgaaacttctctttctcttctgttgtattcaccaccactttagcctgaataactgagcaaataccaggttcttggaacactggcataaactatgtatctaggactatggctctgtccatcagcacaagccactagtaattcagaaattggtcatttatataatggcatttattgcatctttaccacgaacaatatgattttttaaacatggtttaaactatattatacaaataattcagctgtgtttgatacttcttatatgtaagaatcactttcctttttataggttacttttcctctttttataatatctgaaatttaaggatgctgtctcagagagccctttatttatgcaggcaagataagaatctatctgagatactctcacattcttaaaaactaaatagctacccatgtgtgtgtgcatagtgatgtcagaagttcttaactgagtcgtaaattccaaagaatcttagctaaaatgaagctcatatcttgctaattcttctctgttaacccataagaaaacagaagcccagagaaattaaaagatttgttcaagatttgcttgatagcatactaaggtggatttaggactttgggctctgaattgcttaatatggaagtgttgctcagggaaaagcccaaaccccagcattacacaataaatccatgcaacaaatttatacatgcagcctctgaatctataatttaaaaatgtgcaaaaccaagcatctttgaggaacaaaattctgagatattataagactttgaaagtcatattaggctttgctattgttcagattttttaaatatttttaatttttttcatttaaattttaagattttgttgtggtaaaatgtacataacatataatgtaccattttagccattttaagtttacagtttagtggctttaaggacattcacattgttgtgtagccatcaccaccatccatcttcagaacttttcatcgttacaaactggaactctatccattaaataggtgctccccattaagccctgctccccgcccctggtaaccattattctatgttatttctctattaatttgactattctgggtatggtatatttgtgaaatgatatgaaatttgtgctttcaatggacaagcatttgaggggattcaaaattgaattattttatcacgtttcagatggaactacaattattgagcatcaccattttagacattttactaggaaccttaaatacatgttttattttaaattctggatcaaaattctgaactaattgatttcatttctttataaattggacagaagctgagcatgagaggttaggtagccctctcaaagtcaaacattagaggcaagactagaagtggaatcttcaaacccatgtccattaacatttcacagaactttgaagtacattatgcttgcagtgattaaagcttgcgatcaagtgtctgactaacctgagttgcaatcctgactctgcctcttacatgctacaatattttgggcagttttctgaacttttcaaaccctcagtttttcctttgcaaaatgttaaaatgatagtttgaaaatcatctagaaagggtgttgattatagcatagcacaagacagaaacttttccatatcataaagaaaaaaatataggctttttgagatactaagaagattatcatttatatctgaaagggaattcagattgcttagggaaattatacctaagatgagactcacaatggcagataataataaaatagcgatatttttcacatattaaaatgcatgtgttattgtatataacaattatatatttaaaaattgtccttcagatatactcaaacacgtcttcaaataccttcatataaggatatttactgaagtatgatttgtaatacgaagaggttgtaaacaattagaatgtacagcaataaaggatacaataggttaaagaaaaaatgtattgtaggtatagaatatttgctatgtacctaattttttaaaatcatatttataaactaaaatagatactctaggatatgtcaaggagctaaggaaatcatttagtttactatttggatgtttacactgaatcttcaaagtgttacattttcttaaaagaaaatgttaaagcatatgtggcatttagtcaaatgtatatgaatatgtatttatggcctctttatgtaaatgcatatatgagatgttcttgaagtaaaaaataattctgtgtttttttctcttgacacaagttgaagctattacaaaagctaattatttaattaaaataacactggaaaaaatgttttaaatttcatttgttaagctagaaaatatttaagaagggaggaaataatttagatcaataccatgtgtatatttaaatcagattttcaaagtttgacctttttacagaaaatctaacagcaacaatcatttccagcgttactccaggtcaaatcatttgatagtgttatttcctatagtagtgtgtattagaatagaatgtctgaaaacttaggctacactaaatttataaaatgcattttttaaatagtaaactaactttagcttactgttgtttttaataaaatttttaatttttaacttttttagctttttgactcttgaacacatggtatagccatacaacatagtttctttctttatatttttattctataacctttttctattttaaaaattattaatttaatttttacttttaaagcattttttaaacctagacccaaaaatacacattagcctaggcctacaccgggtcaagataatcaatatccctgtcttcctcctccatatcttgtcccagtacaagactctgagaggcaataacatgcacggagctgtcatctcctatgataataatgccttcttctggaatatctcttgaagaacctgtctgagggtggtttacagttaatttttttataaggagatgaagtacactctaaaataacaataaaacttacagtattgtaaatacataaattagtaatataatcatttgctatcgttttcaagtactatatactaagtgtatgtgctattatttttatcactggcagcacagtaggtttgtttataccagaatcaccacaaacgtgtgagtaatgctttctgagatgatgttacaagggctatatcaccaggaaatagaaatagaaatttttcagctatgttatagccttatgggaccaccattgtatatgttgtacattgttgaccaaaatgccattatgcagagcatgaccatacaaatgtacagatgctcatcaaattacaatgaggatacatcctgttaaaatcattgaagtcaaaaatattgtaagttaaaatgcatttaataaactctgtctactgaacatcatagcttagcttagcctaccttaaccatgctcagaacacttgcattagcttacagttgggcaaaatcatctaatacaaagttaatttttataatagtgttgaatatagtatgtgactgattgaactgcactgaagtaaagtttccactgaatgcatatcacttggcaccatcataaatccaaaaaattgtaaattgaaccactgtaagttggcgactctctgtatataaaatatgtgtgtgtgtgtttatgtattttaaatcatcactgcctctacttttctaatttttgcatggaaatccaaatccaagggagcaagacagccaattttttttttttttttttgtatttttagtagagacggagtttcaccatgttggtcaggctagtcttgtactcctgacctcgtgatcagcctccccaagtgctgggattacaggtgtgagccaccgcactcggccaagatagccaattttaattataacccagagctaaaaatgtctagaaaattaaaatcatcagctaataaccaaactattatataaatatagattattttctagaaaagaaaagttcaaaggccatttaatagttgaaattttatgatgggtgcaaattttgatgcactatgttttgctttagatcctttttaaagaaagcattaaataaggaatgctttacagagttattgagattttttagcaaaaagaagtcctcattatttttgttttggtttcctgtgcttttggtgtcatatccataaaatcattgctgagacgaacatcatgaagcttttccctcatatttctttttgcactttaatgatttgagtcttacatttacgtcaataacctattttgaattttttgtgtgtatggtgtaaaattgtgtccaataccattcttttttatattcttatctatttttccaccaccatgtgttgattaggtcattgtgactttttggcacccttagtgaagatcagttgactatatatacatagatttatttctgagttctgtatcatattccagtattctatatgtctgttgtacaagtggtactatatcaaactaaaaaggctctgtacagcaaaggaaacaacagagtgaagaggcattttgccttaacagaatgggagaaaatatttgcaaaatgtatatttgataaaggtttgatctccaaaatactttatttttgaaactcctgtaactcaataaagcatgtgacttgattttaaaaatgggctaaagacttggaaagacaattttccccaaaagaactataaatagccaatagatatatttaaaaatgttcaatgtccctaatgataagaagaatgcaaatcaaagtcaacaagagatatctcctcacacctgtcagtatggctattacaaaacaaaaacaaagaaatcaaaacaataaaaccccaaagacagtatgtttttagtaagaatgtggagaaagtggaactcttgaaaactgttggtgggaatgcaaaatggtgcagccactatagaaatcactacggaggtttctaaaaaaatttaaaaatggaactaccatatgattcagtaatcaaaattcttggcatttatccaaaagaatcaaaattacactctcagatacaatcatatactagtactcttatgctcattgcgactctatttacaatatccaagatgtggaaacaacctaaatgtccatcaacaagtacatgaataaaaaaatgtgctacatatataatatatactgactaaaactctctcctttgaccaaaactttatttggactcttttgaatcttatgcttggctaggtctaaccttgggcttctctttctgtccttgttgaatccagtttgagcaagattcctgttaagtcagcttaggaaaaaagcttcaatatcttatgacactggactccattcagcaataattccatcaagttgatgtagctagaaacctcgtttttctgtatgtttcctcttagtaattttccattcactgaaccccaccctgctttttggtataagtctccacttgtcatggtggaagtcagaattgagtccaatctctctctgctcctttaagaccactttgctggggtccctatacctattaccatgcccatccttgaacaatatctgccttaacatctttaagaaaattctgcaatatataatacaatgttgtatggcagaaagtttcagtcaagccaggtaaaaaagccctagagatctgccaaacaacattatgtctatagtcaaagattatacacttaaaaattggttaagaggataggtctcacgttaagcattctaaccacaataaaataaaattaaaaaaatttaaaaaagtcttcactagcattaaaaattattaattataaatttattacagagctgtcctcaattaaattaaaaaataaaattgtcagcccaatgaaggcattatcttaaaaattagaattaatgtgcaaagagtagaataatgggagtggtaaaaattgaagttataaaagttatgttctaccctcaaccatcccattagttaggtaggctgggtaagtcatttttttttctctaagcctcaattgtacttctttagacttgggctaatcatactaaacaaatgggattgctattatgttaaaacacagacattaacaaacagcagttcaatctgactctggctaactatatactgaatagaatgcttaatgtattttaaccattctcacagaagtagaataaacaatataaacaataaatttccgaatccaaagtttaagagatgttaaggcaaatactgtattgtctgaaaagtatacacttttgaaaaatacataggattaatattgaaaatatcagaatatgcttaaacaagtatgcttacataggttttctcctttcatctcagtttgaaaatctagccatgtaaaatcagtttctagttaccagtgattcacagataagcttcacccattaaaatttccattcctacttaagaatcacaaagaagttaaaccccaaaagcagcatctcaaaatcaactctgaaaggcaattactttttcaataagtaaaattcatgaggaaaatttgtcactgcattagcaagttgtctctccatagaataaagaaccaaagctttacttgttcattgtgtatgagaagatcaggatcagtcagttaatgcttgtgttgagaacatttataatgtcaaaataaggttaataatcctaaaaattagataacttaataaagcaacattagactacctaaaaattccaatgctcaaaaagtaattcaatatttttagatatgctaaattgggtatctgctttctcagtaacgtttccaaaatacctatcttctcttcacattcaatttttctttcttactacaactctttagccacaactacataaaccttaaaataaaattttctgatattattattaatatatatgtccacataggtagataaaatggctataaaataggtaatttttaaagtttatgagctaagtgatgctaacagaagcaattctacaaatacatatgcaaagtgtattattcatttaaaacaattaacacaaagcactcttttttggatatggtaactaccaaagtcaaaaaaacaaagagctgaaatattatgtaaattgttcacagaaactgttgatctccaaaccagtcaattattatcacggcttgaatgttatataaaatggtagaaaaattcttgatcaacacttacattttgcctctgactactttcctcattaacttaccagccatgaaaagcactgtgcaaaagtcagcaattagggactgaataaagttttaagtggatcaatataacatatttggcatatctatgacacttctattaacattcatcaatttatgaaataacgacattaagtaattgtgttcatcccaaaaacccaaatatcaaatactatttgcatgactgtgttatacatagagcagaaggcagtgaagacatgatctttgcttttgtcacctatgaagacaaatatattgagtcacctatgaatacaatatattggagtgtgctctataagacaagtagatgccaactcctactggtcttggagaaaatgtaaataattctattggatgggagcagcaaagtaggtagcaatttcacagaatgggtggtattggggcatgttcttgaaggaatgagaggtcatcaaacagacaaaaacgttttgaacataggttataagcaataaagaaactgtggagttgcaaaaaatacagcatgatcaagaaattgtatagtcatgtgccacttaacaatgtttctgttaataatggaccacatatatgaggtgatcccttaagattggaatggagctgaaaaatgtctatcttctgttgacactgtagctgtcataacattataacacaacgcattactcatgtgtttgtggtaatgctggtgttaacctactgcactgccagtgtataaaaatacagcatatgcaattatatatagtacataatactcaataatgttaataaacaccatattactggtttgtgtatttacaagactaccttttttttttttttttttgagatggagtcttgctctgttgccaggctgggctggagtgcagtggcaccatctcggctcactgtaacgtctgcctcctgagttcaagtgattctcctgcctcagtctcccgagtagctgggactacaggagcacgccaccacttccagctaatttttgtatttttagtagagatggggtttcaccatgttggccaggcttgtctcgatctcctgaccttgtgatccacccacctcaacttcccaaagtgctgggattacaggcatgagccaccatggccagccacaagactatattttttatagttattttagagtatacttctcctacttattaaccagagtatttgaattttgcattttaagctgtggggagttgctaaaccagtaataactataataagaatatcaactaacgtttgtcagtactgttaatatcattcaccaacttttaaaatcacctattatatttgaaactgtttattatctcagtgtccctagaaaagcaagtactgcattaggtgcataagaagatgaccatcattgaaggtcaatgagcaaaatgtccaatttttttctcaacttggctgaatatgagacagaggagttcctctgagcaggtgagttatgtagcttatgacttacaaatgatccctaaaaacttcttatatggtatggtgtaaatgaaagtacaaaataatttatgacagtacgtagcagaacaaaagaggaaaatatgttttaattatcaattaaaaattacctccaaacttcaaatatgaaaacccacaaataaattgcatctctattgaaatagcacaggcacttcatggtttagatttgtagaaatgtctctgaaaactctgtatttcctacttttatgtttgtttatatttaggagcagcctacacataatttggctcacttaaaagactttcttaatgagtagtaatctacatagttccttgctgctttattttttagattgggctggggaagtcaataaccactagaaactctcaaaccaagaaattctcctgaagcaatctttcagctgtaaaccacctcagctaggaacccattgtattcctataaatttccttcagtattcctaagactaaactaatctgaacctcatgactgacaatgagttgagaatgaccttttgcaccagtgcattaattgtgaaagctttctgcagcaggagctaggaaattactcttctgagtacagcagccagagcactgaaatggctctggctgctgtactcagaggagtattttgaatggcaatgcttaactcttcagccacacatcgtctacatttttatattttacagacattttagatgtgtccatcatcctccaaggaaattggatttctgaataagaaatttcttttcaccctgtgatttctacatgatacttatagaaacagtttgacagctttggagaggatatcctatgcttcatgtagactttctgcttacggagtttaacacactcataaatttagctttactgactttacaatcttttatatgagaacagaaaagtcagcaaatttggaaatagaaagtttatgttccgccacatataaagtatgccaagtaatactttggccacttcacaaggaagaaaaggatatatatccaaatttatataacattcaagaaaatctttaattatattccagagctgataatttaaaatttatcttcaataattttatttgtttccaaactacctgctgctgagaggaaaataagaatatgcaatttgaaggcatggcttgtagtgtatcatagctctatttattatattattatattcatctacatacactgaactgaaattgtagagttcatttatcatttagatcaacttttaagaagatatatttccaattcttacctgtccatctcaaattgagctcactatattcactttatgtataaatggtatgtatacataagcaaaatataaatacaagcagtgatatatttattgcactttgtatcttaaactagtatacgtttgcttccagcagtattttgattttactgcaattcagatattctgattatcttttacctaaactttaacaatcaaaacaacttatcagtcatctaactttaaacttcctctgaaatcatagtctttgtacacgaaatctaactggggttaaatgttcttcttgttctctctgattgagccttccctgggacatctcatgcatagaaaagagttcacaaataaaaatcggttagagctgtgattcagtttacataagatctagaaatataagttccataacttctaaacgaagtcatatccttaagccattcttaaacttaaaagcgaataactccaaacatccctgattgaataactcaaaataataagctcatcaatctgataggaatgtcaatctcagatacattgccaagaaaatgaaaatgatgtagtaaagattaaatgagaaaatgatgccacatacttagcataaatgcaaacacaaaataaatactcaagtaaataaaaccattctttttttaaatgtattctaaaacaacaacaataacaacaacaaccacaacaacaaaacaggatacaggtgcagaacgtgcaggttcgttacataggtatacgtgtgccatggtggattgctgcacctatgacctgtcctccaagttccctcccctcataccctaccccgcaacaggccctcgtgtgtattgttcccctctctctgtctatgtgttctcattgtagagtaactcccacttatgagtgagaacatgtggtatttggttttctgttcctgtgtcagccataaaaagaaataaaaccattcttaggatgatatttctccttacccttctctttttacaccgagaagaattatcactttgacaactgacgctctctttctttctttcctgaaagtaagttacactgtaacttatatgagtaaatgagccctttatatgaagcttaacatttaaattctaaaggattcttaaacacatgtgtaacaacaccatgtgttagttaatcctatcataatatatcatgttcatatattagattaatacaattaatcacattctaaattgacaacattttctgagatcttggtttcttaatatttgcagtagaaacaaatattttttctcacccttgagaattaaaagtgaagcagaaactttagagtcatgttaagttgctgactatctaacttggtttctgaatgataaagtagactctaatggtgattgctttttcagtaacaactttcagtaatatttgtatttttctatcacacctttccctgaagaagaaatgctttcagatgaatagggaaagactctctaagtataggtttgagttttagaattggctagattggagagttttagatggaagagggaggtatcaatcaagtacagaagttaatgctacaataattacttgggaaaattctcacacttcagtgattgccaatcagcctgcactacttactgagtgaaatgtctatggttatcagaaatcgtacaagaaaaaaccaaaccgaaacaaaaaatagtgtagttctttttttctcaacgaagtatatttaagagcattaatttagatccaactaggcctaggtttgagcacaggattttccactgtgattaacttaaactctcttgtttgaagttgtctcacctataaaatttgggacaattgtggtaattccagaatgaaaataaaatgatgtacatacatcatttagtatattaaaaattctcaataagaattgatttttctgttaatacgattataatataatttgaggctacaactaaagaatgaaatgaatagaaatgtaaacagaatggtcacttttgaaagggcttattctgtttagaagaatgtatagacatgatcaaataaatgttcagataaatttatagagatgtcaaataataactgcaaattgtgcaattcaactaaaatgtcgagagacaatgagacaaataccttttttattcaagttttaagaaaaattactgaagtttagaaaatctatggaataaatagaacaatacaggcataccttgttttgctgctctttgctttatttcactccacaaatattccaatttttacaaattgaagttttgtggcaacctggtgtccaacaaatctatcggcattgtttttccaatagcatgtgctcacttcatgtctctgtgtctatgttttggaaattatcataatatttcaaactttattattattattatttgttatagagatcagcggtctttgagatcaactactattgtagttgatttgggccaccacaaaccaggtccatagaagatgataaacttaactgatacatgttgaatgtgttatgactgctccacccacttcagcttccctgtttccagaggcacacaatattcaaattaggccaactaataattgtacagtggtctctaagtgttcaaatgaaaggaggagtcccaggcctctcatttttaatcacaagctaaaaataaataagcttagtgagaaaggcatgttgaaagcccagaggccaaaagctaggcctcaagcaccaaacagccaacttgtgaatgcaaaggaaaagttcttgagggaaactcaaaaagtgctacttcagtgagcacatgaatgataagaaaacaaaacagtcacacaccagggcctgttgtggggtagggggagggggagggggaagggataacattaggagatataactaatgttaaatgatgagttaatgggtgcagcacaccaacatggcacacgtatacatatgtaacaaacctgcacgttgtgcacatgtaccctaaaacttaaagtataaacaaaacaaaacaaaacagtctgattgtggatatagagaaagtgttactggtttggatagaaaatcaaaccaaccacaacattcccttaaaccaaagcctaatccagaacaaggccttaactctcttaaattctgtgaaaactgagagaggacaggaagctgcagatgtttgaagttagcagaggttgtttataacatttaatgaaagaagtcatctccataacataaaagtgtaagatgaagtagcaagtgttaatgggtaagctatagcaacttatctggaaaatttagctaagatcattgttgaaggtggctacactgaacaagagatttttaatatagatgaaaataccttctatggaaggatgccgtgtaaaactttcataactagagagaagtcaatgcctggcttcaaagcatcaaagtacaggctgactatcttgttatggatgaatgtaggtggtgactttaagttgaggctgatacttactgaccattctgaaaatcggagggttgttaagattatgccaagtctactataactgtgctctatgaatggaataacaaagcctggataacagcccatatatttacaagatagatatgaatattaattttttccattggggcttcaaatgaatatttaagccccaatggaaaaaaaaagattattttcaaagtatcactgctcattgacaatgcacctagtcacccataagctctgatggagatgtacagggagatcagtgttgctgtgatgcctgccagcacaacatccattctacagcccatggatcaaggagtaattttgacattcaagttttattatttaagaaatacatttcacaagactatagctggcataggtagcaattcttcttatgtatctgggcaaagtaaattgaagaccttccattctagatgccattaagaacatttataaattataggaggagatcaaataacaactttatcaggagtttggaagaagttgattccaacactcatgaatgacttcgagaggttaagacttcagtgtagataatacctacagatgtggtagaaattgcaagggaactagaattagaagtggagcctaaatatatgactgaattgctgcaatctcatgataaaatatacacaaatgagcaactgttttgtgtggatgaatacaaaaaaagtggtttcttgagataaaatctattcctggtgaagatgccatgaactccattgaaatgacaacaaagaatttagaatattacataagtttagttgacaaagcagtggcaggttttgagaggactgactcccattttgaaaacatttctactgagggttaaatgctatcaaacagcactgaaatctatggggaaatctttcatgaaagaagaaaagtagcactggcagttgaaagttaaaagcttcccatttctgatcaaaaagattctttcaaatcagaaaataaatgaaaaaaaaaaccgccctatttttgtattttaatttccaccctaaatttctacttcgagctttattttagcatgcccattccttaggtttccttttgttttgaataatacttccatagctatcctgaaaacttttaacaagttaaagtaaaatgatgtgattataagttaagtcattgcagggatggatgtttttatctatgtatgtgtatttttccccaacatctcccctgaccatcaggctgtcatcttataggatacagtggaaatttacgtttcttttagagatggtgtatcactatgttgcccagactggactcagattcctggggatcaagcactccttggcctcctgtgtagctgggattacaaatgcacatcactgaacccagctagtgccaatttttgaagatattattgttattatgtctttgcagaaataaagttattttatttatttgtagttactacagaagaaatgactttgatagataaaaaatagtaacaaatttcaaatagaatggaaagagtaaattatctaaaatatcagaaataacttgttttagcttatatatacttgatagtttaaaaaatatttttctctcaaagtagcatactatatttctgttgtgaaattatttagttcacatatcatgatcttttaaacttattttatttacaggtatatctgcatataaatttaaatcttcatgttgaaaatacatgattacctgagaacacagtttaatttatttaaaacagttacattatgttagacttatattttgtttttattttttcattatgtatatcgctatgcttattgaaatgtgtgtatatatatatatatatatacctctttacatgcttgcaatagttaacctctgcagaaatgtttatgcttatttttgcttattccatttatggtcagagagagagagagaaaaggaaggaaggaaggaaggaaggaaggaaggaaggggaagggggaaggggaagggaggaagggaggaagggaggaagggagggaggaagggaggaaggaagtaaggaagaggcaaggaaggcaaggaaggccggcaggaaggaagaaaagcaggaagggatggagggagagtgaaaaaaagaaaaagaaaagaaaaaatagccaggaagactgttcttacataaaaacgttctcacctattggttatttcttactctaacaggcacttacgatactatttaggccacctgctaagttctgtatacagtggcatctgtacattcccttcttatcattggtagagagactcctaaatcaatactcatcctgagagtgagctttaatatagtatgggtggtatttataagtaatgaagcagtcaagaggagaaacaagtccatgtttatctgaaatgactatcttctcattcaatgcagttacagccacctacagaaagggaaaatcatccaaacagaatttaagaaagaaagtttacattcgcttgactggaaatcacaggcaaattgctttgttggcatgggataaatgaaagttaaacacgtttggatattaggagagacaagctaatttgaagtattggaattaaaaaattaagtacatagatttcttgaaacaatcactcacagatacagtgacatgggtttgctcaaagaatagagaagactggcacattttgacagaatgttgccttgggtttattatttgcatcagatctgctcaatagtttagtgctgtatagattctgtgtttagaaggattccgagggtgtctgttgctgagcagagaaaaagctacacactatttgctatatcagccaggggaaatggaatgagatgagatatttgtcattcatgtggtagtgcaaagatctgcagctgtgctgccttacagaacctggttttccaccctctacatcatttcaaaactatataaatttgatcaattacttaacctttttaattctctattttcaattttatcacttgtaaaatgaagataataacagctaccctgattacctacagtgaatttagaggtcatagataaatgttctaacattatgcctggcacatgatagccaacatttacctagtgccttctattatcatgatttcttccctgacaactgagccactttttatctttagaaggcaccattttttaactattgccagtgtcatttgtgtaaaagtttcttagtaaagcagtctttgataatgattatgacttttctgtgtcctcaagaagggttccttgacttatataataaattcttctttgtctttcacatttaaaagggaaagtcaatattaatcaaatgagtgtgttcataaaagtaatgtcctcctcttcggaagaggaaaaacagcattggtttacccaaaatctgtttctgtgcttagaataaagatctagtgtctgaaatcataatggcattctaacaaaggattaaacaaataacttcagaaaacataatacaccttaatgatatttcaaagtatttatcaatgttattgtcaactttgaaaggtgagaattttgtaacatgatttgacaatgcttaactacaggttttatgtaaaaaaaaaactagtcacttacatgttcctcaaattattagttcatatgttacggaagaaaatgtttgccacatttctgaataaaagtcatcaaaatattgtgatctagatgtcatgtaaactgaattaccaagaccctatcttaagtgactctatcaagacccataaccagaagtaacaaaatctctgaaggaaaggatttctgcatgttttcaatatgacagaaaattattttttattgttctatgatgataatgatggcaatgcagtcccacctcacttttgaaaccagacttcagtgtttctctgaatacttttaagtgtggccaacagcaaagtggctgaagtagtaggattgaagactgttagccttaaggacaaaaatggtaatataattttcatcatactataattttacctaatattccttatattgaatgtcaggagaaatatattcatatatattatttccattaatgcattttaataacatatttagaatgttacattatttagcatctcagtagcaataaatagttttttatttctttatctttttaacactttgtaaagaaaatacattttactggtaagttatgcattgcataggggaaaacaaatggacaaaatgaacatatgaaaatcagctatgccttaatgattatattttatgtattttaaatatagtattcctaaatctattttacaaatgatgctcagtaaaatccttaacctctccattgcagcaggttcccagcatgaaggggctaaactaacaaagctaggggcctggcattagccccccagagttactgcaagcaggcctggagtactaaactaatctttggccccctgagatcttccagagacaaagtcaatcgactgaacccaccatattcctctatcaaactcccaagggaatcaaagaagataaaagcaaataccttatccaaagggcagcaacttccaagattgaaggaacatctgcccacacagattagaatgtaccagcatgagaactctggacgctaaaaaatccagggtgatcatcctccagatgatcatgctagttccccagcaatggttcttaaccaggctgaaatgaccgaaatgccagaaacagaattaagaatattgatagggatgaagattactgagattcaagagaaactcaaaacccaatccaaggagtctaaggaatacaatacaacaatacaagaactgaaagacaaaatagccattttaagaaaaaacaaagctgatctgatagagctgaaaaactcacttcaataatttcaaaatacaattgcaagtatcaacgcaaaatcaaccaagtggagcaaagaatctcagaggttaagtctggtactacaaattaattgtcatacaaaaataaagaaaaaagaataaagaatggacaaaacctttgagaactatgggattatgtaaaaagaccaaatctctggctccttggcatccctataggagaaagagtaagaaagaaagcaagttggaaaccatattttgggatataggccatgaaaattctccaacctcacccaagggccaacacttaaattcagaaaatacagagaacccctgtgagatactatacaaggtggccatccccaagaaatgtagccggaagattctcctaggtcaaaatgaaagaaaaaatgttaaatgctgctagaaagaggcagcaagtcacctacaaaggcaactacatcaggcaaacagtggatcttttagaagaaaccctaaaagcctgaagagattaggggcctatattcagtatattttttaagtgataatgcttcagatttcttcctacataattagaaaaaataatcacaacaaattggagaggaaatacaataaccttaaagataatctgggtcttatctaattccaaccaaaaatttcatatctagccaaactaagtttcataagtgaaagagattaagattcttttcagataagcaaatgttaaggaaatttgttagcacgtgacctgccttaaaagaggtccttaaaggagtgttaaatatggaaaggaaagactgttacaagacattataaaaacacactttagtacataaatcgacattctaaagcaactacacaatcaagtctgcataatggccagctaaaaacatgattaaaggatcatatctgcacatatcagtattaaccttgaatgtaaatgagctaaataacctaattaaaaggcatagagtggcatgctgaataaagaagaaagacccaactgtatgctgtcttcaagagaactatttcacaagcaatgacacacagaatctcaaattaaagggatggagaaaaatcaatcagacaaacagaaaagagaaaaaagcatgggttgctattttaatttaagaaaaaacagagtttaaacacacaagcaattaaaaagacaaagaagagcattacataattgtaaaagtttcaattcaacaagaaatcccagctatcctaaatatatacatgcccaacacaggggcatccagatttataaaacaagctcttagagacctacaaagagacttagataaccacacaccagtagtgggagacttccaacagcccactgacagtattagacagataatcaaggcagaaaattaacaaatatatttggaacctgaacttgacacttagccaaatggacctaacagacatagacagaactttccaccaaaaaacaacataatatacattcttctcatctgtacatgacacatactatataatcaaccacacaatcacccataagacaatcctcagcatatgcaacaaaattgaaatcataccaactgcactgtcagaccacagcacaataaaaatgtaaatcaatactaagaagatcactcaaaatcatacaaatacatcaaaatgaaaaaagctactcctggattacaatgtgggtaaacaatgagattaaggcagaaatcaaggaattatttgaaatgaataacaaagatacaacacatcagaatctctaggacacagctaaagcagtgttaaacaaaaataaacaaaccctaaagctagcagaagacaacaaaaaaccagagtcagatctgaactgaatgaaataaattaagacctgaaaaccatacaaaagatcaacaaatttagtggttgtttctttgaaaaaataaataagattgataagtaggctactgaaaaataaaggtctgaatatccacaatcagaaatgacaaaggggacattacttccaattccacagaaatacaaaaaaaaaaaaaaaccttcaagtaatattacaaacatgtctatgcacacaaactagaaaacctagaaaaactgataaattcctggaaatacaaccttgcaagattgaactaggaagaaattgcaaccctgaacagagaaataatgagttccaaaattaaataagtaatacaacgcctaccaaccagcaaaaggcttggaccagatatatccacagctgaattctaccagatgtataaagaagagctgcatcatttctgctgaaactattccaaaaacattgagaaggagcaactcctcctcactgattctatgagtcatgcatcattctgatatcaaaacctggcagaacacaacaacaataacaacaaaagaaaacttcaagccagtattcttgatggacataaatccaaaaatcctcagaaacaaacaaacaaacaaaaactagcaaaccaaatccagcagcattctaaaagctcattcaccatgatcaagtaggctttatccctgtgatgcaaggttggttcaacatatgcaaagttagtaaatatgattcaccacatcaacataattcacaacaaatccacatgatcatctcaatagatgcagaaaagtctgttgataaaattcagcagcccttgaggttaaaaacctccaccaaataaggcattgagtaaacataccacaaaatagtaagagccgtctatgacaaacccaccggaaatatcatactgaatgagcaaaagcaggaagtgtcccctgctgagaaccagaggaagaaaagaatgcccactcctaccattcctatttaacatagtacttcaagtcctagccagagcaataaggcaagggaaaaaaaataaaaatatacaaataggaagagaggaagtcaaactgtctctatgtgcagattatatgattctatatgtaggaaaccccatagtctctgcccaaaagcacctagatctgataaacaaattcagaaaagttttagaatacaaaatcaatgtacaaaaatcagtagcatttctatacactaacaacatccaagatgagagccaaatcaagaaggtaattgctttcacaatagtcacaaaaacgtaaaatacctaaaaatatagttaaccagggaggcaaaaggtacctataatgagaattacaaaacattgaggaaataaatcagaaataacataacgggaaaaacattccatactcatatatagcaagaatcaatactgtaaaaagtgcaatacttcccaaagcaatttaaaagaacaaagctggaggcatcacattacctaacttcaaactacagtgtaaggctgcaataaccaaaacagcatggtattggtaaaaaagcagacacatagaccaatgggacagaatagacaacccagaaataaagccacacacccctacaaccatctgctcttagacaaaattgacaaacaagcaatggtgaaacaattcagtgttcaacaaatggagctggggtaactggctagccatgtgcagaagattgaaattggactcattctattcaccacatacaaaaatcaactcaagatgaattaaatacttcaatataaaactcaaaactttagaaaccctagaagataacccaagaaataccattctggacataggcaaaattttacaatgaagatgccaaaagcaattgcaaccaaaacaaaaattgacaaccgggacataatttaactaaagaacttctgcatagtacatgaaactatcaagtgtaaacagactttgatagtttgaacttctgcatagtacatgaaactatcaagtgtaaacagactttgatagtgtaaacctacagaatgggagagaatatttgcaaattgtgcctctgacaaaggtctaatatccggaatttctaaggaacttaaattaagaagcaaaacaaacaaacaaaaaccacacaaataaacaacccattaaaaactgggcaaaagacatgcagagacactttcagaaagaagacatacatgcagctaacaagcatgtgaaaaacgctcattatcactaattattagagaaatgtgaataaaaatcacaatgagataccatcttacatcaatcagaatggttattattaaaaagtcaaaataacagatgcctgcatggttgcaaagaaaaggaacacttataccttgctggtgggaatgtaagttgattaagccattgtggaaagcagtttggagatttctcaaaaaacttaaaacagaactaccatttggttcaacaatcccattaattgagcacattcccaaagaaatataaatcattctaccataaaggcacatgcatgagtatgttcattgtagcactattcacaatatcaaagacatggaatcaatcaaaatgcccatcagtagtggactggataaagaaaatgcagcacttatgcagcatgtcatattacacagccataaaaacagaacaagattatgtcctttgcaacaacattgatgaatgtcattgttctaagtgaactaatgaaggaacagaaaaccaaacactgcatgttctcacttataagtaggagctaaactttgagtactcatggacacaaataagggattcagagacactgatgcctacttgagagtttagggtaaggattgaaaaactacttatcagctactataattattaccttgggtatgaaataatctgtacattgcacccccatgacacctaatttacttatataacaaacctgcatgtgtacctatgaacctaaaataattaaaaaaaatacatgctaagattaatccatatcagttatttccagaactgtcatttgaatgtggtagagatataattaatataattgaaagaatagttagaatgcctgggttcaaattatggctccatcacttgttagatatgcaattttgtgcagtttatctcatctccccaaacctcaatttcatcacatataaaatattttaagcgtaatatttcataggttgtacttcttgatctataatcagtttttacaaccttttgaatttgtttatgacataagtgaccatagcaccactattatccataccatgagttgttctacaaaaagtgcatagagaccattttcttctagaacagtgatttgactataatagattatcatgaacattttaagctttatctgatttgaagaatatttactttctcaaatattacttaatatttactggctcttggtcaggtggcatggattcacattttgattctatcattcactactgcataagtctgatagttttactcaaattataggtgattatagacaggtatctgatgatggatttttttcaaaaatttctgaacagtattgatagatgtggtatcaacggtacagtgaaacttgccatttctctttctcagagagtggagattaggcatcttaaaaagagaagagcatattgagaggtaaacagcataattactcttaacagtgagccagatattttgaatgctcagatgtataaagctgagtctcatccaactaaatatgaatggttgtctgccttagcagagtattttaatcacattcatcacctccagagtaatgctgattacaaggaactccattaaaataaaatgcatttgatattccaaatagttttcatgatagtatggctgaaatatgtacatttaaattatctttaatatagaaaacaaactgatctttctaacttccaagtcaatacacaacttaccatccccacttttagctataactcaaccctagaaaagtactgttagaaatcaaatataaagtaaaaatgagtgtattgggtttcatgttatttagtcaattatagggctaataggcctataagaatttaaattgcattgaaaacttgaagaaatatgacatgcagagattatcctagtagataaaattccttagatggtatgggatagtaatataaatttttagaattatttccatgtttcctactttaagttttacacctaccatacctggagaataggatatgtaggtatttgaagacttaaccacaggaaatgggggcgaggaagacatattttaatttattttttcaatacggtgtctcgctctgttgcccaggctgtagtgcagtggcgcgatctcggctcattgcaacgtccgcctcccaggttcaaacgatcctcgtgcctcaacctcctgagtagctgggactaccagtgcatgccaccatgcccggctattttttgtatttttactagagacgggtttcaccatgtgggccaagctggtctcacactcctgaccttagtgatcttcccaccttggcctcccaaagtgctgggattacaggcatgagccatggcgcccagccagaaagacacattttaaatcttagaaaataagatgcaggaaatcctgttgagaacatagaagcaatcttcatgatgttatacagacctacttctctaatataattctaatagggtttacacatgttaatagtaagagatgtggaacactgtagctgtacttggtatactcctagaggctgacctctataggtaataaatgaaactggaccatggactacttacctaagctacagaacctagagtaaattgaggtggtaggcttgcctgatcagccccaaagaagggtcagagaaattaagtaagactcaactgacaaaatttgttgcaaactccagggacagtaaagtttcttaggaaaaatgagtagtacatcatgcaacagtaacttagtactatagataccactgttcttgcccaggtccatataaaattgagaggaaaggagtctaaataaatcatattttgatatattttccattggaagtaacttgctggtatagaaacttgaaatttgaaacaactacttctgtccagtttgccatttgcaacagctaccaagactttattctcagaagttacaaaaataacaaatggagactaaataaatacacaaataataaaataattaaaatagtaaaaataaagcagcatgtagatttaagattcctgaaaatacacagcctatctgactttttgaagcctgcatttatttcaaaataatacaaggtctttcaccagtaccaaaactgttttgggacagtattctgtgattctcacttcatgaaaaactggctatttcatttcaacaaacacacattacatgtttaccagacataatgcttagggttgagtatacaaagataaaaaaaaccacatgctggctgtttcatcaaatacatagaaacctaaaagaataaagaaacccataaagagatcattttaagaaggggaataaaggacatgatataaactcagagcaggactgcttagccccaatcactagattggtcatcacttttgggatggcataatttctaacataatctttaaatgcaggtaatgagttaagtaagtaaataagtcagagtttatcatgttttagcaacaggaaaagcatgagaaaatatatgcaattataaaataacatgcatatgttgtaggaactatattctatataattgtaacataaacatcaagttatgcatattagtggaaaaggctgtagaagcaggccaagaccacgacacagaggacatgttgtatgccatatggataatcacaatagagccagagacttgctaaatagaagtggaataaggccagttttttcttgtggataaatcactatggcaacattgcggatggtgaatttcaagagtgcaagataaaaagcaaaaggtcatggctcatatttggtattatatttgcatcaagtaaaatagactaacccaagttggactgtgacaaatatgctgaatcttacagagttgaatattttttatccagatgataaaacatataatgtattgaatggcaaaaattccatctatgtagatatatagaaaatgaagaaaatttttgattagacattatattacatagatcggacattagatctgacattctattacagcagccatgtgaattttgcagttacatggttttactgtttctctttgttttctctctttatagtcaggattttacctgagtatctagattatttctcagcttttattttacttaatctatagtgttggcctcctcttaggcctaaactgaactatttcaaatatctgactcctaattgtgcaaccttaaggctgtcagaatcaccccaatgcaggccagaataacgtgtgtgtgtgtgtgtgtgtgtgcgcgcgcgtgcgtgtggtcatctttattcttggcatgcttaaatagattttcataactgttccctcagataacgagcaataatagctctaatgatctctgaaaaaaaggaaacaaaatatcagaagcaaacatttgttttcattattttctcagaggagttttacaatttttatcgcttgagttagacatcatgttgtaaagtgagtgccttagttttagggaagaataattcaagattgactatcaaaacctgaccgtggatatttgctttaaattcttaccaccactgattatcttctttcattccaaagaaaaagaagagaaaaccaaacaattcattactatatggaacttacacctccctctgataagaaatcagttgctcaagcactgaaacaagatctttgcaaatgcattctttttagtatttgaaacttaatcacatcgtatagaaacagaattttatacgtaagtaaagaatactatgatcggttccaagattctccacttattcttggattgattgaagagagaaggaaatacacctactccatacattattatacattaatgaagaaatacacatttccttcaaaagttatactgcacaatctatttaagcctcagttttattttctgtaaatgaatatgaggataataatatcaataacaattgtaataatatctacttccattgttgttgtgaggatcaaatgacagggggtctttagtatatgcctggcacaaggaaacaaggaaacacacaagtcttagcaattacaaataattcatatatatatatatatacatatatatatatatataaaatcactttaaaacaattctaatacatattaatgtatagttatgggagtaatgtgtgtgtgtgtgtatatatatattatttatgcaggacatatctaaaatatatatattcataaatatatgtgcaggacatatcttaatatgtatataaaataaggcttacattgaatgagtcaataaacacagaatgaaagattgctgaacttatggttttactttaaccagatttttaggaattttccactcatgcaattgactaggataatgtatatgaatgtgtatatgtgtgtaagtgttttttaacacctttatgtatatatatattacatatttatatgtaatatatgtaataaatatgtactagacatgtaataaatatgtatatattacatatttagatgtgtcctgcatatatacttaaataaaaatataaatctgcatctatatacacatttaaatgtgtcctgcataaatgtagcaattcacaatgctactgacgtgatcctaccaagcaaacgtttgagtaatccttcttcctctaattgtattcattcagatcaatgcaatcagtcccactcaagtggacgatcatgcaatgattctttacaaaattggtaaatgaaacatcagttttcctagtgacaaaagcttgtatctaagggttttacaaacactgagaaatcaataaatagtgctggaaaagtattgtgaaggatattgttagtttcaaaattaatcatatttagtttaatattgtttaataatactgattagatttttactgtaggttaaatttctgagcgaagcatttctctctcaagactatgttgcccaccacacagttttagaatagcagtatattatgttattattagcctatttattttctactggctgctgcagaaaataaacacctctataatgaccacagtctagatttcagcctgtgtcaaaaggattttgaattatacttcatttttagcttttgctcccaccctttgcacaaagtagaagagacagaacagaaatgttttcctaattgctgttgcaagaaatacttcatctagaaaaaaatgaggaattaatttattttagcaggaaaaaatgaacaataaaaaatacatagagtgaaaagttgtagtcttctaatacctcttttttacttgatgactcaactttttgggaggtttctgggtctaccacctaattatttttactcaaattttattcctggaaggaagatggccatatgcagtaatttatggttcaaaccagaatacttttgagggtgagagcggtattgttaataataatgcagcaggcataaaccggattgctttgggaaaaccagtatatatgatcacctgtatataagggactacaatttcagtacttgacagcatggcaacactctatttagcaatgttttaggtttatttaatggtcacttcccttgccatgtggtaattacatctgctaaaagggtaagaggctgcttgctgtcacaactcaggctattcacatacttaatagacctgaacaaatactcagaagagtttcattgaatagctgtgtgtaccattgagataatctatcatttaacgtttcaaacaaaaatgatatctttcctctgatacttcaagtcattgcaacatatcagtaaaacagcattaaggaagtgttgataacatatcttttgaatgctgataatgtgactaggtctagtgacatctttcatatatttaatctgacaaacatgaacatacaacacttgaaaataagaggacttcttgatttatagggagtatattgtcactatgagttttttcatgccatagatatccattcctagggcaaaacaataaggacaacgtacaaaatcaaatctgctcatgtatcacatggatgaaaactaaggaatcatagaattctgagtaggtatagaccttaaagttcattctattttccaacattttattaaaaataatcacctttataatatccataatttatgagtatatttttctgactataaatgtccaaaaatgtcgataaattcctcaaaagaaagcccagttgaaaatatacaggagtttattcattcaaccttaatttgaaaaactaataaaagttattatttttttaaaccttacttctaatgtcttgaacaatgctgtagagtttactcagattttaaaattataatccttaagtagtgggactaagcaaacctgtattaaaccattttgcaatgtataatatcttctatttctataattatcatggattaacttccagatatgtcataagtaattgtattgagatttgtataatgtttaattgcttctgagttttctgcctttgattatacaaatgaatattacacatccttaaattctgaaatacttacaggtatttctcgtatatacgtagtagtgtaatttgttccctgaggcactcctaaatttgaatgtaaagagtatagaaattactttttccctttacaaggtacaatttaattatcaattcttttcctttacttaatcttcaaagtttcaaaaagggagagacaaagaaaatctattgtcagtagaaaaatgaatatttaaaaaagcagaaaacatcattgggtagttaggctaaaagaaataatctgttctccaagttcaaacaaagcatttcgaaattcattgttttaagcattaatttatattgctaaattttaaaagagatttaaaaaatcataacagctaagacacaacaagcagtagaagagacatatgaagaaatactacactgatggaagagacaatgatgaaaagaacatgtcatttgaagcaggattgtgataaggagagttttgaaaaagtttgagtgctatagaaaatgtctcatatttatagcagaggttagaaagaactcagatgtcaatgcaaataatggaattataggttgatgggtgcaccctgttctccagctggaaaaagtgtagttggggctttgggtgtacaaaactaagggggcagtaatttagttcatatagccacggaaaataacattctaaactagaattggaggctacatttagcaccccctaagatgatgagaagagctaaccaactgggttgaagattggtaccagtttaaactgaaacactagaaagaattaatcatcttatgagttatagcaagattcatgtcctaaattttaattatcataataattttaaacagatggatagtttggataaactttgaacttcactatgcagtaaaacagattttagtattccatgttttaaatagacctgtaagagatgtatgatagaaaacgttggcacagatgaaaattacgaagatagcttttaatttctacctcaaatttttaaaagattatctctttatgccataggtaatgggcatcataaatcactagctgcaaaagcaggtaagtgtgaacattccttcaatgccttggcataaatctagaacagttatttctttagactttatttcatagaattcattcaatttggcatgtgttcatagatgtggctgtttgtaactgaatgaagttaaaacacacacacacacacatacacacacacatacacacacagggcctgatttcaagtttttttacatttaatagtccacattaaagaaaatattcttcaacaaaattaaatttcaaaactccttacatgagtcattgtacaacttaatactgtgaacagacgcacgagaggaatatatttaggtaaataaaacttgtacaggttggagaacaatattctacctttcatagtagcaccgtagtgttgttcaaattgcagctttatgctaattagtgttgttctggctttttaaaacgtttaagaagtaacagtttaaataaattccgaattgattaagtagtcagtattccacagatcatggaagattttagaattctggatatatttccattcatctgtataatcagtgtctgggcaaataatcaatatgtctaaaatcttcatgacgaaacacttaaatatttcctgacaaagctctaagaacattttaatatatctggccatatgcctgtaaggttgtattacattttacaggtatcttatttatttaaaatttgaaaattgcgttttctaaatttactgaatttctttccctagacctgaaaaggcaaaacatgttttatcaaaaaggttaaatcctttcaccacaaactccattttgacttttcccttgataaacattgaagtaatattttattttgctttcacagaagaaccaaatggctcacattaattctgtgtcttatgtttatcaatgaaccaatagattgtgatgaacagaatcaaggctttgaagttgaaagtgtctctgactgatgctacttcacctctgtgagactcagttttcacatcagaaacactggccacgtagcagcccctttattcttcggttatattttctttcacaacttcacagttatacaggacttagaaagaacaatgtcagacagactaaagtgggacactgaactgtaatcagagaaggagatctctttttgagaaaggtgtcagatatcctgtgaagtgaactgtctatcgcaaacatcactggtgtctctaaacagctccaccagtcgcaactaaaagttagcctttttcagcagtgtagagatgagaagagagactgataggtaatatgaaataatagaacttacagcacgtattcagattgtatttgtgtccagtcgcaatgtataggttcatacatgtaaacttcaaacacatatgtacagtttaagcttcactctttatcctcattaggattcaacaaaactgttttgtaaaaaggccttaaacattcaattaatagcagtataatctaattccaatataggaatcataactttcaaaaagatccatttgattcaatttttctaaagtacataataaaagtcatcttataggcttcttacatatcttaggatatcttttagagtcatagtgaattggcttcattaactggtcttgaggtttgggaagttaagttcttcaagcccatggctaatagatttaacattcaagaccatccatttgatatattttcaaacttcacaggactcctgtttttattcccaaactataaccttttgaggtcaaaaataaaactttttaaatcttcatgtattctattcacttaatgttataatttttataacttctatctttgtggtataaacaaatatattcaagtgtgaaaaattttaacatcatgttgtgtggtaaatttatttacattcagttttggggtagaaagtgtattcttaaaaagtttaaaaccaactgttttcatgattaagctaatagaaattattaagcacatatttgtttgccaagagaaatattgagattgctgatactcatttttttttctccaagagtaaactatagtgagttccacaaatgcagtaaatatatctgttttagttcaccactatatttcaagtgcaatgctcggtttagacttaaaataattttccttatgcaaggtaactgactatatagaaattatttgaatagagtttgatttttctatccattaagaaattaccaatatggaaaataaatttccttaagggaaggtggaggcataggcagattgattctgctcaccctccatcttattcccccaagtgtagattggtcttgttaaatcgcccatgcacttgttgcagaaacagtcaaaatggcgggttagaggctgttagcatgcctcagccactcggaaatagcaaaacagtgcataaagattgacactgtgagctttaattcacgaaggaaagtgggaattcaccagaataacaaaggacactccagatccaagggagaagatagtgggcaagccaccccctgatggcgtttggctggtaaaacgatatgggtgcagtggaacattttctttcatggccagacatatctccaggcttttgatgcaccatatctcctgggataggagcttcagttgccattcttttcccacacagacaatttagtacagcagcactccctccacgtcacactcagacatacctccagtcatttggcacacacacgtccacagattagtagtttgagccattcatcccttcccatgcaaagaccttattacagcagcagtttctctgcttttggccagggtatatttgcaggcatttgacacacacattctcttggcttaggaatctgtgctgcccctcccttcaggtgcagagattgtggtacattggtgctctctcttcttgatgcccagacatatctctggaatttggagcactcactcttctaggttatgatttaggccacctcactcttcccatgcagagaacctgaggcagcagaagtttctagaattcatgcctaggcacatctcctggttctcacaggctgcccactgggacccttttcaaagctgatgcatgtgcatgccattgggaaacctgtgggtgggcctgctcagtctggtcccacacatcttggatctttcctaaggaggaaggtgataccactgtgcattccacagatcaacccatggtctgaggcaacagagagcttctcccattaaaaaaggattaggtatatacccacctattttgaccacaggtggctcatacccataagtgacacctactggcctagagtttgaaatgcaaaacacaatagaaaatgatattgattcttcctatccatgagcatggaatgttcttccatttgtttgtatcctctttaatttcattgagcagtggtttgtagttctccttgaagaggtccttcgcgtcccttgtaaggtggattcctagctattttattctctttgaagcaattgtgaatgggagttcactcatgatttggctctctgtttgtctgttattgatatataagaatgcttgtgatttttgtacattgattttgtatcctgagactttgctgaagttgcttatcagcttaaggagattttgggctgagtgaaaatggccataccacccaaggtaaatcatagattcaatgccatccccatcaagctaccaatgactttcttcacagaactggaaaaaactactttaaagttcatatggaaccaaaaaagagcccgcatcaccaagtcaatcctaagccaaaagaacaaagctggaggcatcacgctacctgacttcaaactatactacaaggctacagtaaccaaaacagcatggtactggtaccaaaacagagatataaatcaatggaacagaacagagccctcagaaataaggccgcatatctacaactatctgatctttgacaaacctgagaagaacaagcaatggggaaaggattccctatttaaaaaatggtgctgggaaaactggctagctatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttcccaaaagaagatatttatgcagccaaaaaacgcatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggaccataaatcatgctgctataaagacacatgcacacgtatgtttactgcggcactattcataatagcgaagacttggaaccaacccaaatgtccaacaatgataaactggattaagaaaatgtggcacatatacaccatggaatactatgcagccataaaaaatgatgagttcatgtcctttgtagggacacggatgaaattggaaatcatcattctcagtaaaatatcacaaggacaaaaaaccaaacaccgcacagtctcactcatagatgggaattgaacaatgggaacacgtggacacaggagggtgaacatcacactctggggactgttgtggggtgcggggagaggggagggatagcattgggagatatacctaatgctaggtgacgagttagtgggtgcagcgcaccagcatgtcacatgtatacataggtaactaacctgcacattgtgcacatgtaccctaaaacttgaagtataataataataataataaaaagaaaatgagctgacacaagtcaacagacaagtcaacagcagtggggaatgagataggcttcctgagatctccatgattccagtccaataggaagcattgagcctgctcacatgcacagtgcattgctactaaaaataacattcaggaaagccatcatacaaaggctatatgtaaccaaagaacttatacagactctttagccctgaaagcacccagaaccaaagccagaaggaccctacaaatcatacattatagacacctcctgaaggagaaaaattccatccaaattaaaacaaattcaaaaaataaggagagatagcttatctagatgataaagaaccagagaaacaactatgaaagtatgaaaaacagagtgccacaacacttcgaaagatcacactgattcttttttttttttttttttttcttttgagatgaagtctcactctgttgcccaagctggaatgcagtggtacaatctcggctcactgcaacctccacctcctgggttcaagcaattcgattctcctgcctcagcctcccaagtagctggcactacaggcatgcaccaccatgtccagctaatttttgtatttttagtagagacggggtttcactatgttggccaggctggtcttgaactcctgacgtcctgatccacccgcctcagtctcccaaagtgctaggattacaggcatgagccactgcacccggtccacactgattctttaccaatgaatctaaactaaatgaaatctttgaaataccccatgaaaaattaaaaatattgattttaaagaagctcaatgaaatccaagacaaagctgaaaaaaacacaaagaaatcagaagaacaattcagaatattaaaaaagggtagatatcattaaaaaacaaacagaatttctagaaataaaaaattcattaaaataattacaaaatacagttgaaagttttaacagtaggctataccaactggaagaaataacttcagagctggaagacagatcttttcaattaatccagtaagataaaaattaacaaagagtttttttaaaaacttaacaaagcctttgagaaacataggattatgtagtgtccaaacctacaaactgtaagtattccagaggaagatgaagaaaaagtaaaatgtaaggaaaatgaagaaataattcagcaaaactcccatgggattgtcttttttgtgcaaatggtagctatttttattatttccttttttttttaaattttactttaagttctgggatacgagtgcagaatgtgtaggtggttacacagatatatgtgtgccatggtgatttgctgcacttatcaacctgttatctaggttttaagccccacatgcattagctatttgtcctaatgctctccctcacctcagccgccaccccccgactggccccggtgtgtttttttccccttcgtgtgtccatgtgttctcattgttcaattcccacttatgagtgagaatatccagtgtttggttttttgttcctttgttagtttgctgaggatgatggcttccagcatcatccatgttcctccaaatgacatgatctcattctttttatggctgcatagtattccatggtgtgtatgtaccatattttctttatccagtctactattgatgggtatttgggttggttccatgtctttgatattgtaaatagtgtaaatcaaaaccacaatgagataccatctcacaccagtcagagtgatgattattaacaagtcaagaaacaatagatgctggtgaggctgtggagaaataggaaagcttttacactcttggtgggtatgtaaattagttcaaccattgtggaagatagtatggtgattattcaaggatatagaaccagaaatgccatttgaccaagtaatcccattactgggtatatacccaaaggaatataaatcattccactataaagatacatgcacaagcatgtttattgcagcacttggattgtcttgggagaaatttggacatctagatacaaaaggctcagagaattcctagtagataaattggaaaagcctcactaatgcatatagtcatcagaattttcaaagtcaaagtggaaaaaaaaatcctaaaatcagcaagagagaagcatctaatcacctataaagaaaatcgcatcaaactaacaaaagacttttcagcagaaaatctacaagccaaaagagattggaagactatttttagtctcttccaaaaaaaaataccagctaacaattttatatcctgccaaatgaagattcacaaatgaagatgaaatagtctttccaagacaaacgaaaggaattcattactaccagatcaccttacaagaaactttcagtacaactttcttcacaacaaagtttcaatgcaacaaggtttaactatctatcctaaatatatgtgcatccaacaccagaacactctgattcataaaacaaatactactggtcctatgaatagagatagacagttatacaataatagtggaggacttcaacaccctattgacaccactagactgatcactgaagcagaaaatcagcaaagaaacttaacttaaactggactatagaccaagtagacataataggtatttacattacatttcatcctaaaccacagaaaatacattattttatctttggatagagcattctcctaaaccgaccatatgcttagccatccagcaagtctccataattttttaacaataaatcatatcaagtatcttcttggatcacagtggaataaaattagaaattaataccaagagtaattctcaaaactacacaagtaaatggactaaacaacttgcttctgaatgacatttgtgtaagcaacaaaattaaggcagaaatcaggaaagtttttgaagcaattgaaaatacagacacaatatttcaaaagctctgggatacaacaaagaaaagtactaaaggcaaagtttatagtgttaaatgtctacatcaaaaagaatgatctcaaagtaacatccaaattttgcacctcaagcaactagaaaaaggacaaaccagacccaaatctagcagaagaaaaaaaataacaaagattatagtaaaactaaatgagatcaagaccaaataaataacaaaaaggaccaattaacagctagttctttgaaaggataaacaaaattgacagactgctagttaaattaaccaaggaaagaaagagattcaaagaagtacaatgagaagtggtaaaagtgacattaaaactgatactacagaaatacaaaagattataagagactactatgaacacctttatgtgcataatctagaaagcttagagaaaatgcatttctagaaaaacagacaacttcccaagattgaagtaggataaaacagaaatcctaaatagacccataatgactaacaaagttgaatcatcaacaaacatctaccaacaacaaaaagtccaagaacagaaagattcaaagccaaatttcatgagatatacaaagaagagccaatactcattttactgacactatttcaagccatcaaggaggaaagactcctccttctctcttttaacaaaagtggtatcatcttgataacaaaatcgagcgaggcgacaatgtaaaagaaagctactggccaatatccttgatgtgcctaatgcaaaaatcttcaacaaaatactagcaaaccaaatccaacagcacatcaaatatacaatacaccatgatccagtgggtttatccaaatgatgtaaggatggttcaacatacggtaatcaataaatacggtttaccacataaagagaactaaaatagaaaaaacatatgattatctcaagagatgcagaaaattcatctgataaaatcaacacccctttatgatgaaaaccctcaacaaattaaacattgagaaacatacctcaatataataagagccatgtatgacaagtcaacaaccaaaattatgctgaataagggaaagttgaaaacaatctccataagaactggaacaagacaggatgtcaactcttattcttattcaacatagtagtggaagtcacttgtaatgtcatttttaccatttatcattattcttctgggaatttctcttatctcttggttaatttaactagcagtcaattctgtttatccactcaaataactaattgcttgtttagttgatcctttgtgttgtttatttggtcttgatcttatatagttctgctatgatctttgcctgatctttcttcaggcaaaataaagaaaaggcattgcaattgggaccaaaaaaaaaaaaaaatgtcaaattatctctgttaaatgatggcataattgtgtatcagaaaaccctaatgactcccccagaagacctctccacttgataaatgacttcagtaaaatttgaagacacaaaatctgtgtacaaaaatcagtagcatttctatacaccaataacattcaagctgagaaccaaatcaagaatcaatctcatttaaaatagctgcaaaaaataaaataaaatacctagagatacaattaagcaaaatagttaaatatctgtacaagaagaatgacaaacactgatgaaagaaattatacatgacaaaaacaaatggaaaaccatcctatgctcatggattggaagaatcaacatcattaaagtaaacatactgcacaaatcaatctacagattcaatgcaatgcctatcaatttagcaatgttatttcttacataattataaaaaaaaaatcttaatgtttagatggaagcaaaatagatcccaaatagccaaagcaatcctaagcaaaaaggacgaatctagaggaatcacattgtgtgatttcaaattatataatactataagtctatagtaattaagatagcatgctactagtacaaaaatggagacatagatcaatggaacagaaaagataactcagaattaaagcacacacttacaatcagtcgatcttcaaaatgttaacaaaagtaaatagggaggaaagatgctctattcaataaatgatgctgggaaaattggctagccacgtgcagaataatgaaactggaaccatatctctcactgtgtacaaaaatcaagtcaaagtggattaaagacttaaacataagaccagaaactataaaatcctacaagaaaacctagaaaaatctcttctggacatttgccttagcaaataatttataatgatgaccctgaaagtaaatgcaacaaaaacaaaatagacaaatgggtcttaattaaactaaacagcttttgcacaacaaaataaataattaacagattaaacagataacctaaacaatgggagaaaatattttcaaatcatgcttctgacagaagactaatatccagaatctacaagaaactcgaacaactcaacaagaaaaaaaataattccactgaagagtgggcaaaaacacggacatttcttaaaagaagaaatacatacagccaacaaacacataaaaaattgctaaacatcagtaatcatcagagaaatgcaagttaaaatcacaatgagatataatctcacccagtcagaatggttaatattaaaagtcaaaaaacaagagatgttggtgtggatgtcaagaaacggcaattgtttatacactgttggtgagaatgttaatcagttcatcttctattaaaaacagtatgtagatttctcaaagaagtaaaagtagaactaccgttcaacccagcaatctcatccctgagtatctacacaaaggtaaagaaatcactgtaggaaaaaggcatctgcatttgtatgttcaacacaatactactcataataggaaagtaatggaatcaacctaagtgtccaacagcagttgactgaataaggaaaatgtggtgtatacatcatgacaaactgtgcagccattaaaaagaataaaattatgtcctttacagcaacttggatggaactagaggtcattatcctaagtgaactcagaaaataaaatattccatgttctcattcataagtggaaactaaacaagaggtacatatagatgcaaagatggaaataacacacctcagagactcaaaaatgagcgagggtagaaaaagtttgagggttgaaaattacctattggttacaaagctcactatttggctaatggatagagtagaagcccagtccctaaccaatatacaatataattatgtaacaaatatgcatatatacccccgaatctaaaataaaattaaaattaaaaaaagaaattaatattagctgtagagagtagtatatcttcactgaaaagttatatgttaattttgtatggtgcaccagaatatataaaagtatatttacagtacataaaaattgtaacaaaatatatatttccttttaaaatggtttctggaataaacgactcaacagaaaagcaagactaaaggtaaacaagaaagctatatacatataggtttcttatatatgtgtgttagtatacatatatacatatatataattttagattcaggtggcacatatacatatttgttacattattatattgcatagtggtggggattgggcttctactctacccattagccaaatagtacatatatatatagatatagatatagatatagatatataaatagatacacacatgcacacctatgcacacatacatacatatatttaaaaacacagctaatgtataccttacatatatattacatacacatatattttaaaagcatgttcccattagtccgaaacacagaaatggattttatgaatttgtatgccagaataagacatcacattgagttgtagaatattccaacactgtgggttcatgagccattctgaaaaataaattacaccaataatggattccaatactttaaccatttcttgcgaaattttctatatattaatattactaatttgtaaaaatatttacattatagtcacagacactaaaaaccttaaaatcattgaagaaaatgtccattttcttagtaaatgaatgaatatttaaattatacagtaatgagcgaaatttagtaatgaactgaagtttaattcaaaattacaaattagcagcttagatcaggcatgattcctcatgccagtaatcccagcaatttgggagaccaaggtggaaggatcacttgaactcagaagtctgagacgagtctgtgcaacacagtaagacctcatctctacaattgtttatgtttatataaatataattatatatataattatatatatatataattggaaactcatttctctgattaaacaaaggaatgtaattaataaaacactgcaacctcattattcataaagaaatagtctacaatttgtatttcactctaagcaactcatttaggagcttgaaaattttatttttacagttttttaaagcacaaaatgagcacattcaagctaaaactgataaaatgggaataataccatccatgtgagtggctgagcctagtaataatttgcagtaaatattatcacaaaaagttggaactggaattcttgggaaactgttttctgctgaataatttcaagttggaattcagttctggtaaaaaaaaattactgctgatatgcactaacttgattgtcacaggttagcatgtaaatgaagaaagatttaagcaggtacctgtctaaattaatgtaggcagctgttacaagtacatgcattcaaacctcagggcatagctctgcctctctaaaaaggacttgcccaagatcagaatatagaataagagctttacattttatctttatttaaattctccctcccctttttgtggaattgtgagtgagcagcaatactacatgccttttataaccctttctaaaaatatattgaccacagttttactaacagttagaaaattggagtatgatctcaaatatacttaatgaagacacacattccacagaaaaaaattagtttaaatttagtttcctaagaaaataattattattatagagaaactattttgaaaaaggagataagaatttaaaatatttgtaaaataataaagttgattctccagtcatacctcaaaatcagtttcatctttagcacatttctacccatcaggggtgtgtgtgtgtgtgtgtgtgtgtgtgtgtgtgtgtgtgtgtgtatttgaattgacagtgaatagctataaaataaagtggtatgaaacaggaccgaaaatgctagagaaagagaatgatgagagggcacaggtcaaataataaaatgagagatatggaattcagaacttggttttcaatgaagatcatcgagattcacaacaaagtataaatgcaatccaagtaatctaaggaatctagcaaaatgacataagagctgaaagacaaaatattcatttataaaaggaacaaactgatctgatgaagctaaaaagctgactacaaaaattttgaaaaacaatcaaaagcactacacagcagaataggccaagctgaagaaaatctcagagctctaagactggttcttcaggtcaactcattcggattaaaaagaagaaaaaaaaaacagagtaaacaaaataaacaaaatctctgagaaatatgggattatgtaatgagaccaaacctgaaattaatttgcatctctgaaagaaagagagagattgcaagaaacttggaaaatatttttgtgggtattaacattaaccatggaaatgtctccaatattgctagagaggttgacatgaaaactcaggaaagacatttgagaactatactcaaacacttgactagatgagcctaacagatatctatagatttctccaacaaaaaacagcagaatatacattcttcttacctgcacatggtacactaaaatcaaccagatgattttccatgaagcaattctcaacaaattaaaaaaaacacatgcacacaaaatcatatcaaccacattgagaccacagcacaataaaaatagaaatcaatacacgggagatctctcaaaactataccattacatagaaatgaaacaatctgttcttgaatcacttttgggtaaacaatgaaattaaagcagaaaacaagaaattatttgaaactaatgaaacaaagatacaacataccagactctgggacacagctaaagcagtgttaagaggaaagtttctagcactaactgcccacatcaaaaagacagatttcacactaacaacctaacaccacactgacaggaactagaataacaagagcaaaccaatcccatagatagaagaagacaagaaataaccaaaatcagacctgaactgaacaaaactgagatgcatcaaaccatactgaagaccaacaaaaatatgttggttctttgaaacaataagattaatagactggtagctagactagaaaacatgacagaagatccaactaaatacaatgagacgtgacaaaggggatattaccactgatttcaaagaaataaaacaaaccctcagagaatctggtgcagatttctagtcacataaactagaaaaccttgaaggaataaataagttcctggaatcacacaacctcctaagattgaaccagaaagaaattgcaaccctgaatacagcattaatgagttacaaaattgaattagcagtaacaaaccaaccaaccagaataagccctataccagatatatttacagctgaattctacaaagtggcttaacaaaatctggtaccaatcctactgaaactattccaaaaaactgaggagggacttctccctaacttactctatgaggccagcattattctgataccaaaacctggcagaaacatgaaggtaaaagagaacttcaggctaattactgtggtgaatgtagatgcaaaaatcctcaacaaaatactagcaaactgaatccagcagcatatcaaaaagttaatcaaccaaaattatgaaggctttattcctgggatgcaaggttagttccacatttgcaacacaataaaatgattcagcgatccatcgtataaacagaactataaaccaaaccacgtgattatctcaatagacacagaaaagacttttgataaaattcagtgtccctttatggtacacatcctgaacaaagaagacatcattttgaatatacctcaaaatataatagccttctattgactgacccacagagaacatcatactgaatcggcacatgctggaagaattcttcttgagaactggaacaagacaaggatgcccagtttcaccaatcctgttcaacatgatattggaagtcctaaacagaggcataatgcaagaggaagaaataaaatgcatccaaatagagaggtattcaaactatctctgtagacaatgggattctatgcctagaaaaccccatagtccctgcccaaacactcctagaattgataacgtcagcaaagtttcaggatacaaaattaatgcacaaaaattgtagcatttctatacatcaatagtgtccaaggtgagagccaatcaagagcacaattgcattcataatagctgcaaataaataaaatacctagaaaaacagctaactagggaggtgaaaatatttacaattagaattataaaacactgctgaaagaaatcagaaatgaaacaaacaaatggaaatacataccatgctcatggataacaagaatcattatagtaaaaagggcatactgtccaaagctactacaaattcaatgctattccattcaaactaccaatgtcatttttcacataattacaaaaaactattcaaaatttacatgaaaccaaaaagagcctgaatagccaaagcaatcctaaacaaaaacaacaaagttgaaagcatcacactacctgactttaaattatacgacaaggcaataataaccagaacagcatgatactggtacaaaaagaaacatataaatcaatggaacaggttaaagaacacagaaataaagctacacatttataaccatctaatctgggacaaagtcaactaaaacaaccaatgggaaacaactccctattcaataaatgaagctgcagcaactggctagccctatgcagaagactgacactggatcctttcctttcaccacatataaaaatggatttaagacttaaatgaaaaacttaaaactatgaaaattcttgaagaaaatctagaaaatactagacattgtccctggcaaggattttatgactacgactacaaaagcaattgcaataaaaacaaaaattgacaagtgggacctaattataccaaatggcttctgcacagcaaaagaaactatcaacagtgtaaatagagaacctacaaaatgggataaaatatttgtaaactagacttctaacaatggtctaatatccagaacctataaggaattcaaacaattgaacaaccataaaacaaacaaccccattagaaaataagcaaaagaaatgaacagacatttctcaaaagaagacatatatgcagtaaacaacctataaaaacattctcatcatcaataataagagaaatgcatatcaaaaccacaatgagatagtatcttacaacgctcagaatgactattattaaaaagtcaaaaacaaagatcctggcaaggttgcagagaaaagggaatgcttaaacaccgctggtaggagtgcaaatttgttcggccactgtggaaatcagtttggagatttgtcaaagaacttaaaatagaacaatcattcaacccagcaatcttattcctgggtatatatccaaaggaatataaatcattctaccatgaagacacatgcatgcatatgttcactgcagcactacttatagtaacgaagacatggaatcaacctaaatgattatcaatagtggactggataaagaaaatgtcatacatatataccatggaatactacacagccttaaataagaatgaaatcatgtacttttcagcaacgtggatggaactggaggctattatcttcaacaaattaatgcagaaacagaaaaccaaatgccatatattctcacctatacatgggagctaaacattgagtacacatggatacagacaaaggaacaatagacacagggcctacctgagggtagagggtgggagttgaggatcaaaaagctacctattgagtactatgctcattacccaagtgatgaaataatctgtacaccaagcccccatggcatgcaatttaccttgtagaaaacatgcacatgtaccccaaacttaaaataaaagttggaaagaacaaatcataagaaagtaatcaaagtagaacccagatataaatccatgcattcacagccaactattttttgaaaaaggcaccaagaacaggaaatggggaaatgagattttcttcaataaatgatgctgagaaaactggataaccatatgtaaaagaatgaaaatggactcctatttctcaccatatacaaaaatcaaataaaaataaagacttaaatttaaacctgaaactatgaaactattagaagaaaatattgaaaaaatacttaacgacactggtctatgtaaagagttttctttgtgtgtgtaatatctcaaaagcacaggcaaccaaagcaaaatatagacatatgaaattacattaggctaaaaaccttctgcacagaaaagaaaacaatctagaaagtaaagagacagccagagaatggaagaaaatatttgcaaactatccacctggcaagagattaacaaccagaatatataaggagctcaagcaactcaatggcaaaaatagatgaaattaaaaatgggtagaagatctgaaaagacatttttctaaagagacatacaaatggcccacagttgtatgttgaacaatgaaaaattgttcaacatcactagtcttcagtgaaatacaactcaaaagtgcaatgagctattatcttaccatagcttaaattgattttatcaagaagacaaggaataacagatgctggcaaagacgtgaagaaaggagaactttgtacaccgttggtaggaatgcaaattagtgcaaccactatgaaaaaaagtatgacagtttctcaaaaaaattaaaaataaaactactatatgatccagcatttccactattaggtatacattcacaaaaaggcagtatattgaagagatatcttcactcccatgtttattgcagcactatttgctatacccaaattatggaatcaaccaaagtgcccatcaatgaataaagaaaatgtgagatagatatatatatatatatatacacacacacacacacacacacacacacacatatatatatagttgaatattgttaagtcatacaagagaatgaaatcctgtcatttgtagcaacatgatggaacaggaggtcattataagtgaaattagccaggcacagaaagacaaattgcatgttctcactcatatgtgggaactgaacaagtgactatcatgaagataggaatttgattattgggtaccagtggccaggaaaggtagatgggaagggagggtgaagagagtttgaataataggcacaaatatacagtttgagagaagaaataatatctagtgtttgatagatcaatagggtgattatagtttgcaatgattgatagtatatttcaaaatactaagaataatttgaatgtttctagcataaacaataaatatttaatggatatctcaattacactgatttgatatttacaaattatatacatatatgacattatcacatgtaacctgaaaatatgtacatctattatgaatcaatgcaaaaattggaaaaaaaaattaaaaataaaaataaatataccaacaatgctgtgaataaaggtaatcaaagcagcacagtagaatacagagagcatggaatgagaagcagacaaacttaaattcaaattcatattaggagacttctagctaaatgatcgggggcatatcacattaataaaaattattaacctccagagagccagagccagagacagagcaagtcagacacagagaatgaaaaaacatccaaactaccaatatccttatgaaagacgggacatcactatagaacttaaaaataacaaaaatataataaggaaatactgtaacaactctacatttgcaaattcaccaacaaatataaaatggaccagtttccttgaaagacacaagactcactcaagaaaataatggataacctaagacatgtcatatatttagtcaagcaattagatttagacttaaaaattcttccaacaaagaaaaattttgtctggatggactcactggggaattccactaaatgctgaagaaggaattttaacaattctgaacaatcccttccaaaaaatagaagaggaagtaacaactctcacctgattttacaagggagcattgtcctgatactaaagtcagacaaaaacatgatcaagtaaaacaatgaactaatctctctcatgagcatagatgcagaatttcttaacaaattattaacaaattgaatatggcaatatatacaaaacatactacatcacagtcaggtggagcagattccagtaatgagagcctgtttcaacatcagaaattgagtctacataattcttaatattatcagaataaaaagaaaaatcaatagattcagaagaaaagcatttgataaaattcaagatttgtttatgatatacactttcagtaaactataagtacttccttaacctgatagagtttgtctacgaaaacgtacagctaacattataatggcgaaagactgacaaagcaagtatatctcttcctcatcactactatagaacattgttttggaacctagacagtaaaataagacaaagaaaattaataaaatcctccagattggaaagaaagctctctctattaaaaagagaacatgattatctatgtagaaaatatctgaaatctcaaaaatgaaaagaaaataaactttcaagaatagcaaaagaatttagtaagtcacaggatacaaaaatcaactgcatctctgaatgttaacaatgaacatctttaagtcaaaaactgtaaccataccatgtacaatatcataaaacaattagatatttaggttaaattctaacaaagtatatgcatgatctatattcagaaaaatacaaaacacaaaagaaatgaaagaaggcctaagtgatgggtatacatattctgtgttcatgtatttgatgacttattaatgagataaattattcccaaattgattctatacatttccaattgaattcttagcaggatatttttagataccaaaaaactgattataagtttacatagaaaaggaaaataattataatatccaaaacattttgaaaaagaatttatttcaagatctcccactacctgatattcaaacttttttaaagttatagtaatcaggacagtattttattggcaaatgggtagatacacatatgaaaggaataaaataaatagaatataaatagaaccacacaaatgtttattttctgacaaagttgctttaaagacaataataaaaagacttaattttaaataaatagtgccagaaaaattagacctccaaacgtaaaaacaaaaatggaccttcacctgtacttcacattttttatcaaaatcaacagtaaaggatatagatataatatagaatgtaaaatgttaaaactttacaaaaaaaaacaaagaaaatttggaacataagtttaagcagccattttatagaaagaatatcaagagaaaaaacattattaattggactttaacacacttaaaaaaatgctctgccaaaaaacatatttaaaaagtgaaaagactagtcaaagattagaaaaaatatgtatttgtcaatcccctatctgacaaactgtatgcattcaacacagagaaagagcaattatgacacgataataaggaaaatatgtgggcaaagttcagtacaggcactttaccaaagaagaaatatggactgcaactaagcaaatgagaagatgctcaacaacagtcattaggggcatgcaaattgaaaccacattataatatttttttaaaggctaagattacaaagaaaacaaaaccttgttacactaaataccagtgaggaagtagagcaattgacacactcatgcattgctggtgaaaatgcaagataagacaacaactttggaaaatagtctgccagtttttaaaaagtgatcatttaactaccaaatgaccttgcatcaccacccctaggtatttacccaaaacagattaaaacttatgatcactcagaaatctatgcaaatggctatattgcccttattcataatggtgaaaaatggtaagcaatcgaaatgcctttcagctaataaaaagaaaaatgagctctggtaatccatacaacagagtactattgagtggtaaaaaaagaacgaaccaactattgatacctacaatccatgtggatgagtatcaaatggatatcctaactgaaaaaagtcagattcaaagggtcatgcatgatttaatttacatgacattcagtaaaaagcaaaactataagaaagagaaaattttgctacaaagcagcagcatggaagtttctttggggtaatgaaactatttcagtatctttattgtgatggtggttacaagactacatgtttgtcaaatataatatttcataccctaaagtgtgaattttactatataaaattcagttaaaatcattaaactatacatttcaacttattatatgaaaactaaatcataatacaactgacttttaaaaaacatctggtatattaaccactttattatactatccctttatagaaattctcatgttaaatctatatattttatgcatagaaaaatctacaagaaaagatagtctcaaaagtatatttgtccatgaggattttgcttttgaccaatttggttaattctactattttattatttgagtgtcttgaaaaatattctgtgtattttctgtgtcagtcagaatgattgccattctaactggtgtgagatgatatctcatagtggttttgatttgcatttctctgatggccagtgatgatgagcactttttcatgtgttttacactgttggtgggactgtaaactagttcaaccattgtggaagtcagtgtggcgattcctcagggatctagaactagaaataccatttgacccagccatctcattactgggtatatacccaaaggactataaatcatgctactataaagacacacgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaaaaaagaaatatactttctgaatgtcaagatctcgactttctttccttaggtcaaactgcattttagagttatccctcttgagcacttagaagctgcaataatcctggcaattggcaaactggagactgaatctaactctgtagcatgtgaccatagacaacagtatcatcacattatttctctaaaaaacagccaccttgctcttgataaatgctgtaattcccattttagtagacaatccttcctttcagaatcaggtttgccatttgattttatcaatcacaagtttcaaatgatcaataatccattagaattattttcaaaaaaatagcttttggaagatgatttcaacatatttctttctctctcacccaccccatcccccaacaaacgcagccctcagtatttataaatgtgccccatgctgctttcttggtcatgctatgaccatcaccagcattacacatgttgttgtacttatcttctttctaagaatacttcaatcatcatttagtacaaaataaaattcatgtttctaacaaaaactcttcttcatctcggcaaaaggagaactctttcctctgcagttgtgtgtagtttttgtatgagtttagtaagatatattagatggtacttcatagtagttacgtaggtctgaatataccttcttctactaggttttaaggttcttaaagacagtatatcagcatttttgagaaagaactttaggcgaaaattcatgtcccatatttttgttaggaactatgattctagagaatagggtgtgagggaaaaggagagtgaggcaggaagcaagcagggtcaatatgacaatgcattactgagctggtcactgatggcatcaggtataacgaatcacttgattttgaaggactgtcttcaaaaaggtcaaataatctctttccaggggggacaaaatcataggccagcttctgtttctctctgaattaaggtttaccagagggagcactaccttcctgtacaaatggattgcacatccatgagtgctacaagggtcccaaagcattacatgcctcagtggcagcactgaattctcacagaagacatgaaagaagcacagaaaggacctgatgttagacctgccgggtgcttcttatgcgaaactggccagaggtcactcatattcgttgctccaggtgctggcgctgacccagtggctatctgccctggatataggtgacactgaaagaacctgaagtggcacataagaggtgtctgattgagcatgcatttgtggtaaagctgtaaccataaagctgaagttcatctttgaatcacccactatactacaaaatggtgtatacatcaattattaaaatacttgctaaataaataagatttctaagaatgtataatggaaaggtaagagtgaatgctcacaatataggtgagcaatcctgcttacagaaaaggtaatgagttagtaaattccaaatgtatgaaattgaaaagagtgttaactactagtgtaagtacaaaattatacaaatactttgctgaaaagtcagggccattttcttattctaattttagtgaaaacagctgtgtgacctctctgggcctcactttttttcatctgtgaagtcaaaagcataaatttgatgacatttaagattttagtcaaactttgaaactgatgtgtttgaagttctgaatctatggcaaataaataattaaatattaatttattaggtatgattgagtacaaattgtgagttaggcacctctccagttcctaagaatacagtaatgaaaaagcagatatgaatactgccctattcgagtttaaatcctaatgtggagagtcacaaagcaaaataaatatctatgcaatatgttagaagtggggaggccagagaactgcattgcatgtttactcgggtggccagggtaggagtcactgaaaagctgagctgaaagatccagccaaatggataatgggggaggagcactctaggccattgtctgagcagggggtgaacttcacatgttctggagaataacgaactctttgacttgagccacatgatagaagttagagactgttatgaggatgatgccaaagagttaagaaggacagatcatgtagcaccctaggacattttgagaaatttgggttttactcagaatgagtcattgaggattttgagcagataaatgtatagcttgatttaggtttataaaaggatcaggatcaaattggctgctatattgagaatagattataatggggcaagtgtgtaaacagagatatggaaataaatagtttccaaaagacacatctagcataatttctgtaaggtaacaatgtggctaaaatgtgttttaatttagtatttttatggtcgtcagggtggttaaaaggttttatttattttaaagtaggtaaaacatgaatttactttacaaacatgtaaaaaacaactaataaaagttctactcaaactatttcaaaaaattgaagtggagggaatacttcaaaactcattctatgaggccagaattaccataccaaaaccagacaaacatgcaataataataataactataatccaatatctcttataaacacagatgcaaaaatcctcaaaaaacactagcaaactgaattcaacaacacaataaaaagatatttcaccatgattaagtgaattcatcccagagacgcaagtatagttaaacatatgctaatcaataaacatgatacatcataacatatgatcatttcaatagatgctgaaaaggcattccataaaatccaactttccttctttaaaaaaaaatttcctttggttattatcttgattaaaaacacctaacaaactaagtataaaagaagtatacctcaaaatagtaagggccacatctaacaaacccacagctaacataatactgaatgggaaaacattgaaagcctttcctctaaggtctgtaacaaggcaaataggctaactttcaccactcttattcaacacagcattggaagttctagacagaggaatgaagcaataaaagtgaataaagaacattgtaaaggaagaagtcaaattgtccttttttgcagatgatatgatcttatatttagaacataaatattgaaaaaaacctaaggattccactagaaaccgttagaactgatccatgaattcagtaaagttgctacaaaatcaacatacaacaattaataacatttctatattccagcagtaaacaatctgaaaaaaatacaagaaagtaattcaatttacacagctaccaaaaacaaacaaacaaacaaaaacccgggaataaatttagccaaaaaagtgcaagatctttactggaaaactggaaaagattgataaaataaattaaaaaggagacaaaaacatggtaagatacctcatgttttgggattggaagaattaacacagttaaaatgttcataccagctaaagtgatctacagattcaatactatccctatcaacataccaatgacattcttcacaaaatcgaaaaaaaaaaaaagctaaaatttgtatggagccacaaaagaccacaaatagccaaagcaatccagaactaaaagaacaaagctatagtatctaaaaaacagcatgatgccgtcatagaaatatacacataagccaatgtaacagaatagagaacccagaaataaatccatgcattttcagccaactcatttcaaaaatggtgccaaggacatatgctgataaacaaatacttttcaatgaatggtgctgggtaaactagatagccacatgcagaacaatgaaaatagactcttacctcttactacatacaaaaatcaaataaaaatggattgcatacttaaacgtaaaacctaaactataaaataactagaagaaaacattggggaaacacttcaggactttggtctagacaaagattttttgggcaagtcctcaaaagcacaggaaagaaaagcagaaatagagaaatgggattacactgagctaaaaatacttctacacagcaaagaaagcaatcaacaaagtgaggagacagtccacagaatgggagaaaatatttgtaaactatccatctgacaaaagggttaataatcagaatacataaggaactcaaataagacaatggtaaaaaacaaataatcaaattttaaaatgggcaaaagatcttaatagatatttttaagagaagatacaccagtaggtatgtgaaaataatgttcaaaatcactagccatggggaacgtaaatataaaccacaatgaaatatcatctcaccccagttaaagtagctataattaaaaagacaacaaataaccaaagctgatgagaatgtagaaaaatgtgaccctcctacattcttggtgggaatgtaaattggtacagccactatggagaacagtatgaaggttctactgaaaactgaaaatagaattagcatatgatccagcaattccattccttggtgtatgtccaaaaaaaggaaatcagaatatccacaaaaaatctgcagtctcgtgttaattgtactactattcacaacagccaagacatgacattaatctacgtccatcagcaaatgaacagattaagaaaatgtagtatatatacaaagtggcgtattaatacattaaaaagaatgctactctgtcatttgcagcaacatggatagaactggaggtcattatgttaattgagctaagccaaatacagaaaaacaaatatcccatgttctcactaatatgcgggagctaaaaaacttggtcttctggagataatgactataacagtggttatcaggggctggcaagggtagggtagaggatggatgaagaaagattggttaatggatacaaaaatatatatagatagaaggcacaatttctagcatttaataacacagcaggagtatagctaacaataacttattgtacatttaaaaatggctagaagatttggaatgttctcaacacaaagaaatgataaatgtgtaagatgatagctaccccaattaccttaatttgatcattacacattgtatgcatgtatcaaaataccatatgtaccacataaatatgtattattatgtaccaatattaaaagaaaaaatataaacagaaatatatttatacattctcttttttatatactaatatttaaaactaaatcatactatatactagtatacaaaaactatatattaatatataaaactaatacatataaaaataaagccatgcatacatatttagtaactaaaaatgtactctttctctttccaagtattatgttgtgtattcctctcaatgccatgaaataagtaatttttcatttacagatgaggtcacatggtcaaggacatatagaaagtgaaaggaaggcttacatattagtgaagcataatcactgatggcagaaaaaaaatgaagaatggggtggtagattcctattactgctattaccaatgactacaaaattgatggtttaaaacaacacaaatgtatcttataattttggaagtcagaagtaaaaaataggtctcactggactaaaatcaaggtattgacagggctgtgttttatctgtaggcttgaggcagaatccatttatttgccttttctagcttcctgagtctggtcacattgcttggctcatggctcatggcccccttctatctttaaaaccagcaatggccacctgagtctttctcaatttgcatcattctgacttctatttctgcttctctcttcgacttcaaaagaccattgtgattatattggacccacctcaacaatccagggtaatgtccttatctcaagtcacttgagtggtaatcctaactcaatcttcaactttaattcccacttaccatgggctataacatattcaacaattgtgaggtataagacattaacacctttgagtggctaatgttctgcctactacaaatggtgagataaatttgaggtgatgggatgctagataagtcttttcctttcctcataacttttgtcagaatctatgtgaatatatatagcagaatatgtaccatcactatttcaaggctatcccatttaatttttgttatgaggtcattgactctttacagaaaacatctaacatgtcagcgctttgtccttattattgtatttatctgtgtggtcatgaaagaagtggtctatgtgggagacttttccaaattatgaatctagaatacccataaatatttagtctcacttattcctacagtgtgtatgggtaagtgtattatttttcataagatgatggctggggaaattgggaatacagaacatgaagacagttaacatacgtgccagcctagttgttacccctcattatattacagactggtaaatgtatctacctaaatggaatgatgatgctactcaagactgaagaaggtagccttagaaaattttctaatgtagatcgttgaatgttgaagaccttgccatgttaagtgatgtagagaaaggtcctagaatactggctttctcctgaagagacaatagatttccactgatgacgtagagtgacacatcctgagtaaggctataaggattgtggagactgactttataccagggtgaagtcgggacatgttctttcttcaaaagcttttctttaaggcctgcattctagaaaggagagacagtcccaagggtactttcctaatgtcatggtacactagctcctgtgttaagttggcagcctggggtgagggaagaagtcttcgtcacaaagaatacattgcccagtaggaaaccactatggaaatttatggacttaagttattcaggaacagtcatattgcatactgagtttcaaatgaccttgtgtagaaatattcatcaatgtcttacaatattcaccataagtctggtaaaagttacaaactggtctttatctaaccgtttgaaaaaagaagggataggtgtccacaacacagtgcggagtgtttaaaagagagccatacaagcactaagaaagccagaagtgagtaaccagcagaaaagtagataaaggttctgatctggatccagatgataaatggaatggcaagtgaaaatcgggatatattttccagaagataaatgttcctggatatcttggaacatcaagtaaattattaagttcttatatataataaagcaagattgtagattcatctttttattcaggcatttgaggaaagtgtgacttcaaggactattgaaatctgagacatatgttctgggtacattaaggagaaggtatagtagtattgaagaatataaaaatatatttaggtctcgtaagtcagcacttctccttacattaactatatgactccttcattgtggattattattccatccaaaatttcctatttagaaggccacatttggttcatgcaaatacgaaaagatgccataatcggagaaaaaagtttggagatcatgaagatgcaaacaggagtatttcttaatactttattaagcttatacgaatacactaaagtacagttttaatttggcttctaagtatactttactctatacaaattaccaccacttgaaagaaaaaaagagagccagagatgaatatatagtttccaacataatatagaggcatagtagcatccttaacatgacatacactgtgctcctaaatactgctcctaaatattaaggataacatgctaaaatttgtctttatccccatgttttgggttataaaatattagatttagaaaaaagaaaaaaaaagaaagtaaaaagaaaccactctaacacaaggaattttattttcataaaacatccatatccatatactttgtaggcagttttcaaaatggctttcagtgatcctcttctcttaatattcatatcctgtcctttcagcttgatagttggcttgagattaatcacacttgagcttaatcacttccaagtctagatgacaaaagcctttgacttttctcttgcacattcttttttgccttcttatttattagccctgtcaaagctgcttctatgttgtgagatgctttatggataacatccatgtggtaaaatagtgaagtaggcctcttgccaaccaccagttaggaataaccatggaggaactgagtcccaccaacagctacttgagtgactataaaagtggacccatcactggttgaaccttgggataactatagcccaattgacaccttgattttagccttgtgagatattcagaaacagaggatgcaactaagcattgttttaatttctgacccatggaaactgagataataaatgtttgctgctttatccagtaagattttgaataatctgttaaacaaataaatagtacacatacatatacaaacttgcaagataaaacataactttagaggaaaaaaagaaatcaagcaagaactagatacagttaacataaacaaaactcatcatatttcattacagcatgtggaaattgtgaagtatctttttcttatatatgttaattactcagtaaaaaattagagtatcgctgaaatctgtataccaaagttgaaaaagacaaagaaaacttatagaatgtatgggaggtggtgaaaagataattaaaagattcaaaatcaaaatttatataacagaatttgtattttaagaaaaatgtaaagtgttacaaaaagtatgtctccttctctggcagtaattatcctatttgctataatataataaataggttttgagtaactgttttgtggccgatttaagcagcaatccacgtaaacagacacctggatttccttcagtaagggagcaggaaatgacaattacattcttcagcaaaaacattttatctttgtttacagacattttgtgtgtgtgtgtgtgtgaatgtttctcacaaattgcaaaggccccccaccagtcttaacaaagaatttatttgaccattaactatatttcatgcgtaacatatattttatgacatgaattatattttgaatttagatttttacattttgttaattactacttcacaagaaggggaaaaataaaaaatcttcaaaaagcaattatagctcaatgatttaaatcaattcaccgggttatggttgtggcagataataaaaaattaaattcttcttccaaagctaagttgattactctgagtacctacctgtgttcttccaaaattttataaattacgtgtgattggagctcagatgaaatttagattgctgattgactttaactataggaaaaactattcaaagaaaagattaaatgagaaccaaatccttttatatacacacagaaaaaaaaacatgaaagtgaaagtgatctaatcagaagtattacaaaaaatagacaagaagaaccaacagttatacgatctctctgataatggtaaattctctctttaagtaggcatgttgctattgatgtatgctgaatgagtgtgttttagttttccaacatagcaaatctgacagtgaacttgaaatcagttagactggtaaggggtttctggctggattccacataatgctgttggctcatgggatttccttggtctagccaggtttagaaacagtttttaatcagttaatactggatttattatgttaaagaatgggggagggtaaaactcactgattcagaaactggataatatataagtgtataatataaaattaatctgcagcgaaggccagagtgctttcaaatataagccagtacatttctttaacagtttccaaatgtctgggaattttaatcactaattatagcattaagtgagccaagaattttagaaaagaatatacttttattagatattttcttgaagatatggcagtctaacaaggaacaattttagataataggaaaacttattggaatagtagtcaaaatctccttcctgaactgtgagataaatacttaaaaatttactaaatccttcattcataaataattcttattttccacctattaatttgttaggtgattgaatgttatcttgcactcttatgtacaatagggtttctcaagcacagcactattcgcattttgggccagatgacaccttgttgtgggggtgtcctatgaattttaggatgtttaacagcatcctggcctttctccacctgctggatgatttgcgccctcccagttgtgacagccaaaaatgtttctaagcactgtcaaatgtccttttgggggcaaaataattgtctgttaagatatactgctcaaaaagaaagaggggaggagagcaggtagtggcgatggttaatgggtacaaacatacagttagatgaatggataagatctagtattcatagcaagaaagagtgactacagtctgcaataatttgttcacattttaaaataaccaaaagagtataagtggattgtttgtaacagaaagaaaggataagtgcttgaggtggtgattaccccatttaccctgatgtgattatcatgcattttatgtctgtatcaaaatatcttatgtaccccataaatatattcacctattatgtatccacaaaaattaaaaattaatgaaaggtttctatgactcatgtgcaaatataattataatcttagtggtcacaaccagtatatatatttttatccttcttgtgtcagggttccccaggaccactctaaagtttgatgatatacatattcacaactatggtttattacagcgaaaggctacacagcaaaatcagcaaagggaaaaggcttatggggcaaagtccagcggacaccacgtacaagtttccaagaaacctctcccattcgagtcgcacagatgagagtacagatggtccccaacttacaattttttgactttacattgggtttatcagagtattataggcatttgtgacttacaatattttcaacttacaatggttttataaggtgtaacaccactgtaggtcaagaaacatctgtgattcatagcaatgagttgtaacaccagttgtggaatgtcctctagataagttcattagagacttaatgctaactgcttagcacataccacatttccagactttcagaaataaagcaattgtttagaaaaaccatcattgtttttacaaactgtttaggtactacacaccatgcttatcagttagggaatgacgagatccctttcagaaatccaagttcccagacaccagccactggtcaactttgcaaaaagatcattctaatcacagcagtctcaggtctgttatgttaaccctttctctatgctttcctacaaaatgttttgtgacatgtcagctgcattttaggcacccaaagacttatacaataaataggtgaactaattaatcaaccagtgatgttttcagttagaattccttaaatgtctctattgacacgtttgttcctaaggactcttacacctacaaagaggaaaatgttccacataataaagcataactacagttttataatagaggaaaattttagttaatcaaattgtaccagcattaacctgcatttccagaaaagtcttcaaacaactcaagatccaatgggaggaactcattttcagtgaaaagaaaatgatgtatggtaatattctggtcgatgtaactttcaaatgcaaccactaagagaaagaggaatttaaatttcttgaatctaagactccatgaataaccattttctgtcaaggagccaatattatttttaaaaataaaatcactcaatggttacatttttttttttttttttgagacggagtctcgctctgtagcccaagctggagtgcagtggcgtgatctccgctcactgcaagctccgcctccagggttcacgccattctcctgcctcagcctccagagtagctgggactacaggcgcccgccaccacgcccggctaattttttgtatttttagtagacacggggttttactgtgttagccaggttggtctcgatctcctgacctcgtgatccacccgcccccgcctcccaaagtgctggaattacaaggcgtgagccaccgcgcccgaccactcaatggttacattcttatttgagatatggagttgtctagagcccttcactcaagacgatctgctttagattaataggatgctttgagaaaataaacttcatgttacttttgagaaaatatgatgcacattaattttatgataattaatgttgaaacacctcccataaccacacatccctcttttatacacgggataaaattgttagtttagattttattacttaattattgtctggtcatcaccccttatcccctcctgaatatttaatgagaccaaggtccgtgctcttttttaattcacatttgtctctccaggaccttgcataggatgtagtaaagagtatttaacaagaatctgttaaaatgatttttttgaaaaagctcagagagataactgtccataccccatgtgtccccacggtatattcgatctttattttgaaggcaaacactatattttaaaaatcaaaatctaataaagataaagcaccatccctttacaggattgatttctttgattgtaaagtgtgcgaaaaaagggtttccggtgcactctgacaccattcataaaatcctaaccaggacctggtaaggccttagtttgtcaacactgtaccagaaatctctaatataaacaggctcatattataatcttctgcatttgtaatttttgagaacagggtggaaaagcactcatttaagtggaggatttttcttttaaatgctgtacttgagaatgtatcattattccagatgagacagataagacgcgttgctcccttgccctggcagtggatttgtttgtatattatgctttctaactctctttctttgctgagctagctattttatgtttctttgtgaatgactgtaccttaagggaactatattctgtatccattattttataaaggtgagtgggctcagtaaatgcctgaaaaagtaccttgactaagatcacagagttaacataataaacctgatagtgctgtaggaagaaagacctagttaggtgtggagtaaaacttagccttataattcccaggccaaagtgtttccaccatcaccaaatcagcgtcagtaactaatcaaataacaatttatttaagccattaaaaaatgtaatgctttcactgcaatgtgaacatatatttaaacatgatgacgatttgtaaaaacaaagatttttagaactaagaagaaatatatattacaaagtagttagtattaaataaactgtttcctggatcctgaatgatgataaaagtttaccccattaacactagggagcatattcaaagaatccaaaattctagcaattctttggtttagtagaagccacaagaagataatttatatctgaaattctgtaatattacagcatcccagttccttttgtgaaacccagagttccatttactcattcgaatggctatacttttttagaatctcttcaaatttgttccatacatactttttagatatgaactaaaattaggcagagtaatatagttttctcctcaatatggaattgaaaaaagaaatactccagttacattttccagctgagtactttggcttattattggatttgattttacctttaacagtgatacaaaggcaaatgcaattgacaaagttaaatatgtggtagcagagtttgaagtttaaaaccctacgtgcttgcttgcttgcttggttttgcttttgttttcttgagcaattgttgactactcagcctgctctgtaaagttaagagcatagactctggagtatcagatgtagattagaattctatttttgccactacctatatttatgaattaaaacttttttttaacttccctgatctcagttttctcatactttaaaagaaatttatgtgtagacaaggaggggtcttactactctcattagcaataaataatattattacttcattgtcaagtttcctactacctaggtacatgaagcgcccttgctctgtctctctttctctctttctctcctctctttcttccagtttcctttatttaacagcaagttaaaaatgcagttggagaaatcaatttattattctcaaacaatttattttacatttataaaaccgtagagatggcttatattgtttatgtgacattgtttatccacaggataaaagaaaaagagttaaacagtaaataattaaaattgttagtttatccacaggataaaagaaaaagagttaaacagtaaataattaactcccacagctatagtcattcctctttaaaaactctagtcaactaaccaaaggaaacacctttttggtgaatacaggtaagttagggcaaagttttggtagtgaaattgtaaagaatcgattactactgtgatgaatcaaatcataaagaatttaacttcactgtactatacaatctattttcaagttgaaagttagttaaaaatgtttcactttattttctttgaagacaataagttggaggcaattcaaacattttattatgaattatcaactaagtttatttaaataatgaatttatctttatgcttaatgcaaattgcatatacattgtattcaaaataaaatgcaaataccaaagaaaaattgttttctaaaataatgttacaagtttatatttgtttcacagtaaattatttttaaatttttgtcagtttacaaacaaaagattgcttaacaattgcaagcagcaaatttaccaatatataaaattcaaaatgttcttccaaacacaaatataattaagcagcaataaaagcttagtatatgaactttattaatagtggttatatctagtttgtagttgccaagaagtaccagctttacatgcactggcaacagtaataaacaatttatggctttctaataaacagatacgtgttaaaagcacatttaaaagaaataccagaagagtttataacatttagcgagcatatggtctctataaagtagtaaattaagtactttataaaactgttagtattaatactatattacaatattttatatttgtgctgcatagttttcaaagtatcatttagaaggattctaatatttttagaacttatttattcttcccaactttgccagataagatttatctctactatgttgaagaattaaaactgagactcaagatggttaaaattttgactgacgtatttcaccacttggtaggagggccaggactcataattaggtttgtgtaattctaagtcaatgattgttccagtttatcttgctgttgctcaaacaggtgtgcttttaaatttgcttataaaatatgcacaaacagatggcacctgctaaatacataactggcaataatatcttgatattttcaaatactcaagagtaatctagcacaaagagctcagaaatttgcaacacaatatattgcacccagaaaaaacccttaaaaccgtctagttcaatcatctatgttagagaaaaattggacaaatagaattaaatgtctagccaatttactatctagaaaatttcaaagttcagactcaaaaatcacttctttgaatccatttctagagctttctgtgttacatcaagaaaacagatttttttccaaatgtttatgtttctttgtccaatctaaaggatgaaagatactaattctctgtaatacataagaagaaaagagaattagacagtatctttatcaagtcccatcagattagcaacaaatttacaaaagtgatgttataaaactttttgactaaaaggctttcccaatattataaaaagggtatcacattatactgccatttaatgctattaagaaaacattacctactacaaataaatcttaccgtcatgtttctcaatctattataattaataaaatattaggaaaagacttgttttattgtgaaaatgttattcaatatattttattccagataaatggatattaaaggatatttatagtactttcaatttgttctgaaagctacatctgtattatcaggaatatgtataagcactaaacattgttgcagaatttgtctaaggctaacaccattttcaacaccatgaagaataaaacaggccgggcgcggtggctcacgcctgtaatcccagcactttgggaggccgaggcggacagatcatgaagtcaggagatggagaccatcctggctaacatggtgaaaccccgtctctactaaaaattacaaaaaattagccgggcgtggtggcgggcgcctgtagtcccagctactctggaggctgaggcaggagaatggcgtgaacccgggaggcagagcttgcagtgagctgagatcacgccactgcactccagcctgggtgacagaacgagactccgtctcaaaaaaaaaaaaaaacaaaaaacaaaaaacaaaaaacaaacaaacaaacaaacaaaaaaaaacaataaaacaattttcctatatgtcagaaaaaacttctttacagcttttatgaagtgtataaatccctgcatgaatatattcaactcagtgactctattacattctttgatgtccctcatgtttctaaaaaaaatgatgccgagtgtatctttaggatttgaaagcaatgaaagtatataaagccaactgacaggacctcacttatttcctgctggtttatcagccgtcaggaaggatttgcactcaaactcttccacctttccccccttgttatcaatggcatacatggagccacaggaagagtaacgcatagtgtggccatctaaaacagggtaaaattcagacagtcttatagaaataaagtcacaaatgaggttcgaaaataattaccaacagacacaaaagaagaatctttaaaactccatgatctaaatatatattgacaatataattctatgccaatgagtagttttgaattcagcaccatatactgactgcctatttatcacatactaaagatacaaataagtaaggagttacccacatataaatattccatcaatgtttgcacatccatggtatatattataaagatacatctagcaccagaggatgttgggtgctatggaataagaaaatagagacgtgatttttttttttattttcgagacagggtctctgtcacccaggctggggggcagtggcctgatctctgctcaccgaaacctctgcctcccaggttcaagtgattctggtgcctcagcctcctgagcagctggaattacaggcgcatacaccatgcccagctaactttttgtatttttagcagagacggggtttcaccatgctgcccaggctggtctcgaactcctgacctcaagctatctgtccacctcggcctctaaagggctgggattacaggcgtgagccaccaggtccggcagaggcatgaattaaaaacaaacaaacaaacaaaaaaaaaaacttaaattacattctcaccccatcaacttatttgatcttaccaagtcatttcatctctatcttccattttttaaccacagtgtaaaaacatttgacttttcttcccactatattgttgtaagtataaaatgccacaatatatgtgaaaatggtctgaaaatcctaaagcacttctatattgctctatatacactagagcaagaagaggttaaatggtttcccctggtagcaccttcctgagcacagaaaggtgacctcggcaccagggtgtactggctcacttccctaaatctggaatgtaatctgaagagtattacccaaatcctttttctattgttttttttttgttgttgtttttttgtttgtttgtgtttttttttttttttttgagactgaatctcgctctgttgcccaggctggagtgcagtggcgccgccaccacggccggctgattttttttttttattattattattttttatttttagtagagacagggtttcaccgtgttagccaggatggtctcgatctcctgacctcgtgatccacccgtctcatcctcccaaagtgctgggattacaggcgtgagccaccgcgcccggctccccaaatctttactgccaagaaaagtgacaggtttagtaatttcatagtggtttggataatttggctttcaaatttcctttagattagttcctttagattataacattgctaacactataaaactctagtttgagtgaaattcttgtggattcagatactgcaatcaacgaacattgagccaaggatgaattggtgctattcctggtcaattctctttggcaaataaagatagactcgttccatgattgaaagctacataaaaaatatctaatatcactacatatcaaatataatttaaaatataaaatcaaaattaagtccttattaagccttggtagattaagaaaatacaccattaatatgccgacacacatctaattattaaattaaggaaaatttttgtatcaatttttgattggtaatacagaaataaattttcactacaaagaaattttgaataagtattgacactgatataaagtacatcatttaattattatcattattttttcaaattttagttatatttagaagattagattaccttagattccaattcaaagactatatcccatatgattatttcagcttttttcagaatgcattatttaaaaaacaaaacgtttatggacataaccaattataatgtgctgctgctcacaaaacaattgattataaacatgccagaaaaaatgacacaagtcgcatatgtgttctttccagattcaagctattatcttctaaatattctaagtagatagtagattaagataatttatttgccatgtttttcacacttagagtttttctttcttttttttttttttttttttttttgggagacagactcactctgtcacccaggctgaagtgcaatggcacgatcttggctcactgcaacctctgtctcttaggttcaagcgattctcctgcctcagcctcccagtcccttgccatcacacctggcttattttgtattttcagtagagacagggttttgccatgttggccaggctggtctcgaactcctgacttcaggtgatgcacctgcctcggcctcccaaaatgctgggattacagccttcagccactgcacccagccaggtttccctttatgcagaaagcagcttgcaggcaatgctaatattggtttaattttcttaggaggaacccagtatagtacgggaaataattaatataatttgttcttaaaaatatagcttagtattgtattaatttttctagagactgagccaaatcaagtttattccaactaaaatactgcaaacatttacttaagctaatatgtcttattcttaaaatgcttaagggtgcagctctagaattatatttcttagtcacaccttactgcaaattatattaattggagaataaatttatttataatcctagacacgttttaggaagagaatttgaatggaataaacagggaagagaaagatacatcttcttatgataaaataaagatactagagatctttatgacacaatagtaaacatatatatgaattatgaattaatctaatcatgctcatacataaagatctaactgtgtatttttcattttaaatcagttaaattagttacataatctactgtataagattaataaaaatgaactaaaaatatctgttggctcatcagaataatgcagcacttttttcattgggttattaaggataatatttataataataagtgcatacaaagttcttattacagtgcgtagagcacaatggatgctaactggatgttactttctctctctctatcgtgtaaacaccatgagacaaggcgcggtagctcatacctgtaatcccagcactttggcagcgggtggatcacctgaggtcaggagttcaagaccagcctgaccaatatggtgaaacccccgtctctactaaaaacacacacacacacacacacacacacacacacacacacacaaaattagctgggcatggtggcaggtgcctgtaatcccagctactcaggaggctgaggcaggagaatagtttgagcccgggaggcagagtttgcagtgagccgagatcacgccattgcactccagcctgggtgacagagacagactctgtctcaaaaaaataaaaaagtaaaaaataaaaacaaaaaatagtaaataccatgagtgcaaaaagaaaagctatcttattactgacgtgtccctatcctttatatagtgtccattacgtaataagagcccatcagtcatttttttcaatatgtaaatacggagaaatatcttgactacagtgcaggactccatgtttgtttggctctctgctcaaattagacttttcttccatcaatatagaataagccatgcatagacatagtttctattaaaaatctgtaccctaatgagtagaatgggctcacacagatcttggaaaaatacatttagtaggcttggtgaaactgtaatggctttgtacagaactccactgcaacccacctgacaaactaggatatgctaaacaaaccagtcatttatgtgagcgtgtgtatgtgtatgtgtctttctgtctgtctgtctgtatgtatgtgaaagagagagagagagagagagagaaactatggatacttcctttataaattctggctttgccttgccttagaacaggacaacagacttcacaatttttctacatatatgcaaataaattctcggcactttaactgtctttgagttacactttgatacatccacagtgcaatttatgtcaataaaaatgaaattcctaagtaggagggagctgtgtcttaacgtgattagtatttggacttcctattattgtatttgaagacagaggatgcttggctttatgaagcaagctcccaattggattaccatatgtctcaaaaaacatgatagtaaatgtcttttgatagcatgagatataaaggagaaatataaaaatttgctttatgaatgttctgcttccagccggggtatattcagttgtagttaagatagttgtgttctattagctggggacaatttgtaactgtccttattagaaacatacatgtgtatgccaaactgctaagaaatgagaaatttctgtctatatcacctgtttttggcttgctcagaattctaccttttttttttttttttttttttttgagacggagtttcgctctgtcgcccaggctggagcgcagtggcgcgatctcgactcactgcaagctccgcctcccgggttcacgccattctcctgcctcagcctcccgagtagctgggactacaggcgcgcgccaccatgcccggctaatttttgtatttttagtagagacggggtttcaccgtgtcagccaggatggtctcgatctcctgacctcgtgatccgcccgtctcggcctcccaaagtgctgggattacaggcgtgagccaccgcgcccggccaattctaccttcttaaaaattggctttcctttagaaaactacttcatttgccttctttatggtagtcacagtgctatgcccaccaacaatgacaagtaagagacctaaataagaccaattagattattccttaaagttttatttatgccgagagagagacagagagagagagaagggctcctttccttagtaattgcaattatgaatttaggttgagttgtcagcagccttaatatatagctgcatggacaaatattgactgagagttaaagccaaacatcatgggatgcaagcaaaaggcatcaaaagaaacagattcctcaggaggtcttattgggtctctgaatacagccatgcctgaaaaactcactgtaagacccttcattgctttatattatttgagctgcttttctttcccttgtaatcaaaggaccactgacaaatactggctaagtagaatattaataagaatatacacgaaaaagaaaaacatgaatatgcttttggtataaatttacctaaaatattttaacatgcaaattagataccatgtagtttgttaactttaatagttcctcaaattaaaatgttttagtatgtaaatacagatggtttccaactttaaatggttcgacttataattttttatttgattgtgatgtgaaagccatactaattcagtagaaatgtttcatcaaattttgaattgtgatattttccaggctattaatgtatggtaaaatactctctcatgatgctaggctgcagaccccagccagccacaagatcatgagtgtaaataagtgatactctacagtgtattgtgttgctgacgctttttggatattgtcttttcacatcccatcatgtttacaaaatggcatttttgacttacagtgttgtaaatgtatgatgtgtttatcaggccacaactccatcataaatcgagcagcctctatatacacaatatgtatataattttgagtatctcttcatattaatgtaaagttttattttacacttcatttgtggctacttttttcctttaaataaaggcaatgaaaccagatcaatgagagtacttgaattaattctagttgtagaaaagcttggatgatacccttacaaaggaaacccaaataaaaacctaaccaattgaacttttgggttgtgtttggaactatctcttttcaatgaattaacatgtgttatgtgtttatgatgacaaatattagactatattctttaaggcttatcatcagcaaagactttccgggttataggacttctctttatgatttcatctttccaatttttctgacttatgcctgtattttcttttatctttgcctcctataggtctggcttcttctgtcctctcatttcctggtctcctactgactcgcctcttatctctatggcatgtgaccttgggcatgtctttcagtgcctgtcattcttcttatacttcacttcctgtctctgccttccctccccctccatcttactacttctcagcatccttatatacaggtgaaataaaatcacttaaaattatcaattagatttctagtaggaaattgaaaagtactatcatcattttctttataataaagaatgtgacatgatatttaaagaaaattatttttagaagtgttcaattccacttgaacactaccgggcaaacacctaaattttcctttgttcaggttgcaaaatgtgagcatttcctaaatttgctgtgaaccctcaggaataaagcaaaaaacaattttcaaaataaaaatgaacaatttaatagatttaaatatgaatgtttcctaaaaaggatatattaataaagttctgtactaatatatataaatcctaaataaatttccatttcaatacttccttttgatatttctgtcttctctctcttgatatagaaacaacctgcatgtatgcagttcagttccttaggcatatatgattcattcatcttaatttagaaaatatcaaggccatgcctgggagcagaattggggcattatttgtctttcggcagcgtatttttaaaattgttatgaataagtaaattgacaaaatcctttctaagatgtacagacattttcaatcaataatgcacactatcaggacataaaatcttccctaactttttgagaaatctttacgttttctttagggaatagattcacacttaggttttatcacctatcctacactgacgtttgggggctgaactttttgaggtaatgggtgcctctgtacagctgcaacccagaatgattctttcactactatgccctgagcaaaaacagtcttgggttacaggagtgaattagtgccttctcctgtttcctgcaccctttatttcatgaccttatcccatgtatagggcgagtaagagtagtcagttcatactgatctcagcagatagcgatataaacagatacttggctcatagggcataacttacatttactaagaaaatgctcaaaaccattcattgaagtttttctatacagactttcaggaattttaatgagtacttgcttataaaatgttgacaaccttaatcataaagtggtaaaaactaatatgcaatgtatcaagggaacaatacctccaactgttttcccagaatatactttacaaattaccaaagcagataactgaccacatttcctttttaatttacctcactagttctttgaagttctattcaccattagctctttgaataactgttttaaaacagatgggatgaacatctggataacacaacatatatattttttttatcaattgcctcactgatgtgaggaacatctcctcccacacacaccaccctgtgcctcatctaatgtgttaacactttggataatgagaacaacagaagtggatactaaatatcttattcaaattaactcaaatctgagtgcaaatgtggaagtatccatgcaattcacgaactgctgccccagactgtgtttttaacagcagtgtttgatgatgttggcactcttgatcattttctgtttttgaagttactgagttcaatgatccatcctttgtgtttatttatcaggactgtgaacatcacaaacaatttgagatgtttagaattaaatgttgattttagctggcagaaaaaatgcaaagttaggtaaattgatgagcatcattttcatgtatatattatctctttgttaacagttatctttcccagacataatggaaatggctgaggagtatgggtaaactgaagtatctgagttcaaatttatgcatgttaagatagaataataaacatgctactcttctgtgcagaaattcaatgccaaactaattcatgaaatactgtacaatactatacaatacaatatagttcaactatattggctcgaatcaatataactggtagtttaagtcactggtagttcaaagaaagaccaactagattctgagcctcaaacagcattattagggacttgcctgcctctttgtctggcttcctctacgatggcttacttttcaggctgggtttcttaataatgttggtaaatatgatcacaacaagctctaaaattctacactccttgcctttctgcctgaatcttgcccccccaaaaataatttatttcaggcacttccagtccaaattttaaaactgatactaattttgtgtagtttgggtcatgtttatgacctactaattagtcacagttgccaagaaaccgaatgacctaggtaatatgctcaactctgaagctaggctatcaggttttgaaaccaatggattaagaacaggtaagtagctgggcgcagtggttcatgcctgtaattccagaacttgcgggggccaagacaggtggatcacttgaggtcaggagtttgagacccgcctggccaacatgggggaaaccctgtctctacccaaaatacaaaaattagcctggcgtggtgatacacatttgtaatccaagctactcgggaggctgagacaggaaaatcgcttgaacctgggaggtggaggttgcagtgagccgagatcatgccactgcactccagcctgggcaacatagcgagactctgtctcaaaaacaaaacaaaacaaaacaaaacaaaacaaaacaaaacaaaacaaaacagttaaggggtaattctccaaaggaaaactatcattattttatcaaactaatgaaggaagcatgctggtcagtcaaaccaacctgtgtctataatcaaagtgcaagctttgcagaggagcttttaatacataactgaaatattattcataagtaattggagtattctggggaatagatattagtaaaagttaaggaaatagaatgacaacaagtgataacaacatatatatatgtatatgtatctcctaacattagtctaaacatagagtccataccactgacagcaggcactggacatggttagaggaccattctccttaccataaagtgagaactcagatatactctccaactaatttaaccttgaatcacattttacctatgtatgagctatagcataatgtcagagcatattaatcataaccatatagcaagaatattacagattaaaattgtcatagcttatttttcttgtcttataagaaatgctaattagggtgaaattcatgttataaaagtatttacatataaatacttcaagaaaaaatttgctggagatattagcagaacatgtcgtacttaaaaaaatgcaagaatttggtctaggctgggttgaatatgtttaggaaaacacagtcttttgaagaaaaagtagattgcaatatctcaaataataactagtgacaatgaagaaaataaagtgttcttatgaacataagagttgatatttgtaacttttatggcatagctgatgaatcattcagtaaaaccaaatgaaacaaataccttcaatctctcaaatcaaacaccatactattgagattttagctataactttatgtttgtcttgtttgaaaaaatacttcaaaaccccaaaatattttttgttaaaccatcttacatggttaaaacattccttttagagtaaacacttatgaaattcttaagcattgtaacttcatcattctaaaggattaaaatgtttattttaaattgaacatttatgaaatgcttaagcattttagctagccttttttaaagtgcaatcataaaaacaatggttttataatgaaagaaatatttcataattgcattcatacatttgaactgtttatacatgtggcaataaaatgaaatacaattgtgaaacacatattttatataaagtatagttgccaatgtttttgttttcttgaaataatctttttattctttttcgcttttaaagcataagtttgtgtcacaatttaaattcattctagaaacttgcagttaatccctgattacttgtcatgattagatattcagctaaggtatacatcacagaccatctgtgagaggacactatttcatttgtcttctgggtaatagggaggctcattttgaggatgaacccaccctgctcttttgtgaaagcaggagagtgccaggtggttggtagagataaacacaaagggtaataccggggaaaaagaaacgcagggctttcccagcaaacctttacaatattggtgcactacaacaggtggaaaacagtgagatgtcatatatgtgtgcaaagccagaacacatttcacaatttgtagctcagattccatgagacactaagaatacagatgttaggaagtttcaaatttcaataagggtagaatgtaataccaccttgaaaataccctttctcaactgcatgtacttatattgctaactggagaaaataactctggagagtaatcatggaactgtgtggagtttatttggttaatgggaccaaacatacagttaggtagaagaaataagttctagagttcaatagcacactctaaggtgactagttactaattcattgtatatgtcaatatagctaaaagagaatatttgaaatgttcccaaaacaaataaataataaatctttgtggtgatggacaacctaaatatggtgaattgatttttacgtgtggtatgcatgtatcaaaatatcacatttactttttatggatacataagagttgtactatataaatatatatatatatagtatataaatatactatataaatatgtacaactcttatgtatccattaaatgtaaatacatgaatagattaacaaatagaacaagaaaaaatgattagtacagaatatttagcctttttctaagtttcatgagaaatctgcagatttcctagggaaacttatgatagcctattaacatgcaaatataacgtattagatctaatttttaaaagtaaaaagggatttttttaatcgactcgaagaagaaaaagatcttttaccatggttttcttgtcctgggctcaacatgtaatgatgaaagcaaactagaatagaaagtaaggcaaagaaaaataaatatatatttttttcagtggtctctaaatgtcttataaactttgttatgtctcttgtctagctttattccaggcacaaactgatcaaaaattggttcactgaatgagcttgccatatcagatatagaaattttgagatttgctaattcaaagtacaagaacacagtaaatagtaagagaatacatgagcctgtgagtatattaaattcactggcatgttttttcatctatttccctttagaatctattacaaaacctagagaaatgtgactcctatgaaccactgttatgcaaaggtgtgccagattcattgtgtttagggtagaaaatatagctgggagtaagaaaataaaaaataaagattttaattccaagaatgccccaaactaagtaaatgatgtattaccaaatttttattgctgcataaaatacctctttgtgacaacccagtttacaggcaatttcagtgttgactattagagaactattaagctgagaaggtcatgtagcatagggtaaacctcatgacctcatctgttagaacatgtgttgatacgatagaccaaggaaaaaatatgctctgagtaagaggtaagcatgcaggatcaattcaaaatggtcccagatgaagatgccttctgagtatatgtcagggaagtgaagacaatgaatagttccatgcaagcaattcaagtgagaaagggcaatgcgtaaggcaaaataaatgagataagaagcaactgttgccctcaaagagcctggtaagaggaagaatttttgtaagtcttgcttatttttcattagaaaaaaaatttagaggcaaatctttttatttaggcatattataaaaatatttctgtatcctaactatgaatgagaaaataagcataaactcaaattataaaaagatccaacaggcaaaaagctatgacatacaacatttgtttgaggttgatacttgaaaagaaattacccacaagttgtggagaaaataaatagaaatctgtttttctccactgctttaagaatctatactaatttcaactctcttagacaaaatttcacataggccacgtgcataaatatttttatgttgccattataccttatatggcaagtaattcctgtatccatactaactttactctgttgagctaaatacctttttagcaaaaaatagaatgtatcaaaatcgtaaatgctgacatttattgggaaaatggaataaattacatgcgctataattctcaaacctgtttagtgcaaaatatcttaaaagatgaaaaaagttcagagagagcaatcacaaatggatagaaaggaaaattcaaaatgatgtcaagaaaaaactggaatattagctccaggagagcaaaaacttttgtcttttattttttaaactactctcaccctggtacccagaattttgtttggacatagtaagcactcaatagatttagtgaatgagtaaacacattttaaaacatcaaaagtattacctgtattacagtgaaaaatacctaatgaccttctacaatgtgccattctttatgcaaagtactttatatataacagcctgtataatcactgttaaaaccacagagaaagataatcatttattgatgagaaattagaagttcagatctattaagaaagtcatccaaagccatgctgacttcaaagtacagactctttactttaggacatggcataacctccagagggtaatgatattgagaaagctttgccattggaaacacaatttcatagacaagaagagaaggttatgttcacattacttttcatgcttcacatggcaataacattctgatctttaatgttaggatttataactttacactaaatactccatgatctgttgtctaaatggtaacaccaagaatcatcacttttcctctgtaataagatgtgcagtgtctttgtgtgaaatatagctatatacattgtatatcttctagttgagaaaattaatcatgcaatgtatctggaataagaaaaaaatacagcaacaataaaaataggacaataaaatgagtaatacgtttaaatttctattgccagaaaaattgttcaaaatagaacttatgaaagagaaatagtgtagcacaaaacaacagcagaggagaaatgatgaaaacaatgagagaaagagataaattagtgaaataaagttgaaaaaagtttcattttaacatcattgcattttgtgaaaaaattttacacttttacattaaagagtttaagcgtatactaaattgaatttcttacttgatgcttctgctttaaattatatcaacgcttaattaccatttaaagcttattattagttaatttatatatcattactaatgtcagcatcttgtcaggcataagagttaaatataaatttatattccccaggtgaatgcaattgatacaagaaaaaaaaaaaggagttcctttctctaaatgtatcacatagtgatacaactttttatacactacaaatagactgggtcagaagttaaaaaaagtagtttgtagggccaggcgtggtggctcacgcctgtaatctgagtactttgggaggctgaggcgggcggatcacaagatcaggagatagagaccatcctggctaacacggtgaaaccccatctctactaaaaatacaaaaaattagccaggcgcggtggcaggcgcctgtaagtcccagctactccagaggctgaggcaggagaatgacgtgaaccccggaggtggagcttgcagtgagccgagatagcaccactgcactccagcctgggcgacagagcgagactccatctcaaaaaaacaaaaaaaaaaatctatccactatacacctttttgtgttcttaatataatcttcccactgaatacacaatcatatttactaacgtctataaccataaatgctatattttaacattatagacttagtagggttgttacttaaacagaatacatgacaacatcttcatgttctctaatctgcagacaccttttcaggcttttgcaaaatacgtaactgtttggctcaaaatttattacgagttcaaaaatatttttaaatactgaatacaaacagagagtattgaaaagctattttaaatattcaagaggactggagaaaactcctccattaattttaatgatgaaattaaaactgaacctattaaaactaaacctattagtcatcaagaatgatgattaaatgaaagtatcaaacagaatctatgagtccatgctaataagtgtttagatcaattaataaatgagggagtagaggaaaagcctcccatttagaagaattccaattaaattacatagacagtccacactaaaggagggaaagcataaatccttacatcttaagtgtgccctggtgtaagaaacttctttcctaagagtacagtatgggaagggggaagaacagtgacatcacagttgagaaatccgacaagtcctatttcatccaggagatcaaggtcaaatttaatagtcataaattacattggtagtatgtaccattgatacaatgtgaggaaaataacaaattccctctgtaatatacctcccccaagcactagtcttatcaataggaaaagcaccaacaaatcccaacacatggtatgtattctacaatatctgactagcatgcctcaatactgtcaaggtcatcaaaaacaaagtccaagaaattgtcatagccatgagaagcccaaagagttaggacaactaaatgtaacatagtgtcctggtgccaccttggtatagatagaagacattacataaaaacttaggaaatatgaataaactatgaatttcagttaataataacgcatcaatatttattatctaattttaccaaatataccatgctaatggaaaaatgttactaataggtgaacctgtatgctggggtcatacggggattttctgtacaatctcctctatttttctgtaaatctaatttttttctattaaaatgtctattaataaaaataacttaaccaaagagtctaaatatgaatgtgattatatgcaggtctgaagggcataacagcatgagagcatagagagaatgcaaattacacagtccagaggatttgacaagaagtcttcttgctttgcaataagctgcttgggcacacttagataagtcatttaagcctcttttccctggtttgctatgaaatgaatgaacaggactacaagagttctgaggccccactgagctctgttgtccgttgatttacctacaaaatgatgtcaccctcagagagattacaatctacttgagaaagtaaacttgctaacattgaaacaaatcaaaacatatttaggaacatagttcaaggctgggatcatattctatgtagttcatattctcaggatttcagagaaactaagcagcattatgaaatacttaagaagtaagcgagacttaaggaccattttgaaaaattggaaaatatgaatgaagaagtgaaggacaccccatatcccaaataattggaatctgactcttacagcaaattctccttttgcttcagttttaggttctgaatggggtaaaatattccttcaaatccctctatgctttattatcacatatagcatgaaacccaagtgccttacatggtgtatcccaccttccttgacattgtccttgttagttttccaaacccatgtcatgccacttgtaaagtgatctgcattagcacagtcctgagctgtctttagtttcctgcacagactatagttttagtttgaaacctaaatagtgttctgtgccaggacaggactctgtctgggaaagaagtgtaaaacttttggacttggtttggaaatgctcgttcattttaattcctcagtttgttttgattatctgagcctgcagaaatgatgcacccaacatttctctcaatcattcaaatgatttaaaacagatgaaatttttgtatataatatatcagatttcagtgagttgttaacttctgtataggagccaacaggaattttaaaaatctgttgttaaacactaataataatcaaagttgcaagacacttcatgttgagaactacaaagacacagccatagataaagttaacagcgacctggtgtcactgctcactccagggtgtaagcttattgaatagaatggcaggcatgcttgacagcagagtacgcaatgcctttttttttttttttaaatctcccactctttttctattttatcaagcatacataattaaatttgttaagtgaaaggatgcttaaaacacttgcagggatgtttctcaggaacatcctgagatttttttttttttcaaaaattagtgactttaaagaaaccagcatcctttgcaaactcaccaaattagtgtgtgcgtcaccaagatagaccatattttcttatgggtgggatgctagcatgcaacctgggatcccaaaatgtgatatatttacaggaaacatcatcacaaaatgccatgagaaagcagactgtgtacagaatccattctgctaaaggtggcatcagagcatccatctttgggaagtagttgtgacaaagtttctagaatccagtgcctgagggtcagcagtccagctctggtgtctgtatccctcaacagtatttcttcctgcataagccagttagggtgaaatctgttctttgcaactcagagcactgatagacaatccttcttttcttctggtgatacgtttctctaattctttagcaaatacctttttgtctgtagttctcaatttttggttccctccttaactgaaagtaaaaactaatactctgttgtccagtattgtagtctaaacacatatgtatctatttacattaaattagttcaaattgaataaaattaaaaatttacttcttcagtcatcctgaacgcattttaacggcttaatagcaacatgagctaccagcaacaacatcaaacaatgcagatacagaaacatttccattactgaagaaagttctatcagaaagagctgctctaaggcatagaaaatttgactagggcatatgtttctgcatctacatcagagaatccccttttaatgagttaactgattctgttaatggtttcaaattatgaccttgataccatgacatattacattcatctttcactctattattcattttgattttgcaagtaagtttacaaatgatcagattagattcagagctcattttgttagaataacaaaaatttaatctcattactactcattcctaaacattgaagttttcctcccagttaccttctcatgaatgatattaaactccagagtaaaatctgaaggctgacactaacagagccatccttttcagaaagtacatccaactatgttaaagtgttcattttagttcaacgatacctgaaatgcaggctgtgaggtggacatttaggatatgtacctgcctagcatacatttcccatccttttactaagagtactccaatttttgaagtctcccctagtatacaaagtcttggtacttctgtcagtcaagttattttctcactctcccctggccttgtgcttgacttaggaaacaattaaccaattggattatgctgtagaaacttacaaggagggaaattaaatgaagttacttaatctcaacgaaattacccaaatatatgctcatgagttccccttcactagacccccagagctgcccttattttgtccttcctgagttttgattgttcaaaatttactttgcatatgtgtcctcctgcaagattttaatgataatttttagattttgcttttagaatagccagttggcttttgcaaaagtattagatgatatcaatgtgcccatatttttacctacttgggaactttttcaaattacatctgttcttgatattctgaaatgccacgcttacccctttcttatctgtcttggtagcctaccacactattgacacactcatcatgaaccagataggtactttgaattcatctgcctgagaataatttaaccttcatggtctatttctgccaaaatactgctttaatacccccaatatttgttaactctatttgaagttaaatttctatctgtttgtgctttgagagatgttggcaaagagaaaggaggaaaataaactattttagataggcctagccttgtcaaatgtgttggagactttatagaaatcatgttgtcaaagtgatcaatttaaagaaaaacatacttatgtcttcttattttctgtatcaggatgtaactgaatatcttttggttagacatttgatcatatgttattttcccaaaccatcatttcaaggttattatcataagacaaatcactctaaaatctaatagttcaagccagtcagaattgagtgatgaaaatatacagctttatttataagtacattttatcattaggcttgaattggttcagacgtcatgaaaaattttgcatgctagtagtaattcctcaaactccaaagggattagagtttaacaaaattgccaatccaaaaaaaacaccaagcaaacagacatttattttaataagtacaaattacacataattataaatattccttatactaatatttaaactcagcagacagaggacaggttgaggtttgatttatattcacacttccgtcttaaaattttcaaaagacatcttttatttgcttacacatgaagaatgatcagtatcactatctgaatataaattaataagtgaaagtatctgtatatgtaaattcaggcaaactcaggcttaaaaatctaccttattgtaccacattgcaaaatagaaaggattgtaattctttataagtattcggtggaattaagtgcaatgcaaaacatgctatgaatgtcagctgttatatggaaaacatctaccagaaaagccacccatgagtccactcagataataatttttcctcttgtctgttttataagctgttgaggaatatataaaagaaatggaaatttacaaatttcaaataaatgaaacatacatatttttatagctatataatattacatacatttaaatagttacttgtattttattggctcttcggctacattccaaaacttaagcaagttaatttaggaagagccattaaatgcacgttctcaggcatattttcctacttgtaatgttcatgttcaaacatatttttcaatatgtaaaagtaaagtctttgtaaaataaataatttaagacattccttgtattataactgcattcagaatgtataatacaattatggcttggaaaaatcaccttaaaattttgtcttatctttttgttgtgcagaagctccactcaaaagaagacatacatgcgtccaacaaacatatgaaaaaaagctcaacatcactgatcattagataaatgcaaatcaaaaccacaatgagataacatctcattccagtcggaatggctcttattaacgttcaaagaaacaacagatgctggtgaggttgtggaggaaagggaaagcttttacactgttggtgggagtgtaaattatttcaaccattgtggaagacagggtggcgattcctcagagacctagaggcagaaataccatttgactcagaaatcttgttactgggtatatacccaaaggaatataaatcattctactataaagacacatgcatgcatatgttaattgcagccatattcacaatagcaaagacattgaatcaacataaatgactatcaatgatagactggagaaggaaaatgtggtacataaataccatagaatactatgcagcataaaaaggaatgagatcatgacctttgaagggacgtggatggagctggaagccattatcctcagcaaactatcataggaacagaaaagcaagcatttaaagtgggagctgaattatgagaacacacggacacatggggaacaacacatactggggcctgtccaaggggtggggggcagggagaacatcaggaagaatagctaatggatgctaggcttaatacctaggtgatggtatgcatctctgcagcaaaccaccatggcacacatttacctatgtaacaaacctgcatatgctgcacatgtaccccgaacttaaaagctgaagacttttttttttcttagagggagaaactagatctaaatgagtcataaaatacaaatgaatacaaatgcttaattctcctaatacgtcatttttaataaattaaaactatgcttatcagttcatgtgggattgtctaaaaattataaatgaaagatttaaattctctaccttcacaaatcaggtacagctagcattgatgtcattgagatttggctgatggtacatcattagattctataattaatcaccaacacctgcagatgcattctcaacatgaaattacttttgatatcacatggagaaggagagatctcactaaatcttttaactatgagtactttggaggtaacagagatgattgtcatcttgtcacactgagacatgttgattctagcacttttggattcttccatgaatatgttaaaccattaccaataggtcaataacctgcccttttcacccctgactagaaacactattttaaaagagttcttattgatttttttctagctgtttttatttttctcactttctaaaataccaagaaaatatcattcaatgctgcaaaaataacctaaagaaaaaaaatctaggagcatcatacaataaaaatgaactgatttcttatgaagtcagcttcaaaactgtgtaaggcccaattcttatctctgacaatctgttacttaacatttgctgcttaacacttcataaaagtcaagtctagatgaactggcatacttcataggctttttttttttttttttttttttttttttttttttttttgagacggagtctcgctctgtctcccaggctggagtgcagtggcgcggtctcggctcactgcaagctccgcctcctgggttcacaccactctcctgcctcaacctcccgagtagctaggaccacaggcgcctgccaccacacccagctaattttttgtatttttagtagagacggggtttcaccgtgttagccaggatggtctcgatctcctgacctcgtgatctgtctgcctcggcctcccaaagtgctgcgattacaggcttgagccactgcgcccagccacttcatagtcttataaataatttactgtaatactcattaagggcagtaaaacaatcagcagttactacacactgacagattcaagtatagagtgaatgagatactatgtatctactatatcttgaaactaaaacataaataagtgtcacaaatttaaaatatacatttaaaaaagaatagacacacacacaagcacacatacatacaatcacatacacatccaaacacaggcgtattgttatacatgcatataaattaatattaaataaaacttatgttttaacaaactctgtatacttaaattcaccagtggttagttatcccaggcagtattacctactaagccttagggaccattattttcatttaaattccagtagtaggtaaaacctaaatgtcaaaacttagcacaatgtttaatgagtggataaatattagaaaccacgtctcctgaaatcttaggtaagtcattattaggggcttactactttcagtacctgacatttactcctttttttcatattagttttattttttattaaatgtcctcctgccttgaagataatctatttaataaagaagaaaaaaaagtgcttttttactttgaggtttacttgaacataagcatcacctttgtaattccacacaagcgtcacctttgtaatttgtcctttaagacaattagactgttttatatcaatgtattattaaacttgattgcacttatgcaggacatattataaaagaattatgagggaagtacacagatgctgttagagtctactaaaaaatagattatttactattggaaacccaaaggagagaatgcctcaaaaatgtggtaataaatacctgtgggaaaatcttaagttgaagaataatcctggacataattttatttactattgttattatatctttatcctaacgagattaatgactgatgttttcactgcaatttcagttaataggaactctatacaatgaaattgcttgatcaactgatagttttttagtttattgttttattgacacataatagttatacatgtttatggagtacatagtgatgtttagatacacacaacgtatagtaatcagatcagggtaattagcatatccattatctccaatatttatcatttatttgtgttgaaaacatttagtatcttctagctatttaaaaatagatattattgttaaccattgtcattctacagtgctataaaatattagaacttgatcattctatctagctgtaattttgtgttccttaacaaatatctcggccgggcgcggtggctcacgcttgtaatcccagtactctgggaggccgaggcgggcggatcacgaggtcaggagatcgagaccacgaggaaaccccgtctctactaaaaatacaaaaaattagctgggcgtggtggcgggcgcctgtagtcccagctactcggagaggctgaggcaggagaatggcgtgaacccgggaggcggagcttgcagtgagccgagatagcgccactgcactccagcctgggcgacagagcaagactccgtctcaaacaacaacaaacacataaaaaaaacaaatatctccacatccttcctttccctctaacctttccagcctgtagtaacctgttttgcattttacttctatgagatcaacttattttagcttctgcatatgagtaagaccatgcagtgtttaacttttggttcttatttcacttaacataatttcctccagttccatccatgttgctgcaaatgacagaacttcattttttatgtctgaatagtatttcatgtgtatatgtgtcatattttctttattcagtcatccactgatagacatttaggttgattccataccatgacaatcacgaatagtgctgcaataaacattggggtacagatttctcttcgatgtactgattaattttcctttggataaatggtcaatagtgagattactggtatgatcattttaatttaaggaggtattcatcaaactggttgataaaattaactagtcccagcttaagatatctgggatctagaagcactgtttatatactttgcatgagacacagttctaaccatacaattaaaaaaaaaaaagattccaagcagttcatacctgtagcctcagacttaagcttaccctctaattagttaaacattagggcaatgattttctgcctgtattttataaaatgtcttcatgctggtggtagagtgaatgtggaggaaaagaacatatttaagtggaggccattcatgatataagataccatggaaagcttgagttttcagtttaggctacagaaaatgcaaataaataaattaaacagttggtttaaaatattactacaagtaggattttcccctgaaggaaggcttggttttgtcatgttttatgctcggtttgttaggttttattgttggcttcatatgtctcttgctgatgggagtatgtgacgtcaccacacggcatagagaggaccaagaagctgtcccagtatcataacagaaggagactggaggcaatgtgagaaataaaaatgcagagttaagaggaggtttatacaaagaaagaactagggagtgcgaagaagagacataatttaaaagaaatgttttcttttattatggaaaaatatgctgtttatagtataatgtgaatcctcttctcattatttttactcaaacttcattaaaatatcaatttctggttgatgcgttgtgctttttaagagataccacgaaagaggacttaggtggttattctggaatatgggtatttacgatgagtaaggtgactattttcatgcaatcatttcagaatcagcactgtgagctgtcctgccttaagacaatcgttgcgcacatctatacaatactatctatttcactccaccaccataccaatcatcgagcgctggctgctcagcagggtgcggatgtgtacttgaccatagccatagtggttctcttgagatgcagacagtttctacactaaaaatgagttgacgtttaggagaaagaaagaacaatcttggtggtatccatttgaaaaagggaagcggaacttcaaggaaatattggcacaaaaactaagactgcttacaagaggattacctcatctgggttagaggaggatttcaaggatatgaggcgctctcatcacaataaagcagacattcccaacagtcacagaagcaggcaaatgaaagatgatgtaaacttatataagacttgagttgcttcatcttaagcatccatccaatttcagtacatgggttcttttgctgtttcaaagttctttttttttcttttagtactgtacatttccatataaactttcattcagagtttttacttttaaataatttctgtagctgccttttgtacttatttgaagaataattgaaaagaaaaaaattgagaaaattaaaacagatttctttttgccaaaagaaagtattggtaatttatagcaaagctggaaacgagggcctcttaagagttttccaaagtatgtcagctagtagcatggggttttagatcttttctttactgcaatcaatcctgctggaaatatgaagtcagttcagaagatcagtagagttgagctagcaaaagaataaaaatcctgaaaggagttattaattatgtgcatactgtgtgcagacagaatcagaagatactggccaagacattatgaaacaaggaagaattcacgagaaactttgaaattgccatatgcaagatgcaagttccctttacccaattttgcactcatcttctgatgctagaaaagcaaatgagaatgttgctaacacaaatgttatgtatttgcactgatcgagatgggtgagttcaacaagggaatccagtctcagtgtggattactgataaatgtccttgcttttgtgctagcctaaatttctagtgttgagagacacattttgtgtagattccctatttatattacattaactaagtatcttgaggatatgatgatttcagtaaatgtcattcacacaatccatcaatagtcccggggtggaggggcgttatcagctattgtttctctgaataagtattatcaaacattgcttttctgctatacagaagcactatggaatgaaaccacaaagtctgtagacaatgtttttgcacactgtaaaaattttataaagtcaggtttcatttaatttacacttttgtttctggttagtgtttttactataatttgggaataatgtacagtggtaaatcattgtgaagtaacactgcattctccttaaaattgggatgtattcaggcatattaattatttcaggattcattaaatataattctaaaagagtttctctttaaatatttatctactcttgactggtcgtattgaatctcacattcattactaaaataaatttaagaggccttgataattgcagaccaaatatatagttacaattgtcgctatttataaagaggttcaagaactctaacctataattcacattaagttgaggcatcaaagaaaaaaatacacaaaaaaggcatgttggcagtgatggtggtactaccaaaggtagagttgggtttcattcctttcctgttccagcctatctattgcttttaaataacttatgctgctcgtgtgtgaagggatttctccttttactcacatatttacaacctctaattcaggagagagattagagatagagaatctaatacccttttaagttgcaggactataaaaacaaaataggcctcactccacttttctaaggcaagattctaggaaaggataaatatattcatgagtcaaaatccactacaatgaaataagtaaccaagggtaaatatattcatgagtcaaaatccactacaatgaagtaagtaacctaggttactgaccagaactctgcattgaggataaagccaaattctttataacctcaactctgtcagagttggtagtaatcaggactaggattcagtaataagcacttttatttaatatatatatttatctgtctctctctctctatatatatatgtatatatatatatatacacacacatatgtgtatatatatatacactcatatatgtgtgtatatatatacacacatatatatgtatatatatacacacatatatgtgtgtatatatatatacacacacatatatatagcatttcttcccctttctgttcaatacagcacactgattctttcctactatgtgatgctccgggctggtatgtaaatcaagaggcctgccttccctagccaaaatgtgaacacagcagagagttagcagggtgtaaatgaatcctactgtcattcccaataatttgaactgtgagtacaatgacacaagaatgagaaaaataaatggacttcattcattcaattggtggtgctctatcaacattgtcgatttgtgcttcctacatagacccctgaggctttactgcagcatttttataaactagtctcattctcaaaccttctcaacatttgtgtgggctaatattctccagaaaagatccttttatgattaaattggccactattggtttatgttcatgcaactacagaatcataatttatagcacatggcaagcatataagaaatatttgcacttattcttataaacagcagtggtaaattctacattgtttagccctttggggtggtttgcttgaattctatatagaattacaaaatgttccgcagagaagttctcaaataattcttgctgtcattcatgtaagataagtaagacactacttcgtgtgaggtgccacacataagttctagggaatacttcatcacttttgagcaagccagcaagaaagcccttaccacaaggaggatatattttaagagaaagagaaatgtgagtcaatcagttttgatagcttatatgcaatggacagttatcagtctgagcttacattacatttactaacgtaaatacaaaaatctttgggacatggtgagagatgtcagcattagctagctgtgggtcagctgtttactgcaaaacctgcaaggcttgggaactgggagaactgtttgttctcaagaggagacgtgaaacccgaaatatctcccttgaggatgggattttttaatgtacaattctttatatttttcactaaaatctatgtaattttctttcacaatcaacataatctgacaaaaatgagctgttcctcataatattgagacattcttggaaacattttgaggaaggaaagcttaggaaaacactatcaagtttctggccaaagagtagggctccacacatcaggatttgaggtatgaataaaaatgaggcatttttacactcatcaggtgataaagcaattgtgtaaaaaaaaaaaaaaaaaagaaaattctagaatataaattatcttttaacgaatgagaacaaattactttggagatatttggtagcttccttaatcatagtagctttgaatgatatagatgcccgattgtcaacagagatcaaaactaaatcagaaacttaaaatggcccaataaaatgtaaagctccttagaaaaacagcattgctataaagtctcaaatacagtaatgtgggagaaaatgacacgcacagcctatggtaagggataagagctgcaatatggagaagtttatcttggattctattttattacctctacctaagccactttttaataaaaatcatcaacagttcacaccataaaacattttggacctagcccaagtgagaaaagtcaaatatatttatatatgttttttggctttttaagagattatttattttttattatactttaagttctggggtacatatgcaggacgtgcaggtttgttacataggtatacacttgctatggtggtttgctgcacccatcaacccatcatctacattaggtatttctcctaatgttatccctcccctagcccaccatcccccgacaggccctaagtcaaatatattttatatgagatccatagtactcacaaaatttaatacatctatgtagacattgtcaaatataggaagacacttaacatatttctttgaatatactgaccctttttatatattaatgcctgtgtatcaaagtacatttcatacacagtttatcttctcctgaaatgtgattataaaattgatactctacaactgatgaaaagctagtaattgaaatgaagtcattctaatgaagcaataacactaacatagttttccaataaatatactgtgaatgacttagcctatggaaaaaggttttgaataaaaattattattttctaaatatctgaactgtaagatattagttctctaaatctatcttttttcttttccctggatttgaatatcatagctcactaaacatctttacaatttgcttcctctaaacacattctttcttctggaaataaaatggtgctttgaaagaatattaccaataggaagacatatttcaaacacgaggttcctgctttcaattacctaacagctggtactatgcgtttacatttagaaagacaaaaccttacaaagatgtattatgctttttcaagtaatttagatttgtcacagtgcaagaaaaactcattggcaaataattcaaataggcttgtaagtctcagagataaggggctttaaaaaaagcaaaatacattctttaataagcaaagttatgagacagatctataaaatagaattgagaaatctttcaaagtattccatgcagaacagctgatttagtaacctactgtgaaaagaactattgatactccaatagcagcggtgatacagtgaaaaggtaaattttgaggatgcgatatgactgcttgatctagtagtacaatactgtgaacaagcagggactttgcagctagacgtatttaagttccagttctgactccataatttacactgctgtggttcacttaaaactctgtgagcctcagtttctatatctttaaaattaggctaataatgcctatgtaagtgttgtgaaatgctcagaaatataaactaaaatcaatgctattgttttcctgtcatctggcaaagagtattgctccaattttatgtgtcaagtaatgtaaaacgtaaaagtactaacctaccaaatctgttctttttctaattgattacagaagaatccattaactttagtggcaagaatgtctgttatctctcaattgttctctcccttcaggctgatttttttgctaatatctttggtgctgagataatccaaaagagaacccccatctcctttagtggcagagctggcacaagcttatacacgacctcagggacctaagaactagcccaccaagcttgctaccactggagtccccaacacatccagtggtagtactgccacacacaggagagctggccagcccaatatctttctctccagcaaggcctcaccacagtctctacaaacaactgtagtctatgctaccaagacactcacccataccactgatgttaattgaagtcagagaaatcacatggagactatactaatgtgcccaccagaacccaagccaaagcactctaccaaaccaacactctaggacacatctacaggaaaaaaagtcttttcctataaaagctactccataaaattggaagaagaaactattccaccagttgcacagatatcaatggagggatacaaaacaggtaaatgcaaggaaacgtgacactttcaaaggaacaaaataattttccagtaagagaacccatctctaaaaggaaatctatggaatgcttgaaaaagaataataataattaacaaagaaacagatacaagaaaacacagaaaaaatgtttaaataataagaaaaataatttatgatctgaatgagaaattcaacaaaaagataggtatcatgagaaaaaatcgagcagaaactctggaactggaaaattcagtgactgaaatgataaatactactgagggctttaaccataaagtaggaattttttacttgaagacatcttttgaaataacctcatcaaataaggagaaagaaacaaggaaagaaagaatgatgaaaaggaaaaaagaaagcaaagtaaacatagtaaagaaagcctgtgagacatatggaacatcattcagcaaataaatatttgcattatgaagtttctgatgaagataagaattcatagaaaacgtgcttaataaagtaagagctgaaaaattcccaagtcttcagagagatatggacttccagagtcagaaagattaaagatttcctagtagattcaacccagagggttttcttatcgatacttatagtaaaactatcaaaagtaaaagacaaagagaattatggatactggagtctccaaagtggggaggctgggaggggaataagagagacaaaaagccacatattgggtacaatcttcaccactcaagtgatgggtgcactataatctcagactttaccaattgtattaatctgttttcataatgctataaagaactgcccaagactgggcaatttacaaagaagagttttaattgactcagagttcagcctggctagggaggcatcaggaaacttacaatcatggcagaaggcaaaggggaaacaaggcacctttttcacacggcggcaggaaggagaagtgtcaagtgaagggagaagaacttattacaccatgaggtcctatgggaactcactcactatcatgagaacagcatgcaagaaattgcccccaggatttaattagctccacctagcctcttccttgatacatgagggttatagggattatgagggttacagttcaagattagatttggttgaggacacacggcctaaccatatctccactatacaatttatccatgtaatcaaagaccacttgtacacctaaagctactgaaattttaaaaaataaaaaaataaataaaaagatcttagaataataataataaaaaaaaaaaagcaagagaaaagtgttgtcacatgtaggggaatttttaccagactaagagcagatttcgcggtagaaatgtaacaagccaggaataatgggataatagattcaaagtgctgaaagaaaaaaataaaagttggtcaaaaatactatgtccagcaaagctactgtttagccatgaagaagaagtaaagtctttcctatatggacaaaaactaagagaatcaattcatcaccactagattggcctgaaaataaatgcttaagggagtccaacatctggaagcaaacagatgatatctaacatcatgaaatcatgcaaaagtagaattactgatggagaaaaatgtaatccaaggaaaattgtggtgctatgatcagaaggcaaaaataaatactgggaaaaaggcaatatatatttgtataactctgcataatcatataatatattactgctttttgttttgtttatatctttatacatgctggttttggtcttgaataatctgaagatgaatctatgtgaatgaattaatttttatatattttattttttctacctctgacttcacccagctcccaacccccatcgcatactgaacccattaatggcttcatttccatcatgtcagtcatcagtccttctctaagccccaagacatccctgaccaagacaggaagtgtgcctgcatttcagaacggaacacagagttcatctacccgatatgacccaaatatcagatcagaagaagatacagagcaggcaaaacacaaaaaggaaaggcagcataaagtcagttccattttataaaaatgcctttcttttttactcttcttggaaaataacttcttgttctcaaacttttggtgatcagaaaaaaaaaataactttatttttttctttctgatacataggagcctggagcctgcctcaacatttttttctcttattgttctacctagctgcatacctcagtattaatactagaataaaatgtattttgcttttctttcacaatcccctcctcctttcttaagcttcatattttagctctctaattaactcccaagtagggtaatacctaataagcattatgtatacaattcctgagagactatttaagaaacaacccatagagttatcccttgcatacctttgatgagtttcctggatccccttttgatctggattaattaatgttcctgagggagtgctgattttctagcattcttccacctttgatgcagaatctcaaaattcccttgtacaataactttgggtagcaacatgaacgcaaatggctgttcagatttcaagaccttctatactaattctttgtaaacttaggctgagacaagggggaaaaaagcatgtagcaccctggataaatcttaaattctgccatcagagctaagatttaccgtcatctgtttctgcagagacagacatttttttttaaaaggcatcctatgcttgactctaaatcctcacttatatcttcatcaccatctagagatggagcacctcagggaagttccagggattgccatcagcacccccttctctctgatacgttgttaaaggtttcctttctaataaataatttattgagttcctagagctatagactgaagtgtttattttggattctacattttttcattcaataaatgtattgagtgtccacacttatgatataatatgcacttatacttctccaggtaaagtaatataagaaattgtactgattggtgcaattactgaaagtgaaagtcccataatcaccgtcagttataattctgtgcttttagaatatatgacacaaaaccggcagcttgatgagagcatagcagtcatgcattcatctgtatatcaatgctaggataatatcatctgaggagtccatagttaaagtctcgaatgtagcttttgaatgaatcatatatgacatacataatcagcaagaacagacacatgattctactacttcactctattccaccagttaaagtttgagctcctaggagaagatctttcatatacaagacttttccaaaataacagataaaaacatagacacaatagtcccaaaaatattttcagagaattcaggcaagttatttttcaagtatccatgataatgctctgtttatagaagtcaaagacataaagtacagattattcacaagaaacagctgtcttgagaaacaaatctgatttattcatttaataaacatttgttggcaccatgcaggtcagtactgttgggaatatagtcataagaaagatacgtttttattaaagcagaattttaaatgaagggtatgctttgtggaataggattttatagatctttgaatttatgtcaatacaatgaaatgacaaaccgtagtttcttatcatttagtcttcaatatatgactttaggttttcttcttatcaatctgttcctgttactaagaaaacaatttatagtattttataataatgagaataaaatcaaatagggtatggcaggtcttcatattattattacaattgttcttttataacttgtatccattgcaattttctttgctaatttcctcaaaagttaactatgtaaagatattatatttctatataatatctctagatttgtttgttctaggttttacttgtctaacctagaagattatcctacaaagtccatggcctttaattatctaactttgaaggtatcatctttagatagaatgccaattttgattctaaaaaacttgatcttgctgtacatgtgaatcacataatgcagttaattggttcattaattatctataaaaatgtggaaaaagtcctaaatggttgacaaatatatgctaaaagcagggtataaatataggccaacatttaaaaggtttccaaaatattctacataaagataaaaaggaaaaaaaaacaatttttacaaaaatcatcttaatgtatgctttgtgacagttacacaaatatataaagtgtatgatacaatcctttatctaaaagcatttatttttcaagttttgaacttgactttttagaaaatatgtctaagtttttacatatcattatgtgatagtcaacaatagtgtcaaaattctaaacaatttgattcaatgtgagaggctactgcaatgtttctcacttcagttactcttaagtattctcttctgcaaggcaagttacactacctctatattatctaaaagtgactcttctccaggcatcaagagtgcagaacatgacaggatgagccagtatggacttttcaccttcccttcatggggcagaaaaacattcaggaaatcagagattttcagtttaatcatcagggcatgaacctcagggctcaaagctgctgagagccaacatacggattttgaggacagattcaactagcaaagccaatggagagatgcatcccaaattcatgtttgagccttaagttcagcgaagcttgtagcaagccagttatatatcactaggttttcaattagttagaacaataaatttatttatcttctcttttgaataaacttatttaggcagaaagagagtatccgagagagcgtgaataaacagcatgagaaaacttggaatatcttagcaacgcaatgacaccataagactggcagcactgtagagaaaacagagtaagaaagaagagaggcacaggaaggggagaaacaaaaaataggaagggtgaccatcaggtgaaaaataatgagaactttcaggaacatatgggaggaaggtttgactctaaagctattaaggggatagaattaacaggaaaaaatatagcatttgaaatacgagcagaaacaaacagggataaaacagggctgatatatgggtttcaagcttgtaatatgatattagatgttattagtagacgaaataagattataatgaagaaaaattagaggttaggaagcagggatggagaagagatcatgaacttagttttacaccttatgaatctgaaataatcatgggatatccaaatgaaagttccaagagacagttggttatgcaggtctgagctatggaataaaatttggagatgtcagagatacaattttagctgccatctatagacagaaattagttaagaatttaacggtagataaaataaatcagaagtaatatggaaggctggaggggaaaaaaataagaaagtatatctgagaacattaacgtgtgagatatacatagagtaagaagagcttgaaagtaaacctaaaatctgtcttcagtaataagatttaaaatgtaaataattataaacaaaaaataaacaaaaggtgaaagttatgctatgtaaaagtaggcagaggagagattctaagatgggggaaaagtcagcaatagcaagtaatgcagatgggtcaaatcttccattgagtttagcaagtcattggtgacaactggtatggggcatctcagaaaaatagtaaaggtggaagtaagattgcagtagagaaagtggaattgcattaataattcactcaatgggtcatcgagtttgaagttgaattcaaacttatgaatctaattctttatagaatcaaggtcctctagaaacttggtcatttcctatatgaaactttcaaagaagatatttatattccccatgagaataatactaactacatggaatatggggtcacattgaatgtctcaggaattgttgctgattttttttctatgagaaagcataagtacgtctaatatagtgaatggctcccaaaacattcatatttaaaattcatttgacaaccaatatataacataacatttataagaatgtctttggtatgaccaacaccaaagcaaatacaaaaacaaaaatccttaaagacatactatgtgtgaatgttataagttatccaaaaatcttgtttctattttgtcccttgttaaatttttaccctatgacttgctgagaagctgcaggagagagaatttcctgatgagttgtctaacagcttattctttcctcctgctatgtcctcaacatctatgttcaatattaaattgcactgcagcggagatgactgtgtgtgtgtgtatgtgtgtgtgtgctttaagcaaaagacagaggcttgagtgatttagtagctacaaatataaatcactgacaagcaattaacatatactttggttcaaaaccaaatatttccttagcaacaatcataatcactattttacagtgaaaattggcatatttatgatatgttgacattaagatattcagtaagcatattgatgtttaaattccatgtttaaatgcaactatttataaatcaatcatcccacaatcaccttttcttaattttgaagtgcaaatatgtgagtttaagattttagattgaccaaagtgcttatttgttttcttccacatagctcagtttaaaatttgtaaaaagtattaaaccacaggaaagaaaagtgataaaagcaaatatgtgattcagcaagtttcttaatgtttgaaagtaaatggaaggtcataattatttaaagcagaatacaaaaatatcacattgaaaatggcaaaattgggtgagtatggataacatacactatcaaattgactggagaaaatacgacaaacttaacaaataagggtagcatgaaaatcaagaaagattagtggtgtcagttaaaatattaaataaaagtataggtaaattagggggatccttccccaagttctgagcaattttcccataagacttctccttccccataactaagattttattttctgaagaaattgtcagagagccaccagacttttaagtcaaagaaagtaaggccaattctttgcttgagtacaggaatgtctacctgctgacaagctctgctcatacacagaagatttccaaagagcatctcagtgcccagccactagtgacagtgacaactatctattaaaaatccacacacacatttttacatatgtatatatttacatatatatatatacctatatatgtaaaaaatatatatatgtatttccctcatcttttagaacacaacaagagtatttatctcaacttcccaatagttaaacttggccttgtgactgagttctagacaaaggcaggtgagaagtcccatgtgccacatcccatcctatcttgatttatgaaaccttctttgcaggctgcttatttttttcccgcagaaagttgtctggggtaacaaatcctctgagcgagcttggaagccatgtgttgcagatcattcccctggccccaaggtcctgttgacttaaaatccacccacacagagatacatgaaaaataataaacactgaacaattacacgtgaagatatatatgtttccattgcctacatactcatctaataatttaatgtgaatggagaagcaggattaatcagcctctttgaataaaacctgaaaccctaaaaatggaaaataaaacagaataaaaaataaaaggtgggaatagggagaggaaataatagagaggtagctaaataaaactgctttaaaataaacatcctcacaaagataagaaaatataattttaaaaaagcaaatgacttagaggataagaatgagatcttgagagaaaaatattaagacccacaaacaaaaataacaataacaacaaaaatactcaaaatactcctagaccaattatctttcaatcctaacacagcacctgaactgcttttcatgtttactaataacctccatttttgaaaccagtaattatttatcagttcctgtctttttggaatcattaatggtatttgaaacaattgatccttataagggcccagagctcttcttttcttaaaataaaagaaatatgaggtagtactcagcaatcaagtagtccagataggtcaaatcttccattgaatttagcaagtcattggtgacaacaggtatggggcatctcagaaaaatagcaaaggtggaagcaagattgcagtagagagagtggaattgcattaataattcactcaatgggtcactgagtttgaagttgaattcaaactggagaatctaatcctttatagaatcacagtcccttagaaaccttgacctcttcttttcttaaaatttaaggtccacagaccttttcttttcttaaaatttatatccagcccaacttctcttctaagctctaaacttgcagggttatctaatttgtatgcattatactcatctcaaacgtaacatgtttaaaaatgagatcttaatttgcctttctaagctcatgctaatcttcccatctcagtgacaattttaaaaatcctgaagtcatccaatctctctctctacttcatatctcacatttaagccatcaatacattatggtgattctatctttaaaatgtattcagaatcaaaaccacttctgaccaccgcactgctaataccttaggctgagccaccatttctttgtgcctaaattattgcttgggctccttaatttctcatttctgctctcatctacctgttgactatttccacagagcagggagagtagcacctttacaatgtgcattaggaagacttctgatttcattaagaagcccctcttgttacaacacaaaagccctgtacacaacacaattaatgagcatagaatgaccctgagaagtagaaagaacaaggtgaactggctagagacctaagggccaacaacaacatggcagtgagccctctgggtttccttattctggcccataatctggggcagggctccaaaatggactggaatatagatgcaggtccaaaaagctccaagaaaaatatctttactctaaacaaaggaccagaaaaatggtggtctaaaaacagaaaaagttttgggaaatacttgcctactccagccaaataccaaggacaaaaattgcaccatctctaccccactagtgacttcagcaatgtcaagtagggagcagatttttcacaaatgacaaccttgcttctgagaaagcaggtagctgccactaaattcatctactcaaggagctgtgatgaatggttttgtgtgtcaacttgactgggcgataagatacccgaatacttggttaaacattattctgggtgtgcctgtaaaggtgtttctgaatgacattaacatttgaattggtaaactgagtaaagcagactgacaacccaagtgtggatgcgctttatctaaaccactgaagtcccgaacagaacaaaagttgctctccctacctgtcttcaagctgggacgtgagtcctttaccatcagacttgaactcagactggatcaataccatcagtattcctggatctccagcttgctgactgcagatctagggacttctcattctctgtgattacttgggacaatttcttgtctatctatctacagatagacagacaaataggtaacctatttgtcacctatctaatttcctattcattctgtatctccagagaaccctgacaaatacagtaatatagccaggttgagcactggcagggtgggatcttatatctcattcactaccagaaagaaggaaatgtactgagtcccccattcccaactcctacccatatcatgctgttagcagagtcctccacctggaccaccaggtgagctaggtgagcctctattcctacccagtaccaagctgacttaattaaggaggcaatatgaggatgatcttgtcaattgtaggctccactccactactccatgtcaccaccagcacccaatatcagtaggctcaggggaactgaaccttcatccccacctgggcatcaatgagattgaaactgtgttgcaagtctaggctagttagcactgcgctttatccccacccttggtgtcagggatattgagtagctgagcctccacacccattctgcagcaaaaaagtattgcaagtcaattctctattttcaatatctctggtggctctgggatacaggagggaagctgagattttatacacccacccagaggcaatgaggcagtataagtctgggtcttaaaactgctgaaaggaggactgccattctgaaaaatcatggaatttagtggccagcatttttgaagacttagaaaaatttatttttctaagtcaatttatctattgactatcatgatctgtggaatgtctcaaaaaaatttaaagatacaggttcagcaaagtaagctgaaaaaggcatgaattaatgatagaaaaataaaaaattagaaaagaatcacaatctatttttgcatattgtagtaaagtagccataatttatatatgtatatatatgcttatatatacatatatacacacatatatatacatatataaacatatatatacatatatatacacttgtgtatatatatgtaaaactgtgcttagaacttggggtaggataaaaaatgagctgatggtataaaataaccaaatgttaaatagcgtaataggaagaaaacaatatcttgaatcagtaaatcaaaagataacatcataatcatgttatttaaaaatatgtgaataaataaaataagaaacatcacaaaaaagggtttacaaagttgtataggaaaacttgactaaggggcaggaatgtgttcttttttttttcattatactcacaatttaatgttcttttttgaaaacaatgcacagctatttctttgattaaaataatcatgaattctaagaaactgctttgagatatatatatatttcctttaagatatatatttctttcctttaagatatatataagatatatatatatcttatatatatcttaaaggaaatataatctacatcaaaatggcaactatttactaaacatgcattttattacataaacacacagcaatgctctttgctttggcattttctcaattacacaatatcttccattcaagttaccatctcctaaaaagttatttgagaaaatcttatttctcacaatgaaaccttattatctgaagctcagctgaatattgttctatccttagccctaatttacaaatacaaaataataattaatataatgtatgctattgaaagctcagtatatcctgagtggaaatttttcaataaaccttataaatatgcctgaaatgtttgctgtcatttttttgaaaaatattagcacaccaatgcaactatagctaatgttccaaatggagtattttatttcatgcttaccgtatcagatggaatgtaaggttaacagactttcaacacctcttaaatgaagggcttcatgcacacacattcagaagtaaaattaatcagaggggcaaaatctgtacctacctggtagaggttaaatggatggcatatttaaaatcaccattcatagctcctggcacacagtagactctaaatattttttccttctatcatttataagataaattcaacaacacatcaaagaaagtaggaaaataaacattcaaaccaaactcttgcattcattcctagattgctttttttaaaacatagtcaaacagtagtaataacaaatttagtaaaaagttctgaattgtaaaattcaaaaattgtttaagttcaaatttttaacataaaattgaaaatcaaaatttgagtactttactttctggcaaatctctttatttatcataatctgccttatagctagggatagccttagtactttcatattatacattttcacttacaaaccatacacattctttatgatgatatttctcccatcttttcttgaaattcagaaaaagaagtatatgtgtgtctcatttaaaattctccacacttcttagttttatactttttttctaacttaatggtccacttttccttgtccttggtcgatcttcactcatcttactataaacattcacttactttttaaaaattcctaccgcctctctcttccaaaaccagtccttatattaagtaattaaataaaaatgaccaagtcaccaccaggacaaaataaatgtccattctcaaaactattacttcagttggccttaagaaagtaggatggacagtagggagatatcttttctagtaattctgcaaatcaataccaccattctctgcaaagcagacaggaggaaattgattgtttcattgcaatgtttcatattaaaaaaccaaaacatcatttcagcttttccatactctatggaaactaatattcagagcaaatatgtattctttcatcaaatatttattgagtacttaccaaattttggacactgagctagttagtggaattactaaaatacaacgtgcaaggccacaaatgaaatatgctttttcatttaattgagagcaagactatgagatagaaaataatacctgagttttccaggtgatgcaactatagcttatcaatattaaattactcactatattctgtgcagaataagggttgaaacaaggatttaacttgacctctgatgccttgacctctgatgacaatgcttttgctttcaagaattatacctaaataattatgttgatgtcaaggatgatgatgatgataagtatcaatctccatttactgaaatataccttggtttcaggtcctgtgcttgcatgctttatgtatgtgaattacatccttttatcaccctttacagagagaaaccaaggctcagagaagttaaacaacttgatccttgctggtaagggagtggaatagaattaaagctcaattccatctggttctgtattcttttctttaccatcaattctctatagcaacagttattgaaacttgaagacccatctcacagcctctctcttacatacacacatttaatttcattctccatgcttggatcacaggctctcttctctgtctttctacattatctatctatctatctatctatctatctatctatctatctatctatctatgtatctatgtatctatctatctatctatctatctatctatctatctatcatcatcatctaggtatctatatctatatatcaaccttcctattatctgtatgtatgcctgtctcagtctccctttctgtctctatctctcagactttctgtctctatatccctttccctatctctttacatttttttgtttcattttgattattatttgtctttctggcaatctgtctatttctgtctttcttgaccctgtgttttcccggcctgtctgtcactctgcttctacctttctgtctcaacctatctccacttctctctctttctgttcttttctaagtgtatatctcagtttctctttctgttccctttctctttttcttatatttgactgtctctaacttttattatgtttttccctgtgagtctctctcattttctttgtgtgactatccctgtatctctctttgagtttgtatctctgtgaatatctttctgtgacttatctgtgtctgtctctgtctctcggacagagatgtaagattctaaagtaataaaaacctctcatccagttttaatgacccttttctggattccagtgatgtgctgcaaagttgaagaaataagtcccttaaatgataaagcaaaaagaaaagtcactgtccttggataaacaatttgcatttccataaggattcagtgatgcagaatcagaaaaggctcattctgacacctccatgaaaacaacagggagagcattcattagctgggcttccttttgaatgatgcacttcattgcacacaccgctgtcctcccccggtcaggaaacagtgcttaattctatcggaagtttgccctttcactaggcatgagaatgaatgacttttcaaagtaataggaactacacatctgccatggcctgagaatgcttacactctaaaagccatacagaaagttacacctcctatcaatttcttatccatcaaggaacacaataaacaagctttgaacttttccatttaccaacttgaaggaaagaaatgcttcattttctttagttttttgaaataatgactgcttttgcctcttacatttatagcttcaatagccatgatctaattttaagggtgaatgcaacctttaaacaaggtttatgatataaaaggaaatttgtccattacagtgctcagaaacttttactctttaggtgaaaattattttgttgctgttattgttgaaacacacacacacacacacacacacacacacacacacacacacacgatcatcttaggaagtaattggacaagattaaaacaattaattgtatttaaaattatttagcaatttacaggtttcttattcattttgctggcttcatttataagttatgtattttaaatgtggacactgaggaacaaatgtttagagggtgtgctgaggttctcaaggaaaataattgttgtccttcggacagaatatgatgtttctatgctccttatattaataaatagcacacatgtgtatgtgtgggcagggggggagcggggtgtgtccatcttactcagcgtgactgacttttaggctgagattaagtcatactcgtctacatattcttccaagtctctcacttcagtttatacaccacagttgaaaattgtattttaaggtcaagctagtcgctctcacattcaaaactacctcccatcctgcccctgccatccatacatgcaacgaattaacatgtgcatttggaatttctgggtgtattctcggttcttgtcaccatttcaacctaagtgcttccagtattcaatttaaataaacgttacagtttctgggtgatttacacctctggaatttctatggcgactctatcaagagaaaataatctggccataaattactcacattagctttttttttttcctcactcaaaattgactatgagcactaatgagtcaccacacttccttccaatacccttggatgcaactcagtcatatttgagtctgaaactaataaatgaagccccacaggtcactgttagttttgaatccacattctctcatgctatagtgttaacgacaacaacaaaatcccattacaaaagaaaatatatcaaacctcaaacaaagttttagttgagagtaacaaaaatagtttttggatgccatccctgacaagtaaaacaatcttttcaatattataattgtatagtcttattttgcatgtgaaaaccacagatacatagaatgacaaaatgattctagttcacaagtggtcccgatactaagaactcttttaaaaaatggaaaaatacaaacaaaatgactatgaccaaaacccactcttaaaatagagtctgaagtaaaattaaacttttagataataaatatgatcattttatgaagtagtgtggtctctttgtttagattattatttctgctaacttttccttgtgttcaaatcctgagtgaaacttaaaaccatgtatttctcccagcattagggctacaataaaatgtaaatgtatatggggggcttctgtgttaggaagaagttaatataacagctcgtttatgaaaagctattgttttacaccatttaagtaggaaaaaaagttcctacagtctgaaattgtatctgcacatttacagaaagggggagtacactcatctacccaataaagtagtcacatttatgaaattactttataatttttggttttacattttactattttgagaaggttcataatttgtctaaggagtaaaagtcctcatgataaagtgataacacaaaggaatcattaattcctcaacatgtatttgcttgacgtacgttttgtgatcaaataattatagtgatttcctttgataaaaataataattaccttttgcctttaatttcaaacataagctatgaaccaaatactggagaatttttgcaagtggcataaaaacaatttatgtctgcctatctgctgtgaaagttgtataataaaaagatacaacacataccatgcaaaatttaaatgtgaacaaattaagagcaaagttgtaatggacatttatttttcactgggtttttttaaagcataattattagtgttttttaaaactatagttcagatacttatcaaatattatcagtgggtataccatatttttaaacatttcctagaaaatgaaatgttttatttaaatctttttgtgaataatattcaaaacttcatgccataattttccagagaagttgctgacacttaggtagcacaaactctgacctgttcaggtcacttaatgattatgtttaagggtaatttggggggcaaagttgtagggattcacatttcctgctcagcacataattgcaacagctgaggggttaggaggtcgccactcagtggaattgggcacccattaaatggcacttttatttcataggagaatgagtccacagtcaaggggatcaagttgctgaaacttgaagacacacatgtacagatacattcactcattcacacttagccacaacttaagcaaactaaagaaactaatagtaaaaccaattttctgtgaaaagaaaacaaaaaaacagttcacatgagcatatacaacaaagcttcatacctgctgtgcaaaccacagcaagcattttgcgctcaaaatatgcctcttttacagattatttgtttctctaatgttaagcaacataataacttaagtatttggttactagatttgacaattggctcttttgtgaaagcaaatgagtatgacttggagttaaccttacaggaggccatcatattatactctagttaacaatggctttctgcatacgtgctacaagtccatcaaatcgatggccatctgtgtgtactagagacacagagtatcaacacactgaacctgaaacttgttattcagggcccacccactctatagctaccaaagtatattttttaaagtaaaggccacatcacaaagtgggaaagctgttaatactatctagcattaattctgtattagaaggatacagttgacctagattcaaattctaaatggttaatgcttccagatacgcacaaaggaagtaaatattctaataaactaaaacatccacagtaaaaatatcagtatactcacaaaagacaaaaaatactgttcattgtgaggcagaattagctactttaactcaactgccaactataacctccagcaacaaccactcataaaacaaatcatcaatatttgcacacagaaaaacaaaaagtcaattctgatgccatttttctgtattttttcaggttggaggaagtagaagaagtggttgaggactaaaaattcttttaaataacaaaccagagttataattcaaaagcttgtgtctttgtaaagattacattgtcatctaaacaaaattacaataccagacagtaatcaggaagaatgaaaggacaggcagttgtgttcactcttccagcaaataatcacttgcaatcattactactctattctttcaacaagcatgacagaaagtagcatcatgacagagatcattgtactgaaagaacatcttaactttctctgtggttcactgctgccttaaatttgaaaaaaataagagaagggcgggggaagaacttacttgcggtttaaagtttcatctttagtccatgtaagattatgcagcaagttttcttgccaaggctgcctcttgcacatccctttaaaaagaaccagtgctcataatctagttccaagacgattcattcacatgttccacctcttgtttctgtgaggcattgatatccactctcatatcatcaagaaaatgttactaggaaaatttttagaaaagcaaaacagttcaacatgttaactcagaaagcataccatcattctccacgttctgagatgtatgccacctgccttagttaccacaagcaactaacactaagctgctagcaggaatctgtctgccctctatctgtcgctattagctcagcacgttg

SEQ ID NO: 934 - DNA, 998519 bp, Homo sapiens; identical to SEQ ID NO: 933

SEQ ID NO: 935 - DNA, 980192 bp, Homo sapiens; identical to SEQ ID NO: 925

SEQ ID NO: 936 - DNA, 980192 bp, Homo sapiens; identical to SEQ ID NO: 925

SEQ ID NO: 937 - DNA, 2282 bp, Homo sapiens
ctggatagaacagctcaagccttgccacttcgggcttctcactgcagctgggcttggacttcggagttttgccattgccagtgggacgtctgagactttctccttcaagtacttggcagatcactctcttagcaggtaggtgccgcagaccctgcgggttaagaggtggggtggggggcagtgcttgccaaggccctaaactgggagcgctgggtgaggggaacaacccactttggagggttctctgagagatagatacaccccatatcctgggcccagctcgtgcacacagctggaggtccagagacccagtcccctctgctccgtcagccaagttccaagaagttgagcagagaccctctgggagcctggcggggtgcagcggcctcccctgcggggcctgtcacccggccggcgcgtgcaaacgcctctggcgcctctctgcgcggagggagataagcgtctgagccagggaaagcgcgggctaaacccgcctcgccggggcccctgcccgccctccgtgccccgcccgggcggtgcagctggcccgggtgctcacgctcgactctctttcttcttttccagggtctgcgcttcgcagccgggatgaagctggtttccgtcgccctgatgtacctgggttcgctcgccttcctaggcgctgacaccgctcggttggatgtcgcgtcggagtttcgaaagaagtgagtccgggcagcgccttcccccttgctggtacctggcaggcaaggggaactgaccgttggtcccgaaggtctagaagtgaatgggagcagggacaggcctgggcgtcacctgaacgcacgcgaatcgggtctgcttgtgttttccaggtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacaggtaactacgccctgtgctgtccagggacgggagggaaggaaggtgtgcgggaggagttctctgtctccactcccctggcccgggggatcgtcggggctggaccgcagctcagatggcgcgagcagtttccagctccctctggctctagaatggctcccgttcccggtgttggggccaaagctctgcttgatggggtctcaagttgcctttcttccccctccccccgcccgcagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaacc

SEQ ID NO: 938 - DNA, 56903 bp, Homo sapiens
cccctgctgctctcaagtttcccgttggcggcgcggcccgggcgcttcaggtagcctctcggctctctctgctccgctccgcgcccaggtagggcaccgacgggggctgcacgcggctggccggcttcctccctgctgaggcggccctccctcctcccgcggggccctcctggccggggatccgcagcgctgcgccctctgaacgcccggcccccgcgcctgctgcggggcgcggcctggccgggccctggccccggctggcctcagtgcccagcagccccgctccgctctgcccagcgcgtcccctttgctccagccctgcggccgtccctttcggccggcggcatggccctgtcgtccgaacccggtgagtgcgcgcgaggctgcgctgctgaccttgggccagccccgcggaccctgcggcccaggcgggaatcagcagcgccctggggtctgaaccgcggcttccgccttccctgctcgcagaggcggtggcgctgactccggtccgatcccttgccctgtcccctgttcctgtccctgtccctacccctgcctctgcggtggcccgagccccagcggcctcaggtgagcgggcagcatcccgattccctggcggcctagaatggaatcgcaaggtttagagaaattaagggacctgggacttgccaccctgggcaaagttcctaggtgcttgaggactggctggatgtggacagctgaggtggacttctacctggaggcgagggatgcactggatgatagggtgatgaggtcgtttgaggccttcatccttacctctttggctctctcccggcaagggaggtgtacagccttgggctctggcagtctgctttctgcccttgatcttctggtagctgctttgccagcagagctgctaatggctgttgtaggctggcagaggtccctggggagagttttgagaggccttggagtaggagaggcttgctaactagggtatcatttccccaaactgtatgtggctgaaagcttgatggcgacacatcagcaaaggagctgggtgaaagcaggcagcacaaggagggattttagcatggtcttgagcccctgttggctttccctcaggatgcagtgaccaacatttggccatcttcatggaaaagctgcctgcagctggaacctgcagaggagaaattctttccctggctgtgcagcactaaggccgagtgttagtggagccattgagccagacagacagagcctctgtcacttcacacctctaggagtgttgacagcaggtctggggtagttggcctggcctggctgcagcttcatggggcctggcttgctctgaggatgatggtatggggctgccctctctaggaataatgacacctgcataggtggtggctgggagactctttgacctctcagtcccatccttagctcagcctctgtcttctaaggttctcctagctctcagctaggtcaagaagctctttgagagatgaggttttttgtagttgtttttttttgcctctacactgactggatcactcttcaaatggcctcaaaatctgtctcaggtcttgaaaatgtcatgggcagataacatgtagccttcgggttaacagggagataccctttctcccctaaagctgcccattggcctccatgattcttccaccaagtataataatctcttagttcttctgtatgctggttgcatatctaggacaacagacaattgctttgggcttttgatttgtaaggaactgactggggcatgggaggatgagctcatggctggagtcctggctgtgtacagtcaccgagaagtaccattcataggggagaaggatgttcctcctcctgatctggcttcacatttaaatatgttttccttcttcctgcacccaggtaatagaaacttgggagagtgccaggcacatggtggtgctcaataaataaggttgaataaaaggattcagtgtctagataaaacttcatgttcattttcctagttcttctctctcgtatctgatatcataatgatgatgacaatgatgttggcagataatgcttataaaacacatactctatgccaggtaccagtctaaacacttcacttatgctcattgtcatggcaacctatgagattggctttttattatccacacttcatagggaataaaaccgagccacagaaaagttatttaacttgcccaaggtcatacaactaagtggtggaacaggattcaaatgcagggagtctagctggagttttttttgttgttgtttgtttgtttgaaatggagtctcactctgtcacccaggctggagtgcagtggcacaatctcagctcactgcaacctccacctcccgggttcaagcgattctcctgcctcagcttcccaagtagctgggattacaggcgcccgctaccatgccaggctaatttttgtgtttttagtagagatggggtttccccatgttggccaggctggtctcaaaactcctgacctcaagtggtctggccgcctcggcctcccaaagcgctgggattacaggcgtgagccaccacactcagcctgagtctacgtttttagccatacactctactcattcctgagattgccataggtggattgatctattataaatagctagttcacttgttcattgttttatgcattcattcattcaacaaatacttgctgaatgtcgaccatatttcaggtatggggatacaactgtgaatgagacaggcgagatttgtcatggagctggtatttagcaagtgaatcccctttgtccaactccttgtgtgagtcacacacacctcacaaatgagaagaaaaatgaacccctctatgcaagctcatgcctggcttttggggaggagagtgatatctttctttttctttttctttttttttttcttgagataaagtcttgctctgtcgccaggctggagtgcagtgcagtggtgcaatgtcagctcactgcaacttctgcctcctgggttcaagtgattcccctgcctcagcctctcaagtaggtgggactacaggtgcgcaccaccatgcccagctaattttttgtgttttagtagagatggggtttcaccacgttggctaggatggtctcaatctcctgaccttgtgatccacctgcctcgggctcccaaagtgctgggattacaggcatgagccaccatgcccggccgatatctttcttgatgagacataatttgattccgtcctctcctgtcttttagagtttgtaaggggtgcttaagtgataaaaggggatgcagtctagtctcgggcaggagaagcgggccctgtatctggttatcataaattgtcttgatgtttgttcgaaagggaaataaggctttgagcttgggatcagtgctcttcagtccacagagacatcttggctgcaagaagcagcaacaagttaggctcaaggtggaattgtgaggtcctgagaagagcttgctcttctgggacagaactgtatttttcttctaaactgcccatgttctggggagtcttcccgccttttggcttcagcaggacccttggtcattgttacaacctgtgtcatcttagtggagctgctgctggtttctgtctgaacccgatgcaatgggtctcatacctgtaaactgggctccaggaaggcagctttctctaagttggaaaatgaagactcaaggtggagggtgtttcccaaagccgataccacaagatattaataggtgtttttttcctatgacagcagttctaggatggtcaaataagtgcgtcgggttaaacaaagttaagcagctttctttactgcaggacttctcaggtgttgaatttgctagtagaaactgtgcatgaatacccataagggactacaggatgcagtgttttccaagccttctgacctttcatgttctgcagactgcactttgaaaaatgcttgtttagactaaggctagctgggatccggttaaaggtgcagaataaaattccctgaacgtgtcggacttaaatccttgggctggaatcctcccactgcagtccccactctacctcccctttccccaaaacactagcagaaaaagtcatctgcccctcctccttctggcagaatagtactaagggcttggatttttttctcatactgtaagttcatttaattgtttaatgaataaatattaccctccctctaggttgcttgtagcctgctggttgcactgtttatgaaacagctgtgaggacaggtgggccgtaatctctgggtagctaaagcccagcagcagcccgaggatcatgtgtcaaccctgtaatactgctctgtgcacacaggaattatgatgtgagctcagtaagacacaacctcacgattggacatgcggaggtgactcaggcccaagtcagggttacagctagcctcccggtaaacaactgacccatccttcctgagctcttctccccaggatttcaacagcaccacagaaatagccattttgctcatggttatttcccaggaccacaggatttgcctaagtcactgggaggctatgtgtctgttctgagccttcccactctcctaaagggcagatgaagatcagagctttgcaccctgtgatgccattttaatcaaccctgcttggttttagaggattgctcctgtgggtcacttgaggcaggctccaccttccccaggaggagtggcagagtccagccagcgctcggagctggaggcccacgtgggagcagtgagcggctgtaagcaggggagggtttggggtgggctccggtgggtcagttggggtgtactccttttctgtgtgtgtggatgggggtgggggttctggtaaagcttatcaggcttcgcagtcacctgtgatgtgggcttccttctgggaagaaaggaaggagtgggatggggctgtcagcttttcatcctagcctgcccctgtcctctgtccgcctctgtgctgaggcagttcctgctccctgagtctctgtcctttcctgggaaaggtggaagcagttcatggtctttccctttcagaggaggaggggatggaggggattgtattagcaactgggattgaagctccccctggcagttatggggtgcccttgggagggctgctttaggggggctttctgagaagaggcaggtcgggctgtacctgagaccaatccccttgataaaatgcagccaggcctgaagcacgttcagaacggaagcagcaaaggtgatgatatcgctcgttgctactcagctttcaggaggaggctgggcgttagagggaggctgtggcttatctcctgcagctgggcaggacggctgagtttactgttgtaaagaggaagccgccgctttagtttcctcttgtgagggctgtgaagagggccaggacactgcattcaggataccacagccattttgttttggataactgggattacctggggacttcagggctcttggaaattttccactcatatttcatattcacgagagaatttccagcccaggcttttcctgctctggctcactgctgctcacagatatgcaaaacagagacctcctactccagccggcagacaggacccagccagctgcacgcacgcactgactcagctgagcctcctgggtggcaggcagcacctcacccgggtgcatcacttgagtggcatcttcaggaccagtcatggagccaggctcaggtctgtgtcggggcttctgcaaggggagtctggcaagagtaggaaccagcttccttcgtataacgaggggatttcagtggcactgggcttcctttctggagggactgtggcaccatgaaaagttactgtttgttgaaactggcagtgttttagaactttctaactttgggacacttcttcaagttcatcagagcgtgttgcatgtaacagtgagataagctgtatcattggctgactgatgctggtgaattcacagctaagcctcccaagcctgctggcttcagctgacaaagggttggaagccaggcgtgaacatgcagctggagctgaagctctgcttggcatctgcagagtgagctttccttgtcaggcctggcctggcaggtgtctggagggtctgagaggagagacactctggagggacgggttggcaggtgggagctgtctgccaaggacatccagaaggcagcagatgtgggggcagctgctaaggcctgcagcaccccaagtgggttacttggtccatactaagatatggaattaattattttgttgtggttgctgttgtttcttgcttttttttttttttttttgagagaaggtcttgctctgtcacccaggctggagtacggtggtgccatcatggctcactgcagcctgcacctccaggactcgagcaattctcccaactcagccttccaaatagctgagaccacaggtgcatgccaccacacctggctgtttttttttctattttttgtagagatgaggttctgacatattgcaccaggctgatctcgaactcctggcctcaagcgatcctcttcagcctcccaaattgcttggattataggcatgagccactgcacccggtcttggaatgaattatctaccaactatttaagacactggtagtagttctgcggaagatttttatgggttctgtaaaacaaaaagggttctgtatgttaatgttactctatgatccttgattttaatgagccttatgaatgtgagttgaggggctgtggaatgcaacatctcccaataactgaccacaggacctgttttaccagcaacaggtatcaatttcttatggcatccagtttgggaaaggttgatttaagctaaagagaaaggaagatatgttatagaaagctgtgtcctgaaaagtatttttagttgattagagcaagctaaaaatgctttgtgcgctggtatgatggctcacacctataatcctagaccctgggaggccaaggcaggcggatcacttgagaccaggagttcaagaccagcctggccaacatggtgaaaccccatctctactaaaaatacaaaaattagccaggcatagtggtgtgtgcctgtggtcccagctactcgggaggctgaggtgggagaatcaccggagcctgtgaggtcgaggctgcagtaagctgtgattgtgccactgcactccagcctgggcaactgagaccctgtctctcaatcaatcaatgaataaatgcatgcttcatgagcaaacatggcaggatctggcataagagccctcagacatcaaggacttccctcccacccaaatacccattgccaagggagcctggttgggggtgtctgggtcaggcctgtgtgtgtctgagggcatgaaggaggtaggaaggtgctgctggtggtggatggcttctgtccagggtaggagctaacacagagataggtctgaatggtgaaactccctttggcctggcctctcaatagtgtgggttaggctgatcttgaactcttagcctcaagtgatccttcctcctcagcctcccaaattgcctggacaacatggcaaaacctcatctctaaaaaaaaaaaaaaaaaaaaaaattagccaggtatggtgatgctccctccctccctcccttcggcaattaaggagggagccctaattgccaaaacctgccagaaaaagaagtttgttttcctatttttctctcttttcatagagtcttaagtctactcattttctttctattctctttgtatttgttaaaaatggcattataatagcattcatcatcaaaataaaatatcctctcacacacaggcagccctgccacctggtcattttgactgcgtgaatctcttgcaggtcttgcccataaagggatgcattttcctttcactgtaaataaagcatgggtatggttctatgtattaattttttcatttactgtatttttatttttttatgtgattgcaccatcctcataatcataattctgattacttaacatctttttcaagtgagtatgctctaatttaggcattttaaagctatttatgtaaataatgcaggtaaatatccttgtgcttttcattcttaggattctttttttgaaagaaatttgtagaagtaaagttgcttagtcaaatggtatggtgctttatggcatttgcggccttttgcctgggctgttgggttgcatatcttcttctgagatgcgatgtgaggttttgggatggtgcccttgattggtggccttggaataaggggggaggtgaggatccagtttcgtttcagcctgatggagcctcctgggtctggttctttgtgctgttccagactttctctcccctgtcacctcctttgatggcctccagcttcccccctctctgctatcaagacatggaaatccccacaggcagctctgttcctcttcctttttgcagaggccaggcctcgctgtcttgatgtctgctccccagacagttgtgtgttgacaggctgttccccaccagctccctcccactcctctcatcagggagtggcaggtccttgggtctcagagttaagggagccacagacctcactctgattgcctgttgctagcctgctttcttccttcctgtctgtgtcatgacttagtcccacatgccactcagactcagagcagcaagccctcctcaggcaccggaaatctctctggtacctagaattatgccacttagagctgagagggccttagagaccacttagttcaatccctttatctcacagatgagaacattgtgaggccggagaatgactgtcccaagatggcctagtgtgttcccctcccctgtagctgcacttctccctgctggacagcagcagggctctgtctcatctccattcttgtctgtctggtccacaaaaccacttctctctttaaaccaactttaaagaaactgtggtcataggtagatgggaaactcctcttccagagctgctcccaacgagggtggcttgtcgaaaagggtgcagtattaatccattccacaagtgttatgctggggactgtgaggagcccctgcccggacacatacgtggacaaagagaagcagcacagcatggtgggtgaggggacagaggcaggaaccaggtgcctgggttcagatccctgagctgaggatcagagaggaaagggatgagagagaaaggctgagaacagcacaaatctctgctgacttattaaaagtgtgaccctgggcatgttagctctctatgccttcattttctcatctgtcaagtgggaataataagattaactgagttaataagtatgaagttctttgcagagtatatatatgtatgtatacatatataaaatatatattatatataatatatattatatataatatatattttatatatatatatatattttatttttaaaattgagacgaggtctcaccctgtctcccaggctggagtgcagtagtacgatcataactcactgcagcctcaacctccctggctcaagagatcctcctgcctcagcctccctagcagctgggattacaggcatgcatcaccatacctggctaattctttaaatcttttttagggatgaggttttgccatgttgtccaggctggtctcaaacttctgggctcaagcagtcctcttgccttgacctcccaaagtgctggtattacaggcgtgagccaccacacccggccccagagtatactttttttttttttttgaggcagagtcccactctgttacccaggttggagtgaagtggctcaatcttggctcattgcaaccttcacctcctaggtttaagcaattctcttgcctcagcctcctgagcagctgggattacaggtgcctgccaccacgcctggctaatttttttgtatttttagtagagacgtggttttgccatgttggccaggatggtctcaaactcctgacctcaggtgatctgcccgcctcagcctcccaaaatgctaggattacaggcgtgagccaatgcgcctggccagagtgtacatattaagtgctatacaagtaattgcaaaaaaggaaagaaataaggaaatgaagaaagcaagcaagcaagaatgaaacccaaccaaccaagcaggtggttgaggccagtgactgttagtaaggaatcagtatgcgaggaggtggatagagaaagcttctttgagggagtgagttttcagctgggtaaagagtgttctaaaacctttattttatttgctgtgtcttgttaggaggttccagagggtttggaactgcaatagcagattctttctcttcagcaaaaggccttgatttatgtaatgaagaatgcagctttggatttcccagggctctgctgtaatcttgtgcgaccttagctgttaaagcctctgtgaagtgggggagtgaggtttgattattgttgcagctataacagtatcctcatagtctggaggagggagagctgaactctctcttgtcccttctcaaacatgggaacaaagtcaggagggcagggctgccaggtgctgcagattccctgagtttgggaaaatggaagcccacctagttgaacagttcattctttgaattttgaacacttgctttctcctgacacctaagtggccctacatgcttcacatccagttacttattgagctaattttgaaattggcatgctgggtttggtctggggcattcctaagtagacagctgaccccaagtaccaggtgggcctggccctcacttcagtgccttctcttccccggtgctggtgactcagggcatcctgcaattcatgcttgttctttctttgctagctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaaggtttgttcccaaggcatggttttcgtgtacatagagtcatgcagacccaggcaggctgtgggtgtgtgtcctgatatgaggcacctcatggggactggtatgtccctagagctgtgttggttccttaaccaagaccacttaactcacctcttatttattgagggatgtctcggtgcctctgttgcactgaaaagatcaaaacccactttgctgctgatgtgaaaaaatacacaccatttccaaatggcatttctcttttctttttggaaatttgaggatttcttaggagacagcaattgtatttcttctcatcacttgacaagcattttgcattactaatgaacacagcttactatttgccgggtgctgtgctgggactggagatgttataatgaacaagatagatagagtccctgggtctagacaataattaagtaactggacaaattaacttaaaaattacaagttataataagtgctgtatcagtcagggtccaactagaagatcagaaaccaatgaagtattagaattttaatgcagggaattggttacacaggtggtagagagctgagaaaccaaacaggggagagagaggcggctcagagattagacacagtaaggagcagctactacccaggacaggagtgacaaggaaagcagtagtgtttctggagccaaggtggagtcgccctggggaaggtggaactgtggtggactttccagtggaaactggagccaaggggaagaggtggcagctgcagagatgcctcccaaggcagagatggaggcaggcaatacctcgtttgaccctttctgcaccttccaggttctcccagtggctgccatgggccaaacctagccagaatcctgctggcacacttgggaaacacaggagaggatgaggaatggatctgagggcaaacaggcccaggagcagcgcaagtgctatgaaagagatgaataaggatgagatggggttaggggagagaaaggccgggaaagagagagaaaaaatccttttttagactgggaagtcagggaaggcctctccaaggagatgacatcttagcggatgcttcagggtataaagaagctagctatgtggccttccagatagaagaatcagctagggcaaaggccccccagtttcttccagaaggcccatgtggttagaggtctgttaaaggaagaagtgctgtgaccagggctggaggacttgtggggcccagatcagactggccttgtgctccctgataagaagtttggattggagtctaagtgaaatgagaagccctcatcctttcacagtttatctcaccctgggctttatcagattttctgcctgcccggtaccctgcaaacatcaatagttgacatggtagacctttgagccctctccgacctagtctgtgatcacactagatactgcctcagttttaaaggcaagtcttttcctttcttggttgtgtagaagctcgcattttcttaactcgtttggaaagaagtaaaaagttgactactggtgtaaaggcaagaacagagcttcaccactcataagaccagtgctttccttccttgaaaggatggtgagcccataaaggcaggagtcactggtgccattggttaacctctgagtgccagccttgtgttggataaggtggggtggccccagccccagcagtgtgctcatccctggagggtcaagaagagtatgactgtagagaccctcattcacactccgtgggtggaacagaagggctgacttcatcaagtgaatggtctgcagggccttctgtgtgttatgaattgagcatttgagacccttaacaatgagaggaaaagaaatcctggcattttttattactaggaacaataagtttctggaaccagtttccactacagagtgacactgggcctgacatctgctgaagcgactgtgctcttctcaatgcccagactcagggcaaaatggaagctttcttactctaagtcttaatggtgctctgtggtttccagaaattcccctgcaaacttctctccaaaaactttgttctgtccttgcctaggttatggtgtcttagtttgcatctgtctgcgccatttgactagacgctccttgaggactggatccattgtggaacttagttggtgggcagtggatgtctggcagaggaagacatcctgcctccccattgccaccatggacactacatcagggtggctgcaacttcttggacctctgtgttctgccactcactgtcatgctctgtgactttggggaaattaggaaacctctctgggcctcagcctcgtcctcatctataaagtggagatgctaacagctaccttcatggggtgttgtgaggaatgagggaatccacaggtaaaaggcttcggacagtgtctggttatagtgcatcccgagtaaatataagtgatttctctgacttcctgctgctgagacagggaacaatagcagctcctgccattgaatacttactatgggctaagtactagcctgtgtaggttggattcattctttaattctcacatcgagcttatcaaatggatattcttagtattctgattttgcagattagggaacgaaggctcagagaagttgaatttactttcacaaagacacatagtgagtaaatgacagagcaagaactagagcccatatcttttgaatctagaccccacacttcaaccataaggctatcccctcttcaggtaggggtggagtcttcggttccctggtctgtagaccctggaatgacactaggtgctgctccctagaatgtaattgttgcttctaaatgaaatggagggaaactggtcaaagctcccgctctgtccatcggcttctttcctgaaaaaaagcttggtccctggactgtcagatgccccagcatcctcctctggggtctgcccatacccaattttgtcttttagtttctcttctcactagaggtgcctttatatgtaaatgttcgaaagttaacattttcatggaggacaccctctccccagctccctctttgtctgtggcacctcccatcccatctcctatttattcttactttacacagaattctataatctggctatattgtttcttatcccgtggcagatttaaagaagcaaattagaagcagggagagagacttctacaggcagggtcacagaggtgatgtgtggtgattataagcctgggctttggggtcagacctattgggttcaagtggcagccctgtcacttactactgaatggccttggtcaaagctcttgactgcctgagctggtttcctaaactgcaaaatgagaataataaaaggacataccttgtgagaattaaatgagcgaatacacaaaaaatccttagcgcagtgcttggagcaccattaatgttcctgttttgttattgttgttattagacagtcaacagtgagagaggaaacaaaataattatgaaaagcaggcacaagaatttgaagcacagtagtttagggataacacacctctgagatcataactggataatacagtgatgatcctgggtcattgagaaaactttaaattatgttcagcatgctttgaggaagaatgcaggaattatgtatttttttaagaagccagataaaaattgatttttaaaaaattaggatatagttaaggctggcaagatggccaattaggaacatctccggtctgcagctcccagtgagatcgatgcagaagggggtgatttctgcatttccaactgaggtactggttcatctcactggggctagttggacagcgggtgcagcccaaggagggtgagccaaagcaaggtgaggcgttgcctcacctgagaagcacaagggatgggggaattatcttccttacccaagggaagccttgagggactgagcctgaggaactgtgcactctggcccagatactgtgcttttcccatggtccttgcaacctgcagaccaggagactgcctctggtgcctacaccaccagggccctgggtttcaagcacaaaacagggcggccattcaggcagacactgaactagctgcaggagtttttttttttttttttttttctgtaccccagtggcgcctggagcgccagcaagacagaatcattcactcccctggaaagggggctaaagccagggagccaagtggtctggcttggcaggtcccagccccatggagcccagcaaactaagatccactggtggccaggcgcagtggctcatgcctgtaatcccagcacttagggaggccaaggcgagtggatcacctgacgtcaggagttcaagaccagcctggccaacatggtgaaacctcatctctactaaaaatacaaagattagccgggcgtggtggggggcacctgtaatcccagttacttgggaggttgaggcaggagaatcgcttgaacccaggagaaggaggttgcagtgatctgagatcgcaccattgcactgagcttgggtgacaagagcaaaactccgtctcaaagaaaaaaaaaaaagatccactggctcaaaattctcactgccagcacagcagcagtctgagatcaatctgggacactcaagcttcgtagggggagggtcgttggccattgctgaggcttgagtaggaggttttaccctcacagtgtaaacaaagccaccaggaagttcaaactaggtggaacccaccgcagctcagcaaagctgctgtggccagactgcctctctagatttcttctctctgggcagggcatctctgaaaaaaaggcagcagccccaatcagggacttatagataaaacccccatctccctgggacagagcacctgggggaaggggcagctgtgggcacagcttcagcagacataaatgtccctgcctgacagctctgaagagaccagcagtcctcccagcacagcgttcaagctctgctaagggtgagactgcctcctcaagtgggtccctaacccccgtgtatcctgactgggagacacctcccagtaggggccgacaggcatctcatacaggagagctctggctggcatcaggcaagtgcccctctgggatgaagcttccagaggaaagaacaggcagcagtctttgctgttctgcagcctccactagtgacacccagccaaacagggtctggagtggacctccagcaaactctagcagaggggtctgattgttaggaggaaatctaacaaacagaaaggaatagcacatctaatcagagaccacatccgaaaatcaccagcatcaaagaccaaagatagataaatccacgaagatggggatgtaaaccagtgcaaaaaggctgaaaattccaaaaaccagaatgcctcttctcctccaaatgatcacaactccttgccagcaagggaaaaaaactggacagagaatgagtttgaccaattgacagaagtaggcttcagaaggtgggtaataacaaacgcctctgagctaaaggaacatgttctaacccaatgcaaggaagataagaaccttgaaaaaaggatagatgaattgctaactagaaaaaccagtttagagaagaacataaatgacctgatggagcagaaaaacacagcacgagaacattgtgaagcattcacaagtatgaatagctgaatcaatcaaacggaagaaaggatatcagagattgaagaccaacttaatgaaataaaataagaagacaagataagaggaaaaaaaatgaaaaggaatgaacaaagcctccaagaaatatgggactatgtgcaaagaccaaacctacgtttgatggatgtacctgaaagtgacggggagaatcgaaacaagtggaaaacactcttcaggatattatccaggaaaacttccccaacctagcaagacaagccaacattcaaattcaggaaatacagagaacaccacaaagatattcctcgagaagagcaaccccaagacacataatcgtcagatgccccaaggttgaaatgaaggaaaaaatgttaagggcagccagagagaaaggtcaggctacccacaaagagaagcccatcagactaacagcagatctctctgcagaaaccctacaagccagaagagagtgggggccaatattcaacattcttgaagaaaagaattttcaacccagaatttcatatgcagccaaacaaagcttcataagcaaaggagaaataaaatcctttacagacaagcaaatgctgagagattttgtcaccaccaggcctgccttacaagagctcctgaaggaagcactaaacctggaagggagcaaccggtaccagccactgcaaaaacataccaaattgtaaagactatcaacacttcgaagaaactgcatcaactaatgggcaaaacaaccagctagcatcatgatgacaggatcaaattcacacgtaacaatattagccttaaatgtaaacgggctaaatgccccaattaaaacacacagactggcaaattggatgaagagtcaagacccaacagtgtgctgtattcaggagactcatctcaagtgcaaagacagacataggctcaaaataaagggatggaggaatatttaccaagcaaatggaaagaaaaaaaaaaaagcagaagttgcaagtttaacctctgataaaacagactttaaaccaacaaagatcaaaagagacaaggaagggcattacataatggtaaagggatcaatgcaacaagaagagctaactgtcctaaatatatatgcacccaacacaggagcacccagattcataaagcaagtcttagagacctacaaagagacttagactcccacacaataataatgggagactttaacaccccattgtgaatattagacagatcaacgagacaaaattaacaaggatattcaggacttgaactcagctctggaacaagctccaacccaaatcaacagaatatacattcttctcagcacctcatcacacttactttaaaattgaccacataattggaagtaaaacactcctcagcaaacgcaaaagaatggaaatcataacaaacagtctctcagaccacagtgcaatcaaattagaactcaggattaagaaactcactcaaaaccacacaactacatggaaactgaaaaatctgctcctgaatgactactgggtaaataaggaaatgaaggcagaaataaagatgttctttgaaaccagtgagaacaaagacacaacgtaccagaatctctgggacacatttaaagcagtgtgtagtgggaaatttatagcactaaatgtccacaagagaaagcaggaaagatctaaaatcaacaccctaacatcacaattaaaagagctagagaagcaagagcaaacaaattcaaaagctagcagaagacaagaaataactaagatcagagcagaaccgaaggagatagagacatgaaaaactcttcaaaaactcaatgaatccaggagctgttttttttttgaaaagatcaatgaaataaatagactgctagcaagactaacaaagagaaaaagagagaagaatcaaatagacacaataaaaaataataaacggggtatcaccactgatcccacagaaatacagactaccatcggagaatactataaacacctctatgcaaataaattagaaaatctagaagaattggataaattcctggatgcatacactctcccaagtctaaaccaggaagaagttgaatccctgaatagaccaataacaagttatgaaattgaggcagtaatgaatagcctaccaaccaaaaaaagcccagaaccagacagattcacagccaaattctaccagaggtacaaagaggagctggtaccattccttctgaaactattcccaacaatagtttggagctggtaccattccttctgaaactattccaaactcattttatgaggccagcatcatcctgatgccaaaacatggcagagacacaacagagaaaatttcaggccaatatccctgatgaacatcgatgtaaaagtcttcggccgggcgcggtggctcacgcctgtaatcccagcactttgggaggccgaggcgggcagatcacgaggtcaggagatcgagaccatcccggctaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaagtcctcaataatatactggcaaaccaaatccagcagcacatcaaaaagcttatccaccacgatcaagttggcttcatacctgggatgcaaggctggttcaacatatgcaaatcaatcagcgtaatccatcgcataaacagaaccaatgacgaaaaccacatgattatctgaatagatgcagaaaagtccttcaatataattcaacaccccttcatgctaaaaactctcaataaattaggtattgatggaacgtatctcaaaataaaaagagctatttatgaaaaacccacaggcaatatcatactgaatgggcaaaaactggaagcattccctttgaaaactggcgcaagacaagtatgccctctctcaccactcctattcaacatagtattggaagttctggcaggggcaatcaggcaagagaaagaaataaagactattcaaacaggaaaagaggaagtcaaattgtctctgtttgtggatgacatgattgtatatttagaaaaccccaccatctcagccccaaatctccttaagctgataagcaacttcagcaaagtctcaggataaaaaatcaatgtgcaaaaatcacaagcattcctgtatactaataacagacaaacagccaaatcatgagtgaactcccattcacaattgccactaggagaataaaatagctaggaatccaacttacaagggatgtgaaggacctcttcaaggagaattacaaaccactgctcaaggaaataagaaaggacaaaaacaaatggaaaaacattccatgctcatggataggaagaatcaatatcatgaaaatggccatactgcccaaagtaatttataggttcagtgctatccccatcaagctaccattgactttcttcacagaattagaaaaaaactactttaaatttcatatggaaccaaaaaagagcctgtatagccaagacaattctaagcaagaagaacaaagctggaggcatcacgctacctgacttcaaactatactacaaggctacagtaaacaaaacagcctggtactggtaccaaaacagatatatagaccaatggaacagaacagaggcctcagaaataacaccacacatctacaatcatctgatctttgacaaacctggcacaaacaagcaatggggaaaggattccctatttaataaatggtgttgggaaaactggctagccatatgcaaaaaactgaaactggactccttacaccttatacaaaaattaactcaagatggattaaagacttaaatgtaagacctaaaccataaaaaccctagaagaaaacctaggacattcaggacataggcatgggcaaagacttcatgtataaaacatcaaaagccatggcaacaaaagccaaaattgagaaatgggatctaattaaactaaagagcttctgcacagcaaaagaaactaccatcagagtgaataggcaaccttcagaacaggagaaaattttttcaatctatccatctgacaaagggctaatgtccagaatctacaaagaacttaaacaaatttacaagaaaacaaccccatcaaaaagtgggcaaaggatatgaacagacacttctcaaaagaagacatttatgcagccaacaaacatatgaaaaaatgctcatcatcactggtcattagagaaatgcaaatgaaaaccacaatgagataccatctcacgccagttagaatggcgatcattaaaaagtcaggaaacaacagatgctggagaggatgtggagaaataggaatgcttttacactgttggtgggagtgtaaattagttcaaccattgtggaagacagtgtggctattcctcaagaatctagaactagaaataccatttgacccagcaatcccattactgggtatatacccaaaggattataaatcattctataaagacacatgcacacgtatgtttattgcagcactatccacaatagcaaagacttggaacccacccaaatgtccatcaatgatagactggataaagaaaatatggcacatatacaccatggaatactatgcagccataaaaaagatgggttcatgtcctttgcagggacatggatgaagctagaaaccatcattctcagcaaactaacacaagaagagaaaaccaaacatcgcatgttctcactcataagtaggagttgaacaatgagaacacatggacacagggaggagaacatcacacactggggcctgttggggggtgaggggctaggggagggatagcattcggagaaatacctaatgtaggtgtcaggttgatgggtgcagcaaaccaccatggcatgtgtatacctatgtaacaaacctgcacattctttacatgtaccccagaacttaaagtataattaaaaaaagaaaaaaattaggatatagagggaaaaattttattagttgaaaaatttggctatctaggacagccgcttccctagaatgttttgagtgaaattgagaaacatatgtgctttatgaattgagcatagcacagctaaagtgttgctaagtcacttcattttatgaaacttgtgaaaataagaatggggaactttttaaacattcaggatcattgacaaaggagcttcatttgaaatagtcaatctatccccttttaaagttagggagagattgggctgggcgcggtggctcacacctgtaatcccagcactttgggaggctgaggcgggtggatcacctgaagtcaggagttggagaccagcctggccaacatgtagaaaccctgtctttactaaaaatataaaggttagctgggtgtggtggcacatgtctgtaatcccagcaactccggaggctgaggcaggagaattgcttgaacctgagagtcaaaggtttcagaaagccaagatcaccccactgctctccagcctggctgagggagggagactctgtcttgaaaaagaaaaagttagggagattgggaagccgaggtgggtggatcacttgaggccaggagtttgagaccagcctggccaacatggcaaaaccctgtctgtacaaaaaatacaaaaattagctgggcatggtggtgtgcgcctatggttccagctttttggtaggctgaggcacgagaattgcttgaacccaggagctggaggttgcagtgagctgagatcgtacccctccattccagcttgggcggcagagcaagaccctgtgtcaaaaaaaagtaaaaataaaaataaagttagggagagagattgtaacacttaagttaacagatagtacagattgcacttcattttcatctccaggtctttagggaggaagggcagctgggaaggattgaggaagggagaagcgaaggtgagtggcaggagatgagtggagattacagtaggccaggaggggttgtggggaagggaggatggagaaagaaggggcaggtttccagaggagctcagggagagacagagggtggggctgtgagttttcacacctgattggctgcaaagtgttagaatcaaagttacacccacctggccaggatgctggtcatctggctgcatatgcggagtgagtgatctctgtgcgcccctgctctctctgtagggacccctgttatagtgcccatcgtgcagcatatttctccagataggctgggacctctggtctcaagtacagggaaggtgtcagcccctcttagttccctccttagatgggggtcccaattccaggtgagccaatgcaggggcagcgtgagcagcagcagtgtgagcctatggaagtggaggatgcctgtcccgcctgatggcattcagattcccagtgtttgcaaaactctgtgctggtttgtgacttctgattccaacctttattttagcgtaacaattctcatgtggaggggctgccagaatgagctgagtgtgcgtgggggaggagttcaaaccagcctccatgttctgaaatgtcccccctctgaccccattgctccactgctcccacccctagtctggattaagtgtctcctctggggtcccaaaatatccagggcatctcattacaccaaccacactgtatgataatctgtggaactgtctgggttcatctcagccatcacagtcggcccctggaggcgggagttatatcttatctactcctctacacccagggcctggcacacagtagtttattgaatgaagtggggtccacgtgtggcccccagctcatagtacacatatgagagcctggtgaaaggttggctccagtgcccctccctgcctagtagtcatctggacagaccacacagggcagtgggcttcagatggcccctggtaagatgctggctattctctaggagagcaaggtgggcctgaagggctcctcactttagcatttgagtgctatatagggaaggccctgggagcctgattccccagagcggaggagggctggggagtggagcagagtaagggaggggacttagtgactgtcaggggcaaccaagggccatagagcaggtggagcaccagacaggtgctgggaggtaagatgctgtaacaacagcccaggtgacctgatcaactctttgtcttgtgggcctggttagcaagaatgtccttgtgcgtcaagaggataaatctatttcagggatgacaaaactgctcctggccctttgagccctcaggcttggcctggagctggtgtcctcacagccccacactctgctggctccttggcaggagtgtgcttctgccaggtgcaagtgtgggtgggggaaggagggggtgtgccagctgtagcccagcaaatgctggcgccccaggggctagtgcaaggtgcagcaggtgagatagtggacagacagaccttggcccatcagaaggaagtgctttctaacaggggcaccagatcagttttgttcatacacacactcatagacacactcactcactgtattagtttgcactgctataaagaaatacctgagactggtaatttataaaataatgaggtataattggctcatagttctgcaggctgtacaggaagcatggcagcatctgcttctgaggaagcctcagggaactttgactcatggtgaaggcaaagcaggagcaggcgtcttacatggtgggagcaggagcaagaggcagcgagagtgggtaggggaaggtgctacacacttttaaatgcccagatctccatgaaaactctcactagaacagcaccaaggagatggtgctagaccattcatgaaggatccacccccatgatccaatcacctcccaccagcccctacctccaacaccggggattaacatttgacatgagatttgggcagagacatggatgcaaaccatgtcgcacaccctctgacacttacgcccacacgcccactcactcagctccaaccctctacctttactggctgggcctcggttgtatagaatggatgctagatatgggcctaggggaggtagaatttctaaaacggcccctgcagatgtccctccttaatctccagatgcagtgaataagatgagttatcactcctgtgatgatgttatggaatatggcacagttgaccttaagataggggggttattggtaggcctgatttaatcccatgagcccgtaaaaatagagagctttctgagtgtaggaggggagggcagagagattcaaagcaacagcacaatgaccactcctggttttggagatgaagggggctatgtgcagggattggagtgaggtcaataggagttgagagtgacccctggtcaaagccagcaagcagcctgggactccagccttgtgggcactagacctgaattctgccaacaaccggaatgaacttggaagtgaattccttcccagaaactccagacaagagtacagtgtggctaacatcttgattttggcctcttgataccctgagcatagagcccagccaagcccacccagacttctcacctatagaactgtgagctaataaatagctgttgttttaagccatcaagtttgtggcaatttgttctgcagcaatagaaaacaaatccagggtcatccttgggctccatatagcttttccaatttcctgagatacaagctgtggttaacttccagttcttccaagctcaaggggagtgagccctgaggagttagcctatctgtggttaaacctatcccttgtgcctacagagtctgagctcctggcccgcagatgctcatatgtgacaatctggagctcaactgaagaccaaggttgtcgccataatggatatccccaggaaggagaattctttgggcaccagtttgtgggtactagcttcctcactggggcagaagaacattcctaggacaagcctggtaggctgttggcttaggcagcctcccagcatttgggctgtagtgtttttttttttgtgtgtgtgtgtgtggtttttttttaaactttcttagctgttgctcaccttagatgtcacctgttgcttcttgttggtaggaccagacctcaggcagccttggctgaggcatttggaggtgaggttgcatggaaataaaaacagtgagctggaaggcatgtgtgagtgacacagaaaccagaatctcatgcgtcccagctgaggtcagaatgtgttggggagcccaaagtaatggctcttcctctgggtgtgggcattcaaaagatgccaaagggagaacctcatcctcaaggtgaatccgcctctgaggagtgactgacaaggtggcatccctggggcaggatgcttggctgagctccatttgatggaggacagaccagagaaagctgaggctgggggctcccagggctcaggttgagtttcccgaagcagtccagtgcatcacttagcaggaccaggggcaaggggaaggtaaattcctgaaaaggagccacctctgtcttgcaggttaaaatagccttgtcccaaagatgtgataacacagggtaggcaggtgagaaccagagggccatggcaagcactgggtgtgtaaacacgggaggagaactgtggttcttgaaaactcggcagtgaggatacctggccacaggccaagaggaagagagctgcttctgggtaagccctgaaacttatttggggatcaactgatttcttcaggcctgtaggtatcacactagtacctggagaggaggagggctctagtgggtcacagttgtcactgagtccttgctggtggctgtggttgtggtagaataaatactcaggaagctactgggcccatggcacaaggtagggcaggtggtcagttggtttctggcatttgacactgtgggatggcaccgtggggaggccgggttccactgggggcagacagaaacatgaggtaggagaagagtgctgatggcctcaccttaatgctgggtaatttttctgcagaagagacttgcagtgacataatctgatgtctgtttcatgaatgaggaaggtagagtcatcacaaatcagccttgcaaataagcatgggcttgtggcattttaaaccaaccttgggcccaagagccagtgtaatcatcttttggtgccaaggcaacaggtccagagggacctgaatttggtgccgatcaatccctctccccaaacagaggtacatatctgtgcctgctctagcagcggcagtcaggatggtacacggcgggctagaggagggagcagcagggctggaggctgggtggagcagccactgtgccatgggccgtgtgactttgtgccagccctttcccatctctgggaaagtgtctgtgagaagtaggctgatcttgcagatctccttggcacccagtaggtctgctgccagccatggggcctatgatgcctgtaagcttggatggcggtcgctagtccacggtcctgagcactgtctcgactcctttgtaaaacaaggagattggattcattgagcatccctctctcttctggctccaatgccccaaatgtctaactgtgtgaaatgcagtgtgattgtctctctgtgaccctattcctggtcctttctgagaccgttcatatgttgggactgagagtttgtgttatctgaagccagcatgctgtccacactgtggggaaagcctgcatgatttgctattgtcctcccctctagtgccctgtggttttagagcccctgccatgtggtctgccatttgtctctctgtctcctagggcatttgcctgctttaatcttctgtgggctgtgcaaacagccctgagcagtgcatggtgaccacaggtaggggtgtctggagggccgtgttctatctcaggcagacatgtgtaagaggaaggcatgaataattagaaacttcttaatggtagggccagcaccagtgattaatcatagcaaaattctcctgccacgcacacagcaaagagtctttatcactcaccccaattagcttctgatgtctcccacttttccttgtccttggctcttagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccggggtaaggcgtctgtgagagtgttgaatgtgccttgcatgcaaaggccaggggccccatgggccacagggtcgtgcctccctctggagcctggccctgtccgtggatgtctgggagaaggtgaagaggaggcacaggagacaaggagggccctagcagaggttgtggggtgtgggtgtggtgtctcggtggctgcctgttccccgtgaggagggtcccggggtgcaggctggcacactgtgtctgtgactcgtaagttccacatgttctctaagtccagaaagctggaattggtccctgtagcctgttgagaaaggtgccagcttgggcctttcagtgttgccaaatgtttagtagattcaaagccatggtactgagtggtttgtgtgaaattagttgttgctaaatcatctcttcttatatgtaggttcaatacccttaaatataggctagatcccttcaaccaggaagagagaatcttgtttagaaattgagcaaattggtttacactaagtcaattaacgcagtcactgaaaatgtgctaatttcacctgattggatgatgcattttttatgcatgtctgcttcttggagagaaatatcactgagttagtgccagggttaagtttggctccatctccctggccccaactcactacttaacgcctcagttggcttcattagtctctttttaacagtagctgtagaaaatatggtgaatctgagaaagcaatgcagcttattgctcttcctataaaatttcccctagctttcaaaaatttttttggttatgtgtaatggagaacacttgcagatggtacaaaatttaaaagatacaaaaatggtatcaattattcagccacccattctcctcctcagaggcaaccactggttttagtttcttatgtattctcacatatatggtctatgtacctacaattatttatgcatacatagtttatttacttatttttacaaaaatggtagtttacaatatacattatactgcatcttgcattttccacttaacaatacatcttaaagataatgccatatcaatatataaagaacttctttgtccttttaaaaaatatgtacatagtattcctttatgaggatatatcatagcttattttaattaagttcccatggatgggagtttaggttgggttggaaacaatgcaggccttgtctggagatcagcatcctgaccatgagtctttggtgttcacccaacctgaggcaggtgggcagggcattggaaagcaagagtcgaggtgggtcggccaccagctgaatgggaggatgtcagcctgtagcatataatagcttctttctcccagtctcctggctggcacagagtagtgcatggagcacctgaactgggcaactggtcctcagaaagctaagtgtctgtgagaggcaggctgatcttgcagatctccttggcacgcagtaggtctgctgtcagccatggggcctgtgatgcctgtaagcttggccggtggccacgggtccacaggggtcctgagcatcctctctgatgtccttagccatggcatgagccccttgtcatgctgagtccattggttccccagagaaagaatttggcttcgttgttggcagggacatatttttgtctaggatgtcggtgtctgctcacctattcctgccgctctcagaagccatccactggaagatgtaaaaggaattaacataccttatggggacatttggaggcaggaaaggagaatctaccatcgtaacaaaaagtcttgctttttgtatttagtatttactaaatactacttcttagtagtatttagtaaaagtataaaaacatgcataggaaaaatatattcagacttcttccctctgaggatggggtagggaggagagtagagttttagctgtatctgtgatgatttatttctttaaacctgtgagaaatttgaaagaattatgctaaatattattgtcagctctagaaggtaggttatattatctttggtgcctgtctgtatgtttaaaatattacaaaattaaaaatgatgattttattaaagcagaggagatcactttcaggccccagccctccccactctgggctatgccagcatatggtgcctccctctgctgttccccttaccctgcattgtgtctgtctggccacttgtctccccaagcatatttctgcgattcccatccttcccaaacagactaagattaatgagcctgttggaaggcgggaatttatctcattcatctttgaatatgaggctgctctggtaaagcagaacatccttagactttgggactcaatcaggttagagtctgaaatttgactctgtagcttcctggcaagtgatttatcctctctgggcctcagttttcccatttgcaaaatgggttgctgtaaggagcaaaatgaaatctatggaaaggtctggcacataacacatgacaatggggcttgttgcctggatgagttgggtgattaacagagttaatcagaagtgtggggttggcaaagaagcaggctgagcatgcagaatttgcttttgcttcttgttttgtttcgccatctgaaggacacatgaattttctcaactgaaaatgacggtgctcatcgccttcagggataggactcaggctttgtccctccatgggcctggtacaaaaacagacttttggcttaattagctgcatgtgaggccggcttctgggtgtgcaggctggagcacttgtctgtcttccaacgaccctaactcctcctgtgtctcctgtgttgggggtctccaagaccactccaggttggatgattcaccaggaggactcacaggactcagcatatagctgtacttacagctttgatttattacagtgaaaggatacagagcaaatcagcaaagggagcgatacatggaggatacgaggtgcaagcttccaaggtcctctcccagcagagtcatcagaacataccaaatacctccagcatcacattgtgacagcacatgtgggaagtgttgtttaccagggaagctcattagagattcggtgcccagggttttcactggggctggtcacatgtctgcatagcacatctcaaattccaggctccagaaggaaagcaggtgtccaacataaaccatattgtttgtacaagtagtttaggtgcaatgaaccactcttattggtcaaggagtggtgagaaccctcctgaaatctaggttcccagataccaggcaagggccaatcttgcaagcacatctttccaaggatggcagtctcaggcctgctgcatgaaccctttcctgcctgcctcccttctgcagatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccaggtatggagctctggctggaggttgggtcccaagtgtgggcagaccgagagctagtcagggcttttttctggctcggtctatttcccctgatagtattttaaaatgacaatgttctttcattggcttctcccacactgatgtttgatggttcccccaaggattgattctatgtgtactgtatgcctagcctgtgcagagctgaactgttgaagtcaagacagagatgtgaaagacagtccttgttcttgggagtccaccagggagacagggagtctcatgtgggaattttttttttctttttttttgagatgggtcttgctctgttgctcaggctggcatgcagtggtgcaatcatggctcactgcagcctcaatctcctgggctcaagcaatcctaccacctcagcctctcaagtagctgggatcaaaggcacacaccgccacacccagctaattaaaaaaatatatattattatgttttgtagagatgggggtcttaccatgttgcccaggctggtcttaaactcctgggctcaagtgatcctcctgccttggcctcccaaagtgctgggattatagatgtgagtcactgcgcctggcctcatgtggcatatttaaaagaacacaatcacacagtaaatgccaaattggtggtagggtggatcggggtgggagtaggaacagagggcatgttccctgggaagacatgtaggctctggtgtcaaacacacctgcatttgtatctgggctctgtcaatttcttgggattttgggaaagatatttctctaagcctcactttgtaaaatgtaatctgtaaatggaaatgcaaataatacctatctcccagggctgtcgtgaggattaaacaggagaatgcatgtgaagtacttagttcagttctggcatctagtgagtgttcaataaatggtagctacatttatgctgccgagttcagggaaggggaggtcggagagggctaggtggtttcctcatgaagccttgccatgaagaacctaggagcagtagaggcagtgatgaggacagtaggaaaccccactcctgaaagttggtggtgggggacacataagggcctggtggtctccatcaatgcctgggaccctggctgcctctgggggtagctggtggtgccaagttgccccagtctctggcttccttgaatttcaagtcctgtactttgagcatctggggccctaggtaaatctcagccctttgggcctatttccctatctgagggaagtgggtcctaccaccccagttttggcaaagacagacagaaatgactgtcaaatgtgtactttacatggacagaggacccctgggttctgggcatgagtatggggaagaggagcaacttccgaacatgcaggctgtagcttcacccgggccttgaactgcctgcatctcacagaccactgcattgcattagggcctcctgagctggcctgtggccgtgcctgatggggcattcccctctccagctctgcctgcatcagcccctctgtggctcctcacatgtgctctagggatggtctgttccttccaagcacagatggaggatgcccaggcaggtcactctgccttggcagcttcctttgatgcagatcttgaggtttgctcctgcctatgctggcagctggacagctgatcctggatggtgctggctgagctgcatggagttgaagcctccagctctactgatatttagcatcaatacactccttggccagggacagagtttatcaagagtcaggaaaactaattatgagaataataagaataatatcctataattcattatttgtagtgcattactgtttatgaagaattttcctatacacactattgcaaccctcacagcagcgtgttaaggcagggggtgttatcttcagaggagataggctcagagaggtaaaggagtttgctgaaagtctcacagcagggaaattgcatagaggagttttctacctcctgttggctaattctaaccttaacctatagtggttgggggcagatggctttatcattggcattctctgctctgggggagacaagttccctatcctttgctcctttggggagggagtggcttctttatctagcccctcacctggcctgggctcgggacagttattcccactgggcagtccaggtgcaatctgtttttttcctgggagaagacaccgctgctctttttaatattcctggaatctctgaagtgccgaggaaaatgaagcccatttcagttaaattttaaaaaattgttgaagtgctagccatgtgccagggactgttctagacactcagcagtgaacagcacaaattaaagtctctgcctgcatggagtttctattggagtggagaagacatcatatctgagataaagaagtgacatggtttgacatggtggtaagtgctgacgagacaaaaggaagcagggaagagcatatgagatgcggggccggcgcagggttggattttgggcaggaaggccagcgcaggcctccgtgtcttttgagcccatgtgtgctcacaaggtcaggggcactttgccatccctcaatcctgttttgcagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgtaagctagcttctccgcggctgcctgtctttgcacaggtgctgttctgtaggaaggagatgagaaaggcctcacccctctgccctggggtcccctgtacttaaagcatcccagaaagagcgcggtttctcctttcctcagtgctttgcgggtttctgcaacagttttccttcataagctggcatagcctttgacttggtactccctgtcccctcttttgtttttgaggcaccatcttgctctgttgcccaggctggggtgcagtggtgcgatcttggttcactgcaacctctgcctcctgggttgaagtgattctcttgcctcagcgtcctgagtagctgggactacaggcacgtgccaccatggctaattttttatatttttagtagagacaggggttttgccatgttgcctaggctggtctcaaactccagagctcaggtagtgcacccaactcagcctcccaaagtgctgagattacaagtgtaagccactgtgaccggcctccctgtcccttctgcgtgcatagtgtggagcctctgcttgctggtagctacctgggtgcctctgaatggctgtcatccctctccccaggcaggacagcagccttgcagagagttaccagcccagagcataactatttggtgaggagtgatgaagacattgcttcaggccttgagttttctgggtttctggaggggagcatgcagggagcctggggaactttgctcatgggcatggtgcaccatgatgctcgtgggcttggctccagctaacctggtgggcagccatctttctgaatttggcccctcacttcttggtgggcacttaggctgatcagtaatacctggactctgtgagcctcagagtggctgtgctgggagtgggagtctgggtgagaggaggtgctagtcactcctgaggaccttctctcttgttttctgggaatcttgtgatgccagtctcgaaagtagcatagtgagcccaatgtggatgggcagcatgattcttagtcctccctgatctgagggcagaactaaggcatgggaagggcaggggcggttcctcagaggctgtcctcagccaggtgtgcaagtagtggctgtcccatctgggaggctgtgaggatcctgcctagggagagagactgagtgagatggcctttaaactcccttccgactctgaggctgtcctgtgctccgtccactctggggcttgtctgggcagatggatgactgtgctgttgcagtgccggcagatgctcttatggaagtctacgtgattagatgccaaggaagctgctgtttgttttgggggcctgaggaagcagggtagcgtgaattgtggtcgaaggttccatgcggctgtggatgcaggtgtgtggctaggcacctaggctgtgtgtgggctggcagttggccacagcagtgagcacccccatccccaaaggcctttgctggctgataaatcatgggccccttctctgagttggtgggaatctgggggcatcagtccttacagagatttctgtctcggtaacaaatatccctacagtcccaatccacccatgatgcaaaatatcctcctcttgtcgtgaagcctcagagttgagagatccttgggccgtggccattaggtcagggggctggttcctctgcaacccaaggtgggcaggtcatgccttatagtttgactgtgttatcaatcctctgggcaacaaactccttcttcaaggaatgacaagtggctgaggatagaaaagaggaaggaaaggaggagatgaaggagggagacttccactgagcatccactctgcttggactcaggccctttcccaggcataaaccagtttaacccttacttcagccttgggtgttaccacctgatatttactcatgggaaatggaggcttgcggttaattccctaaacacataaacaagaagtcaaaacacctgtatgaggtcccagagctggcctgctactgccccatctcctgactctccactgactttatagagtctgtggatatgactcaacagttcagcagggtctgtagaaagccagaacctcctcattccgccctgctccgtcctgacccttccagccagggttggcccctgcagatgctggaggcctccaaactggagagctcgatgcgactcaactatggtctctccccatctccaacttgcaggaaaacctattgtcaccggcgactgaactttctggaatccaagttcagccttcatgagatgttaaacgaaatgtccgagttcaaagagttgaagagtaacccccaccgggacttctataacgtgagaaaggtgcgttaggggcgagtgttcacagctgcctcacccggtccccctcccagcccatgggatgccctgagccagtctgaggcttgtcccctgtgagaacttcagggctccttgctaagggcggccttcgtggccagaggggtatgaagcatatgtgcagaaggaagatgggtgagctgcatttgtgtcaggctgggcctcagacagcacttgaatcactctaggtggaaacatttgtccgcattgtatatctgttgggatgtgccctcttccttggaaaatagggcacagcctattaattggtcataaaagttgagcacagcctacttttaaggtaggggatgtattagagtcatcaaagaaagacacagctgttaagatctctttggtcccctccttgtgtccatgtgttctcattgttcagctcccttataagtgagaacatgcggtgtttggttttctcttcctgtgttagtttgctgaggatgatggcttccagctgggcttaatacctaggtgacgggttgataggtgcagcaaaccaccatggcacacgtttacctatgtaacaaacctgcacatcctgcacatgtatcctggaacttaaagcaaaataaataagtgaataaaataaaatttaaattccctgaaaaaaaaaaaagatctctctggagatgggagtttgtggttttgcatccttcgggatcatgtggatttaaagaaaagcctctgatatgctcagatctctgcctctcttctcccaccaaggggatggcagccttgtccggggctcctggcagtctccgcctgcaggggccgcaactgcggtaggagcgaaggttaaatgatcatggccctagcctttccattctcttttgctgaagcgctgtgcagtgaggcacagggtcagtgctaggcagggggtgtttgatggtgagcaagagtcacttcctgtcaaccaggtggctttgagggagaggccagaactgagctgacttagagtgagtaggagcttgccaggcagagggtgtggtaggggaatggaagtggtggcattccaggtagaggcacgtgatgtgcaaatgtcaggagggagggatggtatgagagagtcgagagagtcagaacagtgtgttgacataactgcaagcagtgtggtgtggttggagctcaggcattgggagcggggagcagcgggttgtggggagagtaaggctgcagagatgtggggaggtcctggatcatgcaggggctgtgggtttcccacagaaggcagggaggtgggccggggtgtggtggcgagctgggagagaagctcctgggggaagagtcgggatcaggctttgcttggaggagggatggctaaagctgggtggagtcacagtggggttgccatctccacaggagctctgtcccagctgggaacctcttggggacttcttctttttggggtcagctttgataagggagggtaggccaggggaggatgtggctcctctgggaaagcccagctccagcctccctgaccccctggctgggagcatatcagcaatgcagatggaagaccctacctggaggccctaagaccacttctgttacacgccaggggtccaacacagactcccacttggatgggatcaagagctttaagaagtgagagtttggcttcagctcatgtgccctgagaggcttacagaagtgttttggggatttccaggcagaagtgaaaggtgttttagacaccacttacgtgggcaccctggcattttcaccttcaagcaccatttgttccttctctgtgaggcttaggcgttcagacaggtggatgcctccatcactgtgtgaactcctctcagccctgcccaaagaacttcacacgcctagcacatgcccaggcccgtgttcaaagaaacgccttgcccagcccgatgcagccctgccctgagcatacgtgaatgctctgggcttacctgcttcctgctgcctggggccaaggtgtcctcactggctgtgctggcactgacactgttttcttctaaggtggggccccagtgggtgttcctgggtctaccagctgccctctggccacaacatgagaaacagtcctggcgtggggctagggtaacaaatcagagcctatccccagggttctcctgcagtcttggggttaatgttttctctggacagagatgaccttgatatctatgacccagtggcctgttcttaggcaccacagtcagtccataaacatgggcgcaggtctgctatgagtcaggtctgtgcccgcccctgggtgctgcctacttgatagcactctgtctctcttttttttttttgagatgaagttttgctcttgttgcccaggctggagtgcagtggtacaatctcagctcactgcaacctcagcctcctgggttcaagtgattctcctgcctcagcctcccgagtagctgggattataggtgcctggcaccactcctggctaatttttgtatttttagtagagatggggttttgccatattgcccaggctggccccgaactctcagcctcaggtgatctgcctgccttggcctcccaaagtgctgagattacaggcgtgggtcaccacacctggccttgatagcactctcatagcctctactatggggaggagagctgctttctaaaatccagaatgggctggatgatggcctccgtatgtctaaagtggctattggtgtccctggggcagacaagggctgtggtctgaggcaggagctgcgacgtggccgtggatctgtgtgggtggtatctgtgaaggcacctgtcacactacagcaggtgaagggctgagacaccccgaggcccagccagcaggactgtgtgactgagacacttgttttctatgcagaagcaagacagaagagctgagtgtgtttgctgcttgggaattgggtagaagtaggtgacatccactgtggtttaagtgtcatattaagaatagcaaataggttttaccttctgtgccaaacctgaccaattaggggccacccctaaagcttagtgaaaagagtgctgtgttcgattattgatgcctgccatgggtatggaaatggtcaatgttggcttaggtcccaggtctggaaactctgctctttctttacatctgaggtcttaggtgaacacggggaatgcacttggatcctctggtgaactgaaaacactgacctccaatgaccttcaattattttgttcctaaaataatcacccttgagttctgaagtttggatggggtgcttcctggattgtccagttgttttcctcatttatcttgtgactcatgggggtaaggacaggctgacccccctgtggtgtgtcattggtaagccagaggacaggaccagaaagcccagaatccgctgagtcatgctgaggtcattgtaccaagctgtgtccagctgagctgagccaggctgaccttcttttgtgcatcccacgtgagcccagcctcatctctgaggagcctgggctttggggatgttttagttttctgctttgctttgtttccccagtgtccagtggtctgtctttctggtaagaatggcaagattaatggcaggaaggatgctgatgagtgagtgctgtggctaacgacatgggctggctggcataatgctcacagaggtccagtggatcaaatatctggtttggcattacttggagatgctcagccagccgtggacagcattccctgccctgaggtcagccgcctcctcaccccagcccgggctgagcgcccagtcggccgcagcagtagctccagagtgtggtctaatggctgtcagcagcctggccttgaggctgctgtcgtcctcccccggagctcccataggtcccttgtgctcagggagggggagtcagtttacccatagtgacttgaggccatccctcagcttagctggggcttcatttccttagggcttgtggttgtcctatgagtgaagcacagtgaaaaggcagactggggatgaggggttggggagatgggtaggatccaggcaatattagcagagccctcatcctaagattaatgaagagggttcagtaacagaatcaaattacatttaaagaatcccttctagcttctgtgtatggagaatgaattgaaccagagcacaagaaaaaggaacaagaccagttaggaggtcactgtgaattcaggcctgagaacatgcaggcttgaactcccgtggtggcagtgaggttggagaatattgtatggatttgacatccatttggaaggtagaactgatgagactcactgagggaagggagtagtaggaaggccaaggatgactcccagtttttcagcatgaccagctggattcaggacacaccatttcctgggattccagaatctgggagaaaatcaggtttgggctggggtcagagatggagagtccacttttggatatattaaatttgaactgcctttgggttatccagatagagatatcaagaaggcaatagtatgtacagttctggagcttttggctggtggcataaatttgggaattggtataaggaaaataattaaatgcacagaaatggaacagatcacctttggagagaatttatagtgagaggacaagagggcccaggaccaggcatcaagaaattccattattaagaggtctggtagtgaggatgagctgactaaggaggctgaaaaggagaggacagagatgcaaggggtcggtctggtatcacaggacttagcatgatatagagggcatgagaaatcccatgaggtgttttgagaccttgctgggctccttctgcaaaggtgccttctgcaaaaaactgcctttccctggaatgtggggagaagtctaagctgactgttcatttctgcttcttaggatttgctctaagatctttggccttgggccccacagcttgagtccatatgttggcttagggtcagtagagcggcttccagtagagtggcttcttcttgggacttggatgccctggagtttgggtgaggtgtaactagtcaaggaagggtgtgtttggaggcttggcctttagtgtctgttcttttcattcattcccacttggaggtttgctttgggaatgctctgagggttctgagagggatcaatgggaagagtgggatttgatgggccctcagggttatcactaaaactgtgagaacctgtcgtacctgttaatttgttcattcattcatccattggttcgactttgtactaggctctggggtaggtgctgaagacttagaggcatcaaacatggcccttgtccttgaggagctcccagtctagtgaaagcgtagacacacaaacgttagagtgatcgggacggtctgcacaacaatgggatgcctgtgccaggttttgaggttgggcaagggaaagagcattcagttgtgcttggaggaacaaggttggctcccaaatggaggaggttgtgggaaatttctaggtggatgagatggtggagagaaaggagggcattccagactgaagaaacacgtgggcaaagggatgcagtgtactgtaccttggtgtgtggtgtacccgtaagtggtttgtcacggctgcagcacagaatggggcagtggcaaggcgagagttaaggcttgaaataagccttgaatctcaggccaaggtgcttgggctttatcttgagactgatgggcccataggtcatttgttaactggggaatggcctgatccaatctgcattttaaaaagatttcctggtgctgtaaggaggtggaatgcgcagcaaggctgaaagggagggataccagttccgaagtctggaggagaaatggggggtgggatccagacactggtggggctgcccggatggcccatgaggtgctggggttctgtgcacattgagggttggatgtcttaactcttgttgctaggggaggtggcctgactcagggcctggtgggcgctgtgttccaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcggtgagtgagcttctgctccagtgccgccagcagacagcagccctggctggggactcagccccctggaaagccaccatgattgtgcttgccgggaggtgctacggaagcagctttctcttctatctgactgagaggtcatgcggcctcagagaataacaggtctggggcagccatgggacagggaaagagggtgtgtggcttggggcctgacaggtctaagcactaatcccactcctgccacttaggagttttgtgcccttaggcaactcacagaagcctttatttccttgcctataaaatggtgacagccatgtgccttattaacttaaaaaaatattaaaacactaaatgatggtgtaactgctatggaaaacagtatggtagttcctaaaaaagttaagtatagaattacctatgcctcagcaattcatttctaggtatatacccaaaagaactgaaagcaggaacttgaacagatactcacataccaatgttcatagcagtattattcatagcagccaacagatagaaacagccggtgttcatcaacagatgaatgggtaaacaaaatgtggtatatccatacaacggaatatcattcagccataaaagggagtcaagtactgtacatgcaacaaccatgaatggatttttcaaaagattatactaaatcgaagccagacacaaaaggacaaatatcatatgattccactgatataaggtccctagaataggcaaattcatagaaacagaaaggagagtagaagctaccaggggctggggagaggaaggtatgggaagttagtgtttagtgggtatagagtttgtttgggatgataaaaaagttctggaaatggttagtggtgatggttgcacaacaatgtcaatgtacttaaagccactggaactgtatggttaaaaatggttgaaatggtaaacgttgtgttgtacatgctttattagaacaaaaaaaacttttgttaaacaaaacattgaatgatataatgtggagaaagtgctttacaaaatgtgagtagtgatagggaatgttctattattcagtggtgcagcctctctgctcactaagtcagccatgtcctgagccgagctgtggtaacttgcaggtggggcctctgctgttccttcacagggggccttgccaaaggatcccaagctgaccgagtgaggatccatggtcctggtgctcaggagtttctaaggtttcatgcaagaattgacatagaagatgtctttcggtgtggccatacagaaggccgcctcgtaaaggtctagagaggggaacgtgcatggtggctgcagaacgatgcgttgattggtgtggtctcccccctcagggccggcagacattccaccgctttgacaagttcaactccaaatacaaccctgtgggggccagtgagctgcgtgacctgtatttgaaaactgaaaactatctgggaggagagtactttgctcggatggtcaaggtgagtgaaccctcagtctctctgaggcctctcaggtgcctcccaacatctgccttcagagagtgggggccctgtgtgcccctggccccttcccctccctctgtgtaccatcagctcagggaagggtgaggtgcccaggtgcccagtgctgtggtctggctgcctgctccaggcagtgctgcatgtgccaactgcaggaaagaggagggaagggtatccaccttggccaagctcacagcacctggcctggctttcgtgtctctgcagcctgaacctagctgggtgcagatgagctccgtgtggagatgcttctgctgtggcctggttctgcagacccaaggccttcctcaccagagggggcctctcctaaagtggaacaagagcttacaggagcaggcagccctggggatttagatgagtgcttccagcctgggagcaaggtggctgggggagcaacaggaccctgctggtgacggagagtgagagtctcccatgtagctgggatgcactggggctgacccaagctcttcttgtgccaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttagtaagtgaggtggcccgctgtctaccctgtgccctacagaggtgacaatctgtccctcatgggctgctgagtctgcactcctgaggggtagggcctgttctggtgccagcttacgcttgtcctttccagggatttttccatagaaggagtgatgaaaaagatgtctgcatgacactagagctcttttttttttttttttttgagacagagtctcactctgtcacccaggctctgagtgcagtggcatgatcttggctcactgcaacctccacctccctgattcaagcaattctttgcctcagcctcccgagtagctgggattacaggcacccgccaccacgtctggccaatttttatatttttagtagagatggggtttcaccatcttggccaggctggtcttgaactcctgacctcgtgatccacctgcctcagcctcccaaaatgctgggattacaggtgtgagccactgcatccagctgacactagaactcttgatctttgaaaaatatagatgtgcaaaggccttgggggaactactacccccgccttcttctcattgtgggttgaggatggattgtccttttggtgagccccagggtatggggagagctgtagtggtctacattgctggcctctccctggatgtcactcagacggctgctgtcctctccaggcggctggccagggtggagcccatggctccaggatgggctggggtatgtggtttagggaaacagagctgagtaacagaatgtttgggtcactgggaatttgaggattcatatctcagtctcttggtcagccagaatgccaccatcccattcctagtggcttctggcttgagaaagtgctctgatgggcatgggtaggtgtggagcttgcaaaccaaggcagaatattgcagacattgctgggagaggaggacagaggagggatctgttttctggtcccatctgacttgattctgggtgtttgatggggacacagggtgcctgaggaagtgactggggctggtctctgacagggcagcaggctgttggatccacctgacaagcgagtctttgctgtcccccagtgacatatttaggtcaaagaagctgctgccaaactttgggaagatgctggagaacatcttcctgccccttttcaaggccactatcaacccccaagatcatcgagagcttcacctcttccttaaatatgtaagtgtgggtggtgccctaggcagggctcatagcggcagaggcaggaatggattcgctgtgagctgggtcaggcttgctcctgcccttcacgatggtatcttaggtcctgccacctgtgttccaggcgtggggtcaccagccccaagaagctagatttctaaaaagtccccttctcctcaggggcagctctgggagtcagtgggtgtggggggatgggggtggtggtcttggggtaggcctttcccccagcagggaaggcaacagtgggcaaagactgggaactcggttcctgccaggtggggctggaaaggctggatctagcccccggcagcaccaagcagcagcctcaggtttttttttcggaaatgcaaacacttcaattcacctgctttacctcgcaacagaggccctcacaccatgtgtgattaagtacaagcccctaaagtgtatttcccttccggatccagttgtaggagaaggagaggagcagtctgggagaggcttaaccagggagggaggcggagggggcgggagccggtcccaccctccggatgcctgggatcgagggggtatcagatggtgatacaggccagtgcctggtgatggatgactttctacagggagaggcacagcggggagcccgagggctggggcacggggaaagaattgagtctgtgtgcccagaaagtgactggacaagctgagggacatcatcaaatttatgttttagacaaacatattctggctgttgtgtggagttggcccagaagagaaggtagctggaggtgggggcaggggtgagagtcaggggcctgcctggagacaggaggggagcttgacccagcggaaatagctcacactcgtgcgtgcttctgcctggcctggtcagacgccacaacgtgatctcacctaagcctcacaattaccccgttactatcaccattttgttgttaacagtaagcggaattattatgtgcttggtgcgtgttggacacggtgttgagtgctctccctggattatctcatttaatcctcaccaaagccctgtgaagctgctagcttcaattgacacacaaggaaattaaaacagatcataaagctaaaagtggcagagctggaatgcgtttccaggcaggctgactccagcgatgtaccctgaacccctattctatgttgcctcccaagtgagaatagtaaggtgcacagcagctaccagcttgcgtctctgaggtgtggcagcgcagggactctgcacaaagtgtggggcttggtgagaagcggtgggcgtacacctggcaggacctggacagagactgaaggaggcactggggggagtctaggatgcctcccaggtgcctggctttgcaggagcatggatgatgtgctgtccgaaggttgctgccagcaatggaggaagagcaggtatggggaggaggaggaagagcaggaggaggagacaacgcattttgcacccgaggctgtgggagatgcagtggtgaggccctgcttcagctggatagagctctgaagaggggctgaaattatccgcatgccaggccccagaaagttcgggtgaagtatggagctagtgagcacagagcagagctcaaggtcctccctggccccccaaacccgtctagggagtgcttagggtcatagcagggaccctgtcatttcctttgacacacagggctctgtgacacggaagattctggccaagctgccttgctcctctgggcctttgctgcccccataggaacaggagaggccagcagacctggctggggtctggggcgtgggctgggagccctccagtttgggccagttgtggattaagggggacagtctctttctcccatctgctattcagaggcccctttgcaaagcactgccgtggcctggtagcaagcctcccctgtgcgctgagagcccgtaccctccatgcatgtgttcttggttggggatgacccctgggatcagccagaaggctccagtgactcaggagcagccccccaggggtcccagccaaggtagaactgcagtggaagggtgggggtttcctgaggctactcaggcccatctcagagggcagctcccagtggggattggagagcagagctgcctcccaggagccatggcttagcccagcaaggaccctcttatctgtctgtgaggcagctggcgggtttctcctggccacacctggacatgccctagagtattctctacctaccgccccaaagagtgcagacccagagcccagaacctgttttttttgtttgtttgttttttgttttttttagatggagtcttgctctgtcacccaggctggtgcgatctcggctcactgcaacctccacctccggggttcaagtgattcttctgccttagcctcctgagtagctgagattacaggtgcacgccaccatgcccagctaatttttgtatttttttttactagagacggagtttcaccatgttgggcaggctggcctcgaactcctgacctcgtgatctgcccgtctcctcctcccaaagtgctaggattacaggcatgagccatcatgtctggccaaacctggtttcttgagcaactttcttaattgctttggccctggtttgctcaattgtaaaatggggctggcagccaacccctccctcctgggttgctctgaatatgaattaactgacgtgagtaaagtgctttgagcagggcttgatgagtgatgtgtactaggacccttttccctcatcgcttgtcgctgctgctgatggcaatggccactcctccctgcaggctggcctcggcatagcagaggggcaggtggtggccatggctgctttgcccttcacctggcttggcagtttcctccactgtcaccaccaccacacaggggcttggcactctcctgtctcacctccagagtacctatggaagctccgaaggggcagaccttggtgttgtacccacttttcatccctgggaggaatatggcctcaggcaggccaaggggtccccagctgaggtgtgaacctgaggggcccagacccacaggcctctggcagctatgagctctgggaggctgaaccgaggctgagtcctggtcctgccttggcctggtgctcaggacctctcctgcccaggtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcaggtgcgtgaggcctgccctcgcacatgcttgggttcatgtgttagtacatgcacgcatgcacacacatgcacacacacatgcatgtgatccttgtgtccgtgtgcacctgaaccaacatgcatgtccatgtgcccacacacctcaaaacacacagcactttccagcctgctatatgaggcatgtctccacatgatcacacacatgcaaacatgcccaccataacacacatgccagtacagacatatgtcatgtacagtatgcaatgcagccacagtccacacgtgtccacacatttatatgtacacacaccagggcacactccacgtgtacctgtacatccctgagataatggaagcataggacatgctatcacacatgcacggtcacttactgccacaccaacaatgtccacacgtgcatattttcgttcagcaaatcactgcatctggcatgcgataggcattgccctgggcactggacaaataacggggaacaaaacagactaaatccatgcatgcccttacaggcagaggctcctaccaatacgcacacagacgaggcacacgtggccaggagttagctgcccagggcagcaggacactgagccattcccttccctacaagtcttgcatcccactttcccctgctgggccctggggtctctctagctcagcctaaactggtgctagttggtgggtgtggaggtttcgaatggggtcctgattgaaagaaatggcctggcagggtggaggcagtcctgggctgagcttttggagatgggggctctggttctggctttgctactgacctgttcagtggcatggaacatagacttcactctccgggccttggtttgcccatttccataacacagaggtcagactctgtggtttctcatggccttccctgctctggagttctacgaatgcgggacacaaggccaggagaggaattcaggagagtggctggagggcacagcagggtctctttctactgcgaggcccactctctgcccgtagaggtgatgcttcttggttctaaggggccccagggcctggacctctgcattttaggaggggtagtttccagggtgcactgggtcagcacagctgaccatgggtggtcattccccccggagctggccctgagctgtggctgcaggccccaggcagagccaactggggggggccttcctgattcggaaaccccttctcttacagggagcgcggcctgagcacgttcctgttccggccgcactgtggggaagccggctccatcacccacctggtgtctgccttcctcactgctgacaacatttcccacgggctgctcctcaagaaggtaaccaggtcactctcgggagcccgtcctgagtgactgccctgccctgggctcctgggaggctcaaccagtgaggccagaaggctgggccctcttctgggctgggatgtctgtccttatcttggttttatttttaattatgaaagtaatataatcaaactcatcacaattttgattttccaaaaactggagaaatggaaaaaagccagcccttatgctattacattaatagaaatagccattattagctttttagtatatctaatttccatcttttatccacagcatatttttaatgtgtttattatcataatgaacacagaatttggttcctgcctcgtcccttactgttgtatgacaagcattttttgatgctgcaacgtaatatctatgctcctttttccaaaggctgttgttggatgaagggtctgccactttgtctgtaattgactcaaccagtccacactagttgggcacagagtccatccaccttttcactggtgtacccttgagctctgtgcatacagtcttctccgtattttggatcactttccattggcacgatgtttgatcaaaatgctccctttccctgatcccggtgaggtgtaaccatgggtcacatttttgggtggggtgggtgctacagtagaaaaccactctatcctgggcaggtccacccctcccatcccttcagggatcatctcccaggagctggagtgtttatagtctcaacctggctgtttgcagtcaaagcaataaaacagctagaggggggcatcttctagactgggtccgtgcctaggagaaaggagctgaaggtgtaggctggagtgggctgcccttcctgccctgagccttgcctccagtttggagcaagaatgagcacttccaacagtgggtagaggcaccagggagggctggcatgcaatgtaggaatgagatgaacagtggggaaggggagagtgggtctgagtgtcctggcttcgaggaactcgggttgaggacttgggcagacatggttcagacccctggtttccactggtgaatgcttcttcccttcctttctcccttcccttttcccttctcccctctctggcacttgtcacatgagttcggtggttcttttgcagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggtaaggactttggggtgaggacagtagtgcttcagtaggcaccagtcctagcctgtcctcccatttcaggaacctgagcccatggcttagttctgcttttggggtggggttggtggcccagtgaaggcaggaaggaagccactgttgggggaaaattgtgccatccaggagccctttctttggggttcttgaaccctcaaaggcacaatttagtatctttgccttcctctattttctctttctttgacatttatgagctctgtgaccttggtaaagttattagatttctggatcaagttcttcttcatctgtaaaatggagataaaattttctctgtccctaccctgtaaggattcatgaagataatgaatcaaaggttctaacatagtgtctgcatatattcaaaatggttgctactttttaaatcaatgctattataatttctacactttgggtctctgggaaaataaaagaggaagctaacagtggtgtcatgcatggggactagccgcaagtatacccagcatgttttgatggtgtcgacaagaccagccattgcttaacaaaaacagaagcaccagagtcttttaggacagaggttctccaacctcttggtctctggacccctttatactcttaagaattgaagctttcaaagacctgttgtttatgtgggttatatctactgatatttaccatgttagaaatgaataagaaattttaaaatatttattatctcatttaaaaaccacatcaataaaccaatgaaatgttacataataatgattttttttctgaaaagtaacagtttcccctgcctttgttttgcatttttaagcctctttaatgtcttaatggaagtcagcaggactcttctagccacttctgcattcaatttgtttttaatcaaaatatgtaaaaatagaaatcttgcctcatgaaaatacataattggaaaagacaagacctttcaaaaggtcttaggaccctcaggggtccttgacctgtacttcgagaactattgctctaggctacagcggcagtggggtggggaagaggtcacagacggcttgtgatgaatagacacttcacatcccagaagggaagcaaaaccacagctcaaacccagatcattctgggattacaccattttaccacttatcctatgatcacttctcattttttttttgatgttccatctctgcttttagtactttactcatctatctatctatctatctatctatctatctatttatctatctatcatctatctatctattgcaaacttaagaaaatagtgtgttaaaaagaaaagctagagggcaagtgctaaatgtggcatgactagagggcttgtcacaggagagcagagactgccatccctgatgactggcacagggtttcaacatgaggtctcagtgctggtcaatgaataaatgtagaggcgtgattttagatctctctttgataacccatgattttacagaagaaaagatcttaggctttgaaggtgtgatgtttgatgatccaggtgccatttagtgaggaaaagttaaacccgcagtgtctgatgttgttagctttggacatgtgtgaacgattgacatggatatccccccttctaatccacatgctttgggggaggatctaggaagcacttatggaagaatatgccattgcagctcaagtgtggaagctgagcacctgcgacctgtgtgagatcgccaggaacagcgtgctgcagagcggcctctcgcatcaggtatggagtgtgacggtgctgcctgtgtccctcctgggaaggctgcctgctgtgtgccaggagccttccaggcactggggatctgtgatgaacatagcaggcagggcctctgagacactcaggcacagggagagaagacgcggcagcctcctgtgttttcatggctgcttcctcacccttctcagacctctacgcctccttggagaggccttccctgatcgcccattctaaaatagccacacacttgctattattctctatccccttaatcagtttttctccataccatttattcctgctgatgtttagttatgtgtttttctgtctttccctctagcatgtaagctctgtgagggcagaggtttgttcagaattatatccccgggccctagatagtccctggcacatagcaggcgctcaatatttcttgaatagatgaacagtatctagactgaataaaaatctagactatgggactcagacatctgtcattttttaaaaagcctgatgaggagctggcactgagacccatgttctgatgtacgttaggtcccccgacacctccctgggtgatgtcactggttgggaagaggttgcattaggggctgtgctcgtcggatgatgatgcagcagagttaaaggcttaagattcttttcatgcgcagtgtggtgccttggattggccctccccaggaacattgtccttgtcagctctcaggggcttcttaattagagtcttacctccttcccctttgcctttcccatccccagcagctgctgcagaccttatctttcctctctgatcaaggaaagcacagccaggaatgaagggctgtctgaggatgactgaggttgtcagggtgacatccttgaggacacagaggccagcaggaattttaagagttctgtggggataagatgtcctgaccaaagatctgcttcagggggactagtctgacttgctgtgactgatgtcaaagctgcccacatggctatagaaagtgaatcaaaagtatatagtttcatttgtatttctcttggtccacaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccgtttatatacatttgccctaacataggaagtattgtgtagtttctcattgtcattttatctgtatcaagtatctttttttaaattgttaaataaagtcagctaggactgtg

SEQ ID NO: 939 - DNA, 52461 bp, Homo sapiens
aaacaactgacccatccttcctgagctcttctccccaggatttcaacagcaccacagaaatagccattttgctcatggttatttcccaggaccacaggatttgcctaagtcactgggaggctatgtgtctgttctgagccttcccactctcctaaagggcagatgaagatcagagctttgcaccctgtgatgccattttaatcaaccctgcttggttttagaggattgctcctgtgggtcacttgaggcaggctccaccttccccaggaggagtggcagagtccagccagcgctcggagctggaggcccacgtgggagcagtgagcggctgtaagcaggggagggtttggggtgggctccggtgggtcagttggggtgtactccttttctgtgtgtgtggatgggggtgggggttctggtaaagcttatcaggcttcgcagtcacctgtgatgtgggcttccttctgggaagaaaggaaggagtgggatggggctgtcagcttttcatcctagcctgcccctgtcctctgtccgcctctgtgctgaggcagttcctgctccctgagtctctgtcctttcctgggaaaggtggaagcagttcatggtctttccctttcagaggaggaggggatggaggggattgtattagcaactgggattgaagctccccctggcagttatggggtgcccttgggagggctgctttaggggggctttctgagaagaggcaggtcgggctgtacctgagaccaatccccttgataaaatgcagccaggcctgaagcacgttcagaacggaagcagcaaaggtgatgatatcgctcgttgctactcagctttcaggaggaggctgggcgttagagggaggctgtggcttatctcctgcagctgggcaggacggctgagtttactgttgtaaagaggaagccgccgctttagtttcctcttgtgagggctgtgaagagggccaggacactgcattcaggataccacagccattttgttttggataactgggattacctggggacttcagggctcttggaaattttccactcatatttcatattcacgagagaatttccagcccaggcttttcctgctctggctcactgctgctcacagatatgcaaaacagagacctcctactccagccggcagacaggacccagccagctgcacgcacgcactgactcagctgagcctcctgggtggcaggcagcacctcacccgggtgcatcacttgagtggcatcttcaggaccagtcatggagccaggctcaggtctgtgtcggggcttctgcaaggggagtctggcaagagtaggaaccagcttccttcgtataacgaggggatttcagtggcactgggcttcctttctggagggactgtggcaccatgaaaagttactgtttgttgaaactggcagtgttttagaactttctaactttgggacacttcttcaagttcatcagagcgtgttgcatgtaacagtgagataagctgtatcattggctgactgatgctggtgaattcacagctaagcctcccaagcctgctggcttcagctgacaaagggttggaagccaggcgtgaacatgcagctggagctgaagctctgcttggcatctgcagagtgagctttccttgtcaggcctggcctggcaggtgtctggagggtctgagaggagagacactctggagggacgggttggcaggtgggagctgtctgccaaggacatccagaaggcagcagatgtgggggcagctgctaaggcctgcagcaccccaagtgggttacttggtccatactaagatatggaattaattattttgttgtggttgctgttgtttcttgcttttttttttttttttttgagagaaggtcttgctctgtcacccaggctggagtacggtggtgccatcatggctcactgcagcctgcacctccaggactcgagcaattctcccaactcagccttccaaatagctgagaccacaggtgcatgccaccacacctggctgtttttttttctattttttgtagagatgaggttctgacatattgcaccaggctgatctcgaactcctggcctcaagcgatcctcttcagcctcccaaattgcttggattataggcatgagccactgcacccggtcttggaatgaattatctaccaactatttaagacactggtagtagttctgcggaagatttttatgggttctgtaaaacaaaaagggttctgtatgttaatgttactctatgatccttgattttaatgagccttatgaatgtgagttgaggggctgtggaatgcaacatctcccaataactgaccacaggacctgttttaccagcaacaggtatcaatttcttatggcatccagtttgggaaaggttgatttaagctaaagagaaaggaagatatgttatagaaagctgtgtcctgaaaagtatttttagttgattagagcaagctaaaaatgctttgtgcgctggtatgatggctcacacctataatcctagaccctgggaggccaaggcaggcggatcacttgagaccaggagttcaagaccagcctggccaacatggtgaaaccccatctctactaaaaatacaaaaattagccaggcatagtggtgtgtgcctgtggtcccagctactcgggaggctgaggtgggagaatcaccggagcctgtgaggtcgaggctgcagtaagctgtgattgtgccactgcactccagcctgggcaactgagaccctgtctctcaatcaatcaatgaataaatgcatgcttcatgagcaaacatggcaggatctggcataagagccctcagacatcaaggacttccctcccacccaaatacccattgccaagggagcctggttgggggtgtctgggtcaggcctgtgtgtgtctgagggcatgaaggaggtaggaaggtgctgctggtggtggatggcttctgtccagggtaggagctaacacagagataggtctgaatggtgaaactccctttggcctggcctctcaatagtgtgggttaggctgatcttgaactcttagcctcaagtgatccttcctcctcagcctcccaaattgcctggacaacatggcaaaacctcatctctaaaaaaaaaaaaaaaaaaaaaaattagccaggtatggtgatgctccctccctccctcccttcggcaattaaggagggagccctaattgccaaaacctgccagaaaaagaagtttgttttcctatttttctctcttttcatagagtcttaagtctactcattttctttctattctctttgtatttgttaaaaatggcattataatagcattcatcatcaaaataaaatatcctctcacacacaggcagccctgccacctggtcattttgactgcgtgaatctcttgcaggtcttgcccataaagggatgcattttcctttcactgtaaataaagcatgggtatggttctatgtattaattttttcatttactgtatttttatttttttatgtgattgcaccatcctcataatcataattctgattacttaacatctttttcaagtgagtatgctctaatttaggcattttaaagctatttatgtaaataatgcaggtaaatatccttgtgcttttcattcttaggattctttttttgaaagaaatttgtagaagtaaagttgcttagtcaaatggtatggtgctttatggcatttgcggccttttgcctgggctgttgggttgcatatcttcttctgagatgcgatgtgaggttttgggatggtgcccttgattggtggccttggaataaggggggaggtgaggatccagtttcgtttcagcctgatggagcctcctgggtctggttctttgtgctgttccagactttctctcccctgtcacctcctttgatggcctccagcttcccccctctctgctatcaagacatggaaatccccacaggcagctctgttcctcttcctttttgcagaggccaggcctcgctgtcttgatgtctgctccccagacagttgtgtgttgacaggctgttccccaccagctccctcccactcctctcatcagggagtggcaggtccttgggtctcagagttaagggagccacagacctcactctgattgcctgttgctagcctgctttcttccttcctgtctgtgtcatgacttagtcccacatgccactcagactcagagcagcaagccctcctcaggcaccggaaatctctctggtacctagaattatgccacttagagctgagagggccttagagaccacttagttcaatccctttatctcacagatgagaacattgtgaggccggagaatgactgtcccaagatggcctagtgtgttcccctcccctgtagctgcacttctccctgctggacagcagcagggctctgtctcatctccattcttgtctgtctggtccacaaaaccacttctctctttaaaccaactttaaagaaactgtggtcataggtagatgggaaactcctcttccagagctgctcccaacgagggtggcttgtcgaaaagggtgcagtattaatccattccacaagtgttatgctggggactgtgaggagcccctgcccggacacatacgtggacaaagagaagcagcacagcatggtgggtgaggggacagaggcaggaaccaggtgcctgggttcagatccctgagctgaggatcagagaggaaagggatgagagagaaaggctgagaacagcacaaatctctgctgacttattaaaagtgtgaccctgggcatgttagctctctatgccttcattttctcatctgtcaagtgggaataataagattaactgagttaataagtatgaagttctttgcagagtatatatatgtatgtatacatatataaaatatatattatatataatatatattatatataatatatattttatatatatatatatattttatttttaaaattgagacgaggtctcaccctgtctcccaggctggagtgcagtagtacgatcataactcactgcagcctcaacctccctggctcaagagatcctcctgcctcagcctccctagcagctgggattacaggcatgcatcaccatacctggctaattctttaaatcttttttagggatgaggttttgccatgttgtccaggctggtctcaaacttctgggctcaagcagtcctcttgccttgacctcccaaagtgctggtattacaggcgtgagccaccacacccggccccagagtatactttttttttttttttgaggcagagtcccactctgttacccaggttggagtgaagtggctcaatcttggctcattgcaaccttcacctcctaggtttaagcaattctcttgcctcagcctcctgagcagctgggattacaggtgcctgccaccacgcctggctaatttttttgtatttttagtagagacgtggttttgccatgttggccaggatggtctcaaactcctgacctcaggtgatctgcccgcctcagcctcccaaaatgctaggattacaggcgtgagccaatgcgcctggccagagtgtacatattaagtgctatacaagtaattgcaaaaaaggaaagaaataaggaaatgaagaaagcaagcaagcaagaatgaaacccaaccaaccaagcaggtggttgaggccagtgactgttagtaaggaatcagtatgcgaggaggtggatagagaaagcttctttgagggagtgagttttcagctgggtaaagagtgttctaaaacctttattttatttgctgtgtcttgttaggaggttccagagggtttggaactgcaatagcagattctttctcttcagcaaaaggccttgatttatgtaatgaagaatgcagctttggatttcccagggctctgctgtaatcttgtgcgaccttagctgttaaagcctctgtgaagtgggggagtgaggtttgattattgttgcagctataacagtatcctcatagtctggaggagggagagctgaactctctcttgtcccttctcaaacatgggaacaaagtcaggagggcagggctgccaggtgctgcagattccctgagtttgggaaaatggaagcccacctagttgaacagttcattctttgaattttgaacacttgctttctcctgacacctaagtggccctacatgcttcacatccagttacttattgagctaattttgaaattggcatgctgggtttggtctggggcattcctaagtagacagctgaccccaagtaccaggtgggcctggccctcacttcagtgccttctcttccccggtgctggtgactcagggcatcctgcaattcatgcttgttctttctttgctagctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaaggtttgttcccaaggcatggttttcgtgtacatagagtcatgcagacccaggcaggctgtgggtgtgtgtcctgatatgaggcacctcatggggactggtatgtccctagagctgtgttggttccttaaccaagaccacttaactcacctcttatttattgagggatgtctcggtgcctctgttgcactgaaaagatcaaaacccactttgctgctgatgtgaaaaaatacacaccatttccaaatggcatttctcttttctttttggaaatttgaggatttcttaggagacagcaattgtatttcttctcatcacttgacaagcattttgcattactaatgaacacagcttactatttgccgggtgctgtgctgggactggagatgttataatgaacaagatagatagagtccctgggtctagacaataattaagtaactggacaaattaacttaaaaattacaagttataataagtgctgtatcagtcagggtccaactagaagatcagaaaccaatgaagtattagaattttaatgcagggaattggttacacaggtggtagagagctgagaaaccaaacaggggagagagaggcggctcagagattagacacagtaaggagcagctactacccaggacaggagtgacaaggaaagcagtagtgtttctggagccaaggtggagtcgccctggggaaggtggaactgtggtggactttccagtggaaactggagccaaggggaagaggtggcagctgcagagatgcctcccaaggcagagatggaggcaggcaatacctcgtttgaccctttctgcaccttccaggttctcccagtggctgccatgggccaaacctagccagaatcctgctggcacacttgggaaacacaggagaggatgaggaatggatctgagggcaaacaggcccaggagcagcgcaagtgctatgaaagagatgaataaggatgagatggggttaggggagagaaaggccgggaaagagagagaaaaaatccttttttagactgggaagtcagggaaggcctctccaaggagatgacatcttagcggatgcttcagggtataaagaagctagctatgtggccttccagatagaagaatcagctagggcaaaggccccccagtttcttccagaaggcccatgtggttagaggtctgttaaaggaagaagtgctgtgaccagggctggaggacttgtggggcccagatcagactggccttgtgctccctgataagaagtttggattggagtctaagtgaaatgagaagccctcatcctttcacagtttatctcaccctgggctttatcagattttctgcctgcccggtaccctgcaaacatcaatagttgacatggtagacctttgagccctctccgacctagtctgtgatcacactagatactgcctcagttttaaaggcaagtcttttcctttcttggttgtgtagaagctcgcattttcttaactcgtttggaaagaagtaaaaagttgactactggtgtaaaggcaagaacagagcttcaccactcataagaccagtgctttccttccttgaaaggatggtgagcccataaaggcaggagtcactggtgccattggttaacctctgagtgccagccttgtgttggataaggtggggtggccccagccccagcagtgtgctcatccctggagggtcaagaagagtatgactgtagagaccctcattcacactccgtgggtggaacagaagggctgacttcatcaagtgaatggtctgcagggccttctgtgtgttatgaattgagcatttgagacccttaacaatgagaggaaaagaaatcctggcattttttattactaggaacaataagtttctggaaccagtttccactacagagtgacactgggcctgacatctgctgaagcgactgtgctcttctcaatgcccagactcagggcaaaatggaagctttcttactctaagtcttaatggtgctctgtggtttccagaaattcccctgcaaacttctctccaaaaactttgttctgtccttgcctaggttatggtgtcttagtttgcatctgtctgcgccatttgactagacgctccttgaggactggatccattgtggaacttagttggtgggcagtggatgtctggcagaggaagacatcctgcctccccattgccaccatggacactacatcagggtggctgcaacttcttggacctctgtgttctgccactcactgtcatgctctgtgactttggggaaattaggaaacctctctgggcctcagcctcgtcctcatctataaagtggagatgctaacagctaccttcatggggtgttgtgaggaatgagggaatccacaggtaaaaggcttcggacagtgtctggttatagtgcatcccgagtaaatataagtgatttctctgacttcctgctgctgagacagggaacaatagcagctcctgccattgaatacttactatgggctaagtactagcctgtgtaggttggattcattctttaattctcacatcgagcttatcaaatggatattcttagtattctgattttgcagattagggaacgaaggctcagagaagttgaatttactttcacaaagacacatagtgagtaaatgacagagcaagaactagagcccatatcttttgaatctagaccccacacttcaaccataaggctatcccctcttcaggtaggggtggagtcttcggttccctggtctgtagaccctggaatgacactaggtgctgctccctagaatgtaattgttgcttctaaatgaaatggagggaaactggtcaaagctcccgctctgtccatcggcttctttcctgaaaaaaagcttggtccctggactgtcagatgccccagcatcctcctctggggtctgcccatacccaattttgtcttttagtttctcttctcactagaggtgcctttatatgtaaatgttcgaaagttaacattttcatggaggacaccctctccccagctccctctttgtctgtggcacctcccatcccatctcctatttattcttactttacacagaattctataatctggctatattgtttcttatcccgtggcagatttaaagaagcaaattagaagcagggagagagacttctacaggcagggtcacagaggtgatgtgtggtgattataagcctgggctttggggtcagacctattgggttcaagtggcagccctgtcacttactactgaatggccttggtcaaagctcttgactgcctgagctggtttcctaaactgcaaaatgagaataataaaaggacataccttgtgagaattaaatgagcgaatacacaaaaaatccttagcgcagtgcttggagcaccattaatgttcctgttttgttattgttgttattagacagtcaacagtgagagaggaaacaaaataattatgaaaagcaggcacaagaatttgaagcacagtagtttagggataacacacctctgagatcataactggataatacagtgatgatcctgggtcattgagaaaactttaaattatgttcagcatgctttgaggaagaatgcaggaattatgtatttttttaagaagccagataaaaattgatttttaaaaaattaggatatagttaaggctggcaagatggccaattaggaacatctccggtctgcagctcccagtgagatcgatgcagaagggggtgatttctgcatttccaactgaggtactggttcatctcactggggctagttggacagcgggtgcagcccaaggagggtgagccaaagcaaggtgaggcgttgcctcacctgagaagcacaagggatgggggaattatcttccttacccaagggaagccttgagggactgagcctgaggaactgtgcactctggcccagatactgtgcttttcccatggtccttgcaacctgcagaccaggagactgcctctggtgcctacaccaccagggccctgggtttcaagcacaaaacagggcggccattcaggcagacactgaactagctgcaggagtttttttttttttttttttttctgtaccccagtggcgcctggagcgccagcaagacagaatcattcactcccctggaaagggggctaaagccagggagccaagtggtctggcttggcaggtcccagccccatggagcccagcaaactaagatccactggtggccaggcgcagtggctcatgcctgtaatcccagcacttagggaggccaaggcgagtggatcacctgacgtcaggagttcaagaccagcctggccaacatggtgaaacctcatctctactaaaaatacaaagattagccgggcgtggtggggggcacctgtaatcccagttacttgggaggttgaggcaggagaatcgcttgaacccaggagaaggaggttgcagtgatctgagatcgcaccattgcactgagcttgggtgacaagagcaaaactccgtctcaaagaaaaaaaaaaaagatccactggctcaaaattctcactgccagcacagcagcagtctgagatcaatctgggacactcaagcttcgtagggggagggtcgttggccattgctgaggcttgagtaggaggttttaccctcacagtgtaaacaaagccaccaggaagttcaaactaggtggaacccaccgcagctcagcaaagctgctgtggccagactgcctctctagatttcttctctctgggcagggcatctctgaaaaaaaggcagcagccccaatcagggacttatagataaaacccccatctccctgggacagagcacctgggggaaggggcagctgtgggcacagcttcagcagacataaatgtccctgcctgacagctctgaagagaccagcagtcctcccagcacagcgttcaagctctgctaagggtgagactgcctcctcaagtgggtccctaacccccgtgtatcctgactgggagacacctcccagtaggggccgacaggcatctcatacaggagagctctggctggcatcaggcaagtgcccctctgggatgaagcttccagaggaaagaacaggcagcagtctttgctgttctgcagcctccactagtgacacccagccaaacagggtctggagtggacctccagcaaactctagcagaggggtctgattgttaggaggaaatctaacaaacagaaaggaatagcacatctaatcagagaccacatccgaaaatcaccagcatcaaagaccaaagatagataaatccacgaagatggggatgtaaaccagtgcaaaaaggctgaaaattccaaaaaccagaatgcctcttctcctccaaatgatcacaactccttgccagcaagggaaaaaaactggacagagaatgagtttgaccaattgacagaagtaggcttcagaaggtgggtaataacaaacgcctctgagctaaaggaacatgttctaacccaatgcaaggaagataagaaccttgaaaaaaggatagatgaattgctaactagaaaaaccagtttagagaagaacataaatgacctgatggagcagaaaaacacagcacgagaacattgtgaagcattcacaagtatgaatagctgaatcaatcaaacggaagaaaggatatcagagattgaagaccaacttaatgaaataaaataagaagacaagataagaggaaaaaaaatgaaaaggaatgaacaaagcctccaagaaatatgggactatgtgcaaagaccaaacctacgtttgatggatgtacctgaaagtgacggggagaatcgaaacaagtggaaaacactcttcaggatattatccaggaaaacttccccaacctagcaagacaagccaacattcaaattcaggaaatacagagaacaccacaaagatattcctcgagaagagcaaccccaagacacataatcgtcagatgccccaaggttgaaatgaaggaaaaaatgttaagggcagccagagagaaaggtcaggctacccacaaagagaagcccatcagactaacagcagatctctctgcagaaaccctacaagccagaagagagtgggggccaatattcaacattcttgaagaaaagaattttcaacccagaatttcatatgcagccaaacaaagcttcataagcaaaggagaaataaaatcctttacagacaagcaaatgctgagagattttgtcaccaccaggcctgccttacaagagctcctgaaggaagcactaaacctggaagggagcaaccggtaccagccactgcaaaaacataccaaattgtaaagactatcaacacttcgaagaaactgcatcaactaatgggcaaaacaaccagctagcatcatgatgacaggatcaaattcacacgtaacaatattagccttaaatgtaaacgggctaaatgccccaattaaaacacacagactggcaaattggatgaagagtcaagacccaacagtgtgctgtattcaggagactcatctcaagtgcaaagacagacataggctcaaaataaagggatggaggaatatttaccaagcaaatggaaagaaaaaaaaaaaagcagaagttgcaagtttaacctctgataaaacagactttaaaccaacaaagatcaaaagagacaaggaagggcattacataatggtaaagggatcaatgcaacaagaagagctaactgtcctaaatatatatgcacccaacacaggagcacccagattcataaagcaagtcttagagacctacaaagagacttagactcccacacaataataatgggagactttaacaccccattgtgaatattagacagatcaacgagacaaaattaacaaggatattcaggacttgaactcagctctggaacaagctccaacccaaatcaacagaatatacattcttctcagcacctcatcacacttactttaaaattgaccacataattggaagtaaaacactcctcagcaaacgcaaaagaatggaaatcataacaaacagtctctcagaccacagtgcaatcaaattagaactcaggattaagaaactcactcaaaaccacacaactacatggaaactgaaaaatctgctcctgaatgactactgggtaaataaggaaatgaaggcagaaataaagatgttctttgaaaccagtgagaacaaagacacaacgtaccagaatctctgggacacatttaaagcagtgtgtagtgggaaatttatagcactaaatgtccacaagagaaagcaggaaagatctaaaatcaacaccctaacatcacaattaaaagagctagagaagcaagagcaaacaaattcaaaagctagcagaagacaagaaataactaagatcagagcagaaccgaaggagatagagacatgaaaaactcttcaaaaactcaatgaatccaggagctgttttttttttgaaaagatcaatgaaataaatagactgctagcaagactaacaaagagaaaaagagagaagaatcaaatagacacaataaaaaataataaacggggtatcaccactgatcccacagaaatacagactaccatcggagaatactataaacacctctatgcaaataaattagaaaatctagaagaattggataaattcctggatgcatacactctcccaagtctaaaccaggaagaagttgaatccctgaatagaccaataacaagttatgaaattgaggcagtaatgaatagcctaccaaccaaaaaaagcccagaaccagacagattcacagccaaattctaccagaggtacaaagaggagctggtaccattccttctgaaactattcccaacaatagtttggagctggtaccattccttctgaaactattccaaactcattttatgaggccagcatcatcctgatgccaaaacatggcagagacacaacagagaaaatttcaggccaatatccctgatgaacatcgatgtaaaagtcttcggccgggcgcggtggctcacgcctgtaatcccagcactttgggaggccgaggcgggcagatcacgaggtcaggagatcgagaccatcccggctaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaagtcctcaataatatactggcaaaccaaatccagcagcacatcaaaaagcttatccaccacgatcaagttggcttcatacctgggatgcaaggctggttcaacatatgcaaatcaatcagcgtaatccatcgcataaacagaaccaatgacgaaaaccacatgattatctgaatagatgcagaaaagtccttcaatataattcaacaccccttcatgctaaaaactctcaataaattaggtattgatggaacgtatctcaaaataaaaagagctatttatgaaaaacccacaggcaatatcatactgaatgggcaaaaactggaagcattccctttgaaaactggcgcaagacaagtatgccctctctcaccactcctattcaacatagtattggaagttctggcaggggcaatcaggcaagagaaagaaataaagactattcaaacaggaaaagaggaagtcaaattgtctctgtttgtggatgacatgattgtatatttagaaaaccccaccatctcagccccaaatctccttaagctgataagcaacttcagcaaagtctcaggataaaaaatcaatgtgcaaaaatcacaagcattcctgtatactaataacagacaaacagccaaatcatgagtgaactcccattcacaattgccactaggagaataaaatagctaggaatccaacttacaagggatgtgaaggacctcttcaaggagaattacaaaccactgctcaaggaaataagaaaggacaaaaacaaatggaaaaacattccatgctcatggataggaagaatcaatatcatgaaaatggccatactgcccaaagtaatttataggttcagtgctatccccatcaagctaccattgactttcttcacagaattagaaaaaaactactttaaatttcatatggaaccaaaaaagagcctgtatagccaagacaattctaagcaagaagaacaaagctggaggcatcacgctacctgacttcaaactatactacaaggctacagtaaacaaaacagcctggtactggtaccaaaacagatatatagaccaatggaacagaacagaggcctcagaaataacaccacacatctacaatcatctgatctttgacaaacctggcacaaacaagcaatggggaaaggattccctatttaataaatggtgttgggaaaactggctagccatatgcaaaaaactgaaactggactccttacaccttatacaaaaattaactcaagatggattaaagacttaaatgtaagacctaaaccataaaaaccctagaagaaaacctaggacattcaggacataggcatgggcaaagacttcatgtataaaacatcaaaagccatggcaacaaaagccaaaattgagaaatgggatctaattaaactaaagagcttctgcacagcaaaagaaactaccatcagagtgaataggcaaccttcagaacaggagaaaattttttcaatctatccatctgacaaagggctaatgtccagaatctacaaagaacttaaacaaatttacaagaaaacaaccccatcaaaaagtgggcaaaggatatgaacagacacttctcaaaagaagacatttatgcagccaacaaacatatgaaaaaatgctcatcatcactggtcattagagaaatgcaaatgaaaaccacaatgagataccatctcacgccagttagaatggcgatcattaaaaagtcaggaaacaacagatgctggagaggatgtggagaaataggaatgcttttacactgttggtgggagtgtaaattagttcaaccattgtggaagacagtgtggctattcctcaagaatctagaactagaaataccatttgacccagcaatcccattactgggtatatacccaaaggattataaatcattctataaagacacatgcacacgtatgtttattgcagcactatccacaatagcaaagacttggaacccacccaaatgtccatcaatgatagactggataaagaaaatatggcacatatacaccatggaatactatgcagccataaaaaagatgggttcatgtcctttgcagggacatggatgaagctagaaaccatcattctcagcaaactaacacaagaagagaaaaccaaacatcgcatgttctcactcataagtaggagttgaacaatgagaacacatggacacagggaggagaacatcacacactggggcctgttggggggtgaggggctaggggagggatagcattcggagaaatacctaatgtaggtgtcaggttgatgggtgcagcaaaccaccatggcatgtgtatacctatgtaacaaacctgcacattctttacatgtaccccagaacttaaagtataattaaaaaaagaaaaaaattaggatatagagggaaaaattttattagttgaaaaatttggctatctaggacagccgcttccctagaatgttttgagtgaaattgagaaacatatgtgctttatgaattgagcatagcacagctaaagtgttgctaagtcacttcattttatgaaacttgtgaaaataagaatggggaactttttaaacattcaggatcattgacaaaggagcttcatttgaaatagtcaatctatccccttttaaagttagggagagattgggctgggcgcggtggctcacacctgtaatcccagcactttgggaggctgaggcgggtggatcacctgaagtcaggagttggagaccagcctggccaacatgtagaaaccctgtctttactaaaaatataaaggttagctgggtgtggtggcacatgtctgtaatcccagcaactccggaggctgaggcaggagaattgcttgaacctgagagtcaaaggtttcagaaagccaagatcaccccactgctctccagcctggctgagggagggagactctgtcttgaaaaagaaaaagttagggagattgggaagccgaggtgggtggatcacttgaggccaggagtttgagaccagcctggccaacatggcaaaaccctgtctgtacaaaaaatacaaaaattagctgggcatggtggtgtgcgcctatggttccagctttttggtaggctgaggcacgagaattgcttgaacccaggagctggaggttgcagtgagctgagatcgtacccctccattccagcttgggcggcagagcaagaccctgtgtcaaaaaaaagtaaaaataaaaataaagttagggagagagattgtaacacttaagttaacagatagtacagattgcacttcattttcatctccaggtctttagggaggaagggcagctgggaaggattgaggaagggagaagcgaaggtgagtggcaggagatgagtggagattacagtaggccaggaggggttgtggggaagggaggatggagaaagaaggggcaggtttccagaggagctcagggagagacagagggtggggctgtgagttttcacacctgattggctgcaaagtgttagaatcaaagttacacccacctggccaggatgctggtcatctggctgcatatgcggagtgagtgatctctgtgcgcccctgctctctctgtagggacccctgttatagtgcccatcgtgcagcatatttctccagataggctgggacctctggtctcaagtacagggaaggtgtcagcccctcttagttccctccttagatgggggtcccaattccaggtgagccaatgcaggggcagcgtgagcagcagcagtgtgagcctatggaagtggaggatgcctgtcccgcctgatggcattcagattcccagtgtttgcaaaactctgtgctggtttgtgacttctgattccaacctttattttagcgtaacaattctcatgtggaggggctgccagaatgagctgagtgtgcgtgggggaggagttcaaaccagcctccatgttctgaaatgtcccccctctgaccccattgctccactgctcccacccctagtctggattaagtgtctcctctggggtcccaaaatatccagggcatctcattacaccaaccacactgtatgataatctgtggaactgtctgggttcatctcagccatcacagtcggcccctggaggcgggagttatatcttatctactcctctacacccagggcctggcacacagtagtttattgaatgaagtggggtccacgtgtggcccccagctcatagtacacatatgagagcctggtgaaaggttggctccagtgcccctccctgcctagtagtcatctggacagaccacacagggcagtgggcttcagatggcccctggtaagatgctggctattctctaggagagcaaggtgggcctgaagggctcctcactttagcatttgagtgctatatagggaaggccctgggagcctgattccccagagcggaggagggctggggagtggagcagagtaagggaggggacttagtgactgtcaggggcaaccaagggccatagagcaggtggagcaccagacaggtgctgggaggtaagatgctgtaacaacagcccaggtgacctgatcaactctttgtcttgtgggcctggttagcaagaatgtccttgtgcgtcaagaggataaatctatttcagggatgacaaaactgctcctggccctttgagccctcaggcttggcctggagctggtgtcctcacagccccacactctgctggctccttggcaggagtgtgcttctgccaggtgcaagtgtgggtgggggaaggagggggtgtgccagctgtagcccagcaaatgctggcgccccaggggctagtgcaaggtgcagcaggtgagatagtggacagacagaccttggcccatcagaaggaagtgctttctaacaggggcaccagatcagttttgttcatacacacactcatagacacactcactcactgtattagtttgcactgctataaagaaatacctgagactggtaatttataaaataatgaggtataattggctcatagttctgcaggctgtacaggaagcatggcagcatctgcttctgaggaagcctcagggaactttgactcatggtgaaggcaaagcaggagcaggcgtcttacatggtgggagcaggagcaagaggcagcgagagtgggtaggggaaggtgctacacacttttaaatgcccagatctccatgaaaactctcactagaacagcaccaaggagatggtgctagaccattcatgaaggatccacccccatgatccaatcacctcccaccagcccctacctccaacaccggggattaacatttgacatgagatttgggcagagacatggatgcaaaccatgtcgcacaccctctgacacttacgcccacacgcccactcactcagctccaaccctctacctttactggctgggcctcggttgtatagaatggatgctagatatgggcctaggggaggtagaatttctaaaacggcccctgcagatgtccctccttaatctccagatgcagtgaataagatgagttatcactcctgtgatgatgttatggaatatggcacagttgaccttaagataggggggttattggtaggcctgatttaatcccatgagcccgtaaaaatagagagctttctgagtgtaggaggggagggcagagagattcaaagcaacagcacaatgaccactcctggttttggagatgaagggggctatgtgcagggattggagtgaggtcaataggagttgagagtgacccctggtcaaagccagcaagcagcctgggactccagccttgtgggcactagacctgaattctgccaacaaccggaatgaacttggaagtgaattccttcccagaaactccagacaagagtacagtgtggctaacatcttgattttggcctcttgataccctgagcatagagcccagccaagcccacccagacttctcacctatagaactgtgagctaataaatagctgttgttttaagccatcaagtttgtggcaatttgttctgcagcaatagaaaacaaatccagggtcatccttgggctccatatagcttttccaatttcctgagatacaagctgtggttaacttccagttcttccaagctcaaggggagtgagccctgaggagttagcctatctgtggttaaacctatcccttgtgcctacagagtctgagctcctggcccgcagatgctcatatgtgacaatctggagctcaactgaagaccaaggttgtcgccataatggatatccccaggaaggagaattctttgggcaccagtttgtgggtactagcttcctcactggggcagaagaacattcctaggacaagcctggtaggctgttggcttaggcagcctcccagcatttgggctgtagtgtttttttttttgtgtgtgtgtgtgtggtttttttttaaactttcttagctgttgctcaccttagatgtcacctgttgcttcttgttggtaggaccagacctcaggcagccttggctgaggcatttggaggtgaggttgcatggaaataaaaacagtgagctggaaggcatgtgtgagtgacacagaaaccagaatctcatgcgtcccagctgaggtcagaatgtgttggggagcccaaagtaatggctcttcctctgggtgtgggcattcaaaagatgccaaagggagaacctcatcctcaaggtgaatccgcctctgaggagtgactgacaaggtggcatccctggggcaggatgcttggctgagctccatttgatggaggacagaccagagaaagctgaggctgggggctcccagggctcaggttgagtttcccgaagcagtccagtgcatcacttagcaggaccaggggcaaggggaaggtaaattcctgaaaaggagccacctctgtcttgcaggttaaaatagccttgtcccaaagatgtgataacacagggtaggcaggtgagaaccagagggccatggcaagcactgggtgtgtaaacacgggaggagaactgtggttcttgaaaactcggcagtgaggatacctggccacaggccaagaggaagagagctgcttctgggtaagccctgaaacttatttggggatcaactgatttcttcaggcctgtaggtatcacactagtacctggagaggaggagggctctagtgggtcacagttgtcactgagtccttgctggtggctgtggttgtggtagaataaatactcaggaagctactgggcccatggcacaaggtagggcaggtggtcagttggtttctggcatttgacactgtgggatggcaccgtggggaggccgggttccactgggggcagacagaaacatgaggtaggagaagagtgctgatggcctcaccttaatgctgggtaatttttctgcagaagagacttgcagtgacataatctgatgtctgtttcatgaatgaggaaggtagagtcatcacaaatcagccttgcaaataagcatgggcttgtggcattttaaaccaaccttgggcccaagagccagtgtaatcatcttttggtgccaaggcaacaggtccagagggacctgaatttggtgccgatcaatccctctccccaaacagaggtacatatctgtgcctgctctagcagcggcagtcaggatggtacacggcgggctagaggagggagcagcagggctggaggctgggtggagcagccactgtgccatgggccgtgtgactttgtgccagccctttcccatctctgggaaagtgtctgtgagaagtaggctgatcttgcagatctccttggcacccagtaggtctgctgccagccatggggcctatgatgcctgtaagcttggatggcggtcgctagtccacggtcctgagcactgtctcgactcctttgtaaaacaaggagattggattcattgagcatccctctctcttctggctccaatgccccaaatgtctaactgtgtgaaatgcagtgtgattgtctctctgtgaccctattcctggtcctttctgagaccgttcatatgttgggactgagagtttgtgttatctgaagccagcatgctgtccacactgtggggaaagcctgcatgatttgctattgtcctcccctctagtgccctgtggttttagagcccctgccatgtggtctgccatttgtctctctgtctcctagggcatttgcctgctttaatcttctgtgggctgtgcaaacagccctgagcagtgcatggtgaccacaggtaggggtgtctggagggccgtgttctatctcaggcagacatgtgtaagaggaaggcatgaataattagaaacttcttaatggtagggccagcaccagtgattaatcatagcaaaattctcctgccacgcacacagcaaagagtctttatcactcaccccaattagcttctgatgtctcccacttttccttgtccttggctcttagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccggggtaaggcgtctgtgagagtgttgaatgtgccttgcatgcaaaggccaggggccccatgggccacagggtcgtgcctccctctggagcctggccctgtccgtggatgtctgggagaaggtgaagaggaggcacaggagacaaggagggccctagcagaggttgtggggtgtgggtgtggtgtctcggtggctgcctgttccccgtgaggagggtcccggggtgcaggctggcacactgtgtctgtgactcgtaagttccacatgttctctaagtccagaaagctggaattggtccctgtagcctgttgagaaaggtgccagcttgggcctttcagtgttgccaaatgtttagtagattcaaagccatggtactgagtggtttgtgtgaaattagttgttgctaaatcatctcttcttatatgtaggttcaatacccttaaatataggctagatcccttcaaccaggaagagagaatcttgtttagaaattgagcaaattggtttacactaagtcaattaacgcagtcactgaaaatgtgctaatttcacctgattggatgatgcattttttatgcatgtctgcttcttggagagaaatatcactgagttagtgccagggttaagtttggctccatctccctggccccaactcactacttaacgcctcagttggcttcattagtctctttttaacagtagctgtagaaaatatggtgaatctgagaaagcaatgcagcttattgctcttcctataaaatttcccctagctttcaaaaatttttttggttatgtgtaatggagaacacttgcagatggtacaaaatttaaaagatacaaaaatggtatcaattattcagccacccattctcctcctcagaggcaaccactggttttagtttcttatgtattctcacatatatggtctatgtacctacaattatttatgcatacatagtttatttacttatttttacaaaaatggtagtttacaatatacattatactgcatcttgcattttccacttaacaatacatcttaaagataatgccatatcaatatataaagaacttctttgtccttttaaaaaatatgtacatagtattcctttatgaggatatatcatagcttattttaattaagttcccatggatgggagtttaggttgggttggaaacaatgcaggccttgtctggagatcagcatcctgaccatgagtctttggtgttcacccaacctgaggcaggtgggcagggcattggaaagcaagagtcgaggtgggtcggccaccagctgaatgggaggatgtcagcctgtagcatataatagcttctttctcccagtctcctggctggcacagagtagtgcatggagcacctgaactgggcaactggtcctcagaaagctaagtgtctgtgagaggcaggctgatcttgcagatctccttggcacgcagtaggtctgctgtcagccatggggcctgtgatgcctgtaagcttggccggtggccacgggtccacaggggtcctgagcatcctctctgatgtccttagccatggcatgagccccttgtcatgctgagtccattggttccccagagaaagaatttggcttcgttgttggcagggacatatttttgtctaggatgtcggtgtctgctcacctattcctgccgctctcagaagccatccactggaagatgtaaaaggaattaacataccttatggggacatttggaggcaggaaaggagaatctaccatcgtaacaaaaagtcttgctttttgtatttagtatttactaaatactacttcttagtagtatttagtaaaagtataaaaacatgcataggaaaaatatattcagacttcttccctctgaggatggggtagggaggagagtagagttttagctgtatctgtgatgatttatttctttaaacctgtgagaaatttgaaagaattatgctaaatattattgtcagctctagaaggtaggttatattatctttggtgcctgtctgtatgtttaaaatattacaaaattaaaaatgatgattttattaaagcagaggagatcactttcaggccccagccctccccactctgggctatgccagcatatggtgcctccctctgctgttccccttaccctgcattgtgtctgtctggccacttgtctccccaagcatatttctgcgattcccatccttcccaaacagactaagattaatgagcctgttggaaggcgggaatttatctcattcatctttgaatatgaggctgctctggtaaagcagaacatccttagactttgggactcaatcaggttagagtctgaaatttgactctgtagcttcctggcaagtgatttatcctctctgggcctcagttttcccatttgcaaaatgggttgctgtaaggagcaaaatgaaatctatggaaaggtctggcacataacacatgacaatggggcttgttgcctggatgagttgggtgattaacagagttaatcagaagtgtggggttggcaaagaagcaggctgagcatgcagaatttgcttttgcttcttgttttgtttcgccatctgaaggacacatgaattttctcaactgaaaatgacggtgctcatcgccttcagggataggactcaggctttgtccctccatgggcctggtacaaaaacagacttttggcttaattagctgcatgtgaggccggcttctgggtgtgcaggctggagcacttgtctgtcttccaacgaccctaactcctcctgtgtctcctgtgttgggggtctccaagaccactccaggttggatgattcaccaggaggactcacaggactcagcatatagctgtacttacagctttgatttattacagtgaaaggatacagagcaaatcagcaaagggagcgatacatggaggatacgaggtgcaagcttccaaggtcctctcccagcagagtcatcagaacataccaaatacctccagcatcacattgtgacagcacatgtgggaagtgttgtttaccagggaagctcattagagattcggtgcccagggttttcactggggctggtcacatgtctgcatagcacatctcaaattccaggctccagaaggaaagcaggtgtccaacataaaccatattgtttgtacaagtagtttaggtgcaatgaaccactcttattggtcaaggagtggtgagaaccctcctgaaatctaggttcccagataccaggcaagggccaatcttgcaagcacatctttccaaggatggcagtctcaggcctgctgcatgaaccctttcctgcctgcctcccttctgcagatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccaggtatggagctctggctggaggttgggtcccaagtgtgggcagaccgagagctagtcagggcttttttctggctcggtctatttcccctgatagtattttaaaatgacaatgttctttcattggcttctcccacactgatgtttgatggttcccccaaggattgattctatgtgtactgtatgcctagcctgtgcagagctgaactgttgaagtcaagacagagatgtgaaagacagtccttgttcttgggagtccaccagggagacagggagtctcatgtgggaattttttttttctttttttttgagatgggtcttgctctgttgctcaggctggcatgcagtggtgcaatcatggctcactgcagcctcaatctcctgggctcaagcaatcctaccacctcagcctctcaagtagctgggatcaaaggcacacaccgccacacccagctaattaaaaaaatatatattattatgttttgtagagatgggggtcttaccatgttgcccaggctggtcttaaactcctgggctcaagtgatcctcctgccttggcctcccaaagtgctgggattatagatgtgagtcactgcgcctggcctcatgtggcatatttaaaagaacacaatcacacagtaaatgccaaattggtggtagggtggatcggggtgggagtaggaacagagggcatgttccctgggaagacatgtaggctctggtgtcaaacacacctgcatttgtatctgggctctgtcaatttcttgggattttgggaaagatatttctctaagcctcactttgtaaaatgtaatctgtaaatggaaatgcaaataatacctatctcccagggctgtcgtgaggattaaacaggagaatgcatgtgaagtacttagttcagttctggcatctagtgagtgttcaataaatggtagctacatttatgctgccgagttcagggaaggggaggtcggagagggctaggtggtttcctcatgaagccttgccatgaagaacctaggagcagtagaggcagtgatgaggacagtaggaaaccccactcctgaaagttggtggtgggggacacataagggcctggtggtctccatcaatgcctgggaccctggctgcctctgggggtagctggtggtgccaagttgccccagtctctggcttccttgaatttcaagtcctgtactttgagcatctggggccctaggtaaatctcagccctttgggcctatttccctatctgagggaagtgggtcctaccaccccagttttggcaaagacagacagaaatgactgtcaaatgtgtactttacatggacagaggacccctgggttctgggcatgagtatggggaagaggagcaacttccgaacatgcaggctgtagcttcacccgggccttgaactgcctgcatctcacagaccactgcattgcattagggcctcctgagctggcctgtggccgtgcctgatggggcattcccctctccagctctgcctgcatcagcccctctgtggctcctcacatgtgctctagggatggtctgttccttccaagcacagatggaggatgcccaggcaggtcactctgccttggcagcttcctttgatgcagatcttgaggtttgctcctgcctatgctggcagctggacagctgatcctggatggtgctggctgagctgcatggagttgaagcctccagctctactgatatttagcatcaatacactccttggccagggacagagtttatcaagagtcaggaaaactaattatgagaataataagaataatatcctataattcattatttgtagtgcattactgtttatgaagaattttcctatacacactattgcaaccctcacagcagcgtgttaaggcagggggtgttatcttcagaggagataggctcagagaggtaaaggagtttgctgaaagtctcacagcagggaaattgcatagaggagttttctacctcctgttggctaattctaaccttaacctatagtggttgggggcagatggctttatcattggcattctctgctctgggggagacaagttccctatcctttgctcctttggggagggagtggcttctttatctagcccctcacctggcctgggctcgggacagttattcccactgggcagtccaggtgcaatctgtttttttcctgggagaagacaccgctgctctttttaatattcctggaatctctgaagtgccgaggaaaatgaagcccatttcagttaaattttaaaaaattgttgaagtgctagccatgtgccagggactgttctagacactcagcagtgaacagcacaaattaaagtctctgcctgcatggagtttctattggagtggagaagacatcatatctgagataaagaagtgacatggtttgacatggtggtaagtgctgacgagacaaaaggaagcagggaagagcatatgagatgcggggccggcgcagggttggattttgggcaggaaggccagcgcaggcctccgtgtcttttgagcccatgtgtgctcacaaggtcaggggcactttgccatccctcaatcctgttttgcagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgtaagctagcttctccgcggctgcctgtctttgcacaggtgctgttctgtaggaaggagatgagaaaggcctcacccctctgccctggggtcccctgtacttaaagcatcccagaaagagcgcggtttctcctttcctcagtgctttgcgggtttctgcaacagttttccttcataagctggcatagcctttgacttggtactccctgtcccctcttttgtttttgaggcaccatcttgctctgttgcccaggctggggtgcagtggtgcgatcttggttcactgcaacctctgcctcctgggttgaagtgattctcttgcctcagcgtcctgagtagctgggactacaggcacgtgccaccatggctaattttttatatttttagtagagacaggggttttgccatgttgcctaggctggtctcaaactccagagctcaggtagtgcacccaactcagcctcccaaagtgctgagattacaagtgtaagccactgtgaccggcctccctgtcccttctgcgtgcatagtgtggagcctctgcttgctggtagctacctgggtgcctctgaatggctgtcatccctctccccaggcaggacagcagccttgcagagagttaccagcccagagcataactatttggtgaggagtgatgaagacattgcttcaggccttgagttttctgggtttctggaggggagcatgcagggagcctggggaactttgctcatgggcatggtgcaccatgatgctcgtgggcttggctccagctaacctggtgggcagccatctttctgaatttggcccctcacttcttggtgggcacttaggctgatcagtaatacctggactctgtgagcctcagagtggctgtgctgggagtgggagtctgggtgagaggaggtgctagtcactcctgaggaccttctctcttgttttctgggaatcttgtgatgccagtctcgaaagtagcatagtgagcccaatgtggatgggcagcatgattcttagtcctccctgatctgagggcagaactaaggcatgggaagggcaggggcggttcctcagaggctgtcctcagccaggtgtgcaagtagtggctgtcccatctgggaggctgtgaggatcctgcctagggagagagactgagtgagatggcctttaaactcccttccgactctgaggctgtcctgtgctccgtccactctggggcttgtctgggcagatggatgactgtgctgttgcagtgccggcagatgctcttatggaagtctacgtgattagatgccaaggaagctgctgtttgttttgggggcctgaggaagcagggtagcgtgaattgtggtcgaaggttccatgcggctgtggatgcaggtgtgtggctaggcacctaggctgtgtgtgggctggcagttggccacagcagtgagcacccccatccccaaaggcctttgctggctgataaatcatgggccccttctctgagttggtgggaatctgggggcatcagtccttacagagatttctgtctcggtaacaaatatccctacagtcccaatccacccatgatgcaaaatatcctcctcttgtcgtgaagcctcagagttgagagatccttgggccgtggccattaggtcagggggctggttcctctgcaacccaaggtgggcaggtcatgccttatagtttgactgtgttatcaatcctctgggcaacaaactccttcttcaaggaatgacaagtggctgaggatagaaaagaggaaggaaaggaggagatgaaggagggagacttccactgagcatccactctgcttggactcaggccctttcccaggcataaaccagtttaacccttacttcagccttgggtgttaccacctgatatttactcatgggaaatggaggcttgcggttaattccctaaacacataaacaagaagtcaaaacacctgtatgaggtcccagagctggcctgctactgccccatctcctgactctccactgactttatagagtctgtggatatgactcaacagttcagcagggtctgtagaaagccagaacctcctcattccgccctgctccgtcctgacccttccagccagggttggcccctgcagatgctggaggcctccaaactggagagctcgatgcgactcaactatggtctctccccatctccaacttgcaggaaaacctattgtcaccggcgactgaactttctggaatccaagttcagccttcatgagatgttaaacgaaatgtccgagttcaaagagttgaagagtaacccccaccgggacttctataacgtgagaaaggtgcgttaggggcgagtgttcacagctgcctcacccggtccccctcccagcccatgggatgccctgagccagtctgaggcttgtcccctgtgagaacttcagggctccttgctaagggcggccttcgtggccagaggggtatgaagcatatgtgcagaaggaagatgggtgagctgcatttgtgtcaggctgggcctcagacagcacttgaatcactctaggtggaaacatttgtccgcattgtatatctgttgggatgtgccctcttccttggaaaatagggcacagcctattaattggtcataaaagttgagcacagcctacttttaaggtaggggatgtattagagtcatcaaagaaagacacagctgttaagatctctttggtcccctccttgtgtccatgtgttctcattgttcagctcccttataagtgagaacatgcggtgtttggttttctcttcctgtgttagtttgctgaggatgatggcttccagctgggcttaatacctaggtgacgggttgataggtgcagcaaaccaccatggcacacgtttacctatgtaacaaacctgcacatcctgcacatgtatcctggaacttaaagcaaaataaataagtgaataaaataaaatttaaattccctgaaaaaaaaaaaagatctctctggagatgggagtttgtggttttgcatccttcgggatcatgtggatttaaagaaaagcctctgatatgctcagatctctgcctctcttctcccaccaaggggatggcagccttgtccggggctcctggcagtctccgcctgcaggggccgcaactgcggtaggagcgaaggttaaatgatcatggccctagcctttccattctcttttgctgaagcgctgtgcagtgaggcacagggtcagtgctaggcagggggtgtttgatggtgagcaagagtcacttcctgtcaaccaggtggctttgagggagaggccagaactgagctgacttagagtgagtaggagcttgccaggcagagggtgtggtaggggaatggaagtggtggcattccaggtagaggcacgtgatgtgcaaatgtcaggagggagggatggtatgagagagtcgagagagtcagaacagtgtgttgacataactgcaagcagtgtggtgtggttggagctcaggcattgggagcggggagcagcgggttgtggggagagtaaggctgcagagatgtggggaggtcctggatcatgcaggggctgtgggtttcccacagaaggcagggaggtgggccggggtgtggtggcgagctgggagagaagctcctgggggaagagtcgggatcaggctttgcttggaggagggatggctaaagctgggtggagtcacagtggggttgccatctccacaggagctctgtcccagctgggaacctcttggggacttcttctttttggggtcagctttgataagggagggtaggccaggggaggatgtggctcctctgggaaagcccagctccagcctccctgaccccctggctgggagcatatcagcaatgcagatggaagaccctacctggaggccctaagaccacttctgttacacgccaggggtccaacacagactcccacttggatgggatcaagagctttaagaagtgagagtttggcttcagctcatgtgccctgagaggcttacagaagtgttttggggatttccaggcagaagtgaaaggtgttttagacaccacttacgtgggcaccctggcattttcaccttcaagcaccatttgttccttctctgtgaggcttaggcgttcagacaggtggatgcctccatcactgtgtgaactcctctcagccctgcccaaagaacttcacacgcctagcacatgcccaggcccgtgttcaaagaaacgccttgcccagcccgatgcagccctgccctgagcatacgtgaatgctctgggcttacctgcttcctgctgcctggggccaaggtgtcctcactggctgtgctggcactgacactgttttcttctaaggtggggccccagtgggtgttcctgggtctaccagctgccctctggccacaacatgagaaacagtcctggcgtggggctagggtaacaaatcagagcctatccccagggttctcctgcagtcttggggttaatgttttctctggacagagatgaccttgatatctatgacccagtggcctgttcttaggcaccacagtcagtccataaacatgggcgcaggtctgctatgagtcaggtctgtgcccgcccctgggtgctgcctacttgatagcactctgtctctcttttttttttttgagatgaagttttgctcttgttgcccaggctggagtgcagtggtacaatctcagctcactgcaacctcagcctcctgggttcaagtgattctcctgcctcagcctcccgagtagctgggattataggtgcctggcaccactcctggctaatttttgtatttttagtagagatggggttttgccatattgcccaggctggccccgaactctcagcctcaggtgatctgcctgccttggcctcccaaagtgctgagattacaggcgtgggtcaccacacctggccttgatagcactctcatagcctctactatggggaggagagctgctttctaaaatccagaatgggctggatgatggcctccgtatgtctaaagtggctattggtgtccctggggcagacaagggctgtggtctgaggcaggagctgcgacgtggccgtggatctgtgtgggtggtatctgtgaaggcacctgtcacactacagcaggtgaagggctgagacaccccgaggcccagccagcaggactgtgtgactgagacacttgttttctatgcagaagcaagacagaagagctgagtgtgtttgctgcttgggaattgggtagaagtaggtgacatccactgtggtttaagtgtcatattaagaatagcaaataggttttaccttctgtgccaaacctgaccaattaggggccacccctaaagcttagtgaaaagagtgctgtgttcgattattgatgcctgccatgggtatggaaatggtcaatgttggcttaggtcccaggtctggaaactctgctctttctttacatctgaggtcttaggtgaacacggggaatgcacttggatcctctggtgaactgaaaacactgacctccaatgaccttcaattattttgttcctaaaataatcacccttgagttctgaagtttggatggggtgcttcctggattgtccagttgttttcctcatttatcttgtgactcatgggggtaaggacaggctgacccccctgtggtgtgtcattggtaagccagaggacaggaccagaaagcccagaatccgctgagtcatgctgaggtcattgtaccaagctgtgtccagctgagctgagccaggctgaccttcttttgtgcatcccacgtgagcccagcctcatctctgaggagcctgggctttggggatgttttagttttctgctttgctttgtttccccagtgtccagtggtctgtctttctggtaagaatggcaagattaatggcaggaaggatgctgatgagtgagtgctgtggctaacgacatgggctggctggcataatgctcacagaggtccagtggatcaaatatctggtttggcattacttggagatgctcagccagccgtggacagcattccctgccctgaggtcagccgcctcctcaccccagcccgggctgagcgcccagtcggccgcagcagtagctccagagtgtggtctaatggctgtcagcagcctggccttgaggctgctgtcgtcctcccccggagctcccataggtcccttgtgctcagggagggggagtcagtttacccatagtgacttgaggccatccctcagcttagctggggcttcatttccttagggcttgtggttgtcctatgagtgaagcacagtgaaaaggcagactggggatgaggggttggggagatgggtaggatccaggcaatattagcagagccctcatcctaagattaatgaagagggttcagtaacagaatcaaattacatttaaagaatcccttctagcttctgtgtatggagaatgaattgaaccagagcacaagaaaaaggaacaagaccagttaggaggtcactgtgaattcaggcctgagaacatgcaggcttgaactcccgtggtggcagtgaggttggagaatattgtatggatttgacatccatttggaaggtagaactgatgagactcactgagggaagggagtagtaggaaggccaaggatgactcccagtttttcagcatgaccagctggattcaggacacaccatttcctgggattccagaatctgggagaaaatcaggtttgggctggggtcagagatggagagtccacttttggatatattaaatttgaactgcctttgggttatccagatagagatatcaagaaggcaatagtatgtacagttctggagcttttggctggtggcataaatttgggaattggtataaggaaaataattaaatgcacagaaatggaacagatcacctttggagagaatttatagtgagaggacaagagggcccaggaccaggcatcaagaaattccattattaagaggtctggtagtgaggatgagctgactaaggaggctgaaaaggagaggacagagatgcaaggggtcggtctggtatcacaggacttagcatgatatagagggcatgagaaatcccatgaggtgttttgagaccttgctgggctccttctgcaaaggtgccttctgcaaaaaactgcctttccctggaatgtggggagaagtctaagctgactgttcatttctgcttcttaggatttgctctaagatctttggccttgggccccacagcttgagtccatatgttggcttagggtcagtagagcggcttccagtagagtggcttcttcttgggacttggatgccctggagtttgggtgaggtgtaactagtcaaggaagggtgtgtttggaggcttggcctttagtgtctgttcttttcattcattcccacttggaggtttgctttgggaatgctctgagggttctgagagggatcaatgggaagagtgggatttgatgggccctcagggttatcactaaaactgtgagaacctgtcgtacctgttaatttgttcattcattcatccattggttcgactttgtactaggctctggggtaggtgctgaagacttagaggcatcaaacatggcccttgtccttgaggagctcccagtctagtgaaagcgtagacacacaaacgttagagtgatcgggacggtctgcacaacaatgggatgcctgtgccaggttttgaggttgggcaagggaaagagcattcagttgtgcttggaggaacaaggttggctcccaaatggaggaggttgtgggaaatttctaggtggatgagatggtggagagaaaggagggcattccagactgaagaaacacgtgggcaaagggatgcagtgtactgtaccttggtgtgtggtgtacccgtaagtggtttgtcacggctgcagcacagaatggggcagtggcaaggcgagagttaaggcttgaaataagccttgaatctcaggccaaggtgcttgggctttatcttgagactgatgggcccataggtcatttgttaactggggaatggcctgatccaatctgcattttaaaaagatttcctggtgctgtaaggaggtggaatgcgcagcaaggctgaaagggagggataccagttccgaagtctggaggagaaatggggggtgggatccagacactggtggggctgcccggatggcccatgaggtgctggggttctgtgcacattgagggttggatgtcttaactcttgttgctaggggaggtggcctgactcagggcctggtgggcgctgtgttccaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcggtgagtgagcttctgctccagtgccgccagcagacagcagccctggctggggactcagccccctggaaagccaccatgattgtgcttgccgggaggtgctacggaagcagctttctcttctatctgactgagaggtcatgcggcctcagagaataacaggtctggggcagccatgggacagggaaagagggtgtgtggcttggggcctgacaggtctaagcactaatcccactcctgccacttaggagttttgtgcccttaggcaactcacagaagcctttatttccttgcctataaaatggtgacagccatgtgccttattaacttaaaaaaatattaaaacactaaatgatggtgtaactgctatggaaaacagtatggtagttcctaaaaaagttaagtatagaattacctatgcctcagcaattcatttctaggtatatacccaaaagaactgaaagcaggaacttgaacagatactcacataccaatgttcatagcagtattattcatagcagccaacagatagaaacagccggtgttcatcaacagatgaatgggtaaacaaaatgtggtatatccatacaacggaatatcattcagccataaaagggagtcaagtactgtacatgcaacaaccatgaatggatttttcaaaagattatactaaatcgaagccagacacaaaaggacaaatatcatatgattccactgatataaggtccctagaataggcaaattcatagaaacagaaaggagagtagaagctaccaggggctggggagaggaaggtatgggaagttagtgtttagtgggtatagagtttgtttgggatgataaaaaagttctggaaatggttagtggtgatggttgcacaacaatgtcaatgtacttaaagccactggaactgtatggttaaaaatggttgaaatggtaaacgttgtgttgtacatgctttattagaacaaaaaaaacttttgttaaacaaaacattgaatgatataatgtggagaaagtgctttacaaaatgtgagtagtgatagggaatgttctattattcagtggtgcagcctctctgctcactaagtcagccatgtcctgagccgagctgtggtaacttgcaggtggggcctctgctgttccttcacagggggccttgccaaaggatcccaagctgaccgagtgaggatccatggtcctggtgctcaggagtttctaaggtttcatgcaagaattgacatagaagatgtctttcggtgtggccatacagaaggccgcctcgtaaaggtctagagaggggaacgtgcatggtggctgcagaacgatgcgttgattggtgtggtctcccccctcagggccggcagacattccaccgctttgacaagttcaactccaaatacaaccctgtgggggccagtgagctgcgtgacctgtatttgaaaactgaaaactatctgggaggagagtactttgctcggatggtcaaggtgagtgaaccctcagtctctctgaggcctctcaggtgcctcccaacatctgccttcagagagtgggggccctgtgtgcccctggccccttcccctccctctgtgtaccatcagctcagggaagggtgaggtgcccaggtgcccagtgctgtggtctggctgcctgctccaggcagtgctgcatgtgccaactgcaggaaagaggagggaagggtatccaccttggccaagctcacagcacctggcctggctttcgtgtctctgcagcctgaacctagctgggtgcagatgagctccgtgtggagatgcttctgctgtggcctggttctgcagacccaaggccttcctcaccagagggggcctctcctaaagtggaacaagagcttacaggagcaggcagccctggggatttagatgagtgcttccagcctgggagcaaggtggctgggggagcaacaggaccctgctggtgacggagagtgagagtctcccatgtagctgggatgcactggggctgacccaagctcttcttgtgccaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttagtaagtgaggtggcccgctgtctaccctgtgccctacagaggtgacaatctgtccctcatgggctgctgagtctgcactcctgaggggtagggcctgttctggtgccagcttacgcttgtcctttccagggatttttccatagaaggagtgatgaaaaagatgtctgcatgacactagagctcttttttttttttttttttgagacagagtctcactctgtcacccaggctctgagtgcagtggcatgatcttggctcactgcaacctccacctccctgattcaagcaattctttgcctcagcctcccgagtagctgggattacaggcacccgccaccacgtctggccaatttttatatttttagtagagatggggtttcaccatcttggccaggctggtcttgaactcctgacctcgtgatccacctgcctcagcctcccaaaatgctgggattacaggtgtgagccactgcatccagctgacactagaactcttgatctttgaaaaatatagatgtgcaaaggccttgggggaactactacccccgccttcttctcattgtgggttgaggatggattgtccttttggtgagccccagggtatggggagagctgtagtggtctacattgctggcctctccctggatgtcactcagacggctgctgtcctctccaggcggctggccagggtggagcccatggctccaggatgggctggggtatgtggtttagggaaacagagctgagtaacagaatgtttgggtcactgggaatttgaggattcatatctcagtctcttggtcagccagaatgccaccatcccattcctagtggcttctggcttgagaaagtgctctgatgggcatgggtaggtgtggagcttgcaaaccaaggcagaatattgcagacattgctgggagaggaggacagaggagggatctgttttctggtcccatctgacttgattctgggtgtttgatggggacacagggtgcctgaggaagtgactggggctggtctctgacagggcagcaggctgttggatccacctgacaagcgagtctttgctgtcccccagtgacatatttaggtcaaagaagctgctgccaaactttgggaagatgctggagaacatcttcctgccccttttcaaggccactatcaacccccaagatcatcgagagcttcacctcttccttaaatatgtaagtgtgggtggtgccctaggcagggctcatagcggcagaggcaggaatggattcgctgtgagctgggtcaggcttgctcctgcccttcacgatggtatcttaggtcctgccacctgtgttccaggcgtggggtcaccagccccaagaagctagatttctaaaaagtccccttctcctcaggggcagctctgggagtcagtgggtgtggggggatgggggtggtggtcttggggtaggcctttcccccagcagggaaggcaacagtgggcaaagactgggaactcggttcctgccaggtggggctggaaaggctggatctagcccccggcagcaccaagcagcagcctcaggtttttttttcggaaatgcaaacacttcaattcacctgctttacctcgcaacagaggccctcacaccatgtgtgattaagtacaagcccctaaagtgtatttcccttccggatccagttgtaggagaaggagaggagcagtctgggagaggcttaaccagggagggaggcggagggggcgggagccggtcccaccctccggatgcctgggatcgagggggtatcagatggtgatacaggccagtgcctggtgatggatgactttctacagggagaggcacagcggggagcccgagggctggggcacggggaaagaattgagtctgtgtgcccagaaagtgactggacaagctgagggacatcatcaaatttatgttttagacaaacatattctggctgttgtgtggagttggcccagaagagaaggtagctggaggtgggggcaggggtgagagtcaggggcctgcctggagacaggaggggagcttgacccagcggaaatagctcacactcgtgcgtgcttctgcctggcctggtcagacgccacaacgtgatctcacctaagcctcacaattaccccgttactatcaccattttgttgttaacagtaagcggaattattatgtgcttggtgcgtgttggacacggtgttgagtgctctccctggattatctcatttaatcctcaccaaagccctgtgaagctgctagcttcaattgacacacaaggaaattaaaacagatcataaagctaaaagtggcagagctggaatgcgtttccaggcaggctgactccagcgatgtaccctgaacccctattctatgttgcctcccaagtgagaatagtaaggtgcacagcagctaccagcttgcgtctctgaggtgtggcagcgcagggactctgcacaaagtgtggggcttggtgagaagcggtgggcgtacacctggcaggacctggacagagactgaaggaggcactggggggagtctaggatgcctcccaggtgcctggctttgcaggagcatggatgatgtgctgtccgaaggttgctgccagcaatggaggaagagcaggtatggggaggaggaggaagagcaggaggaggagacaacgcattttgcacccgaggctgtgggagatgcagtggtgaggccctgcttcagctggatagagctctgaagaggggctgaaattatccgcatgccaggccccagaaagttcgggtgaagtatggagctagtgagcacagagcagagctcaaggtcctccctggccccccaaacccgtctagggagtgcttagggtcatagcagggaccctgtcatttcctttgacacacagggctctgtgacacggaagattctggccaagctgccttgctcctctgggcctttgctgcccccataggaacaggagaggccagcagacctggctggggtctggggcgtgggctgggagccctccagtttgggccagttgtggattaagggggacagtctctttctcccatctgctattcagaggcccctttgcaaagcactgccgtggcctggtagcaagcctcccctgtgcgctgagagcccgtaccctccatgcatgtgttcttggttggggatgacccctgggatcagccagaaggctccagtgactcaggagcagccccccaggggtcccagccaaggtagaactgcagtggaagggtgggggtttcctgaggctactcaggcccatctcagagggcagctcccagtggggattggagagcagagctgcctcccaggagccatggcttagcccagcaaggaccctcttatctgtctgtgaggcagctggcgggtttctcctggccacacctggacatgccctagagtattctctacctaccgccccaaagagtgcagacccagagcccagaacctgttttttttgtttgtttgttttttgttttttttagatggagtcttgctctgtcacccaggctggtgcgatctcggctcactgcaacctccacctccggggttcaagtgattcttctgccttagcctcctgagtagctgagattacaggtgcacgccaccatgcccagctaatttttgtatttttttttactagagacggagtttcaccatgttgggcaggctggcctcgaactcctgacctcgtgatctgcccgtctcctcctcccaaagtgctaggattacaggcatgagccatcatgtctggccaaacctggtttcttgagcaactttcttaattgctttggccctggtttgctcaattgtaaaatggggctggcagccaacccctccctcctgggttgctctgaatatgaattaactgacgtgagtaaagtgctttgagcagggcttgatgagtgatgtgtactaggacccttttccctcatcgcttgtcgctgctgctgatggcaatggccactcctccctgcaggctggcctcggcatagcagaggggcaggtggtggccatggctgctttgcccttcacctggcttggcagtttcctccactgtcaccaccaccacacaggggcttggcactctcctgtctcacctccagagtacctatggaagctccgaaggggcagaccttggtgttgtacccacttttcatccctgggaggaatatggcctcaggcaggccaaggggtccccagctgaggtgtgaacctgaggggcccagacccacaggcctctggcagctatgagctctgggaggctgaaccgaggctgagtcctggtcctgccttggcctggtgctcaggacctctcctgcccaggtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcaggtgcgtgaggcctgccctcgcacatgcttgggttcatgtgttagtacatgcacgcatgcacacacatgcacacacacatgcatgtgatccttgtgtccgtgtgcacctgaaccaacatgcatgtccatgtgcccacacacctcaaaacacacagcactttccagcctgctatatgaggcatgtctccacatgatcacacacatgcaaacatgcccaccataacacacatgccagtacagacatatgtcatgtacagtatgcaatgcagccacagtccacacgtgtccacacatttatatgtacacacaccagggcacactccacgtgtacctgtacatccctgagataatggaagcataggacatgctatcacacatgcacggtcacttactgccacaccaacaatgtccacacgtgcatattttcgttcagcaaatcactgcatctggcatgcgataggcattgccctgggcactggacaaataacggggaacaaaacagactaaatccatgcatgcccttacaggcagaggctcctaccaatacgcacacagacgaggcacacgtggccaggagttagctgcccagggcagcaggacactgagccattcccttccctacaagtcttgcatcccactttcccctgctgggccctggggtctctctagctcagcctaaactggtgctagttggtgggtgtggaggtttcgaatggggtcctgattgaaagaaatggcctggcagggtggaggcagtcctgggctgagcttttggagatgggggctctggttctggctttgctactgacctgttcagtggcatggaacatagacttcactctccgggccttggtttgcccatttccataacacagaggtcagactctgtggtttctcatggccttccctgctctggagttctacgaatgcgggacacaaggccaggagaggaattcaggagagtggctggagggcacagcagggtctctttctactgcgaggcccactctctgcccgtagaggtgatgcttcttggttctaaggggccccagggcctggacctctgcattttaggaggggtagtttccagggtgcactgggtcagcacagctgaccatgggtggtcattccccccggagctggccctgagctgtggctgcaggccccaggcagagccaactggggggggccttcctgattcggaaaccccttctcttacagggagcgcggcctgagcacgttcctgttccggccgcactgtggggaagccggctccatcacccacctggtgtctgccttcctcactgctgacaacatttcccacgggctgctcctcaagaaggtaaccaggtcactctcgggagcccgtcctgagtgactgccctgccctgggctcctgggaggctcaaccagtgaggccagaaggctgggccctcttctgggctgggatgtctgtccttatcttggttttatttttaattatgaaagtaatataatcaaactcatcacaattttgattttccaaaaactggagaaatggaaaaaagccagcccttatgctattacattaatagaaatagccattattagctttttagtatatctaatttccatcttttatccacagcatatttttaatgtgtttattatcataatgaacacagaatttggttcctgcctcgtcccttactgttgtatgacaagcattttttgatgctgcaacgtaatatctatgctcctttttccaaaggctgttgttggatgaagggtctgccactttgtctgtaattgactcaaccagtccacactagttgggcacagagtccatccaccttttcactggtgtacccttgagctctgtgcatacagtcttctccgtattttggatcactttccattggcacgatgtttgatcaaaatgctccctttccctgatcccggtgaggtgtaaccatgggtcacatttttgggtggggtgggtgctacagtagaaaaccactctatcctgggcaggtccacccctcccatcccttcagggatcatctcccaggagctggagtgtttatagtctcaacctggctgtttgcagtcaaagcaataaaacagctagaggggggcatcttctagactgggtccgtgcctaggagaaaggagctgaaggtgtaggctggagtgggctgcccttcctgccctgagccttgcctccagtttggagcaagaatgagcacttccaacagtgggtagaggcaccagggagggctggcatgcaatgtaggaatgagatgaacagtggggaaggggagagtgggtctgagtgtcctggcttcgaggaactcgggttgaggacttgggcagacatggttcagacccctggtttccactggtgaatgcttcttcccttcctttctcccttcccttttcccttctcccctctctggcacttgtcacatgagttcggtggttcttttgcagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggtaaggactttggggtgaggacagtagtgcttcagtaggcaccagtcctagcctgtcctcccatttcaggaacctgagcccatggcttagttctgcttttggggtggggttggtggcccagtgaaggcaggaaggaagccactgttgggggaaaattgtgccatccaggagccctttctttggggttcttgaaccctcaaaggcacaatttagtatctttgccttcctctattttctctttctttgacatttatgagctctgtgaccttggtaaagttattagatttctggatcaagttcttcttcatctgtaaaatggagataaaattttctctgtccctaccctgtaaggattcatgaagataatgaatcaaaggttctaacatagtgtctgcatatattcaaaatggttgctactttttaaatcaatgctattataatttctacactttgggtctctgggaaaataaaagaggaagctaacagtggtgtcatgcatggggactagccgcaagtatacccagcatgttttgatggtgtcgacaagaccagccattgcttaacaaaaacagaagcaccagagtcttttaggacagaggttctccaacctcttggtctctggacccctttatactcttaagaattgaagctttcaaagacctgttgtttatgtgggttatatctactgatatttaccatgttagaaatgaataagaaattttaaaatatttattatctcatttaaaaaccacatcaataaaccaatgaaatgttacataataatgattttttttctgaaaagtaacagtttcccctgcctttgttttgcatttttaagcctctttaatgtcttaatggaagtcagcaggactcttctagccacttctgcattcaatttgtttttaatcaaaatatgtaaaaatagaaatcttgcctcatgaaaatacataattggaaaagacaagacctttcaaaaggtcttaggaccctcaggggtccttgacctgtacttcgagaactattgctctaggctacagcggcagtggggtggggaagaggtcacagacggcttgtgatgaatagacacttcacatcccagaagggaagcaaaaccacagctcaaacccagatcattctgggattacaccattttaccacttatcctatgatcacttctcattttttttttgatgttccatctctgcttttagtactttactcatctatctatctatctatctatctatctatctatttatctatctatcatctatctatctattgcaaacttaagaaaatagtgtgttaaaaagaaaagctagagggcaagtgctaaatgtggcatgactagagggcttgtcacaggagagcagagactgccatccctgatgactggcacagggtttcaacatgaggtctcagtgctggtcaatgaataaatgtagaggcgtgattttagatctctctttgataacccatgattttacagaagaaaagatcttaggctttgaaggtgtgatgtttgatgatccaggtgccatttagtgaggaaaagttaaacccgcagtgtctgatgttgttagctttggacatgtgtgaacgattgacatggatatccccccttctaatccacatgctttgggggaggatctaggaagcacttatggaagaatatgccattgcagctcaagtgtggaagctgagcacctgcgacctgtgtgagatcgccaggaacagcgtgctgcagagcggcctctcgcatcaggtatggagtgtgacggtgctgcctgtgtccctcctgggaaggctgcctgctgtgtgccaggagccttccaggcactggggatctgtgatgaacatagcaggcagggcctctgagacactcaggcacagggagagaagacgcggcagcctcctgtgttttcatggctgcttcctcacccttctcagacctctacgcctccttggagaggccttccctgatcgcccattctaaaatagccacacacttgctattattctctatccccttaatcagtttttctccataccatttattcctgctgatgtttagttatgtgtttttctgtctttccctctagcatgtaagctctgtgagggcagaggtttgttcagaattatatccccgggccctagatagtccctggcacatagcaggcgctcaatatttcttgaatagatgaacagtatctagactgaataaaaatctagactatgggactcagacatctgtcattttttaaaaagcctgatgaggagctggcactgagacccatgttctgatgtacgttaggtcccccgacacctccctgggtgatgtcactggttgggaagaggttgcattaggggctgtgctcgtcggatgatgatgcagcagagttaaaggcttaagattcttttcatgcgcagtgtggtgccttggattggccctccccaggaacattgtccttgtcagctctcaggggcttcttaattagagtcttacctccttcccctttgcctttcccatccccagcagctgctgcagaccttatctttcctctctgatcaaggaaagcacagccaggaatgaagggctgtctgaggatgactgaggttgtcagggtgacatccttgaggacacagaggccagcaggaattttaagagttctgtggggataagatgtcctgaccaaagatctgcttcagggggactagtctgacttgctgtgactgatgtcaaagctgcccacatggctatagaaagtgaatcaaaagtatatagtttcatttgtatttctcttggtccacaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccgtttatatacatttgccctaacataggaagtattgtgtagtttctcattgtcattttatctgtatcaagtatctttttttaaattgttaaataaagtcagctaggactgtg
